United States Patent 7,365,185 (GENOMIC PLANT SEQUENCES AND USES THEREOF) - sequence listing, part 96

SEQ ID NO: 82917 - DNA, 13758 bp, Oryza sativa
ttaaaaaacggaggtagtatttgagaaaatttcatctcatgccactaaattttgtcctaatctcttagttacctttcaagaaacttagtgcattgtgacacttggtcgaaaagttggatatcaccattccatgccacttctatatgagagagttattatgttggctgtgaaaatatgtttttacactctttgactcttttcttcaaaattcatttttcctctcttttctcgaccaggccgtggaccagtgtaattcttttgtttccctattcaccttgtttgcgcttcttgcttgcatttctcttttagtgtagctaccaatatggacctatggtttgccagtctattctagatcgatttcagatagttgcctccatcaacaatcatggaaagagagaaagaaggatcccaatgtataactaattaacccgattatccaccaacaaatcaaatgattttgactaaaccaatcaaatctgaacgaattaatttggaccgtcatgaatatcagaacaaaattagtagtccacttgtgcagagaccttggaaaattgatgcgtctttgaacccttgattaactgctccaggcggtccatgagaaacacttcaatttgttgctcgagcgcgtttgttgagtccagccgtaggggagtggagagctactatcattggtgtaagggctgtgcaaaggaagacatgaaaacgaagatggcaagtggatcgaccatcgtgagagctacgctcggttttgacaaaacttaaggtgtttcgaaggcttaaagactaaattgtcgaaaacggtcagacatcaggcttaattatttccgtaatcatattttttaattcaaaaacagaataaaaaccagtaaaactagaaatgaaaacggcataaaaatatcaaaagtagaaacagaactgtaaaaacaaaaacatatcggaaacataattgtacgaacagaaacatgtcggtaccgattagaaatcgataataaaggtcagaaataatcattggtggactagctttctccttatatatgcctttgtttggaacacatgagtttcacagaatcttagccagaaattacgtacgaagcaattgaagcattaattattttgttctaaatgggacctcaaatatttaggtgcttttctttgttgatgtttatctcttaacattggacactttcagactcaaaagattcgcgcttgagagaaatctaaacaaagaaatcaaatgaagaatcttcagcaatagaaccagcaacaactcttattacgtggagattgagtagatgatctgtgtagaagaaaactatagttttttaggaagcttaagaaaactgtgttttttttttaaaaaaaagtcatgcatacttgactagaagttttaaccgatgcacgattaaactatgcgactgaaatatttggccacccatacacacgctcacattcttttgtttatctctaattaattaacatgcgattctctattcttgctctagctctctgcatcgagtcagaagacaatgcctttttaattagcatgggcagttgagataagtacatggtgttaacaatatgggcttttcaggatttgtccaaataaaaaaagggcttccggtgacgtcatgctgatgtagtaatcgagctaccaattgttcacgtggagtttgtcgtcatatctttgatctagctagcacaactaccagcttctgacgagcaaactgagcatctctatcgattgatcgtgtacgtccttctctggatcgatcggctagctggtcccgattgaatcccgatcaatcatcaatcccaaatactaaatacatatatatgaacattgttttcactaaactaaatattgatagacaaaacattggcaccataattgctttgaacccgacctgtcacttgtccatcgtcgtcgaaaactatttaattaccttacttaattttacctctattttgatcttccaaggaataatctctaattgactttaattccactaattagtattctccggccttagctagctagctgaccggcaggtttagcattttagctatcttaagctgcagcaggtagtagcatatatatgccatccgtcacacgtaaatgggtgcgtaggctaacggctcagctcagccgtgatcccgcggacgtttccggcgtttcggcgcggcgcgtgagggcgagcccgagacgtacgacgttgagacggcccggcgtgtcgcgagcgtttacaagtaaaacccgtagtaaatactccatccgtttttttagtggataacattattaacgttttaatactattttcatctaaaataagtgctgtcatgagaatccgtgttcaatgtttaaccgtccatcttattttaaaaaaattactctctccatctatttttgatagtcatatttttaaatctgaaaattttatttttgataggcatatttcaatccaacaacctatcatcttaatgattttctcgaatttaatgcatgactcttcattcttccacacatgattggctacatgggctttgagaaatgtaaatattaatgaatcgcttgtttacgaggaatgactagtagcatgcttaaatgaatgataagtagaactacttatccttggtctgtgtatcaagatgaaatataactatcaaaagtagatggagggagtataaaaaaataaaaaaaagtcacacataaagaactattcatattttatcatctgctaacaataaaaatacaaatcataaaaaaaattaataagacgaacggtcaaacgttggatataaatagtgtaaaactgcacttattttgggaaggagggagtacatgtttaactattcgtcttatttaaaatatttatataaatttataaaatatacatcatggttaaaatattttgtatgataaaacaactcacaataaaataaattataattacgtaaattttttaaataaaaaagtaattagatgtgtgaaaaaaaacggaggtagtaataggcgttcgatcgagtcgtcgttacggcgtgcgtgacggcgcgcgcctcagctcacctaaccccgggtcgccgtcgcgggccacccggccacacgcggtgcgcgcgtccgatccatctcctctccgtttctctcagctactctcgcctgtacacacactcgcgggtagggagccggagcgagttggctttgttgtgttgagccctttcctgggcctataaattcggcatcacgcccaacgcatcccctccccagaagaatcccagctaccaaatcgaacctaccaactcattcccgatcgatcgatcttaaaaaaaaactaatcgtaacttttctctctctctcctatctttagaactagcaggtagcaactgcttcgagtgtagtctggtgaacgtacgatctttcgttcgttcatcaagatgaccgtgatcgacggcgccgtcgctgccgacgccggcggcgcagccgcggcggtggtgcagccggggaacgggcagaccgtgtgcgtgaccggcgcggccgggtacatcgcgtcgtggctcgtgaagctgctgcttgagaagggctacactgtcaagggcaccgtcaggaacccaggcatgcacacacacggacgccataagctactacagctcgttcgttttagctagaggcttatagttatatggtgtgtgttgcgttgcgtgtgcagatgacccgaagaacgcgcacctgaaggcgctcgacggcgccggcgagcggctggtgctctgcaaggccgacctcctcgactacgacgccatctgccgcgccgtcgccggctgccacggcgtcttccacaccgcctcccccgtcaccgacgaccccgtacgtccaaccacacaacctcacctcacctcgcctcgccgccggccgacacggcggcgacaccaccattattttctcggtttctcacgctgttcatcatgggcgcccatggcgtacgttaattagttgcgactgacacgagtagcgcattgcatgtgtctttttgcaggagcagatggtggagccggcggtgagggggacggagtacgtgataaacgcggcggcggaggccggcacggtgcggcgggtggtgttcacgtcgtcgatcggggcggtgaccatggaccccaaccgcgggcccgacgtcgtcgtcgacgagtcctgctggagcgaccttgactactgcaaggaaaccagggtaggtgcatctgcaaaatctaatctaatttcttgatgatctctctctgcccttaattgcacgtactaattaaccttggataccttttgcttcatcatgttattgttaccttttttgctttggttcttttcactgagaaaatggaaaaagaaaaaaaaaactttgtatggatatgaattattacatgccactacctagctagctagtactaccaaccatgactcaaaagaattattatgtctggcttttgagccaaccaagacaggtgctcatcgatcgattgcctgtgtcgacgtgagcactaaggttaaaagctgcttcttttttttctttttaactagcgacgttcaccggcaaaaggacatggtgagattaagtttgggtgttactcacgtaaagcatgtgaccaatccggatcgatatgataggaacacacgtaataacacgccatgtagcttagcgtgacacctcggagttttctctgccttacagtgaaggactaggaagtagtaacatgattagcttggacgtacgacttattttatccattacaatatatccacactatttttttatggaaacggcaattttaatatatttaattatattttatttagtttatatatattagtataacataagaatctattttggaaattttgggaatttaagatagtttgtagctcacgattgttgtggttaattagtaggtaaattactattaattagtggttaattatatggaattttcgaacatgcattcagcatcgaagcgtacagttgatccaacagacacacatgtgcgccgtagaggttacaataactagaagtccaacgcacccagccactggaattgaacgccggcacgtcatttattaccgatgagtcaacggtcaaccgttaattaatcagttgtagtagtagctgaacgcatgcatgcatggtcacgattttcaagaacccagtaattggcctctaatttgttagtttctggaaggaaaaaaggtttaccttgtggacagtttttggctttttgcatcgcaatccgtcgggaaaaattcaagtagtatttttttttatctataagaaaaactatttttaagagctactgtacttttttcttagaaagcagatcacagctgagtgatccggcaatatatactccctccattccaaaatgtttgacgctgttgacttttttaaacatgtttgaccgttcgtcttattcaaaaaatttaagtaattattaattctttttctatcatttaatttattgttaaatatatttttatgtatacatatagttttacacatttcataaaagtttttgaataagacgatcaaacatgtttaaaaaaatcaacggcgtcaaacacctttgagaaggagggagtatctttcaaagcaatatatgttaggcgtgaagaaattaatattgtacgacgccgaaggtaacacatctttcatgttttaatttagcatacaaatattaaaaacattggcatgtttcggcaggcaaaagaataacatatgtatatactggcctcgatcttcgcaattatggaaataaatcaaacacacgtgcatacgaaagcgaaacccaatttaatttcttgtgattttgtaatatgaaaccgaaacttgactcccaaacctaaaactgtaccgcgtcccgcataattttctcgtggatccccacagagtaattaattcttctctgaaagaaaaaaaacctagtaccgatttttcacgtcgtattccatcagcatgtcctaattaattcacctaatatttgtaatagctttgcaataaccttcgtcaaagtcaagatacaacaaccagaatctttcggaaatgttcctaaggatagagcgaccgtacatttgtaggggtaggtgtgcttccattgtggatatactgatccaatttttttagagacactcagaggtagagtttacgtgtattcatttgtagggatgagtacggactcgttgtgaacgcgtttgtattatgtttctttcttcttaagggtagcttaggtttcaggactttgcgcttcaacataagctacgaacaattatttgcaatacttaatcctgtaaagtaaaagaaaatgaaaaaaatatatgaaatgatggtgcagaactggtactgctacgggaaggcggtggcggagcaggcggcgtgggaggcggcgcggcggcgaggggtggagctggtggtggtgaacccggtgctggtgatcgggccgctgctgcagccgacggtgaacgccagcgtcgcccacatcctcaagtacctggacggctcggccagcaagttcgccaacgccgtccaggcctacgtcgacgtccgcgacgtcgccgccgcccacctcctcgtcttcgagtccccttccgccgccggccgcttcctctgcgccgagtctgtcctccaccgcgagggtgtcgtccgcatcctcgccaagctcttccccgagtaccctgtccccaccaggtaaaattaatttcatctttattactacattcgtttcaggttataatattttctaacattgcccacattcatatagatgctaatgaatctagtcacacatatatatctagattcattaacatatactccctccgtacttataaaggaactcgtttaggacaatgtttaagtcaaactttcggaatataaatcataaataactcttaagttgttgggtttaaaaatataaaaattatataaatagatttttcttgaaaaatactttcataaaagtatacatatatcaccttttaataaatatttttatagaaacaagaagtcaaagttgtgttttggagaccgtgtcgctgttctaaacgacttcctttacaagtatggagggagtatatgaatgtaggcaatactagaaaatcttataatataaaacagaggaagtacttcttaattaattacttctcctaatcacgtcatcactacattaccaccatcatgctaactactctcttcagtatcagcatttactatgtgctgttaactatagttgatcactcgttaatttaaccccgtattagggtatgtttgagggagcttctagctgctgctgtttctcttagaattagaaacttcttcaaacagtctagttttttgtctagattttgagaagctatagtttaagaatccagaaaatgaactagaagttagaagctagctactaaccagctgtttctcagaatcttaagctttccgaacatgcccttactcccttagtagagttgcgacttctcctaattaaacacgtcattagtactacacccccaccacatcatgcaaactacgtactggtattgtcttaattgtcggcattaacgtacgctgtgttgttaactatagttatagaagtagttggtgcgtctgtggtcacgagaaacagagtctaaattgattatgagtttcatgtttgcttaattagttcattatttgttctctaatctccagtgaaaggggtgtttagccattaactaatgactaattagatagcagctgctagtaattaatttggtgggattggtaggtaaggatggataagacttgcctaccaattgcagcatcagctcaggttcaggtgaaccaactccgtttcagtccggtctgacgctagctagcttgagtttttactcaaagtaaaacaccacactcaaattaaggcctcaaagtaattctaagcaagttcatcgcactaggttacatacacatatgaacaaacaacatcgtgatcatctacatgagatccagagatcgagagatttgtgttggtggcaaaagttgatcgattttccatgcaacttgtgccacacaaatacaaccaaaatctgcacacgtccatgtcgaccaaagttggtgtgagactgagagggttgagatatattcccctgtaagccacaaccaaaccctctgctaatcttctactctgtctctgtctccttcctctcgatcgcatcagcgatgatcgatggagatcagcatcatcgagatcaccatcacgatcgatcgggtagaaatgcgtagcatcaagagagcgtttgttttctgaaaattgagtgtggcggtgtcgcgttgcgatccaagttggtccgcatcgtacgtgtcagattgttcgtttgtttctgtggctctgcattttgtcgtcgctggcaaatcacacgtacggctgggtactactaataaccttttgagagtgtcatgtcatcgcctatgcacgcatgacttcagagtcctgaagtgttagtttttagtttgcatgttgcgatcgtacatcattttggaaatggttttagtgtccgccaactgctacaaggattagttgtctaatgaacgtcataagatggaaatgctgataattgttagtatttaaggcgttataactaaagagtacgtagatgatgcaaatgctaagtcctcatacaaaaatgcaaacctttcttgactttgggaattagctgcttgtgggaagaagtcctaccaatcctggacatttaggaaggggtaggtcggaatagtggaattttctaggaatttttcttggttcttttctcagagaattttttttccttaaaatgtttgtttatgaacagaaaaaaaattattgctttagttaagccctgccttagacgtctggtgagcagtgtctatgcagctcttgagtcctaatgggtctcacctaatcatatattgtttgttagccacacacaaagggttacttgggagaaagcatgacaatccctcttgcaatcatttgctctgacttctttctagtatctcgactcagctagtgatataatagtattaatcaaggagaaattacgtcatgcttgagtatgttaactccttttttctaaaacaagaggaagcttcactcagaaatacgcaaacaagaaataaatattgacatctaggagtacaaaatcaatcggaatagcctgatttcaatgcacaacctgacaagcaaccaaaacgcaggaatattcagctttgcttttgtcaaaacgtcgttacagcggggttggactaagagcacccaccccacttgctaatattacttttcaaccggtatatcccgtaaaaaccttgctgaatttggctcatatttattcaagatcctgaattgtccacatgattgtttcaaagataccatgcctgactacatgtacgtgaataaacagtctaactcgatgtcgtaatcttaccaaacctcttgtactaccttcaagggtcaccaatacgtagcatgatgtcaggtcaggaactcgggatgctttaattgggtccaaggagaccaaggaatctcaagctcttcacaagtcaagccaatcgtgtttacacctgaattaaatcccatatactcccttcattttttaataaatgacgccgttgactttttctcacatgtttgaccattgtcttattcaaaaaatttatgtaattataatttattttgttatgggttgttttatcactcatagtactttaagtgtgatttatatcttatacatttgcataaaatttttgaataagacgaatgatcaaacatgtgagaaaaagtcaacggcgtcatctattaaaaaacggaggtagtataatttttctagttaatcgaattcccccaatttgcgacctgccataggatttgttatgtaaataggtatacgttaatgttccttttcattatgaatcgtaattgtatggccaaccattacggatcacaagataatgtgagaaaaaagaaacaaaattttcgtgcattacctctgaactgttactgatcctgtgttgccatcaggtgctccgacgagaagaaccccaggaagcagccgtacaagatgtcgaaccagaagctccgggacctggggctggagttccggccggcgagccagtcgctgtacgagacggtgaagtgcctccaggagaagggccacctgccggtgctcgccgccgagaagacggaggaggaggccggcgaggtccagggcgggattgccatccgagcatgaggaaaacagcagagcaaaagagcaggaaaaatgtccatatcgtgttagtgtttaccgtgctgtaaaaccaaagtagtagtgttcgctggtttgtctggtctgaagccctgtaatacacccctgttgttgttacatgtgcaccagagtgaccgaataagtatttctatgaagttctctatgttcacaactgatttgtgcagaatttgctaccaagacagcaggttgtgaaaacccacacaccgatataatcgtgcagcaccgtttgcttaacaatagtagggtgcaaagcaaaactggaaatgaacgtacgaatctacgaacaaaatttggcgagagaaagctctagattacacagaatatacagcatatcgaataaacttaagaaattaaaccgtgtttgttagcactgacgtgcagaatattgagcaatattatttgccggtgcaagagcaacttcataaaaatctagactacagaatatacagcatatcgaataaacttacaaattaaacagtgtttgttagcactgacgtgcagaatattgagcaatattatttgccggtgcgacagcaacttcataaaaagacagtctgatgtccttatttgcccgtaccattaaaatcacaatacttacatgatcaccacaacttatataaaacactaaagcagtcattgactgtcacaaggtttcataactttcaaaatagttgtagaaaagaacaaagaatgcaacaaagagaatttaacaaagaggctggaactgttaaactaatgagttggtgggggcaaaagttagaagtagaaagcaaggaacacgtagtacaaaaatgcccctactaactccatggaattagaatctgcatcttgaatggatagaagcaattcaactctgattctaaatggagtggtgttccatcattatcaatagagatagcaacaaaccttaccaaccaaaaccaacacaaaacatgaaaacaacatagagtcctatccagataagacatcccagaattcactcacaatatatcagtataggggatataataaaatactcttgggggcgggtggggatggaagataagatttctcatccttttaatcatatacagttattctggccttatattaatcatgtacaattaattctggccttatatttggtgtagaagggcataaggaatgcaagacccaaagacattgtagtcccaaaaactaggcaaagaatcttattgctacaagcttggaatttgaaaaccagtgggtagtggcgattaccacatcaaacacagattctcaaatcaaattgttccccaaaactaggcaaataatattattgctacaagcttggaatttgaaaacctgtgggtagtggcgattaccacatcaaacacagattctcaaatcaaattgttccccaaaactaggcaaataatattattgctacaagcttggaatctgaaaacctgtgggtagtggcgattcccacatcaaacacagtttctcaaatcaaattgttcctatgtgtgtgaatttcacataaatacaaatacatgattacaactatcaagtgatatactttcaagaacccaatttacagaactataaacactattattatattcttatatacacataaacaaactaccagcccagtcataaccaacatctccatttccattgattatgaaagcatttcgagtctttgacaagcttctccctgaaaaggacatataaaccaaaagcatagcaataggtaggaagtccagcaagttggaacaaaaaaaaagttttgcaccaaaactggaactaatatccaattccaaacatgcaagtaatgacaaaacttgtgtgataaacaatctaaaatagccttcaacatgataaaagataaatctgaaatagtcttcatcatgacaccagaaataaaataggcttcccaataattaagaaccgagattcctactgtactaattagtaaagatatttgaccactcagcttaaatcagtagcttagcgatacaaaaatgtcttaaatatgtagttctatgaaataggttcgtaaatctgtagttcattggaagctatacgctttatgtgcagcttaacgcaatttacaattcatataccatatatacgttcatgtaaaacttgtccttcatatgagtaaaaacaagttcatcatttgaatgtaacattaaattttctgtttcactgaaccctcctttttggttattgcgtctccatattattacctttcacatctatcaagtatcaatacccttgacactacccttggcactaaatatcctagatgtgtaaggtgaatttggcatggtaaatgacatatcatttacatatcatttaccagaaagtacaaaggcactatgaatcaatgtataaacaaacacgtcattaccaaaataaggcatagcactcaggatcataaacgcattaccagaataaagcctagcaatgcagatccaagaattattagagaaacccaagcacataacataattattttcttttcagaacaccctaaagcaaaaggttaaatttgtgcccagtattgccataaatttatagtttagtatcaagcattaactgtgtagggagtaagcctgatatcacgaaacagtgtaaatgcttcatcctgtcatacaactcaacatgggatcttgctttcacttttctaatatctaaaagtggttctctatggatatgtcaaactgaaatacgatattcaatcatctgaaataacgattccctgcacacaaaaaaaactgaaataacaatattcaatcatatgttttttgtcaacccaatgaactacccccccccccccaaggtgcaagattcacagataacccaaaaaaaaaagcaagcagaattcatatgtttaggaccgaatgggatgttggacatggactaccagataggacacaagaatttacaggataagctataagaggttgcacagtcaaagcatgcaaaatcaaagtggtccatccctacttaaaaaaatctgcccataggacccaacaaaaatcacaggagccacctgatgttttgatgcattgaacagtttactaggtatagataaaatcacattgcatactttagcatttttcatttgttacaaaagcaattttgattctttaacaagcctctgccacaacaggacaatgaaacaaaagcctataaatacataggaaggaatttctaaaaactggatgtcataaccaattccaaacatgcaagcatgacaagtcgtgtgaacaaatatctaaaatagccttctggcaagacaaaagataaatctaaaacagcctttaccatgacagaaatagatttcccaataattaaaacccagaaattcctactatagtaattagtagaggtagtatttgactactcagtttaaatgagtagcttagtgacacaataatgtcttaaatatgtagttctatgaaataggttcacagatttgtagtccaatg

SEQ ID NO: 82918 - DNA, 629 bp, Oryza sativa
ctgaagggtcgatcgacctcatgcctcttccccttccaatcgatctcatctcgacgcctcccgctcccggtaacggcgccggcgagccaacgacagggatcccagcctacggcgtgacgcggagcgcgcactggaggacgacgtggagcgcgaccgcgccgaggccgcagacgaggagggcgagcaggacgatggcattggtgttgaacgacacggtgactggaccgccgccgccatggccgttctcggcggccagcagagcgcgcttatcggtcgtcgccatggccggcagtggtgagcaagctacagtgtaatgtttgttcaatttattttcctgaacgtgtggttgctgatttgtagtgcgaactgtgcattcatggtgttcgatgaaatgaccaagaaagaatatatcttgttctttcttagagttgcatttgatagcacagttaggactattttgttggatagtgtattaattgctctattgctactatactacttctgcagaaatccaggagaaacacacaactagaaaatgccgaatttgatgctaagttatgaaactcttatatggattactaatgagttaagttatgtattactgattccatcgtagcagcaatcgaatt

SEQ ID NO: 82919 - DNA, 6852 bp, Oryza sativa
atggccatgggcaaggaattgcctgtgaatgtgatcatctaatgcaagggaaaccagtgtgccggagtctcttgcatataaatcaagattgttgagtaaaaagagccagtaattaccgtgaaaacttcaggtggctcccgtttgctttacgtgtttgcttgaactacagcttaggaaagggaccaaactgcaaatctgggccttattaatttgtcccctggagcacggcgaatgctggcaccacaaagcaatcgggccctgtttagttctagcggtgaaaagatttagcgtgttagatcgtatatacggacacatatttaaagtattaaacgtaggctaataacaaaacaaattacaaattccacctataaattgccagaaaatttattaagcgtaattaatccttcattagcaaatgtttactgtagggccacattgtcaaatcatgaagtaattatgcttaaaagattcaactcacaatttacacgcaatctgtataattagttttttttctatatttaatattccatgcatgtgtccaaatattcaatgtgatagggtgaaaagtttttgcgtgggaatgctggcactacaaaacaatcagaccctgtttagggtgtgtttagttcacgacaaaattgaaagtttggttgaaattggaacgatgtgacggaaaagttggaagtttatgtgtgtaggagagttttgatgtgatggaaaagttggaagtttgaagaaaaagtttggaactaaacaagggcttaggccccgtttagttcgcgaaataaaaatttttgggtgtcacatcggacgtttgaccggatgtcggaagggtttttcggacacgaatgaaaaaactaatttcataactcgtctgtaaaccgcgagacgtatctttttagcctaattaatccgtcattagcatatgtggtttactgtagcacttatggctaatcatggactaattagactcaaaagattcgtctcgcaaattccccctgactgtgcaattagtttttgtttttatctatatttaatgcttcattcatgtgtccaaagattcgatgtgatgtttttaggaaaaactttttggaaactaaacagggccttagttctaggggtgaaaagttttagcgtgtcacatcggatatacggacacacatttgaagtattaaacgtagactaataataaaacagattacagattcctcctgtaaagtgtgagacgaatttattaagcctaattaatccgttattagcaaatgtttactgtagcacaacattatcaaatcatgtagcaattagacttaaaagattcgtctcgcaaattagttgtaatctgtgcagttagttatttttttagcctatatttaatattttatgcaggtgttcgaacgttcgatgtgatagggtgaaaaattttgaggtgtgatctaaacacggacttagtcgtcagtcgtgttctgaagggaaccgtatcctctgacgttacacagtaatgtcacgatgcgacattccttcgatccacaccatccattctaaatcaatggtcgtagattatttgacatgcaattaatcaaactaattagtagattgtgtggctataattttccctagatcagatattgcattttcaagaggcaaacatcgttgaccggtggaagaatcggcatatgatgataattatgtttcacttacttgttagatgcagcgatttgcacattatcctggaggaagtgaatcctgtgcatcaattttgtgctgccatcctccgtcaaaacggggcaattctgaatctacaagcggatgggttaatgtttaatgaagatgaagagactgctttagtgctaacaaaacaaaatccttcccacctattaagtacatatacctacataatctgctagttagtttgattagttagatgccaattagtatgtggccgttgatttagaatgaatggtgtggatcgaaggaatgtcacgcggtgaacttactgtataatgtcagaggatatggttccgttctgaagaacagtgggctcgctttccctgaccacatcgttgacgattaggaagtcaacaaggaaagaccaccttgttcagcacggtgatactacgttttggtgttaacctgaacatagctaggcaatactaacacgtccttactatgttgctaatggtcatgggttagtggctaggacttgaagatgctgaaccaataatacatcaaagtgatatcaagacctggatcaaccggtcaaggacggcactactgaaagcaagccgctaccgtgcaaagatgatcctggtggagctcctcctgtcgtcctgtgatcctgtccatgcagctcactcaggcttgttcttgtttactgctagattttggccctccaattctttggcacttttcaccgacgttttctagatatttgaatttgtgccaaattttaccaacaccatgtattaggtaatagcaactttaccatataaaatttggtaatgcctaaagatgccgaaacttttgaattaccaaaattatggtagagaatcaaaccaaaatagccatcaggccgagccaaatcttctcatttcgcagcaaatggtccgggagacccggacagtgtcgagaaagcaacacagtattaatcgcaggaaaaagtacgccgaaggtccctcaacttgtcatcgaatcacaaaatcgtcccccaaccacaaaatcggatacaacgcatccctcaacttacaaaaccgtgcaaactaggtccctcagtggttttgaccccggttttgtcccacgtggcggctgagtcagcgtgggacccacgtgggccccgcatgtcaggtggtgcggccgcgacggtggctcccgggtggcggcgcgagctcgccggcctcctcgtccccctcgtgcggtcggcgatggaggcgcgcggctgcggccatcatcaccgagatcgactcgacgcctctgccatcaagtcgctgccgtcggtgatgacggtgcgcagctgtggccaacgggggaggcagaggaggtacgcacggatgccctcgcccccgtcgtcgccgccgccaacactaaccaactgcttgagacgtcgcacacgtcatggagaagaacaccgccgccagcgggcaattgatgacctcctccgcggaggcgacgccgtcgtcgccgaagcggccggcggggcgaaccaagttccaggagacgaggcacctagtgttccgtggggtgcgatggcgtgggtgcgcggggcggtgggtgtgcaaggtgcgtgtcccgggcagccgcggtgaccgtttctggataggcacgtctgacaccgccgaggagaccgcgcgcacgcacgacgccgccatgctcgccttgtgcggggcctccgccagcctcaacttcgccgactctgcctggctgctccacgtcccgcgcgcccccgtcgtctccggactccggccaccagctgcccgatgtgcaacgcgctgcctgcaaggccatcgccgagttccagcgccgggccgggggagcaccgccactgccactgccacctccggcgatgctgcatcgaccgctcctccgtcggcacccgttctgtcagccaaacaatgcgaattcatctttctttcttcactagattgttggatgttaatgtcaaagcttatcagcagtagcagagcaaaaggatcgttgtgcctgcgaaaaaatcccatttcattttgcatggttacaaattcttacactgctcttttgctcgaatacattatattgcagatgaattcaatgatcgttttaatccacgaattatcaaaatatcaagtctttctgctactaaccatgataacacaccacctttttcaatggaggaggtaggcgcggacgccctcgccatcatcgtcgatgtcgccactgatgacgaggtccgcgccgctcaccagctcgcacgcctcgtcgtcgtccatgctcgccacctcggtccagcagctgaaccgcctggcgacgtcctctcacctcagtcctccctcccagtgagcgaacaatgaggccgagcggcgcagagtcgttggcgccgctgctccccatccgcagccgcgctcgcctgctgctgtcgccgcctctccgccaccgcgctcgcccgccgacgccgcctcgccccgccgccgtcctccctttctcccatgtctccgccgccgcgtcgctgctgccacatcgccggcaggctgtcaaacctccctgctcccacgtcgccgctgcgatgcaagtggagactggagaggccccggggcatggtggaggggcacagcgttctccccctatcggctggctgtcgcactccctcctgccggccgcggcggccctcctaccccggcagccgtcggtgcggcactcctcccctgccggttgtgctcctcgagaggagaaaagtgagagaggaaaggaaaggagggagaggggctgctgggagagagggagtgctgatgtggcatcctgacatgtgggacccacggtgactcagcagccacgtcggacaaaacctgggtcaaaaccgccaagggaactagtttaccctggttttgtaggttgcgggatgcgttgtgtccggttttgtggttggagaacgattttgtaactcgatgacaagttgagggaccgtcggtgtactttttccttaatcgcaggctcgcagcagctaacacttgatccactgggccgtcatgcctgaatcggcccaaaggagggagccagcagatgatcaggtacagcgcgggacacgacagcgttggtgtcgtgtggtcatggtcgcctccaaactccaaagtctccaagactccaactgtccaacacctcatgcctgccggtacagttttactcgtcagcatccccctttttttttttttgaaactgtcagcatcctctctccggatactccgccacctgtgtgtatcttttttcccttggagaaaccgttttgctgataccagcaactgcccggccatacaataataatatcatgtccagatactcctatacaattacaaaatagcttgagaatgaatagttctgctatcaattattcaaaaatagagggtgtaataaacatagagttgtatttatcttggactctcaggctctcagcttaccattttatatattagtttaatttgaaatactctgaaatattaaaatacgcaatgtaccgggcggacgactggtattattactgatcttgctcaaaatggtcatcgtaatttcagaacgaactgatcgttcaaacgttcctcatgttgcgcgtgtgctgcaactactgcacggtaaaagtgataggaatcggtcggaaacagtattaatgtttttattatttttacaaaaacgaattgaaataattggaaattttcatatttatatattaaactattcagtatcaacttcaattcgacgtcaatagaaattagaaaagcataattatacacagtaataggcgttcaagatattattgttattatttagttttgtggaaatggtatcaacgtgatcggaaaattttgtacatgttttcaccctgcgggatatctcaattccttctcctccctctaccgccatatcagcacacgttttagagcaccaatcataacccataaatccgtgggctactcacttatttaatttatatgtgaattcgtgacctgactcactcacatactatcaaaaatttgtctcagtcacccatctccttctttcctggtccgataagggtttatcctacggttcgacggttatcacgatagtcgtgcggttactgaggtataccgtgatttaaaaatatgataaagttaccgcaggttttaactgcgcggtttggtaaacctgttcctcctcaccaaccttctcctccggtctccttatgtgtctcaccgaggcgagccgccgcgagaccgcatggacgcggtccacgcacctggcggtgcacctcctcctccccggcgaagaagacgtggaggagagtaaatgagcaatcaggcccacggcccaatcgccgtccaccacccaccaccctcagcgacccaaaaccacctcaccaacccaactctgtaccgtactgtacccgccctcccctcccactgacactccgggcccacctgtcggcgcgactcttccacggtccccttctctcctcagagattttttccacgcattttttaatttttttttctgcagttcacatgctcttctcccactcttccgccgcgctatataaaccgcgcgaggcgtcgttgcctcgtcggcgaagtcaatccggcgatccccggcgagcgagagatcgaagcaagctgctacacagatctcacgacatggccgaggcggcgtcggcggcggcggcggcgacgacggagcaggcgaatgggagcagcggcggcgagcagaagacgcggcactcggaggtcggccacaagagcctcctcaagagcgacgatctctaccaggtaacccgccgtctccggccatcccctcctcgccggaaaacctccgccgccgtggctgaccttgcctgactggctgactcggtgcttcgtttccgcagtacatcctggagacgagcgtgtacccgcgcgagcacgagtgcatgaaggagctccgcgaggtcaccgccaaccacccatggtacgccacgaatcccctcctcctcctcttgggccccgaatcggagctcggcgacatcgatttgattcgattgggagggatcgatgttgttcttgcaggaacctgatgacgacgtcggcggacgaggggcaattcctgaacctgctgctgaagctcatcggcgccaagaagaccatggagatcggcgtctacacc

SEQ ID NO: 82920 - DNA, 631 bp, Oryza sativa
ataacggaatttctataccgaacacaaccatacactccatagtaccatacaagcacagtccgatgtacagagccaaataaatgtccagattatacattccaaaatataaatacagtccaaattacaagttgcattaatacatagtactgatgaatcccctaatgattttggtaaaaatcattaagttaaggtggatacacatcttgtcatatgatcaaatggtttcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccggtggcatgctagctttatctgttcgggcaatacgatgcccattgtacttgttgactggtctgatattcgtgagcaaaaacgacttatggtattgagagcttcaattgcactacacggtcgttatgttactctttatgagaaa

SEQ ID NO: 82921 - DNA, 9396 bp, Oryza sativa
cgatggacatcaaccgggagaactacgagctggggctcccgtcgatcgagaaggcgggagtggcgcacaagatcgacttccgggagggacccgcgctgccggtgctggaccagctggtggaggaggagggcaaccatgggtcgttcgacttcgtgttcgtcgacgccgacaaggacaactacctcaactaccacgagcggctgatgaagctggtcaaggtcggcggcctcgtcggctacgacaacacgctctggaacggctccgtcgtgctccccgccgacgcccccatgcgcaagtacatccgctactaccgcgacttcgtgctcgagctcaacaaggccctcgccgccgaccaccgcgtcgagatctgccagctccccgtcggcgacggcatcaccctctgccgccgcgtcaagtgagcccgccgccgccgcgagtgcgactccggccgatgcccaagaactagtcattttaaatttataaattataactaaattgtataatttttgccttttttttttaatttgcaagctactggaaaatgttatttaatatatgtataaatgtcgagacaataatattattgcattataaattgacctggtttttgttagctttcgttgcgcgtgagaatggtgagtgtgtgctgctgatgaaactcgaatgttcacttttgttgtcttgtccagctttgctaaactttggcagcattagcaaagctgttttgttctgtttctgaattgttcttggattgaaatctctaatattgacttgataattaaatttgaccggtttttggcagtaaattccttcagtattggcagctcaaactgaattcttctactaatagtttagtgcttgtggagagtgtagtcgtgtagagtggactggactaattcagatctttacttggttagctgaagatggcatccgttatctgaattcttcagtagttggtggataatgacaactcgatgtagagagataatttgctgcatgttagtttggaagtagcttcaaaggatttaattctcagcgtccgaagtcttaagtacagttggtttggagagctgttcctgtgaagacttttatgatttgtgctagttatggcatcacatgatcacttcaattatcacttatcgatctagtgagaccaaccatacataccatacaaaggtaaaaagtgttcaaactggattgaacaagttctgtctccatatagatcctactaaaatgcatacatgttgtagcaatcccatttcatccaaaccaaacaaaatctctttcattcggctctaaccaatcaaacagagccatttgtatcccccgaaccaaaccagccgagcatggatgagggatcgagggcatccgagcaaccaaacaggcccaaagtgaatgctttggtcgattttcgatttgttccctacgaatccaattttagtccttcagccagaaaaccagatacaattgatccctcaactatcaaaacaagtgcagatgagctccctcgacagtttggacggcggttttggttgacgtggcgcctacgtggctaatttgactatgtttcatctgatgtgacagtgacatggtgcttatgtggtagttcgatccaaaaataataataaatctcataggacccacatgtcagtttcacacacaagataataaaaaatcgtgggacccatgcggccccacatatcatcctcactactcccctcttctctctgtcctctctttcccctcttatctctatcatctctctctcggttgggaaagcaacggtacacgggcatcggccggtgggatgataggagtggcgcgagggcgccggccggcgagaggagaggagccgcggacggaggctgggaggaggaaaggtcggcgagatataggaggataatgagagggagaaacggtcactacccgtggctcctcctcccaccgaccggagcccgcgcgccgctcctttcccgccggtcgccgctcatgtctcctctcccgctcggctccaccactcctctcccgccccggcgaggtcaacggctacgacgacattcttctcatccacccgcgccgctccacccctctactccgccgggacatcggggaagtggatctagaggcagaaggggttgcggcggtcgacttctcgctccgcttcctctcctgccgccgacgaagacgacgacgacaatggcgacgggttcgaggaggcggaggacgcgcacctcatcatcgcagccgccgcccccgttttcgttgtcctccgcgacgccctccaatgttgacagcatcatcgccatgggcggcaacgccaccgccgccgaggatgatgacgatggcgacgggttcgaggagcaggaggaggagaacacacagctccgctatggtttgtcgccgggcggccatcactgtggtttgttgctggcccgctccgccccgccggcttcgtgcgccgccactctgcccacaccaccccgccggcttcgcatgagagagagagagggggataggatacagagaaaagaagagagtggatgagggaataaaatttgaatatatacctttgtttttaaccttttgcgtttatatacatgcataggaaaaaattgtgaaaatatacctctgccacagagtggagatgcgggactgagatggtgccactcgctcccgcagaacggccgcgtggcaccgtcgctcccgcggaatggccgcgcggaaccgtcgctgccgtgctcgctcccgcgcgcgacgcgcgacgtcacggtcccgcgcggcgggtgcgcgcgaccggcgtggcatgcatgcaccgctgtgcctgcatgcatgcgtgcgcttgcgtggccgtgttccgcgtcggtcccgcacagctattctgcgcgatcgtcggttccgcagaatggtggtgcgggaccgtcgtggtagaggtatatttgtgtgaaattttatagcatatgtatataaacgcaaaataaagataaaaacggtatattttcaattttttttctactagacggtagccacggtcccgcacaaccagtgtgcgcgaccgctacggttccgcagaaccagcgcgcgcgaccgccacggttccgcagaacctgcgcgcgcgaccgccccctgttctgggactgcaacggtgccgcacacccaacgtgcgggaccgagtttcccccggccagtcccgcagtccaccgcggtgccgcacggccggtcccgcaatccgccggtggcgcacgcccggtcccgcaatccaccccggtgccgcacggcagttatgcgcgtgcgcctcggtaccgcacgcccaatgtgcggtaccgtcgcggtaccgcttctccagcgtgcgccaccgctccgggatcggtcccgcgccgccaatccgcggttgcgcttcgctcccgctgccccgccctgcggcttaggtataatttcgcaattagttgccatgcatgtatataaacgcgaattagggaaaaaagaagtatattttcaaatttttttcctggatgaggtggagggtatgggtcctactattttttatcttttatctaactgacatgcaggctcacatatttttgttttatttttaaaattgttaaattttgcttcatgtgccatgtcggatgaagaccgggtcaaattagctacgtaggcaaaaagaaaaccgccgaggtatctcatctgcacttgttttgacagttgagggacccattgtatctgtttttttggttgaaggatggaatcggattcgttgacaagttaagggacctcagatgaacttattccatcaagaattctcaagctttaaatatctcccagtattaggtgataaggatttttgttgggcctagccttcactgtcctgctaggtgaaacgggatcgatttgggctagaaaaggacagataccatggtgcacttttgttatccattctggcctagtggcctacatcgaaatgattaggcttattctgcttcaaatcagacgatcacttaattctctgttttagacttaaccttatggaagtgtaagttcatcagattaaccatcttgaaaagaaattgtgtccatcatagtgtcatactgacaaaaagtggcatcttataggacagttcgatcgaagcaactactaacagagtttgggttgggttcgtgtcattgtctccctcacatgtttttctcaacgcttagttggtgagatgtttacatctggatgcgttatcctgatggatacactcacagagaaatgatttttcttttaaaaaatatcagatatgcaaagaattctcgttcaatttccgtatagaaataataatgaatccataaatctgtatagtatacatttattctgtatttctgtatgcgcactaatgtacaagccaaaatatacacaacacaacacatcagcacaacgcaagggtcatgtaaaataaaacaataaatcaacacaacacaaagaatcaagacacagcacgagtccctttcatgaatcttattcgattcaaaagtgaatcattcacgaatctttctttctttttcccatttactttatgaaatggatggtatttttcatcaggtctttcatgagacctggacgttggcattgaggatctgagggatggacctgatctgcagcgccggtctgatggcgagaagtccggcgaagctctccggcggcaccctcatcccgccgacgttgatgcactccagcctccggcagccgccgacgagcgccaccaggccggcctccgtcacgtggcggcagctccacactatgatgctctgcatcgccggtcaatcgcaatccacacaaaaaaaaaaacacgaatattaggaaataacctaatatcaaataattagaaagggtgagacttcgaatccaggtcgtctagcccaccaccttatggagctagccggaagacttttgggcgtttctcgcaacctaggactttttttttccacaccaaaacaaagtcaagcaaaaaacaccgtgcaaatgtgactagagaattgatatgtactttgtcagtgtttttattaattcgtacttaatctgtagttcgacacttcaagtaatctaagcgtgtggattagtatcaccatgctgtgtttcaacgctagctcttgatgacgataaatctatagttatatttcaattgtcgtaagtaaattttgctggctatgtaagtgtgatagtgatggcatagttctaggtaattttatctgatactatgtgaagaacatctagaagacttttttattttttaaaaaaaagaaagaaagaaagaaagaaaataagatgccacagatgagcacaaatgatcacatactagaaggctttagttgcctaggattctatgaccatcttaagatgatcacgctcaaagatgttacttctttcctgaacatatcctcatctcctactgataccagaaccgatgagaagcttttctcttttttttttgaaacgcgaactgatgagcaacttcaagacaggaacaggcataattctgaagcaattgatcactgatcagtattgaagtctttatcatagaggttgagattatatagtagtacatggcccaggtatggtgcaagaaagaacaagatcatcaagatgatatattgatataggttcctatcccccaattaagcatggcacagctcccccatcattttttccaaaagaactacagtacccttttaattctaaaggcaggggtgtttttaagcagaaataatagcaggatcgcagccactaagataatagcagaaataatagcaataactgcatacatatcctgaccacacgaacctgagaataaacctcaaccagtaacatcatttgtctacttcaattcaaagaacaagccatggcgaatctgccaaggttgtcagttcaaccatcattcttttccccatgaaatgactcatttcaaagtatcaactactgtaaacacatcgtacatactgtagacagaatatttgttgacttctaggatcttttttatgtggtaccttgtcatgtttaatttgcagacacgaaagtgtttccagattaagaaacataccttcagatttatacaactttttgcaactgcatacaacgattcatctgtgataaatgttccaccaatgttcaggtgctgcaaagaatgcgctcttgaaacctacagggaaggttgacaaaagcacagtatttattacgacacatcaaagatgtccttcggtagtgcagggtaaattatgaaccaactgattattgttgcaattttcggatatgaacagtggattattattctgaatgaaaacaacacgttaacaatgcatcatgagttcatgacaacatcctgcaacactataaattcctatccaaatccttattggcttcttatacactatgatagcaatagccaataatcaataatcaattgacataccattgagtatgcccttgaaacatctaagacggttttattaccgaaacaatgacacaaacatagcacaatcatgagccaagttgccaagtctcccaacacaaaacagcaaattttttgcctgttttctccatgtttccaagtaagacggcttaaaagttcaatcagagacagggcacacctgcctggtcaatcagaaaattcccaatccttaattgcaagatgaacataacttaaaaactactaatcttttagacggggatttgaaagaaatgattaccagctggatgacgccattatcggtgatcccagccaatccccagagagagatggaggtgaggttcttgacgcaatcggcggtggaaatcctgatcaatccttgatcagtgatctggcagccccagcagcttcgtgaactccaagaacggggaaacaaagttaggcaaaaaaaaaaaaaaggtcacaatctggcagcagcagcagcagcagcaacaagaagttttagcttgatcgattgatcattcgagggttgtggctgaataagggggaatcaatcggctactactcacatgtcgaggtctcggaggttgacggcggcgcggacgaagcgcgcggtggagtcgtcgccggtgcgctgccccgcgaagctcatccgccgccgccccgccagcgacctctccaccgccctgcgccaccgccggctcactccccccgccctgcagccgagcaaacaacacaagcaggtcacgccacgccacggcgtcgcgcgtcgatcaccacgagcagagcaagagcgcgtacatggagaggtcgtggaaggatgggaggagggagagcacgtgcgcgaggaggtcggccggcagccgctcgacgtgcggctcgggctcctccgccgccgccggtggcgcgacgccgatgacgaccccaccagccatggctcgcttcggctcggttgcttctcctcgcgctcgccgtggaggcgagaaaggcggggggcggctttgcttatactttctccatggtcgaggtcgccatggctcacgtgagcttgacgcgacgcgacgcgcgcccatcgcttggaattttgctgcgcgctgcggccgaggtcgcatgaccatgtggacatcctcgcgccatcgagacgcccaccgaatacgcctcttgccaaaattttcaaaaaaaaaaaaagttcacacaaatttgttcaaattttgttaggatttgtagtgaaactgccttagttattggtaaaatctgctataagacatccaaagtttacggtttttgccgctgaaggatatcgacatatcgtctgcctccattggttaatgatcagagttaatccacaaccatccactaatgttgcgggtgtccagcgatcaattgcccctttttagcccctccaaagaaaacatccttacggtgttctctaccaaaaagcacacaaattgcgtgtatcctatagaaattttttgcctaattcatacgtaaaaggaggccttgactttgaaattggtaggggagcaaggccgatctgggctgggttccattgggccgaatgcatcgaggacccacctgtcagacgggtccatgtaagagtctccaagaccaggtgcacgcagccacgcagcggagcaccaccagatctcccttggaccggttccatcgtctccgccgtggaccagcgccaaccctcgccaccgcacgtcgccgggctccggcgaggccgccggagtgtcgtcgggaagcggagggcctcctccgtgccgcgcctccctccgcccctcaccccttcctcctcatggctaggtcctgacctgaggtggggctccgcggctactgctccccgcctcgccccgcccccgcccccgccccctgcctctccgccgcggcgccactccgggctccggcacctccctctccgtgcgctcctgcggggtaagccggtgagggacgcttagtggaattgctagtgctcttactcttgcgttagttagaggtagagctgcttggagtgaggaattgatgttgcttttttttttgggaagaaaaaaaaatctactctgaacttctgaagcaagtaggattgcttgatgttgtagatgaaaccagtgctaaggaatgtggtccttttgtttgttctgtattgtatcccagtttcacgatgttgtttagattccagcatttgcatactccatagctttgttaccagtctgattatgagtgaaaccatggagctttccgtagtatatatgaaaattttcctttcttttctcagccaggaatgccaatataattgatagtcaacatcctaggatatgagacatgttgcatggggcttcagtttagtggatgagtgatcactctaacaactagtacggtagtaccaactagtactgccagcataattgaccacgttgcatttgacatcttatataaagtaggggattttattacgacgcatatgctgtagatttctcctttctatcgattttgtgtttatttttgtaccacctgtggattttaagtggaacaattctctccttttgttgcagaagttgtgtggagctatctctgatgctgtttatgcaaagacttatgctcacttcttgattagaaatggacagtagccgagattctgaagaagaaaggcctcaaaggaaggacaatggcgaagaaactgaaaatggggaagatggtggaaatgctttgagcctcaaggatgttgccaatgagcttcttggttgtgttgtccatagtgaggaagaggcatacaaactgtattgtgactatggacatagaattggttttagtgtccgcaagggtaaacagtcttacttcattggcacgaagaatattcgtacaaaagattactactgctcaaaagaagggcttaagtacgatgagccagttacagaagcaaattttaatcgaccagacacaagaactaattgca

SEQ ID NO: 82922 - DNA, 57498 bp, Oryza sativa
gcgcgggtcggggctagtgcctggggagatccgcatgtcgagactggccaggccgggaacgtggtgaccgagggttatgggtgacccgattgtgggtttttgccgattcccccccggagttcaccacgccccggggcacggctcggttctgggccccgtttggcgatttatctgaccgaaccgagcccccgagggcaaggttgaggcacgagcgacctcatttcaagtcaaaattcttcaaaaaggaaaaagcggcccagatacagcccttaggaaattgaacctgctttattgaaatactgaaatgagagaaatgagaatgtgcatgtgtggcagcccccggccaaccctgcacacccgagggggggtgcggggttggcccgagcccgaaacctgacacccgacccccccccctcaggggtagaagcgacgaaggtgctcgatgttccatgggttaggcaactctgtgccgtcgcccgtggccagccgtatggagcccggccgggggacgccgatcactcgatacggaccctcccacattggtgagagcttgctcaatccagcacgcgtttgaacgcggcgtaagacgaggtcgtcgacgcagagtgatcgggcccggacgtggcgctgatggtagcgccgcaggctctgctggtagcgtgcggctcggagggccgcacgccgccttcgttcttccaagtagtcgaggtcatctctacgaagctgatcttgatcaacctcgcagtacatggtggcccgaggagacctcagggtgagctcggatgggagaacctcttctgcgccgtagacgaggaagaaaggcgtttccccggttgctcggcttggtgtggttcggttcgcccagagcaccgctggcaactcctcgatccatgaatcgccgtgcttcttgagaatattgaaggtcttggttttaaggcctttgaggatttctgcattggcgtgctccacttgaccattgcttctggggtgggcaggtgaggcgaaccaaagcttgatgcccatgtcttcgcagtagtcgccgaagagttcactagtgaattgggtgccgttatccgtaataatacggttaggcactccaaaccgggccgtgatgcccttaatgaatttaagtgcggagtgcttatcgatcttgatgaccggataagcctcgggccacttggtgaacttgtcgatcgcgacatacaggtactcaaacccgcccggggcccgcctaaacggtcccaggatatcgagcccccagacagcaaatggccatgaaagtggtatgatctgcagggcctgggccggctgatggatttgcttggcgtggaactgacacgctctgcatcgccgaaccaggtcgaccgcgtcattgagggcagtcggccaatagaatccttgacgaaaggccttgccaaccagggtgcgcgaggcagaatgggctccgcactcgccttcatggatatcggcaagaagctcaacgccttgttcccgaggaatgcacttcaggaggattccgttagccgcgcgccgatagaggatcccttctaccagcacgtagcgtttggaaatgcgttggacgcgttcactcccttcgcggtcctcaggtagagtcttatctgtgaggtatgcttggatctcagagatccaagcaatcaatctaagggagcttggagcgctcccctcgggtcccgaggcctgggctccgacgggcctcggggaccgatcaggcgcgtccgtctcccctaaggggtcgggtcgcgccgacggctgggcaagcctttcttcaaagacgcccggtggggtctgggctcgcgaggacgcgagccgtgagagttcgtcggcaatcatgttatcccgtctgggcacatgccgaagctctatcccgtcataatggcgctccatacgccgcacttggcgtacgtaagcgtccatctgcgggtcagagcaccggtactccttacagacttggttaacgactagctgggagtcgcctaacaccaagagacgacggatccccagtccggctgccactctgagtccggcaaggagtccctcgtactctgccatataattggtcgctcgaaagtcgaggcggaccaagtatttgaggacgtctccattcgaagaggtcaacgtgacccccgcgccggcgccctgaagagacaaggagccgtcgaactgcatcacccagtgggcggcgtgaggcagctgcgaggggtccgagctagcttcagagactgaaacggtctctggagccggggtccactctgccacaaaatcggcgagggcctggctcttgatagcgtggcgtggttcaaagtgtaaatcgaactcagaaagctcgattgcccattttaccacctgtcctgtaccctcccgattatgcaagatttgaccgagggggtaagacgtaaccacagtgacccgatgcgcctggaaataatggcgcagtttcctcgaggccatcagaatagcgtaaagcatcttctgggcctgagggtatcgggtcttggcgtcccggagggcctcgctaacaaagtagacaggccgctgcacccttcggtggggccgatccccttcgctaagggccatatccccggggcgctcctcgtccaagtggcccctcggggcgcactcgtcttctgtgccgatgacctcggggtcggaggacgataggggcggccttcccacagtggccttggggccgttctgggggtcgggggctcctggcgtcgtcggacaagcgggcaaagggccaactctggtcgtcaggggccttaggccaccgttcggctcgggggcctcttctccctgctccctcccgggtcgaatcggtacagggttagcctcggggtcagagggcgatagatgcagccttcccgcagtggcctcggggccttcctgagggtcgggggtgcccagcaccatctgacgagcgggcagagggccgactccggtcgtcaggggccttaggccaccgttcggctcgggggcctcttctccctgctccctcccgggccaagtcagcacagggtgggggtgcgcggaatgaggattgtcctcatcgcgctccacaaccaacgctgcactaactacttgggggggcgccgctaagtagagtagcaggggctcatttggctccggggcgactagaaccggaggagagctgagatatgctttcaactgagtgagggcgcgttcagcttccttcgtccaagtaaacggcccaaagcgcttgaggagcttaaataagggtagcgccttctctcccagcctcgatatgaaccgacttagggcggccatgcaaccggtgacacattgcacatccctaagtttactgggggggcgcatccgctctatagctcgtatcttctcggggttggcctcgatgcctcgggcagagaccaagaacccgagaagcttgcccgcaggtacaccaaacacacacttatcggggttcagttttatgcgggcggagcggaggctctcaaaagtttccgctaaatctgaaagtaacgtttcctggttgcgcgtctttacaaccaagtcatcgacataagcctcaacattacgtcctaattggctacccaaagaaattcgagtagtacgttgaaaagtaggacctgcattctttaacccgaagggcattgtcgtataacaataagttcctatgggagtaatgaacgcagttttttcctcatcctccctagccatgcgaatctgatggtaaccagagtatgcatctagaaaacacaaaaggtcgcaccccgcggtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccggatggatgacctcacggataaatccggcctccagaagtctcgccacctcctcgcggatgaaggcttgacgttccggggcctggcgccgcactttctgccggaccggccttgcgcccggccgtacggcgagacggtgctcaatcacctccctggggaccccgggcatatccgccggtctccatgcgaaaacgtcagcgtttgcccgcaggaaggagacgagcgcgtcttcctatttgccgtccagaagaccaccgatccgtgtggtcttggacgggccgtcgcccagtgcaacctccttgaccgggacctcatcggacgtgactatccgctgcctcggggcggcgggggcggatgcgccaagcctctcgtcgccaccctcgggcttggacacgacggcgaggcggtccgcacgctgctccatacaagcgagcgcgactttgaggtcgccatggacagagatggggccgtcggggcccggcatcttcatctggaggtaggcgtagtggaccgccgccatgaacttcaccaacgcgggcctccccaggaccgcgttgtagggcagactgaggtccgccacatcgaagttcacccgctccgtgcggaaattggcgggtccaccgaaggtgaccgggaggtcgatatgacctagcggccaagtgtgccccggcgtcacgccgatgattggctgggacggccggagcatcatccccggggccttgatggcatcaaaggctgcggggaaaggatgttgagggctgctcctccatcaatgaggacacgccccaacttcacgttgcaaacggtgggagaaaccaccatcgcaatctgccctccccaggcaacgcacggcgggtggtcggtctggtcaaaagtgagggcaacttccgaccaccgcgcccggcgcgtcgcctcatgagtaggggccgcagccagaagctctcgcttcatagccttgaggctccggcgagaaacgtgagcacacgctcctccatcgacagtggcaatggtggccccaggttcttggaaacctaggtcatcatcgccatcatcgatgtcctcggcgggggccttctgcctggcctcacttcgccgacggccggaaggaaccgccggggacttgccttcccggcgctcctgcctcctctcctcctcccacttccttgtccgctctgccaagcttttgactgcgcgacagtccgcaaggtcatggagggaggtgttgtggacggtgcaccacttgccggtagggcgctccctgctgggaacgctggcctccttctttttgtcgctcgcaggcctcccctttcgggtggcccgcgaagcgccctcgacggcgaggacatgaccctcgccgtcggaacggactgacctctttttcctcctcctgtctcgccgccctgcctgagcggcggatccgggggcggccgaagctgccacaccggaaccggaggggttccaagtccaggcctcctccttgcgagccactcggtccgcgagctgaaaaagctctgcggtagtctggggctctttggaggcgatcttttcgagcatgcggttgtgccgcacgccccccctgaacgcgtagattaccgcgtgtgcagggatgcatggtatggtattgcggacctgacagaaccgctgaatgtacgatcgaagcgactcatcgtcccttcgctgtacggcgtgcaagtccgcttcctcaccggggcgcggatacgtgccttggaagttcatggtgaactactggcacaaatcctcccaggagtggacagacgcgggtggcaagttcattagccaaccccgcgcttgccccttcagggccatgggaaagaaattcgccatgaccctgtcgtcacccccggcggcctcaatcccggtcgtgtagacctggagaaactcggcgggattgacgctgccatcatatttttcggcgatggtgggccggaaccttgggggccaacggacattccgaagactcgccacaaaggctctacagccgacaccaccaaccgggggcacggagggctgattcccacgtccgtgtcgaggtgacactctggacgaggaagcgccctccgttgcgtgggcagcacttcggtcattacgccggcgctcgatgctggcgcgggcgtcctgctccccatgcagatcttcccgggtcgaaggagtcgacgaaggagtggcagccgaacggcgaacagcggctgccgctcgtcgtgccctccgtcttgacgacgcggagccggtggtagcagcaccagaggccttggtggcggaggaccggccaccagcatctaggcgccgccgtgccgtcatgaccaatttggccacatcgtccagccatcgttgggctggagactccgggtcagggacgacaggcgggtggcgtaagagcgcgcccgcagcttggagcgcgccctggggcgtgctgccgtcgccgtagacgaggaggcgacggtccccatctcgccgttctcctccatcgcccgcgatcggtgaagccgcggatctttcgaccctttcgagcgcctccccctgcttaggactttggcgtggagggggcggtggagtacgagctcgacgacgtgggttcggctccccgtcgtcgccactcacactgggagagaggtcgggcgcctttgcttgctcagccatgaggctgatcaagaaaaacttgacgcacacggaaaagcgcgagagctcagaaaacacacgctgagccccctacctggcgcgccagatgacggagcgcggtgctcctcaccgggagaccgcacaggcccccctttgccggttcggccgggggctcagggtgagatctcaagctctccgtgtatgtgggaagatcgcggcctctcaaaagagcatgaaacacaagcgatgtatacaggttcaggccgctgagaagcgtaataccctactcctgtgttttggtggatctgcgtatgaaggagctacaaagtgtgagccaacctctccctcgttctaggttctgaatctggaaaagatcatcccctttctctatgggccaggtcctccttttatacttcaaggggataccacatgcacccctccctttccaaactggacttttcttctcttcataaatggacggagatttgcacggtcgtcctccgaacatcctcctgacgggacggcacacacctacctccacttctgcctgaggcgggcacgtcgtgggaaggtggctgtgtgctgacgacatgagcagtgtcagaccggtcacaaatcggtcattcttgtccaccacgcgtcggcttagcaacgtgcatgtttgcccttcttcaaacaacatcttgcttgtaatggttaggatgaagcctggcatatatcgatcggggctaacgtgtcatctctgggatgtaacacgctagttccagccggggacgagtgcctagaagctctcgtcttgacgggatggggcgaagcgggcgtcagaccgcctgtcgccacctaacccgcgatttgaccggtctgtgactggtcacagaccggataatcgagtgcactgcactgcacttcgtgcggcgtgacacgcttaaccgaggcgcaataaatgcggttaggtgagccccgctgtgctcacctaacccatacacgtggagtagaaacgcgaggggtcggggcgcctcggccctcgggggcgaggcaggagtggtccgaccccccccctcggggagaccaagaggtgggcgcacacatcaccctcgggcccgacgtcccccgagggtgccaggccacgtgggcgatggcgtctgcctcaagcctctagtcatgatactcccggtcccatgtcaccgacacccttcatcacagcgcacatgcgtccaaaggtggtgtcattctcccctgacgctgacctgaaggtactaatgttggcgtcactgctacggcgagggtgatagcggtaagcagtgttgcggaggtcgtggtcgtgtagctccctcatcctggccatcatccttaaagcagcctcctggcaagcatgctcaaaggtgcctcctgtagcagtaactaccatgttgggcaagacagtgggaatgtcgtgcacctccaagcggacttggtgcgggaactcgccattgaggaggcgaagctgtgtgtactccgggttatgagggtagcccactgcgatcgccatacgacccagctctgccacgaagccatccatgccctgaccgtgtgtagggggaaggtttgacatctatagaagacaaagggtaggaatctatgcatgctcaaatccaaattaaataaagcaataaatgactcaagtaaataagcaagcaagagcaactttttatgcacagaacattttacatgaaccaaataaacatactaatgacactgattaaacaataaagtaatgcgtaaaataaatagataatagtaataagcataaagattgcatcccatcgaaccaagacatgacttaatgcatacctcccattaaataaattctcgactaactatcaaatgaaattccaattgaccccaaatctatttacccaaagttactaataccctagactgacctaaattttaaatatctcattcgaataagcgatcaagatttttccctgtaaaccaaggaagaaaattctcaaattttccctgaaacaaatccaaatgcaaaagaacatatgcgtatgaaagagtttcagtgagctcttaaggtttccagttggcttgtcctatggtcaaggtcagctctaataccaacttgtcacgccaagaaatttacgaaacaaaattccgagctgcatgtgcattaaatgacataggcgtgtctatcaaaaccatgcgccaatagcccaccattaagcatattttagttgtttgaataccctggtggtacacgtccaatatcatcatcattaaaccaagatttaagttacatgtgagatcccccatatagtaagctagttgatctaagcatggctaagtatgtttcctagttgatctagtcatattaatacccattttatcaatgggttaaggtaaacaatctatggacaagtataggtaaccatcccacatgacattgtaaaatggcaaaatttgctacaactcaaaaaatatgtaattagttgcgagacataacaaaaatatgaatttgcctgagaacactcagtgtggtaatttgctgtaggataccgaacacattaaaatataatatccacccaattgatgagagggaacccatacaaaatgaccgttttgcccttcttcttctcccaatcctccatcgattccccaatccatcgcagaccggccgacccaaatccccatcaccccatcaccccatcgatggacgatggctgatgtggagcctagagccggcgccgcacacgagagggcaggcggaggctaggaggggtgtggtcgccgggttcgtgggcagtggcacggtaggtggcgagcaggcactggcaagctgggcaggaggcgcatggcgcaatagcagtgcaggtgcagcagcaactcagcaagcagcaagccaagcaaaagtagccatcattccaccagcagaaaatggataattcctaaatgtgaatctttgctatttgtcaatccatcactccagtaccccaccatgccggggatggctgcgaggagcttcctattacgcttgctctcagcggccacgttcctaagcttgtgcagcgtgtcaaggagaccagcagagcttgtggcgcgcacgatcagctggggacttggggggtagggatgaggccgatgacagtggcaagccattggagctcgttgcaagtgagcgttggaaaaagaccgaaagaagggagaagaagggcaaatatgtcattttgtatggtttctctctcatcaattgggtggatattatattttaatgcgttcggtgtcctgcagcaaattaccatacttttggagtgttctcgggcaaattcacgtttttgtgatgtcacacagctaattacataccttttgagtgtcctaatgcaatatttaatagaaaatgagacgtttgcgaaataggtacaatatgattaattaacatgtatcacttgccttgcccccggtgctgcaggaacttctgggaccacttcaaagtaaagtagagcttcggattcaccggaatctaagcgaagcacacatacaaaacaggctataagtctatcgagacataaacaaaactatttttaatggattttaagtttatttatgaatttactgtaatttgagtgggctcaaacggagctcggatgaattttttatgaattttaaaagattgaccgtgcttttagaaaagcccttaaataaaatattacgcattaaagccaacggctgacgtcactgagggagggggccggggctgacatgtgggccccatcggtcagcggcgcaagtgtccgatccaccgtggacaagtccacgaagacggagacgggggcaccaagtcacgtgggcggtcgaacgaacggccctgatctgccgcgtggcagatcaggcagctgagatgcggcggtgagctggcacgggctcagccgagcggcgtcgcgcggtcaccggcggcgacgcggggagtggcggcgcgcggcgcgggagacggcggttcgcacagggaacggcggcgcacccaaaggggcagcggcgcgcacgggaaggagagggcaagggagggggttcctcaccggccggcgcggaaggggacgacggcggcggtgaggaaggcgacaacctggcggcagagggcgcggacgggcagctgcgggacctaagagagagaacgagaggggtttgaggggaaaagagggttcacggcaagcggcactgtcggccgggaggcagcggaaaaggaggtgctcaccggcgactgaggcgagacgtgttccggtggcgaggagcaggcgggctcggtgagcgcggcggtggcgacggcgcggctaggcagcagccctagcagtggccggagatggtggaaggcggcggcgctagcttcgcacggcacgagagggaacgagcgagcggggaagcagcggtggttgcggaaagaaatggaggagagctcgcgagggggttttatagagccgtgggccggatggacctctctcccgtggtaggcggcaacggcggcggtgaggggcgatgtcggggcgtgaagccgggaggaactggggccgcgtgcggccgttgcgggcgcgggatgcgtggagtggggcgcgcacacgtgggcgaggcgcggacagtggggttactggggcgccgggcacgggcggatgttgttctccccctccgatttcaccggcgagaggaagggacgggcctgacaggtgtgccccacccatcggcgacccgtggaggagtgggcgctcgcggggcccagcttgctgagccttcggccggcctagcggcagcgagggcagttgtgcgcgcgctcgggctagagcaggccggcggcgggaaattgggccggaaacagcctatcggctgaaaaagaaaagaaaatggttttgaagttaataattccgataatttgttttcaattattaaaattacttcctttgtttatatacatgtagaaagaaattaattatattgctagcaagtcattagatgtctaattaataagaattaatgttgacatcaatttacaattttttagagtagctcttacagaacaatgactcgtatgaaaaaaaaaatactacttagggtttacgacaactgaaattgatgaattatctaatttatacgattgctatctgagggtataaacgaataaattaacttttaaaaagttaaaattttattttagaaaagtattccaagattttttttttcaaaaaagcaccatttagaaacttggaatgcatgaaaataaaaattgaaagtatagaatcaggaaaaaaataggcccttaaactcgcttataacacttacgtcctactaagagttctattgatattggttcatattatgctcacatttataacataatgatttctttcacctcatgaacaaataataaaaaatctaaatacgatataacacaatctatctatctatacctatattaattggacactttttatgagctctcacgttaataagaaaagtctaaccattgaatataattaattaatttaatcagaatcatagatgcaatagtgatttaacgccataggcctgtctaccgtcaactttatgggctctttccatagcccatatgttcttatctctagtcaattgtatccgggagaggcagggggcgacacgcgccagctggcagcctggcaccctctcctaagcatgatttttttcgttttctttttttcgcggtttttttttttcatttttcattttgcgctttttctaatttttttaatcttcagcacacatgttttcaaatgtttgagttaaaagtttttaaattttaatttgaaagtttttaaatctcaacgtaaaaattttcaaatatggacttaaaaattttcaaatctcgagttgaaatttcttaaatctccagttggaagtttctaatctgagtcgaaagttttcaaatctgagttgaaagtttttaaaatttgttttacaaatttgaatttcaagttgaaaattttcaatgtttgagttgaaagttttcaaaatttgacttcaaagtttaaatcttaagtcgaaagttttgaaatctaacttgaaagttcaaatttcgagttgaaaaaaattaaaaaattgagttttgagtgtcaaattttgagttgaaagtttaaaatttcacgtggaagtttctttcacatatagatttcttttcaatatgttagtaaaaaaatcttcaaaaaaaggaaaatctttccttaattaccgtcattatcctaaactaactcgaaactaactcggttagttacgttgattcctctggaatcgccggcgcgcgttagcttttctgcacaactatatctgatggagagagctaggtaacagtctagcagatggaagcatgaggccacgagcagaaccgtgagcataatacgagagacttcaccttgccggggtgtccattaacacgattgaaaacttcagcaaaggagtcgctccagccgccaattcgaacagcatatatgcatggacggatcgacctgctgttgagattgcatatcccgcatgcatgtgcaccaacctgcgcaaatggaaagaagatcgaagtagataagttcaattatattttgatgaatcggcggcggcgggggaatcagtctcattgtgagtagagcacagcaagttcatttggatctttaaacggcagaagaaaacgcatcagatatgcatcaactgatctgtacgttgtcctaacatatccaatcctttttcccgttgcagatctactattagttttgtaatacaatggccaacaatattcatgcctggattagggtcgaatatcatctgcacaaatacagttcattaattgttgaccaaattaatacttattctccttggccagcatacataatcacattatatttctatatcatgattgtgggtgtttgcacgcaagtttcatacctatgcttattgctcgctttattgtagtgaataaatcaaaatcacctatctaggtggtatcatcaaattaggagtgaaataaaagaagagtcaagacacatcatcgcaggttcctaattcttaaatttagattaataaagaattgaaatactaaaaatcagagccctaagaggaggacaatctagtattttcaatttaaattttcggtattatcaaactaaaaaaatttcgtatttattaactatgagtccacattagatatggctcgctaatatttttttttattttgagaactattaaattagcaaaaaaaactaaatcgaaactatagacaagcacaaagaacgcatttgatactcgagtactttgcattgagctattctacaatttaaaactatttaaaaaaattaaaattaagacaacagtaaaactttatgacgtgaaaaaactatgaacaaacaaaatagaattaataaatttgtattattaattcatattttttatcagtaaaactatgaattaataaaaaaatttactattaatcttaatctttagaaatatgaataaaataatagataatgtaatgtaaagtaaatactagaaaaagcgatgtgagttttttttcctaagaggatatggccctcggagccaaatatggccacctacgaaaatttaaactggggtggagcttgtcgttcgcctgcgaagatcagttcttttatgcggatcacttaagaggtccgcctacgaaaatacctttattttcatagacgggcctcttaaggcgtccgcttggaaaaaaatgatttttgcaggcagaaccttatgttgtccgtctgcaaaaattatgcctgcagaaaaaatatctaagtcccatcattatcttctccttcaccatccttaccctgttggccactcatttcccttccccttctctctttctctctcatttccttcccattagacggcaggtcacgtgatggcctccctctcctggtgatggtggtggctcagtgacgaggaggggaggcgttggccgcaacgaggaggagaggggaggttggcggttcaactcctccctctcccggcaacagcggcggctcagcgatgaagaggtcgtgacgacaacaacgattcctcctggatctgccaccggctcgccctgggcgcgcagatccatcgccagccggccatgagtacgccgatccatcgctggcaggtcttagggaggggaggtggtggcgatgaggaggtgaggggacgggaggggatgcagcgactcggctcctccctctcccggcgacggcagcggctcagcaacatggaggtcacgacgacgatgatgatgcctcctggatccgccgccatctcagcctaagcatgaggatccacccctggccggccgtggcgagcagatccgccaccgaccagtctcagggaggggaggggaggtggtggcgacgaggaggtgaggggaggggatgcagcggctcggctcctccctctcccggcgatggcagcggcttagcgacgaggaggtggcgacgacgacttctagatgtgccgctggctcgcaccgggtgcgtggatccaccactggccggccaccggcacgcggagccgccgtcggctggtctcgttgaggggagtggaggtggtggcgatgaggaggtcagggaaggggaggggatgcggcggctcggctcctccctctcccggcgacggcagcggctcagcgatgaggaggtcgcaacgacgacatgacgcctcttggatccgctgctggctcgccccgggagtgcggatccaccgccggctggccgcgggcgcgcggatccgctaccggccggtctcggggaggggaggggaggtggtggcgatgagaaagtgagggggagggaatgggatacggcggcttggctcctccctctctcggcaacgacggtggctgaacgacgaggaggggaggcattggccgcgacgaggaggtgaggcggtggctcagctcctccctctaccagcccggcgacgaggagggccagcagcggcttggcgacgaggagaggaggtggcggcgggggtaggggtggtggcagcaaatttgtttttgttcactgaaattatttttgtatgagggtggagatgctgcctgcgaaaataattttcgtaggcctttgtttactggcggccctttccccgcctgaaaaaactacttttggccgtctgcgaaaatgattcctagtagtgattgttttctaaagcgatttcgtattgttgacatttttgagtttgaggggacgatgcctaggccacgatgcatgagtccagtgtatcttgctgtgcaacattggatgacaaaggcgagcgtcagtatggagtaagattttgtatatattgttattgtcaaaatccacaattattttcaataggaaaagtaaattacttggtttttactaatctatttatctattaaaaaaatataattctacatttaaatcgatttataaattttatatctatggaaataaaatgtaacaattatgtcggaaaatcaagattcttctaaaatccagatccacacaaagttgtaggggggaatccactaattgcctttaagagatattttgaaaaataaataactgataattcagcatatgattaaaattgtaatacttatttataaaaacaataattagcctgtgcaaagcacgggttgacggctagtacattataattattttgtattcaactctttatttcagcttacacagagctaattgttggaaaaactcaacccacgatgcttaattcttctctccctgcctcatacctttaatttgttttaatgttattaacaaaattaattgttaaccatatatgatttgatatgtggcaaagggatagcgctgcagcggtcgtgatcaacttagctgcctcagatatgatgtttcatcatgcgtgcggaaggcaaagctacagacgtgcattgtgcttctacagcgggccaaaaagaaaacttcggatgctttatttattaacaatagatagatccgatgattcaaataatagatgtaattaaattagttaatatagattttaaattgttaatttaatgagtacacagtataatgatgtaaactttattttaaaacagtttcattgtttaaaattaatagtccaaagtaagtaataaaagatagatctgatcatttaaataacaagtccgccggtttaagtgcaaatataaattagttaatatagatcttaaattataatttgataggtacacaatataataatggtgtaaactttattttaaaatagtgcattatttaaaaataatagtacaaagtaatgagtataccgatttaagtggaaattatctcacattattaatttaacgggtaaatatataatggttcaaatttattttcaaacattatagagctaatttagttacctctatgatggtatattctttcttcgtaaaattatgattatttaaaatttttacggaggaataagtgttttacagaggaagtgccgaagataagtacatctgataaaaacaaatctagcagctctttacactacaaagctagctgtaggagcttggacagagggaatcttgaaatgtaaagtaccgttttcttgtttgaagataggaaaagacataatagaatcccttatatgccagccagttctcttacacatgccaatttaaattggcttctcctttatataccactggttaagttttttcacattttataccacccttagcactgtagcattagttgattgttagtcacatgttattttttttaaatgaccaatatgccttctcaactaaaaaatgtgtaaactttaaaaaatcataactattttattttaaatccgttttgagtgaacaaaattttgtcataaccaatgaaaaatgctctttgtattaaaaatattgttggaaaactgtatgtttcatacttatattgaaaatttatttgtgatggtgatggctaaaattgcatataatgcaaaaaaagaatcaattttcatatgttgtatccagtagctatattagtattaaaatacctatgattggttgtataccaactctcaagagcaaatacgtctttttactctgaagttaacggtcaactgatggtggagtgacggcaatggcataaaagggataacatacttgaaccggtggcatcgcagagagaagccaatttgaaatggcataaggaaaccggttaatttgaagtggcatataagagattctctaattattagaaccagatcggaccgggttccgaccgaagaaaactggaacattggccggtccggtccagcctaaaaaagatgggtgtgaaataatcagactggcggaaaccattgaacggccagtttttttcatagaaaccggttaaaaccggattactagaccgctgattgggccgatgcagctcagcacgtgggagggaagagagttgctatgtccatgtggcagggagggaaagtatcccatagactcacgtctatatatcatatactcgctccattttaaaatatttgataccgttgactttttagcacatgtttaaccgttcgtcttattaaaaaaatttgtgaaatatgtaaaactatatgtgtacatgaaagtatatttaataataaatcaaatgatataaaaagaattaataattacttaaattttttgaataagacgaacggtcaaacacgtactaaaaattcaactaaaaatttaacggtgtcaaacattttgaaacggagggagtacatcaactaacaaatactactaaaatatctaaaaaaattattgaaagtattatatctagctaggataaaatcttaacatcaaatacattatattttagtcgtaaaaaaaatccgacagttttaaggttgtaattctgttagaattttatctttttttactctctatgtagaatgaatttaaaaattcgactttgtgcgtatatgtaatactattagaagtatatgtatgaatttttgtaaaattatttataatattttttagttggtgtatatggtgtgtacacgtgaggtcatatatagatacgctcccgtggcagggaagccggtgcctgctttcacccccaagtaattgcctattcttaaatctttgctgcaatattggttagggttgttgcaatgtgacggaagactcttgcattgcattcaagcctcaatcttgctctatcagtctagttttttttatcaacattttagatacaataatgtagagtttaggtggcgatcccatgcatggttattcgtgtaacacaactaaaaaacgatttttttacgcggactcatataggttgcaggtggaccgtagctgatcacgtcggcaaaaatcgacctatattttcgcatacgactcattatgaggccctcatataaagatctattttcacagacgaggctcttaaggatcacctacaaaaataagcctaatttcgcatgcgagcctcttaaatggtccgcatgcaaaaatacctcctcttctccacaattttatttcttcctttctctctctttccctcctcatcacttcaaaaaattttctcctcctatcctctctcgccctttttctctcctggtattattttttctctcctctctctcttcctctcctctcctctcatatgagcgggagctggtggcagtgggcggctgtgctgccgctcgacaaggaggcagccgggaaagggtggcgccgccgccaacgacgaggaggcggctaggagtggtgtcattctcatccccacccggtgccgccacagccgatgaagaggaggaggcggccaggagcggcaccgccgccgatgacaaggaagcgactaggagcaggcgactaaatcccgatccctgcctgacgtcgctgtcgtcgccgatgaggaagaggcggccagtcgcgatggccggatcagccaccgctggcgccacaatagcctgatccgccatcgctggcccagcgacggccggatctgccggtgccggcgccacgacggccggacctgcgctgtcggcgcaatcgagagctagggtttcgctttctcttttttctgagttttttattatattttggctttttattttttaaatttggtcgacataagtactaattttcgtatgcgggcgtgccacccgtacgcagacctttccgtaccgacgagcaccccaaccgtatgaaaaaataggtttttgccatggctgtccatgagggcgcgcggccggagcaccctcacaggaccccagtcttcgagggcccctagacttaaaactctaacactagatatatagcccaactagtcctgaaaatctattattttctttttcacgttgtttcaatttcggtcatgcatccttgccaagggactatctaaaatactgccacaagttctttaaggaaaaaactttcaaatctaactatagtataaatataataaaattccactataactttattataactataatataacttatatataagtactaaaataatatatgtaactttatatctaatttatatagagactacaatgtagttacagtgcagttacactgtatttacaatgtactccctttctttcagggtataagacgttttgactttggttaaaatcaaactgtttctttcaagtttaactaagtttttagaaaaaaataataacatttgcaacccaagacaaatttactataaaaatatattcaattattaattcaatgaagctaatttggtattataaatattactataatataaattttgatcaaagttaaaacgtgaaacggaacggagggagtagttagaatgtaacaatagtggtgtaactacattagagttacacttcaactatacttacatttgaaagttttttaccaaaaaaaaaattgtgacagttttttagcaattccgatcgcgaattgtgccgcttcggctctcgagcaatcgcgccgcctgcgcctgacgccgtcgctgcccggccgagagagaatctcctgagtccctgatgaagtgacgagtgacacatcgacgcctgctggctgccggccttgccgcgtccctgaccggccagccgtggtgccgcgcagcgcgtgcccaccgcggccgccggactgcatgtccgcttcactgcttggtgcttggttgcttgcagatgattgccttacttcctggtaatttttaatccggtaaccctcgtgtcgcttttcaagtgaatattattgtatatcattttagaccattttacattgctatgaaacgtattacggagtataaattattgtaatattatattattattaattatgtttttatctttcgttacgactttttgcacatgcccctgaatttgatgggacagccctggttttggccgtatagaaaaatatttttttaagtactagtgtaaagacgctctcatgctcatggcttcatggggcacgtgcattcaccacagttccaccccctttcttgagtatccaatgagaatccatgtgctcactcgcttgcttctggcagacaaaaaaagtagcatagcatatgcatgcgacattctgtcttcttacactactagaaaagcattatcacaagcggccgaaaagagacttcgcaggcggggcgaccgtccgcctgtaagccaacgactgtgaagatcgccgatctttgcaggcggggcggccgtccgcctgcgaagataatttttgcaggaagacgttggctagtccggtctgcctgcgaaaataggaatcggccgcttgcaaaaaaaaaaaaaacttccgcctgcgaagataggtagaaaatattgaaatttaataataatttgcccgtaaattacttttaaattatttagtagaaattcttgcaggtagattattatgtacatatattggaagattatcaagcatttggtactgagaaatctacatatattgcataactcaaaagtgttgccaatatatatatatattacaatatttttttacattgtcacttcaaataacgtcatctagttacattatggcatagcagtgttccactcccgaagatccttgaattcgtcacttgccgctagggcaccctctgggccgaagaaatctcctttcacatgacaacactcatggcggatgaagtgacacagatcacgctggacatttgtgatacctgtatcgtcaaagcttgttcgacattctaatcttagcaactacatgcattgaaattaatcaatatattagtatcataaatatgtggagctgtctagtacatagtatagagacttatatcctccgcgttagtcctgtaccgtccattaaccctaaggaattcgcacgcataatacccgcaaaggaccgttcctcgcggttacttgtgacacttcaggacatatcatagaaaaaagtagttaaaatttttaattagtgaaacaattggaatacattaagtgagtggagtattaccagccaataggtacgtactagcagcttcaaccgtgttcgggtctgttctccacccttgaacttgtagtattggtatgcactgtatggatgtcgtaccatttcacagtaaggaggatatttatttataatacattcatatacaaatgcaagagtcataataacttactactgtaagattgttagaaattctttgtattgcttgtgactgtaatcgagagggtccaagactaccacggttccgtctttagggtggatgagtaaacagatataatgatcgctacatattaacaacaatatagttagttagtaccagctaaaataagagatatgtgtacaagataaatataccggacttacttaaaattataagcggccatgacgactttcttattttgaaagtgcaagaaggctcatccaatgtactgtgcgacagcaatcaatttttccttgtgcatgcccttcttgtattctgctatctcttttggattcttgcccttcagctggtcagaccctggtgctagcctcacggtatgctgtgtttggcagatctgagttggatccaagaagtcgatgggttcttttttattcttagcatccatgtattgcatcgtacagaagaagtttgttagtaacaatcacatggatttgtattgtacatatttttcatctaattatttaaaactcatactcacatgcaccaaacaccaacgtagttgacgtccatcttatcccgacgatatatggcgtggagatctgagaaatctagccatacgtaaccttcttcgccgaagcaatctgccggtgatcgagctgttatattgcccaagcctttcttgctggccttcatgtagaagttatgtaaccttctcatctcccatggtccttctttcagtgcccattccggcaagagtggtttcccatgttcgtactttttcgggcaatcatcagttgcgaagtatgttggcccggtgttaacaaccaaatttggtaacatcagcgtcggagagaagattagatcgaagcaaagtcggaagcgaagatcgagttcggaaatagagcaggaatcggctggggttcgtatcggctacggttaggatcggctgagtctgagtcgagctaaataagccgatatagccgattccgacaatatgacttgtacgcgacatcgggttcaagttaatgtacttcaagatgattgccacgcatggatagagtcctgggaaggcaattgtatctattaattaggatattttatgtaaattccttatagataagtgtgggcaaaagtctgccgcaaagacttattagatcttagagtttgttagagataatggtcgtgtccggtatgggcatatcttgtaatcctcgggtataaatagaccctgagccctatgtaatttttaacacacgttcaatacaatctcggcgcatcaccatccttttgctttagttttgtttcgacgagttcttgctttcgggttgagctgcatcgatttcgaacttcaacaagaggtaacattcgttatgacagattgcgttcttaggattagtgcttccatcttcatgatactctaatcttgtttatgtaattcgtcaagttatcatatatcttacataatctctagcaatatcgccatctgaactactatcggccaatatctgtatgcagaaggcagccgattaggttagatcttgacgttgatctggattatataagatatctaccattctatgaaacttctagcggcttgattgtctagatgttgctcttcttttcatacttaatgctgcatcagttgagtttgatctattaagtcgtgtttagaatatcaatctctagcctgccttccagttgccgattagaatagcatcggagtttcagccgatcgtatctgatttagccatatttattctacatgtctcattgatatgctaaatctgccctttatatcaagatattgctgcatctaaatatgttagggttttgtttgatatgttatatctgctttaatatcctgatatagagtggtatcgaagtattagccgatacacgctagatctatttgatcggctacgctataaacatatacagtcctgttattgacatatatttcgatctaagtgatttatactgtctcggcatgatgaccgatctatcccagtcacttgatttaagtatatatcgatataaggagtatatatcgttaatatctatagccgatcgagtagatttagttcttccttacttattcatgactgccgatcgatacatcgatgacatcggcccaaagataaatgatatgtcatcggcatttagccgatcggctatcatttatagatttaaccacggtttctttgcttctatttcttgttgattataggatcaaatcaactggcacgttaatacatccgaaggcgagttttggacatgcactggagttaagcagatctctcaggccacgtgttttctgtcaacacccggctagttcagcagccttctgggggtcgtcatctctgaacttagcatgttccttaccccctctgaagacggttaccatgaacttctccttgttctcatctttggagttggagtcgtggctcctaagcactcgtggcacctcagaactggtagtggccttctcagggaccgtggtctcttgcacctcggggtctttcgcaggagaagggtcttcaaatatttctggctctgtaccgtcccattccaatcctggtacttcttctatttctgacccgactgatgccacaaattgcacctctggttctgccactgtaatctccatgggcacatccggcactggaatctccatggctgcctccggcggtgcaatctccatagctgcctctggcaatgcaatctccggtggcacttccggcactggattttccttttgcatctcgggttcctccgccttatcaatcaccttcctcttaggaggtctcggaggttttcccaaccccggtttaggcaccacaggtttttgcgtggcgtcggtgcccaatccaaaggatatatcattcttgtgccaaagaattacaagatcaaccgcatccccaagtacggatacaccatatgcagtcaggaagtcaatgtcgtaggactcaaacccttcgtggaccacttgcggctgcaccttggcatacgcatcgggtatgaactcttcattgtatgttctcccagggatagcactggctgtagcggcctcaagagttttcccggagcatccaatgggaacgtgcaatctgtagggtgtattctccttgaggtcatcgaaggggtaatctggctcaggttctttggtttcggggcaaggcaaaagcatgtgcttgatgcagaaatccatcatttgcctttcaaactccgcagccccttcgtctctaagtttatccttgtacgcttcacgcttcttgtgggggtcatttttgaacccttccttccaactcatcttgctcgacacacctcgaacccttcccccatgctcaggagtacctagcgccgtacttagcacatctttctcccttttaggcttgaaagatcatttcttttgtgaactagataaattttctattttatcggcaacgctttacagctccggattttcaaaagatacttttccttcatccgtgatcttcggagttctagctcttacctagttccttgatctttgtgtccactcctccattggtaccggttgccccttcttcctcatttcctcctcctcttttgtccactgctccacctttggtgcatatcccgcggagcctaagtgatgaggaaatttgttcttcttggccaactctgcaaacatttggctcctttgaatttcttctgggaagttcttcaaggtcagaaagtcgtcccactgattgggggttatgttggcatacgtcgaaaatggtgtgcatcctgtcttcacaaatttcttgttcaaggtggttttccaaccacgccaagacttggccattgtttgcaatgcacaattcctcactgctgcctccgatccatctgagaactggaagattttcttcaactttttccataggacttccttatccccattcgatacatgatcccagtccttgaccgtgatggggatcttttcccttacaattatgccacactgtgaactgaatttcgcatgtgccgtcttaggggtgagcggctctcctttaggcgaaacatgggtaacaacatggaacccttcatcctttctattcacgcttctctcgcccttcattttcttcgcctttgctgaccgttcgcttttctttgtgccgtttgtgttagctggtacgtcgtcgtctttcgacggaacttttttcttcggctgccgttttgatcgccgtggcgccgtttcctatgagaaggtatacatggaagtttcgaattagctcgggctaatagttatcacggtgaacattttacatattaagtttacttaccccttctttagggggaatgtagtccttgtcgccttcttcaccgtcgccctttttccttctcttcgggcttgggcttggacaaggatcgcttggcgacgagtactcctcgtctttgtcagctacgtcgctgtcggaactaccttccggtgggactgttggttccggagcaaccacaacagcaagggactgctcttgctcccctaaacccttctcttcagtccctttagtactatcggtcatcgtttcaaacctctaatataaaaaaaaagagttatcagccacattttaaattactcaaattagtacaaacaactttgtacaaaaataaactgtatattaacaatatatcgtatgaacaaatttaaattctctgatattcccaaatttaactattatacaaaattaattagtacaaacaaatttaaattgcaaaatattattaattagtacttactattatgctaaattaattaatacaaacaaatttaaattgtgaaactaatgactacttactattatcaagtagtgcactaattgacagttatatttcatcgacatgttgattataaaaaattgaaaaggcaaacatatcctccacatttttttaaaaaaatgttaacataccctccaacatgttatttaaaaaatttgacaaattcacatatcctgcaaaattgaacataccctcccaatttcattcacatatcacccacattcccaaattcacattcacaatcaacatataacccctcattcaaatatcacccacccctcatgcccattcacacccacatgcacacacatatataccccctcacacccacatgcacacacatataaaaagaaacacccacatgcacacacgtccgtgttcgacgaacagccgatgacgagcttcggtcgtggacgacgaaggaagggccggcgacgaggtttggccgtggacgacgaccggccgaagacgtcgttcggccgaggacgtcttcgctcgtggacgacgatcggccgatgaagccgttcggtcgcgagcgagatagagagagaggtggcggccggcggcggtggaggggcggctgacggcgcggtgaaggggccggcggtggttgaggggccagcagcagccgcgtgcgtggtggaggggccggtggtggtggaggagccggcggtggtggagcgggcgcgcggtggaggggtccgcggcggcggcggcagagtggtggagctcgcgcgcggtggagcggcggctaggggcggcggtctcggtaacagcgcgtggacgacgacggtcggcggcgatggaggacgacggtcggagagtgaaggtcgcaggtgggcggcggcggaggacggcggaggtgtgcggcggcgaaaaaattcagtagcctgatggcgccaaaatttctagggttcccgcctggatttagaaattttggcgccgcgggcttgcccttatatagggcaacgatcttcgcaggcgggcggtctgcctgcgaagatcatcttcgcacgcgggccgtctgactgcgaagatgtaaaccctactctatataacaattttcgcaggcggaccgcccgcctgcgaaaattggtacagagttgaatatatttattccaaaatatacaaaccttaatattattacaaaatatacaaaccttagtattattacttttcaaatgtataaatggtaattgcacataaacatattactaatttaaattttttaacaaattttttacactacaaatggtaaaaatggtaattgcacataaaaataattacacttttcaaatattactaatttaaattttttaacaaattttttacactacaaatggtaattacacataaaaattagtacaaactaattaatatgcaaaatgttgagtacaattgttcgtcaatttgcgatatgatcacacatcaccttacataccatcattacataactactaacttcttagattcttacatgccactcaacaatcattaccctttaacatttttgcccacaccgttcgtgcgcatgtaaggcttcacggtcttctgagtagatgtctcgacattcttaatcttctgtacaaactgacatataaagtggcatactatcgtattggttgtaatcttcgacatcttcaaccccatccactcccaatatcttttgtttccctggtagcactatatcttcaaatttgaagggtctttcacataaaacacttgtgccacgcaattggcgagtacccaagggtcatccttgtgacccacactcgtcaggtcaacaacagtaagaccgaatttatcaacattgaccccgttcgggtattttacccattggcacttaaatatggggaattgcattgtgtgcccatagtcgatttcccatatttcttcaataaacccgaaatatgattgtttctccccggcttcatcaattgcctccacacggacaccgctgttttgcgtacaagtcttattatctcgggctcttgtgctaaactagtatccattaatgtcatatccctgccaagaatttactgtagttgatggaccacaagccaactgcttcatagttatttcattggtagtttgtccctcaggtaagtctaggtctcgcaaccaatctatgaagagacgcttgtgttctttcattatccactcggtggtgcgacctttattgttagcttgtattagttcgatatgttgatcgatgtacggctcaacgatagcaaactgatgaagcacgctgaagtgagcttcttggaatgatttgtgatcatgggtgacgaatctcttctttcctatcgttcccctgccactcaacctgccctcgtgtcggggcacaggtactccaattgcatattcatctttgaggtaatcgatacagcactcgacaacctcttcagtactataaccctcaaccattgatccctctggatttgcacgatttcagacgtaactcttcagaaccgccatgtaacgctcgtatgaccacatttgatggaggtacaatgggccaagcgcaaccatctgcggcactatgtgaacaatgaggtgctccatcatatcaaaaaatgacggagggaaacacatctcaagttggcaccgtgtctcatgtgcgaatgtacgtagatttcctaactcttcgagactaatgaccttctgtgacactgtgttgaaaaagtagcacaaccttgtgatagcaacctttaaatgctccggttttatggcccttattgcaattgcaagaaacacggtgagcaagacatggcagtcgtgtgaattataaccagataccgacaaatctttcattgaaactagtcgactgatgtttgatgagaaacctatgggcactctgacatcacggagtgagttgcaaaatgacttcttctcctcaggtgtcagtgtgaaacatgctggtggaagatatactttgccattcttttctccttcttgagggtgtaactcttccctgattctcatctcgactaggtccatccttgattgcagaccatatttagtcttcttcggcatgtccaacaatgttccaactatgttgtcaaacacattcttctctagatgcatgacgtctatggcatgccgaaccaccagatctttccagtacgggaggtacttaaaaaatatggaatgcttcttgaatgggggagggagtttatcatctggcttcgaactatcatcttgcttcttactatcccctcccttcgtattcttctcgggtttcttgcgctttgtcccctttgatggtttcttagtcatttttccaaactcgcaaacaattttctctgtcattgcacacaccttttctcccgatgtaggttttggtgcaggatcagtctcttcagtaccatcgaactccgccttcatcttgcggtacttgtgatttgtgcgtaggaaccaccggtgccgcatgtacacaagcttgttggaacccgggagatacctatagtacgttccattcaagcagatcacacatcctattttacctttaatttgacctgaaactgaaaacattgctggataatcgttaatggtcacgaagatgatggccttcactgtgaagtattcccttaagtactcgtcccacactttcaatccctctttccataaatcagccatatcttccaacaatggttcaagaattatgtcaatatcaataccaggctaacggggtccctgtatgaggatacatagtagtacgtattttcgcttttgacaaagccaggtaggaagattatacatggtgaaaagcactggccaagtactatgtgagctgctcatgtctcaaaaaggattaactccatcagtactcagggcaaatctaatgttccgtgggtctttagcaaactttctatactgagcatcaaagtttatccacttacgagcatttgccgggtgtcgaatcatcccatccttcttgcgcccttcttcatgccagcacattagttccgcatctcgcgggtttgagtatatccgtttaatgcagtctttgacaggaaggtaccacatcacaagctgcgggatttttctctgtcgtccctcagttgcttcagagggttctaggccagtattgctattcgacttgtaccggcttgcaccgcatgttggacattcatctaaagaagcgtaatctttcctgtacagtatgcagtgatttacgcacgcatgaatcttttccacaccaagtgaaagggggcatatgagtttctttgcttgatatgtgctggatggtagagagttaggcctcgggagcattttctgcagaagttctaacagactgtcgaaactggtatcagaccatccatgtctcgcctttaacctcataagttcaagaactgaccggagtgttgtgatctcactgtcacagcccttcgactcatcgtacaaaacttcctttgctgccttctgtaaagcttcaaagttatttaaccctctagccgaccccatcagcacctcgggttctgcatgacgtaacatttcctctaggtcgattttgtcctcaacagaaccatcgtcatgcaccatgtcttcaacttgtgtcggaactacattttcaggcccgtccacttgttcttcgccatgacgtgtccatatttcgtacttgtccataaatctacgagttactaagtgctccttcactttaaaagcatcgtcaaagtcccaggctatttcattcttacagtcagcacatggaccaattatcttcctcatattgttcttctcagcgtgtgccttggcaataccaataaatttagacacttcgtttctatatggagacaaaaatctcggccaatgatacatccattcccgactttccgtatctctaaaagaatacacgtaaaatatttgcacaattaataccaaatttgtagggtttattgaaaaaacttatcgctattcaaaactaattaactaaaagttaagtgtaaattaataaaaaatcaaagtttatttcaattttttttacacagacatgccaaattagtacattaggaaaatctaacaaaatcatatcatcgccatattacaaaatactataactattttttgatttcaccgaataaatagacatttaaaattttattctctctctatatatgacaagatctagatctagatctagaactaggaggtggatgtgatagcaaaaataaaaaaaattgagaatttatgttaccacattaaaccactacaacaagaggcatcaagtattgtacatacatctaacatcaacatatcaaaagaaataaaattaaaaaacatggagctcttccttcacaattttgcatgcataaatccatcacaaattaaggtataaaagcttaaaaaattgcatacctagtgtgaaaatgagtagatctaagtaccgtagaaaaatcccccgaagaattgaagttcaaaacctcccccctatatttaggtcactttaggagagagaaacttcggggagaatgaacagggctcggggaggaagaagactatataggggcatcttttcaggcaggccatataagcggcgcctgcgaagattgatcttccaggcggaccatataagcgtcgcctgcgaagattgatcttccaggcggaccatataaacaattacatgcccgcctgcgaaaatcgatcccctacgacgccgaaaatgagttttctagtagggtcagctagaatatgattcaagcatctctaatttggttcaaggagcccttgattttgagacaacatgtttcacaaaaccaagacttaattatgcaaaacacacgttaatattgtactatggaaaatgctacacgtacgactttcgcttacgatcttgatacgagcaaacgtaaatgacggagaaggcactgggtacctaacgggagcacacactaatagaaaaaagatttttcatggcgttgccctatgatttttactggcggaaaaatacgaaaactgtcagcaaaaatgtaacgaggggtggagggctacggattgccagcgaaaacaaatcttcgctggcagccgagctaagcgggccgccagtaaagatgtagccatttttgctagcagcccactcaatacactgccaacgaaaatcacatttttactggcggatggtacagagtaccgctgcttttaaagtccaccgcccacggcccacctctcgccattaaagttcacgcgtctctctcccaccgcctccctcctctctctctctgactctctcctacagcctcctctctccgactcctctcccaccgcctcctctctcgctcatccgccgcctaggcctcgatcgggagctgcggcggctcgggcgacgggcggtggtcggatcaggtggcgcggtggctcgggcgacgggcggtagccgaatctagtggcgcggcggctcgggtgacgggcggcggatccagtggcgcgaccactcgggcgacgggaaggtgagaggcggcggatccaggtctttctcccccgctcctccctcctccccttcccccgccgccaccacccctctccctctctcagatctggtgcacgggccgaaggcgctaaggttagccgactcagcgccaaccaccttggcgctaacaccctgccagcgtggcggctgagccgttccccccggtgacaatgttcctaggatctatacctatcaacatcatcataaatcagtatgaatccccaaaatattcacaatacaacggcactatacatccctcccaagttcacccttagcaaaatagtgtataacttgcaaaaacaatatgtatcctctatacgaacatcaatatacaactacaacattgcattcttacccatattccctaattcacaccacaacccgagccacattcaataacgtacggtttcaaccaaaatactctacaaaaatgatgaaaacattggggaaattagggtttttggagggaatttaccttacaaatcaatctccaacgcaatgcgtacaaaatagccttcgatttgagggatatttgaggagatattcggaggggagcagagagggcgacgtggatgaaccctagccgcgaggataaaaagaagggagtgccgggcctgggcggctcggccgcgatctataggctgcaggctcaacgcaaatgcgtttggcgaggttagccgtctcagtgccaaccgccttggcgctgagaaccctgccacgtcgaaggggattggctcggccgccacgttagcaggggttcagcgccaacacgtgtggcacggtcatgtaggaactcggtgccaacttctctggcgctgagccgatggcttatttttggttgaagttttttgttgggactactttcgaaataagtttttgaaaaggacaaatttatcaaaaaaaaagggttatgatatagcaggccaagacatcatcatgaacttgagctttggatatgggctcaatagtggaagaggaatccatttcatcgttaacaaccgctggaaagaagcgttttaccgtacaacaatcgtaaaaaagaatcgtatgtatagcagcgccgtaaaaataccacatactattttgtatatatgtgtaatgcattgagaattggatggcgtagagatatatattggttatatgattatttttgtttgttgttttttgtaaactctaaaacttgggatttagaattaagaatgcgttaagacttaaattgtttttaaaaaatacttgaacaaatggttccagttaggattacaggaagatattcttctctcgtgggttgtgcacttatatttacacgggcaaatgaaatctttcttcttttctataggaagacgagagttctagcaaatcaattaacaaagggggatggagaaagatactcctaagtgttttactccctccgtcttataaaatatcaacttctgaggatggacataaataggcatttgtctatattcatcaatagaagattttttttttacaaaaggtgtacagagtaagagccaaagcactgaactagtacaactaataaaaacagatgtagcagctttttacattacaactaataaagcactgaactaggagatcggacagatggaatcttcaagtgcaaagtagagtttttcttatttgaagacagaaaaagacagtgggctgaagtattagataaacagaacgttgatcaaaagacgtatgagtcatgtgaaggcttattggaatttgggaaggagcatctctctctctctcttgagtcctgaactagaggggactatagtcaagacttaacatctcagcttctgtatcgtgctcactttccagtttccacccaccgcatagtctccctgcagtactgtcgatcgctcaatcagatcacaagtctaggccaagatccagagggagcaaggactgctgcgcgcggcagttatggagatgctgcaaagcgtgatcaacatccgcgaagcggtctcaaccatgatcaactttggggaagcgagcaagctggagaaggatctatcctgcctcccggtctctttggacaaggctcgcgctgtcatctatcggggcgagtggggcaggttcaagaacaaggatctggcggcacttctctggcatctcaaggacgccacctatgacgcggaggatcttctccgcgagtccaatgatcaggtgctatggcagaagatggaggatgctgaccggagcttggcaggtcaatttttctcttcctctctaaatgttgtacaaactttgatcggtggtagcaagacaaggataaaggaggtccaagataagctcaacaaggctgtggctgatttagagggagagcttaattcagtgggtcttaattttgagatagttcaacacatgccagtgacaagttcagtcattggcgtgcctcaagtgtttggtcatgatgaagaacgagatctagtgattgagaagctaggtgtgatgattggacgtgacaatgaacgagatttagtgattgagaagatgggtgtgccactcaccaggtttgttgcagcacgagctaaaggaaagagagcagcagggggcactgtcgccaaatcagcatccacaccgaagcgactgaaaggagagagtagcagggctggacccagaatttctcaatccaaatgcatcggcaatgtttctatcttgcctatatttggtattggtggggtggggaagactaccttggctcagtacatctataatgacgagagggtgagatctcactttcgcatgaggacatgggtctgtgtttcagacctctttgacaagaaaaggataatagaagagatcttcaagtccatcaccaagaaagactcatcacaacatagttcaaatgatcttcaggaggaattgaagaagaagctaaagagtcaaaagttccttttggtgttggatgatatttggtccattactaatcgtgaatgggaagaacttaatgcactcttgaaggacggacttaaaggcagtatgatcttagtaactacaagattacaaaatgttgctaatcttgtttgcaccaacaactttgaaccttttgaactcaaaggattggatgaagataaattttggaatttcttcaaggactgtgcatttgggcagaagcgcccagctgattcggaatgtaataatttgcataaaattggtcagagcattgcttctcggttatgcggatctcctttggctgccaaaactctcggacgcttgttgaatatggagctaaccgtgcgacattgggagactattcagaaaagtgaattgtgggagctgccacatcaagagaatgagatattgccggcccttcaactgagctacttatatctcccacgagaacttaagagatgctttgcattctgctccatgtttccaaaagattatagctttgaatgagatgagatcgttgacatttgggtggcagagagccttgtgaaacttgtatccggagagaggacgcgtcctgaagatattgggattaggtatttggatgatttgaggagcaggtttcttttgcaaatcgatcccaagtacccggatgaaagtagatatgtcatgcatgacttgatccatgatatggcgcagtctgtttctgtgaacgaatgcctcttgctgcaagatttgagctctcggaacgagggcagaaagctacatgcagttcgccatatgtcggttcaggttgcagatgaatccttgaagagtgaactaagagacattcagtatttgaataaacttcattcacttaggttagggatcaacctcaaggtcgagattacctggtttaatcagctctccaacatcctatttatgagcctacagggttgcaaacttgtcaagctacctgagagcataggtgagttgcacagcctccgttatctcgatatatctcatagctgtgtaaaggaattgccggagaaattctggcgcctttacagcttacaagtggttgatgcaaggcgttcgagtttgagagcaattagtccggatgtcacaaagctaatcaacttgcgtcgtttagcactgccaacaaattgcgctctgaaattatcagtattgactaggcttggaaatctctctcgtctacgaaacttaaaatattttacagttgcaccaaggaatgggcggaaaattggtgagctgaaggacatggataagctcagtggaacgctaactatcaaatctatttgtaatgttaagagcaaggaagaggcttctgaggctagacttgttgacaagcaatatctcaagacactagatctatggtggcgagatagtgacggatacaatgtgatgagcagtgagaatggagtgctcgaaggcttgtgtcctccacgaagaattgaatgccttaaagtcgaaaactttaggggtgacagcttttgttctagttagtttaaaccagaaagcctaccgactataaggtccctggagcttgtcaggtgtcactgcttgaaaagtctatcgattccgtcattaccttctctggaacatctattactggcacgagtaccgattgaagaactaacagtttttgctgacgatacgccatctggttcaactgattgtgacaggatgcagcatccaagcagcagtaatggcattgtatgctttagaggcctcactagtgtacgccttatcaactgtaacgggctgcggaatcttgatcagttcttgtctccggattatctaccatccatcaagttcattgcgatcgggcgatgccttcgtctagtattacctagtttcgtgggatttgatcgcctacaagacctgagaatctcgtattgcaacgaggtgtgcccacaagaaatggttttgccatcctcactccaatgactttctattgtgaattgcggtgagcttgataggtcatttccaacctgcctacgggctctaacatctctcaccgccctgcatttggttggatgtaataacatggagtccattccgatcggcacaaactttcaggtccaatacctgcatctcaagaaatgtttgaagctatcatccatcggaggagcgcacgctctttcatcgtttcgttacgtgagcatatcggagtgcccggagcttcttcaccaagtacaacagccctttgaaagggacctgctgacaaaggaggagaaagaactccataattttcttcgactgaggctgattgattattaactcgtaaatacttccgatggattctcttctttgggcgagtaactttccgatggattttcttcatcatgcggcggcagcatccacaggccacagcactccttccagtatttcatctattttgtggttaattacccttttactggaacaaccaagtgaggtgtcttccgatgtgcttcttcctatgtagagccaattacggttgtttcctgttctgcaatttctcatgctcttttatcttcatgtatcgagccgttcttcgtgtaagctgatcatgcctgctatgtgtactagttccatgtccaatactataataataatgttgccaatactacaatgcagcatcatgagttgctgcaatctgtagttgccacttgctttacaagtttatatatgtatgggattttgcaatatttgcaatctgtaatttgtcaaatgatcgatgcattgcggaatcgagttgcttaaatatatatatgttggtacctgtgggcttggagcctttggataaaatactacatttgaccgtgctttgtttatatcattacatctttgctaggcaaataaaaaaaaatgaccacaactattgtttacaacagcagttcagatttaagtgtcaggtttagcatggtaattttattttcccgctattattcacaacttacagcatggattccgcatgaaaagaaaactagctactaaagttactcccttgcagatagcaccatgagaaggatatggttctttttcgctgatttaatggtaaccgtatgatccatctgtgaatatttggaaaaacataagcatgtgcttccaatagctacatatttgatgagaattgagtgtgtgcagtaatgcatactgttggacgaaatatagctgcagtaatcacatatgttatattacaaaacattctctgaccttctgtagctcatattttgttgtctttgctcacctgaaaccgataccaaattattttattgaagcacacaattttctgccttgcatatatacaaagttattttagcaatacccgctgcaatatgcggggtatcaactagtttaagaacataagccccggcaagtgagtgaacaacctgacacgaaacaggaatgccactggatgaactgcagaaaaccaacccttcatttcgagcagaaaaatggacgacctactgtgttgtgcaagtgtatagcaccactcctaaaactacgaacttacagaaatttaagagcggatgaacttggtgattatagaaaacgtagaaatccctggtttgagcctgatccagcacgatctcgatgaacagaaattctgcaaaatcacaacaggtgcagcaaaagaatgatacaaaaaaagggtatgtgtaaaccctctctatctacatttacatattatatcagatgcaaccaacatgaccaatcggttcaagcagtttaaaacatgtaaataaacacaacactcgtacttttgaaataaatggcaccataacatagaacatatgcaaataattgcagtacattggtttattggatacggaatggtctaaagaaccaacatgatgacacatttgatgatctgttcttttcaacaaaatatctcgtgttcaccataataattaaattaattttagtaaagtatgtcgcagaaatctcgacatacaacaattgacagttaaagctaggattatactaggatggaaagaactcaacaaattagttcacacgctcattattcttcttgagaaaaacagctttcctaccaggtgtccaggttaccagtaaaaacaactagataaggcttttatacatagcacagataaaggttgaaaatcgcaagttacaaccatgaccagtgtaagattgcaggtagtaatcatctgagttcagcatctagaatctccacatatggcagctagtaataatattaactacttcagtacagcaattagcaaggtcagttcgattcatcgactattccgtgttcaagcatcagagctatgtaattatgtttcagatcacagaattagtctttcaattcatcctataatttacaggcgtatccattttcatgcaaatagacaaatagaaattgtaaatgcatattgcataactccactggaaccaaggttaggaagaacacacctttattttgtaagagagagaattacagcagataagaaaaggttatgtgctaatggtttctagcttctgtacatcgctaggaagaatgcacttgagcaattcttagtcagcaaaatcttcagaaacgtgcagggctgaatgctcataaaccagatcatcagattgccattgtccgcttcaccaagcatcaagctcgctcccagtgtcaaccaacccctcggccacagctttcttcacccaaaactcctccaacgcatccaattcagcatcagcatcgtcatcgctcccctcaccaagatcacccacctcctcccagtcctcgccaatgccaccatcctctaacaagtcccaagattcaccatcgacctgtaccgaatcctgttcttccccatcctcctcttcatcatcttcatcactgtcatccgcaagagcaagaaggcccttcttcttagcccgcctcatccgcttcccctcgcggacaagctcctcaagccgatccctcgcaacaagcatatcatcctccacaagtagcctaccgtcatcgtcgaacgcctcgacaaggaacaccgagtgccgcaaccccttgacactaacatagaacaactctgggtgccgaactagcattgcgcgcagccggttcggtagcccgaaatcacgcctgaaatgtgtgagatgatccaccagtgttctcttctccacagtcatggccaggacctcccggacaaccgcgcacgcccgtcgctccatcatctccaagcttgcgccctcatcgagtggctcgaatggcgacacctcgggcaggctatggaaccgcaagaggtaatcccggtgcgcgcggcggaggttgagccctcgccggagcttgaggtgggggaaccttcgtggccggtcaatgaggcggtcggatggcgccgcggggcggaaaggcgggagcggcggaggcggtggcggcgggggatcgactagctggagtgcgtggccgtgggaggtgttcacgaaggtgaagaggtcggggtgctgcgggcagagcgtggcgcggaagtccatggcgaggccgagatcgggtgcgaggtgagcaatcttggacacgaggaggctccgcccgggtgccagaaggaggaggcggtgcatcttggcggcgaggcgtggcgcgagctcggaggagccacggagcgcggcgaggtcggcggcgagcgcctccgcggcgggggtgagcgcgacggcgagggtggagaggttgggcgagagcgggtgcgacgtgggcgcctggaagaggcggaacagcgccgggtaccggagcacgaacgggaccagcgggcggcggcggcggtgcggcgggaggccgaggtagcggtggcagcggcggagcacgcggagcgggaggaagcggcgcggcttggagaggagcaggacgaggagcttgcgggcgaagcggaggcggttggcgcgcgccgcctggcggtccagcgccgggcaccgcaccagcttcggcggcgggattgacctcgcggacgccgcagacgccgccgacggcgccgccgcgggcgcgggcgtgcagcgtacggccgtcggagtgggcggcgcggcggtggagggcgggggattggggaggcggacgcggcgggggtggatgggttgcggcgagaggaaggagagggaggaggaggaggaggcggtggtcgccatggcgagcggattgtggggaatgtgtggggtttgagatgagagacaggataggaggaaaaaggggttttgggctttttctttttttcgtgggaaattttattttcagtgttccattcttggcttttgtttcatggaaattcacaaagctgcgttaaacgaagcaatgaattaacacatgttaattattaataagtattaactaaaaagtttaaaatattaacatgaatgttaaaagcaacttttctatatttttttaaagaaaaatatattgtttaacaatttagaaaatgtgcctatagaaaacgagttataggagttagaaaagtgatcaaaagaacacacatccgtaaatctctctctatcaataaaattaagatattgtaagacagtaccagcagtaactacatattacattagtatcatatttgaacgtgtcttacctatactatcaataaaaaaagggcatttacaaatttaccactgtttttttttaattttgtaaggatgctactcgaatgatagttccagtggtatttttgcaattttttagtggtagtttcgcaataacgattcaaaaccgtggtaaatttacaattgccaaaaaaaaaaaagatgctagtggaccatcactacccaactatcatgttgaaatcataaaaaaggataaaactttgtttacaacaaaattagcagcatggtaatataagggtgctttagggcgggcttttgaacccatttttgcttttacaaaagcaaaaaccaaccaaaaagctcaaaagccatagctgcttctacccaaaaactgcttttgctctagtacaaattgaaagcacctctatctcctgctttgagctgcttttgggtagctcctccaacacacgcggctgtggcctcactaggcgaggcgagctcccggcaaggcggcgagttcctcccccaccgccgccacccacggggagaggatcttcccagcctgctgctatcgccgcgtttcccccctctaatttgccaccgccgtcaccggccgatgccccctcctctcccgctgacgctacccatggggagaggatcccgccgaggccacgcgtagcgagacgatctcaccgaggccgctcgtcggtctgccgccactgccgcgtttccccctccaatccgccaccgccatctccggctgatgccctcctctcccggtgccgccgccccttcgcccgtcggccgtggaggtgggagacgagagaggtgaggtggtcaacggcggtggcaacaccactgcctccttctcccggggccaccgcccccttcgcccgtcaggcatggtggccgccgctgctccagccgcaccgactccaccgcgcacgtctgcctccccgctgctgccgccgaggccaacggcgatggcgatggccatctccatctcttcctcttctcgtttttttcaacgtgtgtatgacatgtgaggcccgtttgtcagcaggactagttatttcaaaagctacagttgttaaaccaaacgagctttttcaaaaggcagggaccatattccaccgttgcttttataaagccacaggcccacaactcatagctacttttccaaaagccacatctcaaacaaacaaaccctaagtagataacatatttttaagactttaataaaattatatataatgggctatttttaatttaaaaaatccgttgtaacgtatgtgcattatgctagtagagaaaatatatctgatgatattaatatcataataagaacaaatatatcaaactagcttgtctttaattacgcaagtactataatcatagggttgtatccaagaattttagtcaccgagctaaaggcacaaggacaccgtacattttggagaatgtcgataaaaaaataattttgcttcattacataactgaatcatacgatttttcatcgtactaagaagtatattaggcattcatgattaaagactaagatattagtcagataacactagtatatatgttaggagtaccatacattaggtgagttggcagccacccgatcaaaaaaatagtgcgacagagtgttaatggttctgtatctacagtaaattaacattgttcattgcgttggtctactgtaatactcacatggatagtgaacctctgcactaatatgcagaggatcgggctttcgggtctgctctctgcaacagttcattttgaacaattcatctgatctctaattctatagtagaccctatttatatgggactaaaacttttataaatattaaacgtagactataataaaatctattcataattttggactaattcgcgagatgaatctagtgagcctaattaatccataattagcctatgtgatgttacagtaaactaattaggcttaaaaagtttgtctcgtaaattagctttcatttatataattagttttgtaaatagtttatatttaatacttttaaattagtggacacctgtatccaaacaccaccttacactgtttttccaccaccaacttcaatacgtgtcgcgcttcgtcgctgtaatctcaaaaccatagaactaacagccacgtacacataaaccgccacagtttcttctcagtacacgtctcagctatgtcacctagtacacatgctcaggaccaagaacggcatttccctcaatatctgatagttctaatccttctgcctcccaagcccaaaaagccccatacaccatccacgcaggtaaaattgagaaagggaatcaactatgcataatttatcacttcaggctagggaagcggaagagccatcggattttatagtcaagctatttacaccttgccaactacatcacattttggccacgagtagtgtgcagtcattcaccacatgaatacgcaggtggcagtcgttactgtcagtgacgtggctcagtttatcacacatcggactaaatattcttctccatcacatcaacccatacgactccaagaacttacacaatggtccgaggggtggaaacgcgggaccgtgccagtccgtagctccactctaaaacgcgggatcgtcgtggtcccacggctccagaacgcagcactgacgtagctagcgattttttactgtgttggtactgttcaccactatttgggtcactgttttggcactgttcgacactatccacgattcgttccgcacaatggaacagcgggaccgatgcgtgaacaatgtcaaacagtactaaaaacaatgtaaaattgctcactatcacggtcctgtattttggagctacgggactatcgcggagccacgcgactgtcccgcgggactgtcggtcccgtattttggagctgcgggaccatcgcgggacaggtaaatttttgcaattccttcctatgcatgtatataaacgtaaattattgaaaaaataagtatattcgtaatttttttctaagtatagttagcatattatgacactgctaagcatgttatgataccaatgaactttttttttatacgccgcttattgaatcatgcgatttttcattgtactaagaattatattaggcattcatggttaaagactaagatattagtgagataacatttacttctactcatccttttggtattccctaaaatgacttgtacaacaatatcatcatatttaatcttcaaaacatacttatttctcttagccaaatggttctgtatctacagtaccgttcattgcattgatcaactgtgacgcagaggatccggattttgggtctgctctctgcaacggttcattttgaaccattcattccatatctacttctctagttatactgttttttcaccacaaacttcaatacgtttcatgctttgccgctgtaatctcaaaaccatagagctaacacccacctacacataaatcgcctcaatttctttgtacgtgtctcagctatgtcacctagtacacatgctcaggagcaagacagcagtgtttcccgaatttttttgagaattaatattatttttatggaaaatcgcaaaagtagtggccaacgggggaaaatcgcgaaagtaggtccctgtcgaacgggtgcaattcgatagggcacctatcgaacgacgggcagtcgacaaaaccctgtcgaacggctggcgttcgacacgctcacctgtcgaacggagggagttcgacagggcccaccacccggcgccgcgaggcctgtcgaaccgggggcgttcgacatggccctccaccgaccctgtcgaacaatgggcgttcgacaggccggtttaaagccccgtccacccaggccgcgagttcgatttgtttgaggaccacatcgccagccgccgccgagagtcgccacatcgtcgccgtgagcgccggagggagcgaggggaggggatagcaggccggagaggaggccgaggaggcgccggccgggaggaaagggttggcgacgccctctagcagtgaagttaaggtatacattagtaatccataagtacaatgcatatgaaagtttaataaaaaattggtttaagagttgttaattgtttcgcattgttcgatgttagtatgtatggttagcacatatttgttattgctaaatgttggtagaggtatttaagtaattgtacggttaaattagttcttagttagtacatattattgatatgttatgtgttaaaataggtacaaaggtgttatattttatttggattattaaactagttgtttgttactaatagttgtaaattagtacacgacaatgtagtataagttgtaatagggtaattatgaatgattaaatgattaaacgtgagactattttttcattttcatcaaggatgtcaggtgatatgcccatttgtctgtattatggggatggttttaacccaatattgtaaaacggggtgggtttggactggtatatcctttcccatgatactagtctaatgcaccggagcatatgggtttgaacgacgtgttagggtggttgtataatatgtttagggtagatccagtgcacgataaatttgtcataaatgccgtgtggccagtgaggggtcaacatggatggcagtggagagtagtggaggttgcgtcaactgggagttggaggaagtttgttagtaaagtaagggagaaaggctatagcctggcaatagtggtgcagaagacaacatgtgttgatcgatcgggggagtcaagtcatgccgtggtggaagaaacaacgttggaaggtggacaagctgaaaatgtttggcggactgagcaaggtcgaggggaagaagtagtagagggtaatacacaaggagaggtcattgttcgtggtactaatcgtgaggccaacgactcggatgatgaagaaccggattcgcctatgcgtgttgatgcaacggaggagaatgaggcggtagtggatcagatggaagtggaaaacgaggaataccttgcgcttgtagtggaaggagaagatacaacactgtgggacaacgaaactaacatacccgatgattggacgaccatatcaatgagtcgtatgaaggtaaacgatggtttagatgcccactggtgttatgatagtaagcaggtgaaagttggacagatgtttcatgacaaaggtcacttacaagatgcggtgaagaggtgggcatttgtccagaagcgtgagttcagggtgaaggtttcaaataggacgacgtatgacgtgaagtgcatacagggtggatgtccttggagagtgcatggttacaagccacaacatgacactttatgggtagcttcgagagttgagcaacatacgtgtttgttggagaatacccgtctggtgcacagaaacctgacagcggcatttgtggcacaaatggtatattcaaaggtggttagaaaaacatctttgtcccctttcaccataatgcatgacgttgagaaagagtacggatatgagatatcgtacgacaaggcttggagggcaaaacagaaagcattggagatgaggtttggaacttatgaggattcttatcacaatcttcatccactattggaggtgatgcaggcaagaaacccgggcacacacatggctattctcgatgaggtgaatgaatatggggagaatgttcttcgtcgggctttctggtcatttgggtgcatgatagaggcctttagaaattgcattcctttgctctgtgttaatggcactttcatgacaggcaagtacagaggaacaattctaaccgcgatcggagtcgacgcggatagccatgtcgttcctgttgcttttgcatttgttgaaagcgagaacacatcaagctggctatggtttttgcggcacattaaaatgtgtgttgttgaaaacagaccaaatgtgtgtgttctgcatgaccgacacgccggtttgctatcagcgatacagaagcttcaagaagatgtcacacagtccgtgccatggccagatttacatagcagatggtgcatgcgacattttggggctaatttttatagacaattcaggagtaagagattgatggacctgttcaagaagttatgcaagcataatcaacaaagaaagtttgatgccatatgggatcaactggatcgtttgaccactacacacatggaagatgttaggaaaaaacctatagttgccagacaggaggagccggagggacttgaacccattcctaatgaagcaccaagtattactcggcgcaggaagcgtggaagggccacgaagtgcttcacggagtgggtagaatttgagccaagggagaaatggtcgttgttgtacgatacagatggatcgaggtatggtgtgatgacaacaaatcttgctgaagtgtataactgggttatgaagaatacacgacctctaccacttgttgctatcctggagggcatcacgaggggtacacagaaatatctctgtaaaaggtattccatggctagtctgaaccttagcaaacccagtgttaagtatagccccgttattacacagtacatggatgagaaaagtaagaagggaggaatccacagagtgtggcctgctgggaatagagagttgttatttgagatacgacttcgtgacaagagtggtgtcggcattgggactactgacatcacattggaatgcacgttgtggccagagtatcacgcttgcaaatgcaattgcaacaagacttacctgttacatcggccatgttcccatgttcttgctgcttccgcaaaagggggtgttgatggaaacatttttgtttctccctactttagaaaggaatcgtgggaggcaacttggcgtggtgaattgcgtggttggcgtgccttgtgcgatttcattcgtcctcctccagggcaagccaattgggttcctgactcaaatttattagttgatactaagggtcgtcgccagtcgcgcaggatcaagaaccttatggatgaagctgaagtgaaagatcgttctcgtcgtaagaaagcttgcattctttgtggggagaaccattcccgtaaagattgcagcatgtacaatgtagggcaagatgccacaggcgctgatgttcgtcgcgttccaaaggggaagtcgaagaagaaaaataatccttagttcgctattatccttggtggactccctactttgaagatcgttatctttcaatttatgtttagtgcgtctgtaattttaatttgaactttcttgcacttttattacccgaatctatttgtaatggccttgtaattttcattttgaactgcactgcacttttaatatcgtcatgtatttgtattggaattgtaatttaaatttcgaactgcactgcacttgtaatatcataatatatgtgtcgtgggcttgtaattttaaattgaaatgtactgaactgttcttatctgtatctatgtgtgctggtactgtaattttaaattgaaatggcatgcaaatttgttacttgaattatgttgcatacatttactgtactgttaccatacgtgcattgtactaatgtggttttcgatctgcaggtatggctgatcaatatgatgggcagctgatagacaaggagatcgataggaaccatcgatcgcgacgtcttagtacaggaactttctgcaatgtgctaaagatgcgaggaccggatcaatattggcgtattgatcctcgttgggtttcaaggtgtgtgaaaaaatattgtttttactaatacaaggtgtttatattttcatgtattaataacttgcgctctgtcatgttgtaggctgagagcagctgggttgttgacgtttgcacggttggtcgagccttcacgtgcaaggtccgaacgaatccacattgacgcggcgcttctgagtgctcttgtggatagatggaggcctgagacccacactttccacctcacagttggagagatggtgcccactctgcaggatgtgtcttatttgttggggctgctgataactgggccagcagttggcccaacaatggtgaatgctggatgggcggatgaccttctggccagttttggtggtgtgctgcctgttgcactggaggatctcacagatgggcacgggcctacgaaaagttggttgaatcagtttcgacaggatgtcttccctgatgaccaggaggagtggatcgtgcagcggcacttagtcgcttacctgttgtggttgtttggatgggtgatgttcacgggaactcacgctgactccgtggacaagcacttcatccactttgcggagcagattgcagagttacctatcgcggagattccacagtacagttgggggtcggcggtacttgcggcgacatatgccggactgtgtgatgcttgcgtgaggaacagcaagcaaagttcactccctggatgcccgttgctacttatgttgtgggcgcacgagcgcttcgacattgggaggcctcagcttgactcgtacgcaaactacggtttgcgagagatgtacaggtctggtgttgatgacatcgacgatcgtcccactatgggatccttgtggacacaccgtgaggtattttttgttaaattcgtttatgttatcattatgaatactagttcacaaactttccttatatgactaatgaaaactactacttgttacagccgcagtgggttagcgggacgacacgtcgtgtctacactcagtttgtagctgactttgatcagcttacgcctgaccgtgttcggtggactccctacactcagcacgatgtcaatgatcgtgcaccgcacggtctcgcagatctttgcacgcgagatatgcaactctggatgacgacttgtcacctcgtggtggacgtgcacgtcgagccacacaatgtctacagggttctcaaacagttgggcatgtatctggacttccctccgagagatggtcgtcctttggctgatagtcttcataggttagttcacatcacagttgtttaatcctacatttttaaaataaatcactgcacaacattttttctgatgtgtgaatttgttgttgtgcaggtactccagaaaggggctcgggctttcctacgagctagttattgtgaccacggttcagccgacggtacaagagtgggagcacgcagctgataacttggcacttcagacacctccagacgatgggagttattatggagcttaccttcattggtatcgcagtgttacacgatggaggtgttttcctccacaaggagatagcaccgtcccccaccaggcagcgattactgacacgtttgcccctcagcctagatcagcttacaactcaatggtacgtgtttatttgtggaatttgagcaactagttcaatatttttaaaaagttagcaagtagttcagtatgtctaataaatgtgcaattggttcaactagttccttttcttacataaatgtggaactagttcagtatttataaatgatgtgcaactggttcattatttctaacaaatgtgcatcttgttaaatactcttaataaatgtgtaactggttaaataattttaattgccttgattatttgtggaacaggcggaatttgttgagcatgttcacgtggagtccgacaccctactgcaaagactagaggcaagacctccagtcgtcaggcttgacgacgtggcgagcatccttcgcaacttccgtgcacgtgctgccgcactactacgtcgtgtctcctgtcggagcgcggcagatgtggtgcagacgtcgggccgacggccatcaccaccactaccccgacgttccagcatggatcggagtggtccatcctcttcacgtcgcgggtacgaagcggcccacacatctcacggtcatccttcctttcagcacaccccagcaccggagtacaccagggggtcagccggatcaggggtacccacgtcgagcacggcaccaccacgtccgcaggtattccaaactccgccttatgttcacccctcgcagggagcatctgggtcggcacacttcccttacatgccaacgggggacaacgtgttgaacacaccagcatggggacttcatatcactccgcgtgcgccagagcagggccacacacagcacacatgtaagtcattttaaacaataacacgctttagtttctaattatatgtatcgttactaactacgccatattttttggtttctccctcttgtgcaaacagacgatgagtacggttcggcgtcgacgcatcacggaatgcctgcttactcccctcgcacaacattcattgaggacttcttttccactgatcctccccagggggaagtagggatggattactggcacgcagcacctcaggtcacacagccgacgcaggagacggaggccggtcaggggccagacgtgacaccacagcaggcagctagagataggcacccccctgataatttgacatatcccactgagcagattaggcgtaggaagaagggaggacctagcaagcgtgcgaagggcactgatcgtccttgacttatctatttgtattaaacttttagtcatttatgttctgtccgtactatttgagaaacactttacgattaacttagtactatcagtactatttcataaatttcttcagataattactcagtagcatacccttcgaatgaatcatgacaaattatcattcaaatatacaaataatgaaactaaataattcaaatattttaaccaacaaataaatactacaatttctgaccaaacattatcaaaaccctaaatcatatacatataacattacaaaaatattttcctttcttacacactaaaataaattacatattattaaaaaaaataacttattacaaataaatggagaacgcgaccctgtcgaactgcgccagttcgacggacatcctgtcgaacaggggcagttcgacagccctgcctgtcgaacggggctgttcgacaggtcctgtcgaacggcagccttccgatctcctcgccagtcgcgctctggccgttcgataggcgccctatcgaactgcacccgttcgacagggacctactttcgcgattttccccggttgaccactacttttgcaattttccataaaaataatattaattctcaaaaaaattcgtgtttccctcaccggctgatagttctaaaccttgtgcctcccaagcccaaaaagcccgaaacaccatccacgcagctaagaccctgtttagatgggactaaaactttaagtccctatcacatcgaatgttttgacactaattataaatactagtaatatgcctgtactaacgttacggtgatgtttcataagacaacagtgacaaacagaaaatgcactgtttcattaggcaacggtgataaacagaaatgaaattcctgctgagaatgaaaacaactttacagtgtaaatgaaaatgatgctgaccaataagtttactttcacaggtgtaaaggccgggtttaatataaatccattatcttaaaaaataagtatacttgttcctcgcaacatactgtttacacataaaacttactaacaaataaaactcattgcatgatcagcttcacttaagctttcagaaaggttctctaaaagataatagcaacacatacaacaggagtggagaccaaacataatttacagggtcattcacatgtacaagtgcaatagacatgctttctccttttctcgcctctagaagtaggaatattgattcaaaagaatggtatgctaatagttcacaatcctactctcccaagttactctaggaatgttgactttgaagatcatctgatttccaaacaacatcatttaaggtgttggagagattcttgcaaaacttacacattaaaattacgtgattcagtacaagacatttaatcaaaggctaaaaattaaacgataaattataaataagtgaaacccaatttactaagcttggagaagaataggctaggacgaaatcttatcagattaatgactcaaattttccaatgaaagcccatgaacataaggtcttaattcacatgatcgccacgtaaaatatctacctcgtggaattccaggttgcaccctctcttcatttggttgataataatgcacaataacagttagattgaagattgaaaaagtttttacacaaagcagattgcaatatagcatttttttatattgcctcattagcaacattgggatttccttttctccttgtttttaccttttccagaaactattcaatcatcaactaaaaagttcaacacgcagcaaatatctatttcaatttgctataaattatgcctagaaggctagaacctatttttttcaagggaaatttatgcaaatagttgttggacaaggggagcagaccttgtaaatttttctgcacatggaatacaacagttaatctgcatgagaagctgagagagtaaaaaaaaatctgaaggctcataaaaatctgaatttatgcaccatacagaggatatatataatactattatgaactgtaagtctgcagtatataagaacatttgtaagaggtggcacggcgtattcgaatactcaacgactctgcagcgtctgcccagctttacccacacgatacccacagctggccgggctgaaaagtaacaaggtgtaatattgctccatatatctctcccttctgcctagtaagttaaaggatgctcgggatgttgctcggagtgatccggtccaaggtgtgtaccaacctacctctgcatccacttaccattgttcgttattcgatgggcagcccagaacttcatggacccatagggtagttctgaactctcagggcccatcgagcccacatatataaatcatataaacatgaaccatttcactttgcttcacacacttgaaagctaatggccagtacaccgaaaggccttcagaagtttaatcaattggagcaatatacgaccaggttctacaaatcgatcgtgtggatgggcgaaactatgtcattcttattgacacaagggggttgattattatatcaattttaaataagaaataaccatagatatatccatatatccatcacaaccataaaaaggtccataaaaccaaacacatgaactctatcatgtgtaccatccgctcacaagcggtgttaacaattcttagcatatagctataaatagttccataagcatgttttcatatgcaatgataatatccatactaaatcgatagcatgctaaataattaatagtttgtttaagtgtttctcaaattttatcctaaatttgttagactctaaggctcattaaggtgtttataataacaacagaaaatataatgcaataatagtaatataattaatttaaaaggattcatgcagtctatcgtactccaaaggacaagtacgctaccaaaataactctctaactactgggattagattgttcaagggagggtgcatatcttgcaaccttcgggcttgatgtagtcgtacaaaccgtctcctcctatcgcggagatttcactcgctccgactaccggaccagcgtcagcgttttctatttacgcaacaatcatcaccacaataaataacagaaaaacaaagataaccaaaagaaaatagtatcacaaagtgcaacaatgggtgaaaaggatttaaagaaataatttttggaatttcggtgaacggcgaaccctagggctaaaattagggtcgcgacaacgggtgcttgaattgcaacgaaactgacacgcatggattcggaataattctaggagtttagaataggtctcagattttgattttgaggtcaaacggatggtcaacttgataggaagataaaaaggatttttctgattaatttttcaacagaaaaatcggatttttcttttcttctctcgctctgcacaggaacggctgacaactccatggcgccagtggtggagatggccggttttgggcaaaggggcgccggttttgtgatctacagggtgcagcgactctgttcccgtggttggcggcggtgcaggcggcggcggcctggagcaggaggcggcagcggccatggtcgcggtggttccagcgaacttcggtgagggtgatggctatggtgagcatcagtagagcaaggggagcgcggtggtggcggcagctcggcctggggcggcctggagctgtggccgaacagagcggcgacaccgggaggcggcgccggcggcactccggcgtcggattagatgggggaagagaggggaaagggagtactcggcatagagaatccgtttttaccttcaatttcagaggatttgcgatgtatgcgacaaattttggagctcaatcaatggcgccgatattagggtttcggggaattttccagcgggggtaggggcggatttgaggaggtgaaagaggtttaaattgcgcttcttttgcctccggtattgagtcttctagttaaggaacgaaggagatacggaggcgggaagctggaggtgtcacggcggcattcgttcgtcgttcgtcctcgtgcgagcgtgtgcgggcgtgtggcgcgcgcggggcggcacgagctcggcgcgagcgtgcgcgggattggtgcaaggcaacacggcgctggctcggtccggaaatgcgggctgcaggaat

SEQ ID NO: 82923 - DNA, 633 bp, Oryza sativa
attcctgcagccctaatcgcacggtgggtatgttactgtactgcccagatcggtgaccgtacaagccggagcgggtcggatggcatcggtcttatccgcaaaccaaccaaccgactcccccctgcgtcgtttggctggtgtgccgctcacgttctcgcttgtcctctttcgctgctgctgaccccagcagccacgaccgcagggagcatgggatcttcagtgccgtcccatgtgtacaatgaatatgcctggcctaaataaagcctgaaaatcacattgcaaagcaagtcaaattaacacagtagtaagcaggtgcggtgagagattgtcttggactgattttgtgtggtgtcttgtgggttgcaggagatttgtgagcgcttcagcctacgacaagaacgtggaagagcaggtgcgcccggcggtggtgccggacgatgtgatcggcagcgtcgggagccctgacaagtactggggccctcacccgaccaccggcgtgttcgggccagcggcggtggacgccaaggcggcggcggccgttggcgcggcgaaggccggcgcgaatggtggcgcctccgtgctcgaccagaaggtttggttccgccccctcgaggacgttgagaagcctcccgt

SEQ ID NO: 82924 - DNA, 32470 bp, Oryza sativa
  unsure (1)..(32470): unsure at all n locations
cattcacaattgagcaaatgacaagaagaaaccatgcttcacaacttcaaaatacaaacatgaatagtaccaatttatcatcaaatgtgaacgaatacaaaatattgtctgaagagaaagctaagctagttgctaacttaaagcaaatgaggtgtcatggttggaaaagttataaagcatatacgaattttagtgttgtcgcaaagtttttaaaggcatttttatgataaaaccttgtacgcacacaacaaacgtgcatgaattattaaatgaactcttgtgagattttatttttcaactctacactttaagtaccttcatttagttttaatgtataagaacttataagggagtgtgaataatgacatcatttaccatttccatcggggtatagaaatgagtatagatgtcacttatttctattttgctttgaatggcaggaaattatctattcataataatgagctggtttttatctacaaaatgactgggaaagttaaagttttgccaaagataaaataagaaagatattgctgtaaagtgcccattaatactcattattgtttcctaagtataaaaaaattccccctatatattggtcactattctcctttgatagtatgtcagatctaacagatctctcccttgtaaaacagagtgaacatttgaagaacggtttgtgtgtgctgagatcttccaagcttttgttaatttttgttattgattttctttactgtgcttgcaactggtatctagactatcttgtatcctcttgatttgaccgcatatatgttcttctgctataagcatgatttgtatttgttggttttttggatcgtgttctaatataaagtgatctgcatatataagctagacctgcatgttatccatcttttgtaatactttgccacgtactttgcataacatgttattatacgtagtatagtttctgtatgagggaggaacaaagagccggtaagatttttaggtatataccgctgaagtgtaaatatggtatgtgccatatttacttcacttctagttcatcctaagtatgatttgtcaatttatgtattagagaaaatgttgtacatctaacctcaatagatcttgactgatgtatcactgactttgtttttccttccattttctatccaggcaaacaaaaccaactgagggtctttcacatgggaaagtacgagccagaggcgccaattgccacagtggaagatcccatatcatcgcatgataagttagaaaacactgagatggtggccagcctagagatgctaggtaatatgactgacaaaccgttagcgccattggagatgctacccaaggtcaaattaagcgtggagactcctcctgctccaatgagtctacctatgaggtttggtaatggaggttgtcacattgatctgaatgatcaaccaccagaggtagagaagttagttgatgaaactctgaagatatcaggagaagagatcaaagccaacatagagctgcctgctccagttagccctccaaggagctttggcactgggggttgtggatgtgatctcaatgagatgccagaagataatgatgagtcctaaaaggtggtattatttccttaggaaccattgcttggggtgctccaatcattcatatgtgtggtttttctcttaggtttcgaaattgtctggtgaactggttggttaccttttcttcattgtcgaatttcatagcctttgatctttcgaggctggaatttagtaagaattgatggcaaataaattatttacagttgcttttatgttcccttttcggcttttcctatgggttgtttttgcttgatatatgttcttatgtgcaaagaaaaaaaaaagacacatcttgcattagactctgttgctaccatttgaaagggcaaggatttcgggatgagtatttgaagtaaacaaatgcttttagtccagaaaaaagcaagatgctcttaaatcaaattaaaaactgaagtttttttttgaatgcgcaaaaggattgcatgttatttgattaggagaaaacatttaggttacacacaatccataggccggagttgttagaattatatataccccggaatgctcccagcgtaggatattcatcatgcacgtagcagggagagaaatcttatcttagctaaaaggagctacgagtattacagcaaggagcgctacaaaggaaaaaaatacagtccaaggggtaaggaagaaaggttcatatgctcccaactaggctcctaacttagatgcgtcggacatgaccattcccgcccctcttgcaggattaaatcgatgacggcaagcattgagaatagggtcccattaagacgcgagcattacactccctccacagttgccaagaaacaaggagcacaaatgagttgaaggcacgtcggaggttgggtggcagctgctaccacgcatcatgctgtcttgagcccttgacgagcgaccgagagcaatggcagcccagccaagtaaggaaaacaccctaaactacaaccggtgagcaaagacaaactacaagaggtgtggttgactgtttactgatcctaggcacagaatggacttgtgcagtggctgtccataccccacacagcatcagagataagtggtcaaacaccatctttgtagcgccagccaaaggaagaacctgcacttccgcggtccttgtgcatgccatagaagattggcacatgtgaagaactgctgcccacgaaggatgcttgcagtagaagaaacaaagaactcggcatcacttgtccatcgtcaaagaaggcagtcccccacatcaggctgcaattggaatagctgcactctttaaaaaattgaagtattctttcagatacatccaattcaatcattttactttataggttacaaaaagcctatttaactttgtgatcattcaaatattgttccacatgatattcctttgcttattctttacatatttattctatgtttgatagatcaaatgattgattgaaaaaatcctatggacactagcggctcctactagaagaagaaataataaccattagctcttcaaccaaaaagatttcaattccataaatccataaaccaaaccttgttttttcaatttgtactagatactgctgttgttatttgaattcaatgagtggttggttgctgacatttagatacaaaccagcaattgaaaattatttgaagaacactaggaaatgggaatttactaattcttctctatgatcgtatgcctatcaatcaattccaacaacacgttccttgtgcagctagagggtagtccctaggagtgctcgggggaacccaagctcttctctctgctagattggttcaagtcctgttgtttctcgtcaatgtgcatgcctttcttagaggctatatatggcttatatacattgagatgctcccttgggggcaccgacaaatctactattacataaatcatggctctattatttctcgcaacgtgctctaccatcttgctagcctgacacctttggacatgctctacagtgacctcttaagatgtctgagatgggatgcctacttttcccgctcctgatggtacatggaagttgtgagagggggcggaaatatgcctaatgaagcttggcaatgcgacatgcatcataaataaggaatgacaggatgtagtgtgcacactccctattgcgtgtgcacggtgagtaatacctctgaccacgtcaagaccggtcaaagctagatgacttccacgcctctttatttggtggtcgtgggccaccatgacatgtcatggaagcttgattttttaagttttaatttcttgttttgtaagtgatgggaataggtagagttttggatagagaactaggttttttattacgatggagtgccaaaatttgacatgataagataaaggggattgaaaaggagagatttattttgaccggaactcttgtctgcgttataagcaaggggttcccatcacacctagactaattccatgtgggcagggggttagcccctgaactcaaaggcacaaaagacagtccaagaataggcagagcacaccacgtggcgcagctgccccctgagcagggtaggtccaatggttgccaaacggaggcagctagaggtcttgtcgatcgagtgagaatgtgccaaaggataaccatctgatctgctaggccgaatagaggacgaagcattaaaaggcccatctgatctccttggtcgctctcttgtagcagcgtagggcatctatgtcaactaccgaagggtggctagaagttaattctataccgagtcgaacaggtttcttcggttttagcgagaagcttcggttttcatatggactttcttcaattgttggtttgcatcctcttgaaccgaactcctagataaaactgaaaacaacattgtcagcagctggaactagggtggctgttctcgatccggttttcttggtcggtctataaaaagttcagtctttgcaaagtaatgacaaaagttagcatgaacatttgatggaactcgagtccagtctttggttttctcagtttggtctttggtcttgaccgagtagaccgaagtgaagaaacttcaacaaaatcagacaaacaaattgaacgaaaaaaaaccacaaatcgactaccacatataaatgaattagagcgaaaaaaatgatctatgatgttctgtgttttgttgtagggatgccagagtggctggggagacacctgtcatcacggggaggacagtagcattatgccttttagcacagggaggctagggaattatttgtcgttgtggaccacagcggaggagtcggactggacctcgcaaaggcaaagcgccttgactggtggtggaggcgtacgtagttggagatagcagcgccgccaatgcacgccgcaagtagcagccttgcaggccatgggatctcatgatgccttgacatgaggcctagcgccctgacataggtaggagtggcaatttccaccagagtcgaggacgggaaatttggtcccatgggtggattgggacagggccccgaggtaatatggggtggggatggcgacatgatttggaatcataccatgcacctatgttggcccgatagccctattagaggagttcacatacatttggagaaactctaatcgtgttatcatcttgttcccttaccattgccgcatgccaagtggatacacgactcagcttctgctatgctcggtgactccgtttcattgtcgcacccaattagaggtgggcactcggtttatttggtgttctataagttcagtttctcaaaatttctacctgaatatcctcattagaaaataaaaccgagaacaataaacctcattcaatttttgttttataccgaactttatggtataaaacggttagtatgcacacacgtacaaatgtgcgggaattattaaattgactcctgcaggaacatattttttcaggtctattatttagttgactttcatttagttttgaatgtacaagaacttattaggatgatgatgaatcatgccatttaccatttccgtaggtgatatagtatggatatagctgccaattatgtctcttttcttttgaatggtagtaattaatttgtttataatgaacaagacagtttttatctaggaaattaaagtttttccaaagacaaaatagaaaagatattgttataattaatgtgttcattagtactcattattatttcatacttataaacacatttacccaattatatattggtggtcgttctcctttgatagacacttcgaacatctatcccttgcagacagagtaaacatttcacaaacagttggtatgcaatgatatctctcatgctttttttatccttttatcaatgcatgttattgattttgtttactgttcttgcaattgatatcaagaggatgattttgtatctcttgatttgactgcatatatgttctttttacataaacttgatttgattatttttgtttgtttggattgtgttctaacatgaagtgatctgcatatatgagacctctatattatgcatcttacatacttttgcccactgtatagtttctgtatgaggcaggaacaacaaggcatgttatgtttttacgtttataccaccaaagtgttaatatattactttacttttagttcaacctaaatatgatttgctaatttatgtacttttgaaaaatgatttatgtctagcctctttagatcttgattaatttcactttgcttttcctttatttttttatccaggtaaacaaaaacaacttaggactgttgaatagtcccacattggttgtggaagggcaaaggacctaagatataagtgggggagcccatcacctcaatggctagcttttggggtgggaatggccatttacgatcctacaattggtatcagagcctggctaggttaacatctctggcccgatggacacagtgtatgaaggcctaatggaccgtgggtgcctgcggggcccatatacctgatggactgtgggccggtggggcccgtatacggtgaaggggcggtgaagggctgagggacaccaatgtgtgaagggagagattgttgaatagtcccacatttgttgtggaagggtaaaggacctaagatataagtgggggagcccctcacctcaatggctagcttttggggtgggaaatgctctttacgatcctacaaggaatttcaacatgggagtgaaagatcatgtttcgtcacaagatcattttgaaaacatcgagatggccagttcagatatgctgggtaataagaatgataagccatcaggaccattggaaatgctccccaagctcaacttaagcatgggggactcctgctccagtgagcccacctatgaggtttggcaacagtggctgtcacattgatctcaatgaccagccaccagtggaagagaagctagctgctgaagctgtgaagatatcaggagaagagaagatgctgatcaaagccgacaaggagtatcctactcctccagttagccctcctaggagctttggcattggggtttgtgggtatgacctcaatgaaacgccagaagagattgatgagccctaaaccaatagatgtttccttatgaaccattgcttgggacgttgcagtcattcacatttgcaattttccgtttatgtttttaaattgtcttgtaaaatggttggttagctttgtttcattgtcgaattttatagactttgaccttttgaggcaataatttcgtaagaaatgatgggaaataaattatttacacagttgctttatgctcccttttcctgtgggttgttagatatatgttcttatgttatgtcgcaaaaggaaaagaaataagacatcttgtattagactcttcttttttaagattcatgcatttatttacaatagcatgcgttagaaacaaagtgcatgaccttgccttagactctgttgctaccatttcaaagggcaggaatatttgggatgagtatttgaaataatcaaatactttttgatacaggaaaaagcgaaatgcccataattaatcaaaaaaaatgaagtattcattcatatacatctaattcataataggttacagaatccacaaccactccatatcatctcccccagagcccccccccctctctctctcacacacaaaccagcagacggattgagatcctttgacgtaacttccctctgacttggttgcctgacatgtgggcccgagagtggtgggcccacatgtcagtcactgtgaacagtaacgccatggtgaacagtaacgtcaaaggatctcaatccccagcggaccttctacctctccctcttctcagagcgtgcaaggagaagggccggtggcggctcagcgaggaggagggccgacaacggggatggcttggcgaagcaagaaggagcagcgaggaggaggaggaggaggaggaggagggtaggggacgggagcgactcacgatgcaaggaggagcagcgccgaggaggaaaaggtccggtggcggggtggctcgtctcggtgaggaggagcggtaaagagaaggagggccggcggcggcggcgacagctcatcgaggaggaacgccaacgagttggaggctagcggcagatcggctcctcccctcccctccaatcccgccggcggcagtggctctacgacgaggaggaagggcggcggcttggtggagatagtgacgaccactgcgccagcaagggcaacgtacagcgacggcgaccgcgtgggaagagtgatgtcgacagtctctagacctcctcagttgttcttcttcctctagatccagatccataattttttttctctttatttctgtggaatatgtgaatcttgttcttctcatttgcatggtgagatttgatttgatttgcatcgtgcttaatctgtgcaaatggcagctgaatggggatatttttcaaatgtatttttttgcccaaaaatatcttcgtaggtggtctgctttaggtgtccacctcgaaaatgattttcgtgggcggacagggggtccgcgcataaaatatttttcctctagtagtgttatttcagtttgtactactagatattgttgcagtcgaattcagtgagtggttggttgctaacagttagatacgaagcaacaattgaaaatttgaagagcacttggagttggaaatttactaattcagagatcgtatgcccttcaattaattctgatcggcacatacccctgtgtagcgagagggtagtccaggtgtgccaaagactacccttcagttttggaccagagaccacttccaaaaaatcatcaagcctatgtttaggtgctgttaagtttagaaagcagtgcggcaagaactctcaggttaagtttagaaagcagttagacttttcctgcaattttctgtagtaagctttaggactggctgggtcaaagtaaggcatgaagttctttttccttttacccaaacttggctcaatctgacaatggtgtaccccctccataaaaaaaacaaacttagaataaaatatgacatatcctaatacagtgaatctaggggcggagctagagcgaaacaaagggtggtgccacttgcttaatttactctactttagatcaagtttaagctcatgcgagtgcctaagtttgcattgagggggtgcatacatagtgaaaatatatgaggtatagctaaaaaattttcttaaccagattcctgggcacccccctaatatatactagctccgcccctgagtgaatctgaataaccttttatctagattcactgtattatgatatttcacatccgattctagatttgctctttgggacacagagtacctactaatgctagaatcctcctacctgttatccacaccaatcctactagggctatttggcttttttttattactagctctgtcccataataattgtgtttctagaattcaagtttgttccaaaatagttgtcacaatagagtactaattatcttattaatgaattcccgttcaaatttctccctattcaaccctcaaccattctcccactcttacctatgcatcacttaatgagaaacaccatattctttcttcttaaatcttaatatatgctaaataatttataattataattattttgggacagtggtagtatctcgttgtctatttacagaaaaaaaaatatctagttaggaatctaaaaagagaatattggggatatatttttgggcttttgttcgaaggtccttcacatgcatattagaggcagaaaaatgaatgtgcgtagtgagtctgcaccttccccttttttcccctctatgatgtttgagacattgtatttttcataagtactccctccgtcctataatataagagattttatagggatgtaatatattctattactacaaatctagagcggatgtgtcacatccctctaaaattccttatactatgggacggatggagtactataatggcccgcacggcgacacaccgtgcacactaactttgactacggaatacttccgttgaacgcaacttagctatcgttgatcaaatgttttccattagttcaactactccaaaaggaaacattcaaaacgtatttatatcatgcctatttcactacttaaaaacaaatatgtgcgggccaaaacaggttttcccgtgaggagctctagcccatatgttcggaaggatctgtgaaaatctcgtttctctatgcgggtggcgcacccgtacatgaaaatcggattttcacgtgcgggtgtttatgtcaaccgcacaccaaaacaaaaatccaaaaagaataaagttaaaatcacggaaagaatcaaaaccctagttgccgccgcagctcattttcgccgttcccgtcgccgcagctcgtcgtcgtcatcatagttgccacagctcgtcatcgccgccagatccgcacgggggagggcgggagagaggcgacgccgccggatccgggcggcggaggggcgccaccatggagggagcatggggacggccgccaggggagcagattaagttagtgtccgcctccgctcctagccaccacctcctcctcctcctcgtcaacgggggcggcgtggattcgcagggccaacggtgccactcccggccatctcgttgtcatcgtcagcggtaggggtgacgtagttccggctgagtccgctcagggccctactcctcccgccgtcgcctgctgccgagccgcccaccgttgcctactaccgacctgcctgctgccgtgacgcatgagtgcgtgagaggagaggagagaaagtgagagacatatgagggtgaggataaggatgaggaggtgagatagttggagagcggataaggatgaaatttttgaagtattgagagggaaaatgagggatggtattttcacgtacgattccttaagggtgtgtttggttgcttgcattgccttagcctggtccatctctcatatccaggctgagtttagcctggctaggatgatacacatgcaactgtttggttggttgcattagttcatcctggctagtatgagattttgtttggttggttggatgagatatacggtttggaagggattttgtttggttggttgttggactttgaatatagttaccttctcttgatggggtagggtgaggttacctccataatatcactttcactgtttatgaaacaaaaaatcgcatggacaaattaaggaagaaaattgaaaatatactttattttttcatattttgcgtttatatatctggctgtgattaatttgtaaaaatatacccaatccacggaacggatgcgcaggtgcgaggacgaaccgtagactggggatgcatgagcggaacccgagccggtcacgtggacccgggatgcgcgaccgagccggtcccgcacgactggactgcgggatcgagtcggtaccgcggcgccattgcgcgggagcgatggagccgggatagcgagtcggtgccgcagaacagcggcgcgggaccgaggctgtcccgaggttccaacgcgcggaaccaagcaggccgcgtgttgttggagttgggttcttcccttaatttttccaactcatccgcgcgcacgcttttcaaacttctaaacggtgtattctttttgtaaaaagtttctatacgaaagttgtttaaaaaaatcatattaatccatttttttaaaaaaaattacctaatacttaattaattatgtgctaatggtctgctccgttttccgtgcatatgagatcggatccaattcgggtaccgagatggtgggcggcatgtgggagcaccggtcccacacgtccggcatgcgggagagttgccgcgctcacccagccgcaggaccgtcgcggtaccgcggtaccgcgtccccggccagcgagaccggctggtttatccttgctcccgtgcaaccgttccgcggattgggtatatttttacaaattaatcacagccaggtatataaacacaaaatatgaaaaaataaattatattttcaaatttctttcgacaaattagatgtatttttaacacatacaaaggctaatatcgttgtgcaaaaaaacacaacatcgcacacgtcagcacgcacagtgaaaaaaagttcagtgtggtgaaaaataaagagaagaagtggcgttcaccgcttaaaaaaattctaacagaataagaggttaatcaccggatgattaataaaaccaaattacttggtaaaggctacagatcatcaccggctgattaaattagttaggaaaaatagatgaaaaaaaaagagagaaaggactcgaagtctcccagcctcgtctgtatcgccgttgaacacaaggacgccacttttcccctgcgcgcaccgccgtccgtcgccgttgttggaatccatgtcgccggatccactgcaggcaacctccaccgctgctttactactcgccgaccaggcacctgccgcacctcctcctcctcctctgcgccatccccttcttcctcgccacccacctccccaaccacaccgctctccactttcatctcctcccctccattgtttgttgccatcggtggccagatccgtttgccgtgagctcatagccaccggatccggtggtccggcggctggagaaaggaggggacggcggtggcagcgaaggggatcgcgaggaagatggtggtgatggggcgaccgtcggcctctggatttggcacgtgggagcacatgaagggaggaagcaaccggtgaggaagatggcatcggcgatggtgaggaggggaagaagaagacaatggaggcgccgccccttgacctcgagcatcgactctttcctcttcctccttcctgaatcgtgtgtcgagcaaatgtgagagaaggcggtgaggggatccgccaaccccttgcccatcactgcaccagcccgtcccacacttgcactcgtgcccgcgcctgcacgagccgggcctggctgaggagcgaagctcatttcctgcgttcctcctcagcctggcccggagaggcattttgcacccgcccatccttgctcgctcctccatccaggcaaccaaacacatctgcagaaataggcttatttttatgagcggatccttaaaaggcccatctataaaaatcgattttcacgtacagtccttttaagagtctgcacgtaaaaatgggaggacgatgattttttcagaacgcgaccaattacggtctatctgtaatctaaacatgtccttgtacaggaaaatcgtttttagtagtgtgtcttaaacattaaaaaataggattgcacatataaatactgtgatagcaattggtctataaataattaacagtcaattaatatatcagttcaattaaattgggaaaaattgaagcacacaaaacgcgtgtaacaatacaatttggctcatgtgataattattaattcagccaaattttatcaacataaatgaaatgaaatgttccttttttttttgaaagacccgacgtgaatgaaatgatgagcctaaaccatgtgagaagggtgctttgttagggaaagcaactttccttccacacatcttgggttccaatgagaagaaagaaattgagaaccattaacttggtgttccaccccaaagggaagcacaaatttatggttttcagtctattgaacaaagtcgagcacacataagggtatattttacctggcctctacatccaaccggatatatgcaaccatttaaattagaaacttagccccacaatgatgacgctctctctctcgtggcccgatcttctggtgaagggataactctcgctttgatcgagtgcgacgtttgcgacgtggctaccaaccagaacaagtccaggacgccatgcaatcgctacaccacaaaccatgtcgtaccaactgtgacgcgcggttgatgatccctgcaatgcaaacaagagaacactgcaagaacaagataagatccaatcgaaatattgcgaataggtgattaagcacaaaggaatagttgcgattgaagtgatagatctaatcgacccggcaaatcaacacaccaactattaggggctctgaatcaatagtcgccgactaatcgagcgaggactagagacaagatgaatgacacttggcaaaatttaactaaacaaaacccaaatgtttttgaggatgtacaaagctatttatagaggaaaataaagctagggttaagtgctaattcgtggaggtggagggagacacttccgagatgggcctattctattacaaggctcaaggcccaagtttggtttcagcaacaacactgtcttgttttggcgattcccgttgactcgagatgaatttggacacgagaccggatgtgtttgaaaggtagcgagataagctttccacgaagtccaagatcacctaaatcggagttggcatgaaggcgctaggtccgtttgaagtcagtgctgtctccggaggccgaactagactggacttggaattaacattagagcgtgtgaagttatgagcgtatccgacgaagtgatgttctcatcacacaatgacctaatagtctagtgaataaagtcgagcacacataagggtatattttatccggcctctatatccaaccagatatatgcagccatttaaattagtaacttagccccacaaatgacctaacctgaaattcgttcatatgaagatttaaactctcctatgaatatttgaactcagggccttggggtgctactcagatcattacaaccactaggctacatgcaatttcataacttttgtcgacttagtcacataatttgaaaagagtaagaaattgttcggcatcaccttgaaacggatcatgatctcctggaggactgcttttggctgaaacaatacgtttaagagaacaaaatgactgagttgagattttcagacgctgccatatcctacctatgttaacaaagttttgggaacaaattcaagtagcaatgtatcacattgctatcatagcatggctaatcaagaaaaaaggggagtaaattcaactggaggaaattttacctctcattagcattaacacaatacatgtttatgccagccatcagcccaccgtatgctgggccttggaacgacgcatgctaggccacagcccactatatgctgggcctctacttagctatgacgaaataatttgttagggcattcccaacccaatgactagaatggtgtccatagcattaaataagctgccacctaagatgaaaaatgacgtgacaagtgaataaatgagaaaagagaagaaaatcatgtcttacatgagacatgatttctacacaacatacaagacattatgtgagataagtaacattaaatttaagtatggaatagtagtgtttgtattggaagagtagtgtctagtacgagttttttgatgatgtggagtttatgaaaactatgtctagtgtcttgggttgggaatgcccataggaatggttcgccaactcagcatatactcccctgtcctattttattttaagtgcaaacatgagtttccacgctcaactttaatcgttcattttatttttaaaaaattataattagttttttttgttgttatgagatgataaaacatgaatagtaatttacttatgtttttaaatttttttaaaatttttttaaataagacggacgatcaaaagttaggcgcgaaaaaatagactggagggagtaccaaaaaccgcaaattgcaccacatcgggtctacgtcatcaacttgcttgtgactaacggtactttcttttcttttcttttttttttgtcacaaaaggtaatcccagacatgagttttaacggcgcccttccgtcagaaggtcatctcagaacacagtttttatgagatttggcaagttcttgacggaagtactttgtcaaggaatgacagaaaccgtggtagtgatggcctcggctatatattagcatctgtgggcacagcataaaaccaccttggtagttactatataggggagaagtaaaaaggaaaacacagggattatgtgttgttcatgaaaatttgaaaaaagaattacaagaaaacgatatgtagctggtacttacagctagctgggaaattatttcataccattttcaaattacttttattttattaaaataacaagatgtttacgatgtttctttccttaatcttcgttgtgtctactagatatagaaataagaagtatgattttggtgctgaaaagtaagagacaaatagtagaacagggatttgctaaataattatcgacagtttgatttttttcaaccataaaaattgtattaagatgcctgcaagtgagatggaaaaaaccgtcagattcgcattaagatgtccgcaagcgagatggaaaaaaccatcagattcatattgagatgcctgcaagtgagatagaagaaaacagtgatcgatcatgtgggatgtaagctgagtggacctagccaaatgaacgtaccaactttttattattttatacatgagttacacatgagttacagtatactacactatgacctatatactacctccatcccaaaatatttgacgccgttaatttttttaaaaatatttgaccgttcatcttattcaaaaaatttaagtaattgttaattctttttctatcatttgatttattattaaatatacttttatatatacatatagttttacacatcacaaaagtttttgaataagacgaacggtcaaacatgtttaaaaaagtcaacggtgtcaaacatttagggaaggagggagtaatttagtttagatataaaaaggcacatatattttgttcatacttatgtacaagttatattacagttatagtatagttatggtgaaattatattataattatagttacatttgaaagtttttcaatcgaaaaaacttacggcggtactttagatagagccacgtactagaaatcccaactagcatgttagacatgaattattcaaatttcaaagccacgatttgcattttgtcctaggaccctaaattcctaaagactactactggggaactcatctttagtcccggtttacaacccctttagtttcggattgtaaaccgggtgggtaaagatcacttcttctctagtagtagatggccctgcaaaatataatagttttaaaataagaattccatattttttcttagcagtctaaaagctaaaacaagtaggaaaacaatgagaaatagaataattctaaaaatcaaactctaaaatactccgtaaattgtttgtaacaatgacgtcgttacacgtgtatatatacctagatacgtttgggagcggcggcgactgcacacgaaactaaagggcatgtgaggtgtgaagcgagaaagagacgccgacgctgtggctgatcgccgctttgaattggctttttggctcggcgcagctagcccgcgaccaaaacgtacacgagcaagcgagcggcgccttttccacttaaattggaacgatgtgacagaaaagttgaaagtttatgtgtgtagaaaagttttaatgtgatgaaaaagttaaaagtttgaagaaaaactttggatataaacatggccagcttaagtgcaacaagtgtcaacgaagatcttcatggatggatggatatgatcatcaaaccaaccaccacaaacccacatgccgccgcgggggaggcctacgctactacgcgcctgtcgccgacgcgtgacgcgccaacgacctcatcaccgtaatcgttttcgcataaaaaaaatgttttactcgatatacaaaataaacttttttttttttgcaagatcctcgatctgcgattctgcatgcattttggtacttattgctggttcgcctttgaatcgcaatgcatgttttgatgaagatgatgaatgtcattagtgaagggggcatcattgaattggaaacttttctgcaagaacagctcgagtttctgacctgagtatgatggagtaatacagaatgtgagtggagatatattcttcgtgctctgatctgggcccatgatagggggtgcaagcaggccaacccgcgagtttaaataaataataatttcgagtttaaataattaataatttattggttttcgcatcgcggcccggcttgccgcatctaaatatacaagtggatcaatctataaacctatttataagtcaaattcatagttaacccgctagtcaaactcgcggattacgctttatttttgcctataagcagccacttgcacccctagcccatgataacatgtcgtcttaaaactcacgcggaattggaacttgctgaatttgggtctggagaggtagtggcaggaatggtagggggaatgcaggatgtcatcatgatccgagtaaaattcattcagggtgtgtttagttcatgttaaaattgaaagtttggttgaaattggaacgatgtgacggaaaagttgaaagtttgtttgtgtaggaaagttttgatgtgatagaaaagttaagaagtttaaagaaaaattttagaactaaactcagcctcagtttgaaatttctaaattaattctcacctgtgcattaattcaacacttgagagcaagcaagcaaacaacacatccggcaattacgtagtatgtgcgtaatactcctctttctgaccttgtttttcatgcagaataaaaatagctaccgcgtgacagagcggctagctgcatgcacctgagccagatactttctccgtctcaaaaaaagacaaatcctaagttttcgtgtccaacgtttaaccgtccgtcttatttgaaaaaattatgaaaaaaaattaaaaagacaaatcacacataaagtattaatcatattttatcatctaacaacaatgaaaatactaattataaaaaaattttatataagacggatagttaaacgttggatacggaaagctagggtttgtcttttttgacagagggtgtagaaaaatagggtgatcaatattttttttttgagttgagggtgatcaatatttaagcctctggctggcagctggatggcttgtccaccgacatgcatgcatgtacgtatggcagcaaggctgagtaccgacgaaccgatcgaacgatgtcgtggttgagtagcacaagcaagcaagcaaccacacgagaaaagcgcgcgcatgttaccgcaacatggattcgaatcgtggatcgatccatccaccaaccgcaccagcagcggagaaaaggtactggagtacgtgcaacatatagctaggagcaatgcaagctacttcatagtagtatttccgtcggcaaatttattgtattgtattcccaatcagcaggatacatgcatggaacatggcccgctcgcacgatcgataccgcgctcagctcgatcggtcgctccctccatcgccaccgccaaattccgcgtccccgtccgtccgtcgcatgtgcgcaccgcccgcgcgacaccgaagctcagctcgatctcgcgcgtgcaggctgcaggtgcagatgcaggggggaatgtctgtcgctgccgccgcacgcccgtaccgaccgcgcgcgctgacaagggggacgcatttgccttgcctgctggctagtgaatcacctcacctagctacctgcagctacgcccacgaaggcgcaggggcctcctccgatctattcccgcgcgcgaggtggcgacggctcaacgcgcgggggcggagatggcgtggaggcgacggaggtcacgcggtgggctaaatccggtggctaccgacgatgtggaggacgatggcgacagtgcgaaggacggcggtggtcatagggtatgcgaacggagggaggcagctccggcgcatctctcctccatgccatcgtcgacacttggccagcagcaagtgagccgatgcaagagaggagccgtcaaggagatgggaggaggaatgtatgtggggcccacagttggccagtgacttttggcttgtcaagtttggctagtggagggttctgacttagccatctggttggagaggctgttgaaggatatattttggctggaatggctaaaatttggcttagagagtcatttggagaagctgttggagatgctcttatgctgtgttcggctatttatattgggaactagtcattcacgcacgtaaaacgaagcaaggcattagcgcatggttaattaattattaactttaaacaaatggattgatatgattttttttaaaaaaacaactttactatagatttttttttaagaaaagaacacaccatttagcaatttaggaagcgtacgcatttaaaacgagaggagagagaatattggctaccgaacaaaccttacaatttagaatttgtctaaaaattacatggacatatttacctagttcttcattccaaccaatatttataacccctcttatttaattttctcatatatttctgtgcatttcaaccaatcacgatcattcctcatatacttcacttttaatttttcttttaaaaaaaggttttatgttcttaaaagaggtaagagggggagtacagtacattgatgcctgccgcacctatacatggatcggtggtctgcatatgccgatatgcgtagcctaacggtgccgttggtgccttgtccctagctaatcatttccttctcatcaaggccggccgtgctctctctctctctctctctctctgattggagttctgcaaaagggaaaagccggcgcgtcggctgctcgatgatgctgatatctgcctcaatttgtgggtggtgatcgatgatgatgatgcatgatcgaccatgatcagctataggaggggcgtgatatgcatgttacggagcgtaaacctaccggacagcggaacatgcatgctttggctgttgttcgtagattcgagccggccagggcagattctcctccaaatatatattatcttctgtcttttggataagtgagtgggaaatcatcgataatcgatcgatcgtatatacacaccttgctaacagggtcaacgacctccatctgctagctactgcccgagcgatcctaccatgttgcccgtcctgctgtctgatgatgctggtggagataaaatcggcccattttgtttttgttttttaaggtaagcacgggacaccatctgttgccactaagctttaaatatattaattgtgttgtttgtaatttcaaattcaaggctgtaaagtagaatgatgaagaaaaaacacaaattaacactaaattaagttcaaattttaaattttgtctacggctgataagccaataagcaaacgatcaaaagccaacattcactactagaaaaaaaaatttttttccagacggactaaaaaagttttcgcaggcggacaactggttcacctacaaatgaacgcctataaaaatagttgattttcacaggcggacaactggtccgcctgtgaaaagagctcctagcattaaaaaaatgcgcagccaccgcccaccgccgtttccgcaggtagcaacagcttccctttctctgttctctatctagttcccattcccccattcaatctagtttccgttccccatcaaaccaaatcaaattcacaaaagcatcacaaattaacatagaagcatcatagttcacaattaaaacaaacgaatcacaaattaacattcactatcaaaacaaacgccatcgccgtccacgccgtcaccgccggtagccgccgccgcgaccgccctccgcgccgccggatctaggaagagggaggggagacgccgccgcctccaccctcctcgccgtcatcgccggtagccgccaccgcgaccgccctccgcgccgccccggatctgggaggagggaggagagacaccgccgcctccaccctcctcgctgtcaccactagtagccaccgccgcgaccgccctctgcatccgtgtaagttcaagtgctttaatttggtttcggtgattaatgacaaatctaattatatgagactaacgtttttatgagcctttctttgactagtctcatttggatatggaagtaaaaatgatgagaggtatgtattaaacttcacatattctaacttggtctctcttgtggatccaaaatatagtatgagcttcctatttgatctttattgattatgtgcatatgcgttccttcatatccatatgtatgcacatcttgagggggagcttattctatattttgtttattataaaatttctatcttgatttgaaatcatttttcatctcatctctctatattgtttatatcgggttattatccatcaccaaagagagaaaagattaaaagatattggattaaacaatttgtgtaattgttactttggtgatagatgataaaccgatgtttatgggattaacctctcttttgcataagttgtctactaggttatttcccgataatgagatgtggaagacatgcattcttttgtgatggaccttaatcatgacaaggatgaaatgcatggagataaaacgatatgtaccacttcttatctcctactttttgataggttcatatatatgatttccatgttattgatatataagtgtgagactaatgtttactcaaatgttatcttatttagtctcatttacattgagaacatggagatcatgaaggtatatgttttatgttgctctacatcattactacatatgccttctctatatgtataggataaacccccattggtcattctctaattgtgcatacacttgcatctcttgtatatttatttgtatgcatatatttagggggagcaaatcctatacatttattgtgcatgttctagatccatattgttcacctattatttatatcggatctttgcacttgagcttgcatacgagtatatgacacttgtgatgttaatgaatactcaacaaacatatccatatctttcatatgcaaccggttggtcatcaagtgaaggatgacaactgatttgttgagactaatgttctcccttgaggtgtgaaaaggaataggtcacactacgatgaggctaatgaatgacaccatgggttagtggtcaccaagccaaggacatcgtcatgttggcaagaatgaagtcaagcttgtgatgagaataaagtcttgacaaaggatggacaagacctcagcataaacatggttcaaccggatggtcacaagtgttgatctcggctcaagcttgaccccaagatggatggcgcaaggcaaaggtataatgtagctaagaatgttttcttagtcttttcccggtcttggtgtttggtgtagactggatttgctagataggcgccgtactatcaagaggggtctatgaagcgagcttgtggatgatcttgtgccatattagttcatatgcatgtaggtgcattttgtgggcttgtctaaccaagtgtgatgagttttctcaagtcctaaaccaagagaagtgggcatgtccaataggagtgagtgacatcttgtgggtatgtccggtggatatcctttggagtgtgagccctttatccttgacttaagttgtgtttcttggatggatttttcatgggttgaatggccctttgaataagctttccatagagtccaagaacgccaaattccgagacccgagtcaagagatatcgccgttttactaacggtcggttgagctgaaaagtgacatgcggtctgaccgtgggccttaggccggtctgaccgggtctgttagccggtctgaccggcgtggtaaggccggtctgaccggccccactggtctgttgcactggtctggtttttggtggcgatacagagctgccagagccgcaaccggtcagaccgagctgacggcggtctgaccaagccgtggacggtctgaccggccactacactgcggtcagaccggccaggttgagtaggctcaatgattgccctgtaacagctagttttctagccgttacaaagtagtccggtctgaccagcctcacaacggcggtctgaccggcagagcacaaagttggggatttcggttccaacggctagttttggtggttgggggtatatatacccactccccagcagcaagggtaaggttttggcactccattgcattatcttgaacccttgcaagagctctcacacccttgtgcacttagtttatctagtgaggtgttagagagtgagttaagtcaatccaagtgcgttgcttcattgttatagctagtgtggcacttgatcatattcggcaagcatcctagacttgttactcttggaggttgccgcctcctagacggcttgtggaggtgttgcccggtgacctctccgaggagattgtggaggaggcccggcaccgtttgtgagtggtttggagttcaccaccttcggagtgaaggaaaaactaccccgagtgatcgaggcttgggtagtcctctccgtgggccggctcccgccttgcccaccccttgacgaagggggcgtgcggttgcttcgtggttgagcggtggagttgggctcgcctcaacggggattaggaaaccggcgagtttccgaacctcggtgaaaaattccttgtctcttgtctcatttatttgttgcatttacatttgtgctatttacattcatagagacatatttgagcccatatcacttaggtttgcaaaacttaacttagttacttagttaaccttgcacctcaccttgcctagcaacttaggttagttttgtttaagtgccattaagttttaaaaccgcctattcaccccccctctagtcggcctccttgatcctacaatccgccgctgcatgccgccgcacggacgcgccccgccgccgtccaacctgcgccgctggccactggcctccccctcccccctctggccagatctgggagggagggaggggagccatcgctaggcgagcacacgccgcgccccgccgctatccaccccgcgccgctaccggcctcccccctccccctccggctagatctgggagggagggaggggagctgccatcgggcgagcacacgccgcgcaccaccgcgtcggggtgtgccgccaccgcccagtagccgcctccggccggcggccagggagaggaggtgaggtgaggggaggggagaggagataagaggtggaggttagggggaaggggaggaacgggagaggagaggagaagcgagggagaaatcggacttagaaaaaatcgtcccaatgtcgcctctatttatattccacgccaattttcgcaaaggtctgcttgcaaaaataaagggtatttttgtaggcggaccggataagtggtccgcctgcgaaaataaacaacgagcatcaccccggtttaaatttttgttggcggttatttggctccaagggtcatgtccacctgaaaaaaaaaccccatgtctaaaaaatgctttttctagtaatggtttccaatactaatttgaagaaaaatcgattttaaaattttggactgaaacttttggcatgcatatggtttagatgtgatttttcaaaggttcgacatattaaatacattaattaataaaataatccattataaacattgcaattaatgataaataagaaaaaacattgaaaataaatcagaaaacatcgtggttgtaaaataaaggaacattgcagtaacaaataggaacacgaaccgacattcagttgattcataacactatataaaaaattatataatttgaatttaaatctaagttattcttaacagtaactaaattctagcaccgacaaccgctacatgaccatttcaatcacttttaattgttgcaacttaccaggatatccatttttgccaaagtatgttttacgattaaatgaaagacacaaatgcacacatttgccacagtcgcacccttagcagttagcacatgctcaagagatcgacataggtccaacgattacaagtgatttctaatgtatggatttcacaaaagaaataaattaaactgggttctacaaattttataagaaaacctaccacgtgttctaaccaattatatgttatcgttggtatatatccacatgtttctcttaatcaattgatctatcattttgtctatcttatctacatatgtctgccgtgtattttcaattttcaccccaagaattagaaattagtacattaatcagagggggcaaaaggcccagtattgtcaatcatggtgggtctagattataactgtatatattgactaatcaaaataattatatgtaaaatactaatgcatctatacaaatataaaaaaaagaatggtatgtcaatcgtaatttcatattttaaaataaatttaagctagctttgcgcagaactgggcatgaaattaggttgcttactggttagctctgcaatatatttttttaaagaaaatttgattttttttttaatttttttattttgaaaataaattgtcccaaaacttaatttcaaatttaaaccttttagccatgtcatctaaactggtgccagttaaattggcgtgccgagacaatactagtggggtgcattgccaaaagggttggatttgaaaataaattaattttgggagtgtttacttttaaagttaaaaataaaacacgtagaaaaataatacaattccgtaaacatgctgatgatgagcccagcagacaatggtaaggacctaccagttgcgtaggagcagtcctagaaatatataaaaaaaagtattctgtatggtgctatatactgatagtactgtagtaccaatagatatgaaataagtcgtccggttataacaagagaaaatttcttgtgtacacctaattctttctattctttctatgtccctgagatttgctcatttccttctatacccctaaattttagtttggatccttcccataccccttccattagctgattgttagttgaccgttaaatttctatcataaagtctattttgctctttgctatctagaaaatataaatttatgaagtatattgatgaagcgtataaatttattgcatgtgactattatatgtatgagtttattttgtgagatattatttaacaaaagtaatattttagtttcgcctcacgaaggaaaaacaaaaataatgtttatctatgacaacccctttggtatcaagaaaatataaatttatgaagtatattgatggagtgtataaatttattatatgtgactatcatatttatgagtttattttgtgagtccattaatatacttcataaatttatattttctttataaattaatatactttatgatatgaatttaacagtggtatagaagggatccaaactgaaatttaggggtatggaaaggaatgaacaaatctcaggggtatagaagagattggatgaactttcaggggtacagggaattttctcttataacaacgtaatactaatttgctaattctctatgattaggggtaattttagtgtttgcgttttccctttgttttagtctcttatcactcaagtgctcttgccatgtccctccgtttccgttcttgttgtcggcaatcactcacgattggatggcattcgtccatgtatgttgcttcagtttgttctccgcattctccgttcgtcaggccattcacaatgcgcctaggtggagttgggcctcaacaccaaaagtgaaatattcgctgccacgtcgtctatcctcgcggcctccttaggaacgcggagcaaactttagacacagattcctcgtcgtgggcgttgcaggtgggacccatgctcgtgctccgcaccgtcaaggaagagagagggaggaagatccatgccgccgagctagtcggctaggggaaggagggccaccgggccggataagctcaccggctcatcctactgccctcgaccccgccttgccggcaagggcctcctcaagctcgtcctcctcctcctctccgcggtgctgggctcgtcggcccatctcccagatctaagctggacatcatcctcctcctctccgctgccgccgaagaggcaccatcgtcctcctcttctccgccgccatcggagagaggagcgcaagagagagagaggagagggagatgcaccggggtagaggggcaccgacggaaggggaggaagagcagcgcgggcggagaggagcgctagtgtggaggtgctgaggcgagcaaagaataggtagggacggctagggccgcccggcatcgtcgtcgccgctcgggccgcccggcgccactcgcgccgcgcgctgccctcgatttgccaccggcgctggcaccgctagggccgcttggcatcggtgtcgccacttgggccatcaggtgcctccgtcgccactcgtcttcgtcccccggcagcctcagttcctccggtggggaataaaaaaaagagaggagagagggagagttgaaaagtaaaaaaagatggtaccggtggtacaagcaacttgcactgtggaacatgtagcttaacacattcttgatctacgtggcacatgaggaacggcaaatacaagcgacgcactgctaatgccctcatcatcatcatcatcatcatcatcatcatcatcatcatcatcatcatcatcatcatcaccaccaccaccgtatgatctcccaggcgatgaccccgattgtcccaacctagcaaccataattgtgtcaaaggactcttttctcatgacctcgtgcacatgcgtcaacctcctcctcaaccataactgagctgaccatctcctcaccgctaaccatgcaccgctattctttttttttattgttttagtgagaaaatttttgaaaaattaagaattctagtacttttttattccttcagatatagataagaactagtttggtgaatcggaaactttttttcaattttatagaaaattgaagtaaaattttcaagtaaaaattgcaatttcttttctgaaaattgatctttgctgggtggtgaaaaacagtattagtcacagtttgaatagaaaccgggactaaatatcatttttagtcccggttaacaaacccaccgaaactttttgatcttcagtcccggttggtgctaccaaccgggactaagaatccgaaaagcgcgtcgggtcgcacgcgcgcgcctccccgcctcttatcttctcgatatctacacgcctagtcatctgcgtctcctcctctccctcgagacgtgtctcttcccctccccttccttctcctcctcctcctcacctcccctctcctccttcctctcccctcctcctcctccccctcccctcccctctgtcagcgacggcncaaccagnaggaggagacgcggtgccagctgcggctgtggcgggagagggagcggcagccccgttggtgggagcggtgcggcggccggcaaagccgctggggacctcctcctccccatcccctctcctccccctcctccccttcccctcgtcggctgcggcagcaaccggtggcctcctttcccgccggtctccgggtcgacgtcgccatcggcgggagggaggagcgtcgggcctgggccagcgacggcgcgaccaagaggaggagaaggcggtggcggccagcgaagcctccgggggccctccttctccccctcccctctcctccccttcccctcgtcggctgcggcggcatgcgagtgttggtatttcttaacgatattactagaaatagtcatttcagcaatggcgctagaaatggtccttgtatatttatggtcacagaattaatccgcaaacgcacggatataccattgtagtatttcacccggaagtatttcaaggtattgtatttttaatcccaagggaagataataacagtgaactttactaatgcactttatacatatgttacttataattgtcagagcataagcaggggttaaatataatataagggtagagtgacacaaagcaaagctatccaatcctcgtaacagaataattctaactaagtggaagaagaaatagaaagcactcaatttctatacttctagtatacactcgaatcctaacttacatctactaatgtacaattttgtggccaataccccttaacagtgtcctcctggtacttcaagagaccaccccgggttgccgagtttcttacaacaacctgtcatggctgtccaactggggctaaatacggaggagtaccctccccaggaatttgtcttagaaatatatactaacgtggaggaatatccgtactgagctgtcaccatcagcagcccacctctactgtcccgcagcatatatgcccaattaatgatacttaatagcctacattattaaatactactatatatccgcatgcccgacatatatagagtaactaataaatcagacattaaacccgcaccattacacctctctggaaggctacccacacaatcaacataatgcagatataaagaaagaccagtactcaaactaagtaaagtaccgaagttatataaagaagagtatttcattaattcggaaagtattacagaagagattacaagagctgctagagccataccgaaaactcttccgaagactccgaggacttttgaacactattctactctactccacttagcactatgttactaatactaaagtatgaagaggaattttgcttgctcgagtgtgttgtgaagtgagctcctctttttatagggccggtatgacggttatagaaacgtgaaatgtcaattttgcccttgtaaccgtcattgaggagtgatcctggacatccacgtggagggccagccggagccgacgccacctggaccggcccagcatgcctccagcctcggcaggtcactgacaggtgggttccttagacggttgtggtagttaaaagtcggtttccgacggttgcacctgacatgtgggtccatcttatccatttggttgcttaggagtgaggttttctccactttctctttattttatttgataaattcctgcaacatgttattctccaagtacaagtggaaatatattatttagaaataaacatgcattgtaagcatagctagttccccattattttagttatattgacggtcaaaatttgtcggtaacgaccgtcaacagcgaggcgtcaacagcgggtggaggtgcacgaaccgccgggatgatttttagatgtgatatgatttgttggatgattttgtgatgtaaatttgtgaatgatttcatgatgtcaatttgtggatgattttgtgatgttaatttgtggatgattttgtaacatcaatctgcgatgttattttgatattggtgcattccatctgtggtgttggaaaaaataattttgatgtttgcattcgatatgtgattgttggaactgtgaatgttggaaaaaaaactcgatctgtgattgttgatatgtgaatgttggaaaaaaacgatgaaaaaaatatgcaagcagctaaaaacaatgggaaaaaaggaaaaaaaaactctactcccggttagtaacaccaacccggattaaagatagccatctttaataccggattcggggtcccgattgcatactcgggattaaagggggttgcgaaccaggagcatagatgcattctccagcaatgatgaccacaccaacttcttccaccccgaaagatctcgtccagcgttggcttcgacatcaaatagttccactcactgctacaaaaatcggcattggtgtcggttggaaacccacaaaggtgtcagattcccagccggcacctagatgtcggcactgatatggaggagaaatagatgccagtttaggaacctgcatctttgagaatccacgaataaaaaaaaagtcggcttgacgtgagctgatgcattgagcagctctccatcatccccatcaaccaatcataatcaaaatcatcactaaaatcatccaaacacaatcacacgagcagctctccatcatccctatcaaccaaacacagtcaaaacatcactgtaatcatccaaacacaatcacaaaaatgaagaaaactgcaaacacaatcacatgccaccgtcgccgtcgtggatctagcctcgcgtcatcaagttgtcgatccggccacccccaccgtcgtggcggctagcagtagagaggaggccacacatggccatggcggagaaggacgtgccccaccgcggcagagaggaggagatccttcgggggagaggaagaggaggagagccgcacggtggggaaaccaccgccgcctcccctcccaccagatctggcggaagggagagccaccgtgaggagcctaccattcccatggggagcccaccgctgctgctacctcccctcccgccgaatatgacggaggggagggcgtcgccgccgcccgtggagtgccgctaccgctgttgccgagacagagagagagagagagagagagagagagagtccattgaggccactg

SEQ ID NO: 82925 - DNA, 7389 bp, Oryza sativa
attggaatcgaatatcatgtttccagtcaacaaagagccatgttttgagagacatgcagtcaaacatgttaaactttagcttttgatacctttgtatagaatgagcattgaaaagtaatacatgtaaatttgtccaggtgattttgaattcataaatattctacagatagaaattaaaggccaacattgtattttcagaactgtgtcactcaatttcattttttctgattggagtaaaacatgaaaaaagaagtacacgaaactgtgcagcaagatagaaagcattattgtacacaattctttcaataatgaagtcctatcatcatgcatagaacatgacccacaaagtaattgattctataaggaaattatatggtatgattaggaatcaattatgttggctttcttaaagaaccagtcaatgcaaattgatctatcctctaaaaaaattaggaatcaatattcaacacataactgttgttgtatttgtgtctgcggataaaacatttaaaggaaaggcagggataaatggaggcacctactttgcaaaagttcagcatcatcttctgtctcagtttctgaacattccctctcacaagaatcagatctttgcttctcagcaaactccgaaattttttgctctgcagaaaacgaatcaggctgcttgaggtagccttcggtctcaaagtgtgctcccattgaagtgatttgtgtaggaggtatatctccatggttattagtttctccagaatcattaggcatgtatgtcgaccagccctgttgggcctgatatatagtagtcagagggtcattcccttcttcaattaaaacagggccagaatcatcatcacgctgaaaggaatgaggcaatttcaaactactctgcacaacttgagcaagtggtcgacatctgtcatgttttttgacaagagactcttcaaaaacactttcctctgatattttctttgtgaggggtgtattttttccatcacttcctagatttggtcctgcttgcatatgtcctaaatgagaagatccattgttccgattactgagagtattttctgcaccttccaaagcaagagattctgaaaagtctctttttgaaccagcatacggaaagttctgctcaagcccttttgtcttcccagggagatttgagctatctccttttctttttttactctttttgcttttgtaacgagtactgctgagatctttgcactgttgacttgctgagtttcctaaaggaaactgaggtttttgtgtattgttccttgagtaatattctgtagaagagttatcaaactctctcctcatatcagcaaaagggacactagagatgtcatcactcctgaagccttgattctggtattttgatgcaagctgttttctctccaattcaagagcatgaagaatagcatcttctctgcgagcatatttttctcttctctttacaggagtacctcgagaagtcaatgccttctcaatacaagcatcaaactctccacacctgaatgccttgacacgctttgatttctcaaggttataccaatcgctgcaaaagaagggaaacaaatgaagaaatggatcactacacaagacatttaaatgcaaataaacaaagttcaagctgcaagtgttgtagaaacccaaatcaatgccagacaattcaccagatacttgggtatttcttgctatcaccatgaatgaaataaaatgtagcttgagatcaagatatgaaattttaatgggtgttcaaatagcgcaactgacatgatgggcgagtgaaagttaatgggtgttcaaataaaagaaaacatcattctccaacatgatgggcaatgggcattactgtttagttgtggtcttgtgggtggagaactgattagatatttggggcagtaaatatagtataacgttaagactcccttccatttcaacagtcacaggcaagctagaaaaaataaatccttaaggacaatattgaataatgtaacttatatagaaagtgagtcagcacaaaagttagcaaatccaatcagagcacagcacccaatatacccataaaaaatcaaacttggaattcttaaataatgccaaatttattttatgcatgttaacatttcaatttccagactggtatgggagaatccaatcagggcatgaactacttttttctttagactttaatttccattgaatatattcgagattctctttcagcaacatttcattccattgtggcagctaaaagacaaaacactaaatcagtaataaacttaaggaaatataagtatatatccgtatgtcgtaagctattcatatcattctgttataacttccataatacaaaacaaacacctacaaaattggctttctcagtacatttaatagaaatggtaaggcaaaaacatcatagcaaatctgaaacatgcttataacttatttaaactgtataaccacgagaatccagtttgtgagtattttttaagctctgttgaacacatgataacatcataatattgtattcacatgtctccacaaaacaccatacaaaacatcatcacaatatatgatctatttaagttgagaaaataatctacagaaccaaaagctggtctgcacctgaattgccagcatcacttgtttcaatcccacatgacagaatgagcagcacgcatgtttattgtactataaaaatttacaccctacttatgaaaacccaagacatcataacctactctcattcttcagtaaaattagcaaccagaaattaaatgtgcatcccacaaaggaatttaaccttctcacatcacaagaacgtgcatataatttcatattcaaaaattgcaaaatattatatccctgtgaattaaattcattcttccaatataacaagcaagatgtacacctcagaacaagtaacaatgagtgtaacacatcaattgaggcagcttatcaatagcaccatattgggttcaggaatgatatcctctagatggtagattgtctaacattgtttagctttccaagtgtataggcaattgacaggtgacttctttaacatgaatagagggaattcatctgaaacaaaaagttgttggctcttgttaaatactccattgttgttctgatggtatttgcagccgcaaccaactaaatatattccctaattgttccttgagcaaacaactcccaatccaatccacagaacattcaatcctgaccaagcgattgtgaagggacactaaccgagcagatgaattatagaactaagtaacagagtacataattaaatttgagggaaaagggagaaactcacacgcttgcgtcctcacggccgaggagcttgaccggagttcctgtcttcggcgacattacctgagacgccgggagctcgtcgggcccgagtatcctccctggccaccatgacccgttccgtcgccgcacccacacgatgatccccggcgagcaatcggtgatgccggtttccgcctccccacacccctccccttcccctcctcctcctcctcctccacctcccgagctccgacccatcccggttaccaagcacgaaagctccaaccccaccaaacctaaccctaggttttcaactcagcccgcttctagaagcctccttcgccccggagatctgccccccattcaaatcccggacggccgcatctggaggacgccccctctccgcgcctccacctccgccggggaatcctagggttccggcgacctgaggcagcttcggccttcttcctcctcggggagctttctcctcctccccctcgccgccggtatgctccggggtggtcgccgccgacgaagtggacgtgttccggcgcctcacgaattatatttttcccacctttttctctcttttttttttcgcccgagcaaagcgaagaagaaattagggcgaaaaagtataaaaccgaagggaaatagacgggggcgttttctttttccgggttggtttgtgtgggtggttttggtggtccaacgcgtggggcgagcgaaataactgcaggctcgggcccaaaagaatacatgggccggcggagacacggattccataaccgggggtagttcttgtctctctcttctgaggacaaaaggaaaagaaaagaaaatgagaaaggcatctgtattactccacttttctacgggtatgaaaaagtagtatgcatacatggtacatgtacccacaccatcagatgattgcgtacatcaagtttagaagtgcacctctcaaagaaaagtttagcagtacatggaaaagcaatattcccacatgatatcattgatcttaaaagaaggtaatggttccttgatacgttctggttttcgttttcccttacgtggtaaaatattttcaagccgttgattttttaaaagatatttgaccgttcatcttattcaaaaacttttctgaatattatttaaaacttgagtagtagtagtatatttaacaattaatcaaatgatagaaaaagaattaataattaattaaattttttaaataggcatatggtcaaacatgtttaaaaaagtcaacggcgtcaaatatttagagacggagggagtatataccatgttatatcttgttatggggctttagagagtccaggtggaataataacattaacaaaatcatggatttgcccaaaatgtaactcaagacacaaagcgcatatgccatttttgtgttttttctagtttttcctcacatttttcagggtaaattacgtcggtactggtggcgcattttaatatacaattttacaatactttcattcatacacataaacattcatgtgaactatacatcatggtagaatgctaggtgtactcctaccattagtatctctattgctgtaaaaacagatttgtcattcttcagtcatctcattccatcgatcgagagtaggagagtagcgctcgagaaaccgaacgatttgcccctccccacactcataatgttactaccactgtagacgctacgtgtgagataataggaggatataacccacgtatcagcgcctgtaatgatagtgacattatgttatgttagtggatcctcatcccacacccatccattcatctgcttcttctcatattgcatcccaacctagttcatcccacaaatggccctggactgttgcaatgcagaggttttgttactagtttaatacgacaagcaatatgttttaacttatttgcacacacaccacacataagctcatgcgctaaaataaatgtgtcactgtaaggggattgtttggtgtggtgccaaattttacccaaccaattatttggcgactttaataatgtatccatttgaattgataccattctctcttacaaattagcagcgccgtaatttacccaaggtttaacacctagtaatgattcaaaccaaactagccccatgtatttttactactgctagtagattgcattctatctgtaatttactcttttatttatttccagttttttttttaatttcacggtagtctgcactctgtcatataagaaaaacttttatatataaatctgaatataaactatatataaatccatgtgtagaaaatgttgtttattttttaccgagggagtactccctccgttccaaaataggagggattttatatcaacgtgacacattatagttctataaatttagataaaagagattgtttaaatccatccaaaatcacttatatatattaaaacatcccacacccatctaaaatctcttataatattaaaactgtttcacattacatgacatccaccctaaggccccctttgattcataggaaattcataagaattttaagggcccatttgaatcataggaacgaaaaaacagaggaataggaaaaacacaggattctgacaggaatacaattgtaaaaaagaggattgcaaaacacagggatgaccgtttgattggaccacaggaaaaacgcaggaatcagataagagagatagactcagaggaaatgttacaaggttagacctcttgctaacttttcttcaaaatgtgcataggattactcattccataggaattttaaaggattggacaggattcaatcctttgtttcaaagaccttcataggattttttttccataggattgaaatcctccaaaattcctatattttttctacaaatcaaaagggccctaattagaggatttcattcctatagaaatttttcctatacaaccatttgaatcaaaggaatggatcttatggaatcctatgaaattcctatggaatacctaatgccatgcaagttttggaggaattctaacatgaggttttatacctcatggaaactttcctttgagtatttatctctcctctaactcctgcggtccaatcaaacagtcattcctgtgtgtatttatctctcctctaactcctgcggtccaatcaaacagtcattcctgtgtttttcttgtgttttgcaattctctgttttttacacttacattcctattaaaatcctacgtttttcctattcctatattttctcattcatgtgatttatgatttatgatttaaagggcccctaaatctttacattttggatggagggaatagacagggtttcctaaaccgccgggcccgggataccgtgccccggcggtaagcacggttaccgcggtaaccgtgaaaaaccgtacaaaacagtgccaaatttatcaaaaatttaaattattttttaaatttatttaaatttaaggaggttaccgtggtttatattatcgtacctcacggtaaacccggtaaccccgcggttaccggagtaagggaaaccttgggactactcgactgctacgggtgacgtaagtcagttctttctccgctgagaaaattgacatttagccatgttcaagatggggtttcgctggaatgccactcccgaatatggcttcgttataatgccattgtcaaatgaagccaacttgctataatgccatttcaaccattttaactgatttccaaatgttttccaatgttttccatcattctctgacatatttgcccctagtcattttgttgactttgttggggaaaggagaaaggggatcgatccccatccagatgccggcggtggagcgtagcggcggcggcggcggcggcgacggggcgtagctgcgagtcggtggccgccggctcctcgtcctcatcaccaccaccacgccaacatccgtcggctcgccgtgggcgtgacggagagggcgaggagagaggagcggagctcgccgtgcgcgcaacggaggcgacgagcgtggtgaagtggtggggagttgcgggagggaggcataggggacgccggcgaggcactcgaagagga

SEQ ID NO: 82926 - DNA, 2318 bp, Oryza sativa
tttttgtgatttctgagcaggtggttgggaatgtctagtccagtccaggcgactttcttgcgggtcgcaatggcatattgacatggcatctcgtgctgattccattatgcgtgtccacgatctgttcgtaggctgttacgagagctggggttgtggtgcctgcgaggtgttcgtggaattgcgcgagtcgagcagaacatagagtggggtatactaccgtttgcagtttatcacagagatggaggagatgggcatcccgtgagctatgaaggtgaggatatgataaaaagttaaaaacctaaatgcttcccctctcgctcactgtgcaaactgcaaacctgcaatcttgtcatacgccttttgcatttggaaaatatggatcctgattattatgcagcttttagacatgatcctgttaggacacatttctattttctgcccaccatcattgtgatagcgcagtgcgccggtaaactattcatcaactgtttgagccaaaaaactgcactcattaggatttacccattttatgcttattcgtgtcgtaccttttgagtgtgatactaccacctaagctactcaacaaaacatgcataaatcaacttgtgcagctacgttttttttttaactggcacagctaacatatgaaataaatccaaatgcagtgaccagattgagataacatgatcaaatacacaagacaagcatcaaagctttcctagtcaggctagttaaggtgtacaaccggacagcagcaagccgttacatggccaaattgttaagaagttttgctaggtagctagtgctaaagataaaattctctccaatcctggtcaaataagtttgctcagcaaggtaactgaaaatctaggacattgttcagataatcagtactgttgctaaagattagttgaatatgtcgagggcctggtgttgcacgtccactgcttgaaggagcttctttgccactgcacatgcataaaccgccgaaccttctgatacctgagttgccatggatgatgaatcgttactatcgatgctaacatgtgtaatgggacaaaaagaatctttgattctactttaagaaaactgaattgttacttaccttagtgttgaacatgaatatatggtgatcacctataatcccacccactacatggataagctcgagctggaactcatctagaacctttgctgcatgaagcagagagttggccttcttcttttcagtgagcttgatgtttacttcatcgtccactatgcggacatcaacgtggcattcctttgacctcctctgaacccatgagctccttatggctccatggagctgattgtcttgatcatccctcactggcctcatcgatgagctctcgccatcagcggctgcctcttgatccaactttaacacctttctcctgttatttccatgcctcttctgttccaccaggatcttcagctccttcactgttcgattgagctcatctatatactcaatggcatcacctactattgaggccctgtcattctagagcacagtttgtaacacattagtgccacaaccaagatatttaagtgctacaatcttgttgaagggtaacatcatgaggatgataacattgtggaatgtgctaacacacaaaaaaggcaaggaacataggaaatatcgaactgaatgcttctattgctttctcctagctaactagaagggctaactcacttggttaggatgaacacaattaggggtgttttgatttgttaccatgtcaatatattggtagtgccaaaacttgaccaactttggtggcaagccaaactttgccaaataacttttcaaaatgccaacaatttggtagggcataatttggcttaaaaccaaaacaacccttaataacatggcactgttatcagtaaagaacatcatactgatgaactatttttcaaaaaacaatcatgttgagtgatatatcagacagcatattccatatacatatgcatcaaaatgtggtaacgcaacttgaagaattttggacagataatttcaaaatttataccagttagatgaatacacagacttataaatttactgttaggtatttgtgatctgtaaaaaaacagagatttgctaaaccggagctatattggtgttggcagtttttgaatcattagttctctgagaataaatggatgaggatatttaaaattttgattatcttcagagcatgagtaacaaatggaaatattattgaaaatctgagtggttgtctgttaatgtgagaatcaccaagttatttacagcctaaccaactaataacttgcaa

SEQ ID NO: 82927 - DNA, 4494 bp, Oryza sativa
agcttttcccttgccctttccgaactcacccttccctctcctgcattcaagtacactatcaaactgcctgtcatctatctcctgaaaaagatctccacttccaacaccaataatcacatctcgttcgtcctcactgggaaacaacccataattttggggcaacgagtggcagatatcctttattagatgagattgagtaccatggtaccctaactggagagctgaatcactagcaaacatcaacccactcccactgtctggaaccgctgctactcctgtaagttcaccgttaagatccaaatagttagtaccattcagtgttgtgtcaccgaatacggatgtcgttgccgggaatgctggagccattgtgcactgcataagattaaggagatctggtgcaggtgtgtaaacaccatttggataaagtgcagaatcatactgctggatctgttgctccaccaatatgttttgtggatcttcgctaaactgatggttgatgatatgatctggtatagtgcagatagctggatcccagtttgcagtttctactgggggaacctcttgctccaaatcaatttctagttgatgttgaaggtggttaattgctcttgcagcttcagctagattggccgtattcgagagagcttctgttgagtacgggtgcactttgaatttctgcaaatcaatgcttgtgttttcactgcttgcaggagcttgatttgagtcatggatcaaagatcctgccatgagactttgatcgtgggaatcctcaaagtaaccagccccaacaatcattttggcaaaacagtgctaggcaccttcgctccaaatctaaaaccaacacaagtaaaaaaacatatgagcagaagaatcaaggacaggatgaaaatgaaggacaaatagcatcttagatgggtgctaatctagtgctaaaatagaaattacttgcaatgcacatattaagggaaacagggctactcaacatgaatgaagcagtggatataattcaatcggacatgaaaattttcagttggcttagctgttttggttgtttcaagggaagatggagccgtggagtttaagctacgcaatctgtctgtctgtttattccgtgtagagaagttgcatatagcatgattaatgagacatgaagcaactttgcttgttgcagacctaacaaactccttaccatctttctttgcctctaatcatattcatattgatgtttgataaaatgtgcttcaaccaccccaagtttactaattaatcagtaaaatgctgagtagcttgaaatcattgccaatgccaaatatacttcatttattataagctgatcactaaaagtaagaactgtaaattcagtatgattgaaagttctatagaacttaacaactaatttacagaaacataaaccaatgctaattaggatttgcatcctgcaaacagtagtagcaagcactggaaaaaacatacctgtatctttgcctcagccaacggttgaatggaaagaacttatgttcatgaatttgcggctcaaagactcatgagatccagtgctatgccaagactattatagtggcaagacatgaaacaatacaatggtgtcacacaagattgattccaaaagaaaaacaacagaaaatgccgatagcagtaacaatcattttgctgaagggtctttatgaccatataataaaggtcaaagtgaagttctatcatatgattgttattgttattataagagacatagccgagaaagacggaaagctcacaccctttgaatttggcatctttgatgttattcacccataggaagttgagaaatgcaagtcatgctttctgcctcttaccatattctatgatttgtactgctgcagttatgctttgagaaactaaacatacaactacctacaaggcttcaagtattcaaagagcacataatcttgcattatgtagtgtagatatcagtatctgtaatttgaacttgattgtatttgtatatagctgtgcagtgtgcactcttcttggtctgcttaattccagatgttctagatctttccggttttacccatcaaggtactgatccttgagtttcagcaccttccctcagacttaaattgtgaagcatcagacactgtaagtttatccagctacaagtgcatgtaaaatagacagatgaccacgatacgcatgcaggctgcatgtcaataatgtagcatcgatcacaccttcagattttgctgtagctgttaatgatgttataggtaactactactttgcttttttttccattgtgaattaataatatgcgtatatttcgtctgcaaagaattttctgaagtttaaactgagattgcctaaataattattactaataggtgatggactcatatctagctctggatcaagggatttgaaccatatagagtaactgatattatataacattctttcacaacaggcaattgttttatgctttaggttgcattgcttgcaatatgacacctgctgagataatctacattatttttatccatctatgttaaattaatcttttggtactggagtcctatctggttatggaatcatttcttagaatgatgcagctatgtgaacagcgccgttctaagtgcttctattaatggtgtaacctccttttctgtttcgtttgatggattcctcgtggtgtgcctgcggtcatcattggatgcaatgtgaattcaatcctgcatgaactatggattgccagtacagttatattaccttcttaacatagttaaccaatacctgttatattctgttgatcaggtagagtttacggattatgcacttctgacagttatcatgaggggtctggaatccattaggtttctctccataacttctgggagctcgcatgcacaagcacaatggtattgccaagaattccactcctgacaaggtgcgtatactgttaacctccacggctctctcgccttgtgacattgtgcacagacgtgcaacctcctgcttggacccaagatgaagaggaggcgtgaggtgttttggaggggaaagggagacgtctcacgctctccttgcttcagctggattcgcggtgggttgaggcacgcagaacgcatttgcacggtcaaatagccgcattctcctgttcaacagagtacgaatcctccaaatcaccgacttcccattgcaacatactcctctcgataccttttatccttcttccatttttgacctcttttctctctttgagagacttttttttttaatactccaatgcatttttgtgtgaaaagactctacttttgttctgatccaatgatatgtataggtgcaattctctattttatttggacgtgttgatggtctggtacgatgcaactgacaatctgacattagtatggtacattccgtaaaggccgattttgcaaaatggaaaaaacattaagacggcagttcggcccacggcccagttggcccaacatagcccagtcggaaatttttttttttgaaataaggtaaaatgcattacccggctttggggagaaagccaaacagcaacatacagaatcttaaacagaaaggaaaggaaaaacaaaaacgacacagaacaaactggggatgccagcatccatgaagctctaaaacttaagaaactaaaccacccaaaaagacactttgacagacagtatcactcgtatacagacaacttccaggaatcaaaccaaagcattatcaggtaaaacatctcccggtcgcagctccttcatcttttgcttcagcttctcaagccagacgttcagctccacgcgctctctttctcttaagagtaccttccaccgattcgccagagcaattgatctgtaaaccacctgcaaaggtgttttaaccaatttgttttcaaacacaaaatcgttgcgtatagtccataacccccaacataaacaagcacaaataaaaattcccagattaacccctaactgttttttgacgacccttagcccatcccaaaaattcagaggtaccttatcacccccaatcacttcaattacagagcaccaaacgaatttagctatagggcaattgaaaagaatatgactggttgattcaactttcaaacaaagcttacaaaatctatcaccccccttccaatttctgctaaataaaagatcagcacaggggattcttcccctcccagctaaaaacagaaaatgcttgattttcagagggaccttgctcccctaaatttcctgcatatccttatcaacaacacccccaaacttcatcagtctgtacatagacttcgtagagaaaagattctttttgtcaaaaggccagattaagcaatctgaggaattattaagttctacccttagcccagtcggaaatgagcccaccttaatcctccggaagccgtacttgcggcaaaagcccattcttaacgtcgtggagcgtcgaaatcccatttccgttcagcgactgaacagaaac

SEQ ID NO: 82928 - DNA, 8451 bp, Oryza sativa
agagggatgctgcgaggcggtgggggaggcgcgcggtcgcgaccaccgacggcggcggtgcggattcgttcagcgatttcgccagggcgccgtcgaggagctaccagcacgacgaccgggacctcacgcccgtagaggtaagcggggtttatttatctgtttatagtctgttccactgttattttgcactatcattcaacatagtccgattgctgatgctatcgttggaattgctggacactttttttttttaacgaacaagatggacacttttgtgggcaggtgggatgggaggttaattgaccgatcagttaattgtctatatttgtttatttacctatttacagttagatttaatggtcgatgtttatcctacatgagctgtttcgtcatgttgaaattatgtgtaatcaactaatcattatctagagttacttgattaactgagactttcctgtgggtttgcaggccaaactaaagcctctcctctcaagggccaacctccttatcgctagggacatagaatgggcaaatattgtgttggctttcgagcaggtaatgtatctgtgtctcatttactcatttacatgtactgaagttgcgactctaggatgcttctcttgctgtgtttggaaatgaaatagtaacttgtgttcaattgtccttgctatattgtttttgttactgtataaagcaaccggcagttttcacgtgattcatggaggatagctcatacttgaataagtgcttcatttcttgggtaaaaaactgaaagaagtgacataattcattttaccagcaacaaaattacataattcattctgcgcttcagaatatatgcacatttatttgggacattgatattttctcccagttttcgaattatgtcttttgattgtttcagactttcagcctgttatcacttactgttattactcgtactgcaggagagtagatatatcataatggatccgctctttcctcaatcagtatgtgtactcagattttcattggttccgttgctgtattactctgttgttgtattattttattgtcttagcttcattattgacttgtattttttgtcgaatttccagcctgttggtttcattcgagagaaaagcaatgtcatatttaggcaggtatgtctcgtgattaatttatcctaaataagttaataccgtagtagctcatgtctcatggccttgttctttacttcaaagtaacttagtggaaaagagacaggattttgattctttaaattctctgcgtagcagtacttaagttcgaacatatatgatttcatgttctaaatattaaactagtgtcataatctcataatatgttgaacttttcaaattaactattattgtatgctctaatgtatagtgtgatatttgtactagtgtgcttagtcagcatcgactttattttatttctttataaaatattatcatgatcttatatcatgcatgatgtcctattgagttatgcatttctcttcctagtgctaaagaacagctgttgatttttagtaggttagacagatccctttcttttagctatagcaccagtaatgactccttttcttttgtgttgaatgattttttggttgctctctttgctgggcaaggagtctcttgccacgttttcctgtaatgatcgatgctacaaactttcagttagggtggctgtgatgtggtatgtaaaatttcacaatgtgtataatgtggtgggactcatgcaatgttatgtagaatttttcgctgggccggcaaaagaaaaccggccaagttttgtattaagaaggagagaaagttttacaacagaccctaaaccagaaatggcttaggctacagaaaaatttcacatcgatttagacaacagacaagcacagctgctaaaaccttagcaaattagccgccagcgattgcactcagtagcccagcagccttccatgtttccacttgtcgacaattgtggcacaaaggtgaaccgctgaagtagctcgtccatcaaacacatgcgcattcctttccttccaaactatccatgttaccaagataaccccagcatcaaaggtcctccgatccatcttgtgaactgatttgcgcgcttcacaccaccaatccaacaggtcatccatgggggaaacacaggagagtcccaggcgactcctgaccctcgtccaaactgccctcgtgtactcgcaagcatggaaaatatgggtgcatgattcagcatccttcccacaaaggtgacagtatggggccaagtgccatcctcgccgctggaggttgtccgccgtcaggcatgctccacgcatggagtagtagtatctagctatagagactgggaaaatagagatatggaagggaatgctttggagaggggcgcaaggctgtaacttgtgggtgtttgaattttttttcaaaaactatttaccctcccatttttaatgatctaacatgtcaatatgttaccatgttaagtgattactgggatgcaggggatgggctatatctgtgcttttgttctgattcaacttaatggaaacatactttacatcttctttcagagaaatatcaactcctccagttatcatgcagaatgttttatgtataatttgttttatcgatctggtagatttgaggtatagcataaaggttcattagagaaccttaactagctattaatagcagtagtttaaaaagaagtgttctctattgtacatgttcggcttgtttatttgatctggacttgttgattacatcgtttcaaaatttgttgcttattatcttggttgttgtataacttttcattgtgatgataaaaactaaatatgtatcaagtttgtgtaactgttgtgcaaaaaggtattgtgtttatttacccattccttatctttgatgtacaagaaacattttgctaatgtttcagctatttcgctcaagaaggccatttgttgcagaaattactgatgctatgggcaatgagatcttcacggtactatttcataaatttattactgcactcctttgcaaatatgttcttacaccatttaattcaggttcgacggccattttggcttatcaacagttccatttatgcagaagtgaatggcaaggtatgcaaaaattctttacttgcttctacaaatttatttagatgggaatgttgccatcagattgtttcacggaatgtactgacattgtttcacggtttcaatttggttaggaggtaggcgtagtccacagacgttggcatctctggcgtagaatttatgacctgtacttagggtaatttgatcttctgatctctatgttcccttgtttcatagactaaactcaaattactcaattctttgtgtaccttttagtattgctttactgcctgacagcttggtctgccaccttttgtgttctttaggaataggcaatttgctgtggtcgagaatcctggattttggaactggacctttactctcactgatgaggatgacaatgtactagcccagattgatcgtaattggaggggaatcggttttgaggtaaatatcttttctagtagagaattgtcaaataatatgctttttcttttatgttggtgggcattccatgcttatctgacaagaaaaaccagatacatatagattcattatttacagattgatagtaagaactgcccttccaaatttatatgatggtgttgcttttttacattgcttgaagtttttttttagagaactcatgaattatacaggacatgctcattgtgcagtattttgaatttgctttgtggtgactccacatattgtgcagtttgatccaagctgatggcagatgccacaccccacatcttttcagagtgcattgtttcatttgttgcgcactgctacttctagcctgcataaaaaatgggactgaacttttaaggactgaatgtatctctggttcactgcagctcttcacagatgctggccagtatgcaattcgatttggtgatgcaggactaaaccgtaaatttggtctcgcttcagatgtaagtgctgttctcattttagtacttcacaagccacgcattgagtgaatatttttttgttgcctaccttgcctagttaactgctatttacctgatcgagatccatgtcacaaattatggtcacagatcgatgaactgcatgttgttcgccagctgagtttacctgaaagggctgttgcacttgctcttgctgtgtctctggattgtgattatttttcaaagagaggtggctggtaagtgccgtgtgaacttaacctgtgtagacggttcctctgtaaattttggtttaactactgttgttgggaaactgattgaaatgccctttttctttcaggggacttccttttcttattgccacagagtagacgcatatgacctactaccattttcagcacaagaggaaaaccgatgaccttcacattgttgattagtgaagaaacttaatgggtcgactattttgcgcgattgagatcgttaccgaagcacgaaacggttttttgtgtcactgcatgtgctctgctcacttcacctgtcttctagtacgtgtgaatttcgaaagcagatgtcacccgaagaagtttgagcttaacatccaactcgattccgttttgctacagtacaacttgcagcgatgcagtagctcttcattagatggatctttcagctttcaggctgcaacctgtttcatccttatgccctgtggatacgaagcaaaccccatgtatgatggagacgtgcattgaagtctcgattttactgcaggtctctgaggtgctataccgctgcgagtgataaattactattgccatgcgactctagcggtagtaccgtaactctagtaacattgtaccgtcgtcagaactcagaatctagtatctggcatcctagctacaactctcataatccaatacagatacagtactttctacaggggaaaaaaacaaaatatcgtatcttttccttaggggagacggaatcgaactcttaacacgcgaggtaattggagtgatgatgtgccttcgtgcgtggaaagatggttagatggaggtgacagggaaggaaaagccgtccggaccggggagagatgacacggatcgcgtgggcttttcgtacaatccgacgttctcactgtccataaggcaaagccttgcaggccgaaaggcgaaagaattgggcttttcattgtggtagggtctcgtgctctcgttctcctttgccatctcttcgcctacaccggcttcgtccctctcctgatcctctcgtcttcctacgaaaaaaaaatgaaaaaatgctagtgctgcctacgagaggcgtcagctgtagtaacttgtacagctactactttcaccgaattgttctcgtcgggaagcgtggggggcatcggcgtgccagtagttgttatttccagaagaacagcagttggtgcgagcttttactctggaaggtgtaggagcgtcgggtgtgtgttcctgaaaaaagttagaagttagaaggaagttgagagtttaaaaaaaaaagttaaaagtttatgtgtgtaggaaagtttttgatgtgatatgatgtgatggaaagttgggaatggggaggaaactaaacacagccgttgttgtttttttttttgcctttcctttttcatttcaaaaactcaagcctacttgaatccttgctagcagtaatagttgtaattcgaaggttattgagccgaatagaaaaataacgacacaactgctacaatcgtgccgcggcaaactacaatcacaagtaaacttcatctcttaactccactaaaacaacacttagactatcataaggactccccttaaaacatcgccttcaacgaggaaatgaggcgtgcacgcgccgtcattgtcatgttccaatcaactaggatcagaccattggttttcacctagggaaattccgtgaactccagacaatgccttcaagaagggaagaacgtccattgccaagtacaaccaattaaggccaaacttagggatttaaccccggagtcaaagaattagtaacaggcaggagtaccaccttaacgaagtccactagcattggttgccccatcattctgagacagaacctccataccttccaaacttaacacaatcacaaaaaggccataaacatcatacctgcatatttctatagatacccttacaaagataatgtcgcgagaagccgaaaaggtgcatgcccaaaatccatagggtggatctaaaggatgtgacttagatgtaagcgataccttgaatcgaagccaagctgacgatgatctatggtagatctgaacgtcaccgccttatgatgaagaaaacatcattacgagaagtagccgctaaccattggataagaagatagtcggcgttgtccgcccccttcaattgcgacgaggtgaagatgtcctcgatgccggcgaactagagaatcttcttaggcacgcatgccgctacgatgcccaagccctcgccggctccaagcgaacggtggaagtcgcacttgccggcgatgtgcaacttccccatcttgttcccctagtagccacaatggaggttggcgacgatgacggtgtttatgaaaggtggtgtttacctcttcacttgacccgagcatgacacgctcgttgcaccgtccagccgccgccgttgacgaactcatccaatagtattcgctgctcagcgcgcacctgtgcgataccccgccgctgccttcaggccttcattgcaccctgcatggaagtgtgctctggcggcgacggcgagacagcttcactcggcaagaaggcgcactcctaatcgccgatccgcaaattacggattgatccgtaatcaacacgtgagcaaaaaaaaagaagaagatagttttgataaaaagttgcaacttttaaaatttagtcatgatgttaatatatactgtagtctaccctccgtctcaactaaatataatcctaacagcgaatctggatatatgcgtgctcagatttatagttaggatttatttatttttctttcgagagtatagtagatgtaaacgagtgaacatttgcaacagtgaaattttttgtttttgctggcatgccttgtgtggattcctttttgataaaaaaagaactggtagcagtaaaatcatatcaacgcggccaatacactcgacacggtcacacaccaccgcggctgcctctttgccttccccatacaaagggtccagtccccgatgatccaaaaaggcccgaaccgcagcgtctcggttctttcttccttttacttctcacagaagctgaagagactcctccgccatcaaacccctctcctcctccctcatcccactgatcactccggtttctccgcgagcagcgaagcgaccgccattagactcgacgcgaccgcgactccggcgaactactactcctcctcctcctcctcgctcttcctcgcgaatgctggtcgcggcttgctgctactagcctctccaccacccagtttggtcgatgagagagaagggcccctgccgcggcggcaacatgggggagagggatttgggcgacatcgtgctctcctggtcgctcggtgaggtcatggacgacgacctctacagaggaaaggtgattgatcgatcctcatggctgctaatgattttgcgcgaggcagtgttgctgacctgagcaatttgtttcgttatttttttattaaaaaattcggggtgtgaactgcgagatggatgcatggggttttcggtgtacgatttttttttctaaaaaaacgcaaatattagggagtgacttaacatcaaataattaaataattaaaaggggtgaggcttcgaaatctaggtcgtttaggccaccgccttgtttagctaaccagaagacccctaagcgtttctcgtacaatttgttcttctatgtttacctgggagcaagctgttgtatattgtagatgttttgtgagtcgcttgtagtgtcctgttgcttaatgccttgttctgttatagaagctcactagtcagtagtccgtacgtcctgtaacctctgtagtttggagtgttcggaaatgcagttgatactccctccatattttaatgcatgacgccgttgacttttaaccaatgtttgaccattcgttttattcaattttttagtgcaaatatgaaaaatatttatgtcatgtttaaagaacatttgataatgaaccaagtcacaataaaataaatggtaattacataatttttttgaataaaacgatttatcaaacattagacaaaaggtctacagcgtcatacattaaaatatagaggtagtatatgttctgattgctgtgtacgtgcaacgcgatcaataaatggtttgctactttgattatgcatggggatcaggaaatcatacgtttggctgcaggaattcga

SEQ ID NO: 82929 - DNA, 11443 bp, Oryza sativa
agtcccggttggtaagatcatctttagtcccggttcaaatgctgtcagggcttgtcaggtccccccgggatctttagccccggttcataacaccaaccgggactaaagtcccacccctatatatatatatgtcttcttcctcctccagctgtccgagcaagcttcaaaatttcttcaaaaaagaggggaggtcatgccaaaatttctagtgaatttattttggtgattatatacaaatcggaggtgcctaaaaggttagcaacttcatcctccaatgtttttttttgtcatattacatttggagctatgttttgcacatttttatgtctccaaaatttagttgtaagttgatgagagagaaaatttgtgtggggaataaagaatatatagaaatttagtttatttgctaaagaaggttttataaaatagttgagaaggaaaatatagtgaaagttaatcttaaataatagaaaacaaactaaaatgaaaattaaaagaagtacaacacattaatattagtttaaaactttagaaatagtaaataagaattatttggtgtaatattttataatttttgtatgaataatgatatgttattattgtatgactgttgaaagagtttgtaattattttataattattgtatgactgtcattattgtaagaataattatttgtgtacgatttttttttcatgtcatgtagatggattggcaatggatgtacgctgaccggcggtccaaagagtttattgacgacgtgcattatttttgagagtgaccgaagctaacaggcataaggcttttatttgttgtccatgcaataagtgtaagaatcagaaggactattctgcatccaggactattcatttccacttgtttgagttggggttcatgccaagctataattgttggacatcccacggagagcaaggtgttgaaatgcaagaagatgaagtggaagacgacaatattccggactttgctcagtacgttggatttaaaggaaatcaaacgggcgaggaggaaagggatgctgatggtaacgacgttgcggatgatcttggtcagatgttgcaggacgccaaggaggactgcgaaagtgaaaaaggggcccataaattggacaagatgttagaggaccacagaacgtcgttgtacccaggttgcgagcaggggcacaaaaagttggataccactctggagttcttgcaatggaaggcaaaaaatggtgttagtgacaaggcatttggcgatttattgaaactcgtcaagaacattcttccggagggaaacaaattgcccaagacaacgtacaaggctaagaagatagtctgccctctaggactggaagttcagaagattcacgcatgtccgaatgattgtatcctatatcgcggtgaggagtacgagaacctagaagcataccctgtttgcaaagcactacgatacaagattagacgagacgatccaggagaagttgacgggcagctaataaagaagagaattcctgctaaggtgatgtggtatttccctataataccacggctaaggcatttgttcaggaacaaggggaatgctagaatgatgtgatggcacgctgaagagcgtcaacaggacgggatgctgagacaccccgccgatggttcgcagtggcgaaacatcgacaggaaatttaaagactttggaaaggacgcacgaaacatacggtttggtttaagtacggatggcatgaatccttttggagagatgagcagcggccatagcacttggcccgttacgatgtgtatctacaacctcccccctggctatgcatgaagaggaagtacataatgatgtcgattattattcaaggccccaagcaacctggtaacgacattgatgtatacctaagaccactggtcgaagatcttaaactgttgtggaaaaaggaaggtgtccccgtgtgggacgaggacaaacaggaggagtttaacctacgagcgctgctgtttgtaaccatcaacgattggcctgcacttagcaacctttccggtcagtccaacaagaggtacaaggcttgcactcactgtatggatgaaacagaaagtacgtatcttaagcactgtaggaaggttgtgtacatgggtcatcgtcgattccttgctgcaaaccacccggtacagaagaaaggcaagcactttgaacataaggtggaccaccgtacgaagcctaaacattgcagcgggaaaacagtgtttgctatggttaaagatcttaaagtagtgttcggaaagggcctggaagccagcctatagagagcaaagatggtcacgcggcgatgtggaaaaagaacactatattttgggagttaccctattgggaattcttggacgtccaccatgcaatcgacgtgatgcacctcactaagaacctttgcgtaaaccttcttggcttcctaggtgtatatggaaagtcgaaagatacagtggaagcacgtaatgatctgaagcatatggaacaacgcggcgaccttcacctggaaccaaaggagaaaggaagccattacttgagtctagccagctacactcttagcaaggcagagaaggaaagtatgtttgaatgcttggagaaggaaagcatgtttgtatgcttgaatgcttggagagcataaaggaaagtatctgataatccacgaatatcaagcgaataataagcacgaaggagaagaagttcacaaacctaaagtctcatgactgtcacgttttgatgacacaactgctaccagttataataaggggtatccttccagacaatgtccgggcaacaataacaaagctatgtgcattcatgaacgcaatttcgcagaaggtcatcgatccggatagattagaagcccttcagaatgatgtggtgcaatgtctcatcaattttgagttgatatttccaccttcatttttcaatataatgatgcatctactttgtcaccttgtcaaagagatcagtattctcgggcctgtgtacctacacaacatgtttcctttcgagaggtacatgggcgttctgaagaagtatgttcgtaaccgtgctcgtccagaggcaagcatcgccaaggggtgtggaacagaggaggtcatcgaattttgcatagaatttattgaagaccttcgcccaattggggtacctgaatcatgccatgaagggagactacatctcatgggtaacgagacgaacaaccaacaactggccttcctggcaaggggacaatctgggtcgatcacgacattccagggatatgagatcaatgggtacacattctacacgagagcccaagacatgaagagcacgaaccaaaacagcgttgttcatatcgatgacatgggtcacgatggaacaactggcacgtattacagtgccatcgaggacatatgggaacttgactatggtcctctcaaggtccctctattccggtgccaatgggttaggttgactggtggaggcgtaatgattgatgacagtgggatgacaacggttgaccttaacaaggttggatactcggacgaaccttttgtccttgccaatgatgtaacgcaagtcttttacgtgaaggacatgtctagcataggaaagaagggcagaggacctgacgagccgaagcgtcacgtggttctcccaggcaaaagaaaaatcgtcggagttgaggacaagactgacgaggattacgattagttggatgggcaaccccctttcacggtgacgattgaccctagcatcctcctatcaaatgaagacaccccttactcacgtagcgatcacaaggagggaacaatagtgaggagaaagtatgtgcggtcaaccgtcaccgccgatgtattgccgtaattattgtgtacacgatgtaaactattttggatgtattgattatccatataaatcaattgttgtatggcatatgttaattacgtacaattattagaagttttaacaattttaaatcatgtaattgctagttatatgcgataattagaatttttaaaagtttaaatcatgcatgtggcatttacatatgttaattagagtttttaacaattaatttaatatcattcatatgctaattatatatgattatttgaatttttattaattttaaatcatgcatgtggcatttacatatgttaattagagtttttaacaattaatttaatatcattcatatgctaattatatatgattattagaatttttattaattttaaatcatgcatgtcgtatgtatatacatatgttaattacaatttttaacaacttaatatcattcatatgctaagtatatatgattattagaatttttattaattttaaatcatatatttgcttattacgttttatccacttaatttactacagacaacaataatttttcgaagtaattgtcattaatttttcgactttaaataattttaatgcattattttctattttagaaacacatatataatggaaattaatattcagtgtgcttatcagtagtcccggtttaaaaagaatttggaaatagctggaaaatatctttagtcccggttgatgagaacatatctttactcccggttgttctcatcaaccgggactaaagatctaggggtatatatattcccgatgtgcgccctcgtcttctccaccaacacttagaagttttttccccgatcgatctctctctcggcttctccttcgctgccactgcctagggcatccccacgccgacgctgccatcgtatctcgtcgtcgtctcgcgcgcgtcgtcgtcgccgcctccgccgccgccgcatctctggggtgagagccgccgccgcctccctctctctctccgacctcgatctctctctctctctctcccaaattaaccaccgctggccgcctcattgccgacgccgccgccgacgtcgtcgcggccgaacacgactccgccgcgacgatgatgccgaccccgacctcgatgtggccgccaccggcgacgacgtcgcgccggccgtgccgacgaagccgcgccacgacgccgggccgcgccacgccgccgcggcggcttgacgccgagacgccacgatgccgccgcggcacgccaccgccgcgccgccacgccaccgccgcacaacgccgccgccgcgccgcgcgccacgccgatgccgcgccaccacgccgccgctccaccgctccactgccgccacgtgaacgaacgaacgatcatgaacgagaacgaacgaacgaacgtgaacatgaacgtgaacgaacgaacgaacgtgaacgtgaacgtgaacgtgaacgaacgaacgaacatgaacgagaatgtgaacgaacgaaacgtacgtgaacgagaacgtgaacgaacgaacgtacgtgaacgtgaatgaacttgaacgaacgtgaacctaacgtgaacgtgaacgaacgtgaactgaacgttgtatgtgaacgtacgtaaacacatgaacgtgcatgaacgaaaagtgaacttaacaataacgcgaacattacttaacgtacgttaacatgaacgcacgtgaacgaacgaacgtaggtgaatgaaacttgaacttaacgacaacgcgaacgtgaacgatcgtgaacgaaacgtgaacttaacgagaacgcgaacgtgaaatacaatatatgttactttgcgtttatcctaatacatctttttgtatgttgcagaaaagacgttgtcgtcgtcgtccctcaagccggagtggtcgctagccctcgaaggaattcgcgcaggcaagtgatgtaaatatatgattgttagatttttaatgcaattaagactattagatttaatatacgacacttagacttagcaacataattagagttttaatacaatattatttgagttttaatataagattattatagttttaatataagattattagatttgtaattagacttagcacataagattgtgtagggttctaatatacaacagttagacttagcatatatgactatttgagttttaatataagattattagagttctaatacaagattatttgagttttaatttaagattattagatttgtaattagacttagtatataattattgtctagggtcctaatatacgacacttagacttagcatagttgactattacagttttaatacaatattatttgagttttagtataagattattatagttttaatataagattattagatttgtaattagacttagcatataagattgtgtagggttctaatatacgacagttagacttagcatatatgacttagcatatatgattgttagcatataagattgttaaagcaaaaatgacctatagacttagcaactatttcttgtatgaacagatggctgatcgtgatgaggaacagatattgtacgatacaatcgcggagggaaggagccagtactggagcgaagaagaggggaatgaggatccaaaccagtacttgaacaaggaagggaacgtggagagggatgcggaggggaaccaggaggggaacgtggtgaaggatgtggaggggaaccaggaagaggaggctagtggaaatcaaccctccgctggacagaagagggcacgcgggcaacaaggtgccgcgaagaagctagagggtcggcacatcataacggaagtggacgaagacggctgacctagtgccccggcggaagcagccaagaactacgtacgacacagcggttgggttgtgtgggataacgtgcctgtcagtacggtgtactggcgcagaacaagggcacgcggagatcatgagagctttgtcccagattcggagaaagagatgctgtggaccacaatgctcgagacattcacccttcccgcgggtacagaggacaaagtgaaaaggtggactctaaagaaaatggcagaacagtttctgagcttcaagggagatctgtaccagaaatatatcctgaaggggcagacaccgaactttgacacattcccaaagctaagggatcactgggacgagttcgttgcatataagacatgtcaacaagggcaggtgatgatggaaagaaacaaagaaaatgccgccaagaagaagtaccatcaccacttggggtcaggcagctatagcgtcgcgatgccgaagtgggaggagatggaggcaagcttgcttgagaggggtatcgaaccggccaccgctaaatggctggatcgatcgaagttctggtactatgctcacggtggaacgctcaacccagttgatggctccctggtcttcagcgatcagatacgcgaggctacgcatcgactaacagacgcagtggaagcctcttctcagggcacgttccgacccgacagagagaaggacgagctgtcacttgccctgcagactccagagcatctaggacgaacacgagggaaaggggtgattccttggaagattggactcaaggaggacatccacacgtacaggagtcggatgaggagcaagagagataccagggcgaagattgcagatcttgagtacagggtaccgaactacgagctcagcatgtaagaggaggtggcaaggaaggttgatgaacgcatggccgcacatcgatcccatgatccccagccgaccattcctcctgcaatagtgagcccttcaggaaatcgtaacagctgcacctcaacggggcagataggatcacagagcatggacgccatgcaaacccaggacaaaaccacctgccccgttgatgacatcactcagcggacaccatgtgagctgcatattcccttcaggaacttatcaataaaggtaagctcgtagtttatagattttagatttgtccattccgcaagttgctccttatatatgttaattactaataaataacctctcaccacgtgaaggtggcgtcaggcatggccatcccaacgaacccttcaggtacttaccactgcaggccgattccagcaggatactccaaggtcgaagttgagttggtcgaaggcgcgtacgaggacctcgagttggattaccctggaggagacggtgagacgcatctacgagacacaagccacgccattatactatggcgcaagcgggacatcatcctccctgggcgacaagctgtgtctcgtgcaccatctcctccggctccgccatctcctccttaggctcctgcaccgtctcctcctcaggctcctgcaccgactcctcctcaggctcctataccgactcctccgcaagctccttatccagcacctttcaagtcaagggccccccaagctccaccgcctgcccccacaagggcaacgaagaaggcaaaaattgacgccgccaagaacaaggacccggggtacgattgcacgcaagaggagcttgacgcttatgtggcatcaaaagtcaggagacaattgaagcctcgaagtccaaaaaagaagattcctatagacccgagtgtcaggaacttcttcaggggtatgtctgcacctgccaaggaggccataaagctatcggactatgagcgaacactcaagaaagcatcttctgaaaagtccaaaccagtccctcagcttggagagcaaccaaaccaggagatcgagccgttggtgaccggtgaagattttggaatagaagaatttattactgacaccgggctaactacagatcaattactacgaggcgcaccaatcgaaaagacgaaagtgaaatacatgtacgaactcagtaaaccgcttgtcaagcctgagcagctgcagtccctacccacacaaatgtacaagttccatcaactgtacatggagatgagcgccaccggtagagagatgatcggagcgaggatcagggacacggacttcttgcaaggagatgacattctctggatcaatttcaagggtatctacgaactataccagctagacgctctcgacatctctattatgagttgctggattttgtaagtatcgttcagttagatttcttattacgtttcctttaattaattaggtccttgtatataagtagactatatataatatatacttccttttatcattgtagaatggagattcaaagggcccgacggcgggggttttcgatactggattcatcgaccctcagaaagtaaacgtcgcaatgctcgaccagtatccacaagccacagaggacaatctcgtccatctcctgaaggcgcagcattacaagacgtttatactattgctgtacaacacaaagttagtttaattttactgtcttcctataccaaatttcattcccgtacgaacatgctaagtgtttcatatgtaatgcatcccacgcacattgcagattccacttggtccttttactcttcgacctggaggcctgcaccgtcaacgtatatgactcaatggataaaaaagaatctacgtttgacaaggttttcgaacttatagacaggtactgtcataagttcctatgttaattaagaatcttgttataattaattgctactacgaatcatagctttaaactccatgtagggctttgtatcggttccgtcatttggtccgcggcaaatggagagaaagacttacgcggaagttcaattttcctgtgagtacacatgctctacattgaatctcccattcaaatgcatacaagtgtatattaattagatctctcgccatttatcatttatttatagtgcgcaaagcaaaagcagggaactaacttgtgcggctactacgtgtgcgagtattgccactgccttgcagaccaaatcatcaccacaagagagctcgatgtacgtacaaataaattcaaaatttcattgcgtacatatcgatttgttgtttaattactaattaatttcatacattcatatagtttattcgcatgagagataacctgatcacacacaaggaatttattgcggcggttcaagaacaactcatgggattcatcaacgaacaaatccttgatcccaagggtgaattctactacgacggaaatacaattcatatgtccttagcttctgagataacgactactactacgtcgaaatcgtagctagctaggacatcataatggattgtaattaatacatgtctatttttctatatgcatgtacacattttctttaatgtaaatatatatatatatatatatatatatatatatatatataaaccatgcaacaacagggccatgaaaaaaaaaaggttagctcgttctttagtcccggttggtaacggctcagccatggctgagccatctttaatctcggttggtgttacctcgatctttagtcccggttatttcacccgggactaaagatagtcccggattggtaatcccggtttgaaaaccgggactaaaggggggttacgaatcgggactacaaacgcgttcttcacccgtgagtgtcaatctcaatgtgttttttttgtagtagtgacttccccaatccactggacgtgatgaatttaacccgcccccttgatccacggaagaggcacaatgcgggaggtgataggtgttggcgacgggtgtcaacgtttgcaactgcaggtgccactccgtacgctcggcctaaaataagggcaaaattacagttttttcttttgatgttcatattacgttctctcacatttctactactattaattatgatggtacaatataaattcatccaatctcttggatgtaaagatattaatatgtgttagatttatctctactacgggccgcaaagaggcataaggaaataaactgctaggagaatgcagggtatcgaacaaagcttgaacagaggtggcaatttaactggcaatgtgggcgcgcggagtcatggaccttcttcccaccgatccttacccttaacttgagcttgtcggtgaagctgaatcggttactaaaccaaactaattattaaactctgctgatgagtctcacggccttttccagtttctctatgcagctgaccaacaaatagtggtgtggcttcgaccatctgaggatcagatcgatgtgccgctttttctacagaacacaggaccatctcaatatgtctcatcgcatcgaatgtcctatttggcgaatgacatgcaatgcatgttaatttcctgctaattctaccgttcgcgtgtatatcgatcgagccctgaagagagattaatttaagcgatgattatccgatcgagaccagtcgttgccaacgaactcctgctcaccaagtacatacgatcgagcgagtatatatatacgtacattcatacggccttgacggctggggcccacaccaatcaacgccgaaaaatacaccccgttctacgtacacgccggaacatgcagatgtatatacataccggccaaaatgtgatgcaaatacaataaagtaattaatagtcgagacgtcgacgcatgcatgcacgttgcagagctcggaattaaacataacatggcctgtcaattcttaatctctcgatcactgaata

SEQ ID NO: 82930 - DNA, 44776 bp, Oryza sativa
ttttggaataagacgaatggtcaaatatatgggaaaaagtcaacggcgtcatctattaaaaaacggagggagtaaggtgtaactgaaagcctggttgagcactctttgcttgtgaggtagtctttacctaagctatgtgccaccttgttcgtagaccgatagacccgaacaactttaacttcctggaaagcactgcacttgtttatgatcacctggataattgacccatacaccgacttgttataattgtgatccctcatcatattagccacctctagacaatcgatcatgataattagtatagaaaactcaaagatatagtcgtattggctttgctagcttagagagcatgtacaatctgaaagaggctaagtttctaatattaacaatgcaagtagaaattgattcttaaaaacttatgagatatttagcccatcagagatagacacatctcatatcaagaaaacaataaacaatacttgttttcatgataagctaatgttcctctaaaagttaatatggtggtttctaagtgttggccgcattggtagcaaacgttataaacaagttattatattatcaatataatatagccaaaagagtactgaacagacatcaaatcatacatgttgttgagaatagaaataaaaagtacattccaaagcctccgatgccttactaattaaagaactgtataatatataaccaagttgagatattaacaagtggcattttctgaaggccaaacttttgcactgttataataacaaacgattcttaatttcattgaaatacatactaaaagaaatcgaggccatgtatatatataaatgctcacaaacgggattcccttcattcacggttcatgaacttctctctgacccttttgaagcatctaccaaaggtttactacgaacgatacgaagtacgtacagtagtttaccaagggatttgctttaattctcttctagcaggatcacttgtacacaggatcactcctagcagtgcagtggttggcctgtagacgtgcgcatctcaaactagttttcttccagcaacaacccgcgatgttgttgggaatagtccaacattgctaatctagggggagttgaaccaacttaaaagtaaaagtgggggaagcccttcacctcttgagctagcttttggggtgtagcgaggctttctaccagttggttttgggccaacaaaagatagtgttgttgtggagaaattgtttagtgcagttcccgacaagtttcttcacattgttggcaccatcgagcaatggggtgatgtgtcgaagatgtccgtggcggaggcaatcgggcgcttgagggcgttcgaggaatccttgaagggtcggcgccgcgaaccggaggttgagtatttgttgctcacacgtgcacaatgggagaatctctatatcaaggagaagaaaggagaagacggcagcgactccaacagtagcgagcgcaaggttgataggaagaaggtaaagtgctacaactatggcatacatggtcattatgctaacgaatgtcgcaaaccgaagaaagaagaagcgctgctcgctaccgcggacgacgagccaacgctcctgtgaagattgtttactaggtattccaaaataaagacaacaagattagtgctaacagatgtagcaccagaaatcctgacacctcccaatccaaagcgattagttttatagtgttgcatagataaacggtgtatataattcactaataattcagtatgcctcaacaacatgtagatgaagttcttccaactgctgtgccatgtatatatataacatgtagatgaaggcacatgctagtgtttaagaactagtatatatatgcatgatgctctgtatgctactattatacaaatttgcacatgcctgcagattgctggttttttatattttagcccttttcaaaaacttattcggtagatagacccatataaaagcttattactggaatatacccttttctggatgctaaggttcatggcgcctacgtccaatgtctcggtgccaataccctcgacactgtagcagccaatatgtggaggagtcgacaaccaaggaccaatttgtaaaagtaattctaaaaagggttgaaatgtaaatatcttttcatacaaataggtcctcaacacatgctggtgtcaagggcctatttgatagaaagcatttacgtttgacctttttaagaaattaatttacaattatgttatctacgccagtctctttaataatgaccccgttacaccagtgcctaagctataaacatgggcaagggctgtcaacgttagtatcgttggctctgagacattgaacctttgtgccaataacttggctctgagaaaaaaaaaggttcattcttataatatatttgtaaataaatgtttaaaactaactaaaatgtaaaaatttcagctgcagattgcatgtctgtttgtagacttaaggttgtaaaacactgaacttttggtaaacagaatacgcacatgagtctagacgaccgtctccttttttgctcatcaccaatggttgactgattttgaaatggaaaattggtttagatgtcagaaaaacacaatgtactacgctgtacaagctataaaaaacactatatacaatgttaataatagtattctctgcaccataaaccactataataaaacaaattttacagacacccccaattcgatcacggatgagcgtaaagaacatccatttgtaaaaaatatatttggatggtgtttagtacagatccactaacgcaaatcaattttcgcacgcggatctcttaataagcttaccctcctctccttatcccctcaactcctccgcttcacatcctcatcctctttcccatttactccctctccctctctcttccagtctcatttattcactttcctctctcttactctctcatgcgctcctcatcccctttacttctctctcacttgtaggccggtagaggtgcatgaggaggttggtgcactgcggcgacggttagtctagcggcgctcgaggaggctagcagaggaggctcgcgttgacgctggtaacagcatcacctcctcaggagctgccagccacctcgcagatccggcgatgctggccttctccctcgcagacccgatggcaacggccttcttccatgcaaaccagcacagccagccttctccctcgcagatctggtggcggcggcctcaggagcggtggatccaccgccactggcctctcttgtagatctggctatgacaatgatgggtggccctggccctaggaggggcggattcacatgcgttagcgtcaagtgtggcagtggcgttgacgacgatggcggcaagcttagcagtggtggatctagtggccacagccccgggaaaggcggattcgccgttgttggccttgggtgcggccagtggcggagccacgttgagtttgggtggtgcacaggaaccccctaaacttacaatgtctcacttaaaaacactagaatatgcagctttgcatcgaaatttttatagattttcaatggttagtgcaccacccttactttgatgttagctctgcccgtgggagtggcggggtctcaacaaagatgatagtggtagcggactgcatagacgatggtggcggcaagggcggatttgagctagggttttgcctatttgaatttttatttttgttgtgattttcgttcttgcaaacggatggcataactgaccttatgtgaaaattaccatctgcatggggttttgctactcgtatgggaaaatgttgatttttacatttttatagataaactcggggggcaagcgcttgcattgcccgcttgcaaaaatccgttgtagccttttgcagaaatgtaggctgtagcatcatttggtttaggcaaagaaagtacaaggaatagaactctataacttttcccaaggatcctccatctgaatttctttccctgcttgggtaccccaggaggcgcaggcagccctttcaaaaaaatcaaagaggccaagccggctcggcaatcatgtggacagtgttgcagttatggtctaccgtgatcggccataacgtcgatagaatttgcaaaactaaacttgaaccagttcctggcacctccgattcccaaaactcatcatcaactgatggctggtaggagatgaaagttgagagctgaaccaatagaagttggagccttccactgtttctatccaagataaccgactcagagttggaacaaacagaggttgagcaagtatttatataggcatccatgtacgtatatagctttgacatgtctgtataagttgatatcttctgcaacaatttgggatacatatagtacggtacggtacagcaacatcagtatatattaatttatatgcaaacataaataagagttgcgtacatcaatttatatgcaaacatagatataagttgcgtattactgcttattgggcatagtgtaggtctggcatgaagtgaattaagtgatatatggtgaggtacgaagtaaattaagtggcactttattcagggtgttagaatatacaccaacagaccaaatttggtttgctgcagaccgggatacagctaccttgtttgaggcttagagcctatttatgaggcccaattcaagaggagaacttgtgggccaatggccttaattttcatgaaattgatttaactagcaattttggagaataaccccaaaaaagattgggctccctagagattgaaaaactattcgcagtttctgctattgataatgcattaatatttctttcttgatgtgtttatagcctttaattcgtcaaaactccagatcccttcttttcaggacacggtgaccattgtgaagctcgtagcgctaagaaatcatcttgatactagcacatatcagctcaccacagctagcttcgcccatttcgagctgtgtccacttcgatacagggacatggttatttgaatctaccctacgggatcatctctagatgatcaccctaataaggtattactactctttgatcagtgcttgctgttaacctgtaaacatgcccatctcgaactaacgagtgctacaggagagcaagaaatcgtatcactacaactcctgagtcctcccaagccaaaaccgtaaggctatggatatatgcagtgcaggacacaccggcctaaaaaactatatatagaagttcatctatcagttgtgtctcctagcatgaatggacaaaacagcagctctgattgctattttatgctatagcaacgacatttgttatgatcctccatgggatggtatatgtaaacaatagtgtgtagtagtcatgccagcttgtaatttcctcctcctgtccacaaataccaaataatattgtttgtcttttattgagatatatagtgaggatatatgaccgtaattttaaatattaaacgaggagtggttagggagtgcaagcgtggtcgttgaaattaagattacgtaaaactaaattacagatggttgctgggagatctatactctcttttatttaagtatacgacgttggttaaaaatggagggagtagtactttggaagtaaccactgtagttttggtacagcattgttcaagttgatttccgttatgatatttattttatatagtcggaccatataaaaaaatatcttcataattatgctcaaaatattaaagaaagttttctacgaattttaaaattttcgccattctaaaagaaggaaggcaaagaaacttttccacatacagacttctaaaaaaccgcatacacttttacaatgaactaggaagatagcccgcacatttgcgggggcatgcgcattagtatgtttcaaaaatagttctaacaaaacaaattaaaattaaagtaacttattttcaattttgaattgagtgttctttatatctctctttcgtgaagaaatctcaacaaactttcattggtttttttaccatcctgcaagccctctctttaattacttctcatatatgtgcaattagttatgcatgtgaatcaatatagatagaaacaatattttaaaaaatatttattgtagtacttataattattgggttcacctatttgaaggaaaacgaatggtttgtttttttatcataatttttaggatttttaatttatttgagcgctatatagcatctaggagtgtttgtagcacaccacgcatacgacaggttgagagtgtttgtagggagttatttgatttttactatataatagatagttaatatagcattgcttattgtttatgtactgagttgctagctagaaaatttggatataaaagtgagccggtgagataataggagataaaatgatgggtccaccatattaagtgaaaatcaatgatatgatgttttccttttttttctcagaattttttagatttctctaatttattagagggccacgtgacggcttagtagtgtttgtaggagttacgtggcggtttaatagcgtttctagaaagtttagagtaattttatatataatatggtttttttggctttatcctttaggagttacgtacgttacgttcgtacaaaggtaacatgtaatttttttttgttttttaggtagtacatacgaacattgctctccatccatatgcatagcataggaaggatctttttggtttttttttctgtttacgaatagtcattgtaccttcctctccatccatattagaaggaatgattttaatagatttaatctaatagcctgaaatatcaggatcactaatttaagtaaaaatcaagagctagatgttttgctttttctcagaatttgtaggattttctctaatttattagagtgccacgtagcggcttgagagcgtttttaggaagctaagtggctgcttgagagcttttgtaggatgattaatggacttttaatatataatatatttttttagagaaccgcttcactaattcctagattagaacaagtttaatatgtaaattacatgaaaaactgcttgtacgtagattaattttgtataatccctatcgagaagatcgagatttttactcgcgaaggattgattgcctttgaaatggaaaaaacatccggtttggacgatacacaatgttttactatgtgctgccacatggtaggattcccagcaccataaacagcttaattagtagtaaagcctggagcagcatttgctctaggcaagtatgtaaaccatgaatggaactccatcctttccaagaggccaaagcggcttaactggcaatcatgtggacactgttgctcttatgatctaccgcgatcgcgctccacctagatagagtttgcgaaactaaactcgcagctgttcctggtgcctcccattcctagaactcgtcatcaagtgaaggcttgtattggagatgaattaaatttgagagctgacccaatagtacgtagttggagtcttccactgtttctctccacatatatggcctagacttcgaacaaacagaggtttttgtgctagtatttatacagagctttgctttctactgtccatgtcaaaacaagttcactattctacacttatgctgtatatagcacgtcacgtgtctgcacaagttgatcttttctgcaacaagatagctggtacggcacagtacaacaacataagtacattagtttatatgcaaaggtaaatagatgttgtgcattgcttattggacttagtgtatgacaggcacggagtaaattaagtggtatatgttcaggcacaaagtaaaattaagtggtacattattctggtgttcgatagtgtcaaatagacacaatacaatttccgatgcttcccacccaaaacatgacttgctgaggtgagaatatataatgaagggcttctggacatatagactatgagcgtgatccggccatccattgctccctaagttaattatatggtctgagctggtatagaagcacatgcaagagcatgtactgcaggtgaaaactactgtaagaaacatcaaattgcaacctaattaactatgctatcacctgcagcacaagccaaaataaacgactgtacatgatttcagagtgtatgttcgagttcatcacgtgtaaaaatgaatgtcaagacatcatgaaagtaagattgagatttttacgaaggcaacgaaactgtgtgaaggcacctcacacaggttgattatttgtcaacgagatggtagagaatttgttgcgcgtgtcgaccttaaggtgacatgagatggcgtagaatttctcaatgagcttggctggctttcggtcagggaaaaaagcaggaaattcatcaattatatccaagattatgtgaagggttttacaaggatttgcaatttccccgatcaagtgtcggggagttcaccccatagggtgtcggaggtggggacatggttatagacccacgtggttaggagatatggtaaccacttaaaatatactccaattacaagtatcactcggtggaggcaattacacatcaatatataaactaatcctagtccgcagccccacagcaatatgtcgacgcacacacgatatgacagccggtgctcatcgatgctgcatgtactgctcctccttgtcggcgtatccttgtcagccccaatagccacgacgctgcatgttgcattgccccactagctatgccgatgaagctggaatcccttaccatagttggcctcggagaacttgctcgggtgacggagtccaagaagcgcaagagctggagactggttcagccccgttcttcacacaggggcctggaccgggttaacacgcaagatagcaggagtgagcagtttcgttcctgtccgcactgcacccttgcaaaccctagattttacaaacattgtttttttcttggtgtatgtggagctaggacaaatactgcacaacaagcgtactagtattcctaaagcttcccactcctgaatggcggtgagaaatctaaggtgactacagtgcatgatatggcctcttgtcttgggagcttcacattttctttttgcgtgctgcagcaaaaactgaaacaggactgcctttttatagtgatcatgtatgcatgaggtatataattatactgtaagtaaagcagggctgccttttttttatagttatgtatatctcatctttttatttataactaattattataagtaaaacatcttattaatgacaaaaaataatttaatagaaaataatttgcatgtaaaacttttatatgtgtgtcctttagtaatttttttaaaaaaatatgggaaaacaaactacaacgatgaaaacctgaaatcaactccaaaattatgtttcaaaactcgaattatcacttatccttataagctgaaggctaagtgaagaaaacctgaaatcaactctaaaaattatgttttaaaactcgaattttcagttatccttataagctgaaggttacacgttgcgagccgcatatgaaaactacactgtacagatttcactgttgcaactttaagctacgacacaagataaaataaaaccattgtggctacacatatgcaaggacttgccgttagtaaagtcttgaagggaaaacccttatgtgggagctgatgatctttggtatgaatggcaacgaaaactgatgcccacaatgttcacaatcatatgctccgtatgccggaatgtttgttagttgaaatacaaatttgttcattgttataaggagatgtgtcacattcatcatacgagcaatcctataaaataaatcatttccataactaatatttagcatatattcctccaaaatacagaccaggcataatcattagcctttccaaaacttgttttctcgcttttcactagaagtctagaaacttttatacaccaaaatgtctacgaatagaattctgtgcaataaatttggacttgtaaacaaaccttcaatgctccacacatgccatgcgtacaagaaaaacgggtgatgcaagtctttcagttatcaaaaaaccaaactatccaggatgcaacagttgatacattgttataatgaatcataatgaacggactaactcacaggcccttggagagtagaacacagctcgttctacagaaaactatcctacatacaagaatcgtaaagaagcaaacatcataagttgtgattcacagtcacagcatgcacagacgaacagattagctaagagttggcttgcttttttttttcagggtaagagttagcttgctaactcagggcctgtttagatccatttgaaatggcaaatggcaaatggcaaaagttttggtggcaaaagttttggtattgaaaaagtactagttggtgtttagatgcatcctaaacttttgccattctagcactaaagtgagagagagaaagagagagggagtggtcccaaagcactttttggcacaatttgctactatggactagcaaatgtcaaatgccaaattgccaaattttgctactagtgtttagatccaaaatggcaaaaagtgcttcagaatgacaaaacttttgccattttggaggatctaaacagggcctcagactacattgtaaacaatcgtaacaactaacgctaccctaatcgcccatgttatagtctccaccagctaaaccagcaaaatcgcttgtgtcccatagcggaataaactattcggtatctctaagattcccaatgtctcccaatcctgaacagaatctagtgcaattatctataagtatcacgaagtatttctttccccattcattttgcacatatcgaaatgaataagttctagcgttgccaaatttcttgcctcaaatgtgttgtgagccttgcgacattgtttcgtttgaacacaagcatgacacttaaaacctttgatgaaagtgaatttcgacataaaacttatgtcagctaagcgcatcgtacaaccaaaattcaccactctctcatcccaaagacccgaaatggcatggctatcctcctgtcttaatttcagccccgaggtgttgcggtttggctaaacctataacaacattttgaaactaaactcattgcagttcctagtgcctcaaattcccgaaattcttgaaattacatatagcgtaatcaacgatagttgaggtcatattttatctccatatgctgatcgactcagagaaaccaaaatgtaggggtaattctactacaaagatttgtatttatagcagtttgctatactcgggagtagtttcgacatatctcaagttcagttatagctctctactacataaatggggtcttttgtctggccactccccctctcattttccatacgtgaaaacctctcccaacttataaaaaccgtccaactaaaaaaacaatttcccaaaaaaaaaatctacgactgtatagagtaaaccaaataacctacttcgcccaaatctttcgcatccacgaaactacagaattaaaaaaaaagaaaaaaataaatccttcccgtctataaaaatactgttgcaatacacgggtcaataactatttaaaaataaaaatataagttatttagtgctaattgggattaaacggtaaggtaacaaaatcaaacccttgtaccacattactttacactgggaagcaacacctcggaatccatttggggagccaaatctcccacgcaacacttctataaaaacgatttcgcaggtcgtgaaagatctattggagttcttgaaaagctcttaaatgaaatgaaagtgcactgaggaccatggatatggcccataggatgatgaacaggcgtttcctgcaattacataaacatgcaatggaaattagaacaaccggacaatccggtaccactgcagacagtccaacaacacacagaagcggacaacccggcagctactggacaatccgatcaacacagagaaaaacatgaactcgcctagtggaaatataggctcgtactgtccacctcggtgctggacagtccgacaacactaagtgtttgacactctaacaatgataggacaatccgaccctgcatagaaaaaataaaacctatagatagagtactttgcacactacttatatactagagctagaaggtgatcaacaagatataagcatgtacaaatagatcaccaagttactcaatatgacagcatcaatgcaaagtacaaaaagcaagagaggaggcactgatttagagcgctaaatatgaaatttgtagttaatgacgtttttatttgatgtcatttagagcaccaaatatgtatgtagagatgaagtcaaaagaatagcatgcgtgccaaagtaatgaagtatttcatagataagatgccaagaagaccacgcatggagtaacaatattagggtcccaatcctatataccgcttgcatacatatttcgcatgacttgtgattatcagaaacaaattaacactggaattcattttgacaagtatttccttaagagagatgtctgtgaaaatgtgattgtcacatgcggttccttctaaacgcataagaaaattgttgattaatttttacaggcctaggtcacaggtggttcactaaagacgtctataaattggtaatcatcagtctacaaaattatagtaatgtattaaaaaaccattgctgctatcatagtaatttgtcatatgttctgtgcatgacaaggttgcctctgttgtttgagtgtatcgccctcaactattttacacaggctgttgtatatatgatcaacaaaatgaagtaaatacacttttcagaccgagtccagtaacattagtatatagatgcctcagtacgcgttgggataattcaaagccagagatggttggtggttctcccacatatataacattgtggtatttgaaatgggaatttttgcatgtcaaatgaaaatatataaggaagagtattcatatataaccgttaattacaggtcctttgcgtcacaaatttcagaaaaaaaaatgagaatatatagttgaaggtggcaaattaatactcaagtgaatataaaaaaagctttaaaattttaacacatacctacaaaataaaaaaatggaaataaaaataaggcaaaagtaagaattacgattccaatcaagtttaatacatgccttgatgttagtttatggtcatgattagaagctgatagcctcagctggctagaataactagtttcatcatgctcatgtctcttttagcagatcatcacctttcttcatattcttacatagggatctcgggctcccactcctgcctcatagagatgatactgatctagatggggccgtcgatatgccctatctcattctaggtggcagattttgaagagtgctactaagttcaccccaaatctgtactatgcatctctagagctcgcaataatcctctgctatcttacatttctgcttcctgcgtagcgagcagatgttcctgatgcctatcaaacctatgataaataataaaaccttatatatatatatatatatatatacacacacagacacacacatattatgtacagcagagctaccattttctattcaataactcagacaagtctgaccaaatggtggcaagggtggcatattcaagttttctgggacagcagagctaccgttttctattgaattggaagaaaaaatattggtactgtaactgttgaagtatagtctgaatattttaatttgttcaacctagctagacagaacgctggaactcacccctgcagatcgatgtgttggactggtggtatatatactggtataaggctttgatatgctagacatgtgtcagatgttggtattgggtactgcaaccgactacaactatcggtatatgcaccaatgtagtcacactcacacatattcattgtcatgctatttagtgttgtatactccctctttccacaaatataacggattttcatttcttttaagagcttaaggctagaaaaaacatgatgtccctgatgaatgatatataattgaggatagggagatatatatgatttgatgaaaactaaagttatatattcacggtatactactcaaaagggcgtacgatctatctagagtcaaagacaataaaaggttacatttatcatttagcactaggtgaaaccccgcacattgctgcgggagtttagcatgataacaataagtaaaaataatatgtaatacagctagacaacataagattatgtaaagttaacgtggtttatgataatttaaatttaaatagtatatagaatgatgattcaaatgtaaaagtaaggtgatatgactttatgaaagaagaaaagtatcgagatagtttggaccgtagattaatcatctaaaggttaaaaataattgaggtgatatggattaattagagaagaaaaggagagagataatttggaccatagattaatcatttaagcactaaaatattgatgtgatatgtcttaacgagagaagtgagaaatagcattaactagctaagactactaagtgaggatgaactaggtacatagcatattataaaaataatgaagatatatattgaaatattttgtgaattatgtgggatgatgatttaacatgcttgcattttaaaagctctaaaatttaataaattataaaattatagataatatagcatgtttacatgatgtttaaatttaatggttgttagtggatgatgatggtgcatcttgttaatacatgatgatgggacatcttgttagtacatgatgatttggcatgtttgcatgttaagccttagtaacataggatttgacacagacaactgcggattgctaaagaaatttgtttatcataattaattctctcttgctataaagttatagcccactaattcctaaagcttaacaagcaatggtgttccatcattatcatctaacaattattacatttaagcatcatgcaagcatgctatattatatataatttaataatttattaaattttagagatttaaaatgtaagcatgttaaatcatcccaccattcacataatatttcaatgtatctctctatcaatttttataatatcatatatacgtttatagttcatcttcatttagttcaatttttttcttttttctcattaagttatatcacatcaattgtttttagttcttagatgattaatgtatggtgcaaattatctctcttatattggaacagtcaagccatccaaacgtccgttgcatttctctttatgtagtatgtgactctaaggtgctagcatgtaaaaaccatctacccatgaataaaggcatgtacctggtcctgcaaagctagtgtttggaagcttaaatgcctacactaatgtgcttaaccatataattaaataattaattggaggtcctaacaggaaatgcatcattgttggatagtgcttaacctggtcatacacgcaattttgttagcttcgtaaaaatgttactcttttcgtttcattcgtttcatattataaggctaagacacttttatcaatgaatagaagacatatcagcaaatccactccgttgtcgagtctaggttatctgtaagtggtgaaatgatgtatgctattttagctgaaggtagaaaagtttagagaggttcaaatgatggacatctccagaataatttaattatgaaagtaaaaaacctagataagatgaatgtaccttaatttgttactcgaccgtgggcatgcaccagccccaaatcatatacagtagctatttcagcttgtcctggtggtagcttagggttagtttgagaagagggggattgagaagatacgcaaaacgaggtgaaccattagcgcatgattaattgagtattaactattttaaattttaaaaatagattaatatgattttttaaagcaatttttttatagaaaatttttgtaaaaaatacaccgtttagtagtttgggaagcgtgcacgtggaatacgatgtccttttctcacccaacctcccagaactcatcacaacgaacgcagccttaattaattaattaggatactatttcaagtttctgacaatagtcacgttgtcacatgcagtatatgctcttgcatttgctttcttatgcacgctatgtgtctaaacccactcataccatatcattcacagagcaatggccagaagctcggcactattctcaccacagccgtcgcgtttagggttggaaagcattgggaattttattttgtccatttctgaagattggactcgaattctaagctaattttgatcacaacccgaaccacatagtatgggggagaaattattttttctaccttcggtgcggtgaacttcggagctaatttggaaaacaagagataaatgcaaaaagttttctgctcctgaagtagcttcaacgtacgctcttcttccaaagaaccaaagacagaatgttgacctacatattagcagaagcatcttctataatccatattgtaatacttggaatcttaagacaagccaaaaaaaaaatttgtgtcaggggcttacggccatttttattttattttatttgtctatcctcatgctaatacagaaatcacatcgacaaataatatatcggttcaaattgaacatcacttatataaatattttttctgacatctcttctctcttataattaattaactaaccacttagaacacggtaaagaaagaaaataataaatataattaacacacatatttttttctgacatctcttctctcttataattaattaacttaccacctagtacacggtgaagatagaaaataaatataacttactatcgaatcaactccacggcgcaaacaaagccaatcgttttcgccacgcgtttctcttctcataatgtagctgcagaggagatgcaaaacacgccaacatgaagaattttatatattaactagatgctattataaagactaaataaagcacgtaagatggctacttggtaagttgttttaatattctaatattgttctgccatccaatgagtcatagaatgttaaccgttactatcatttacgaccctgagagtattatccttacatgacagaaggtgtaaaaacatgacggatatttctcgcccgcctgcccgaccgtattaatctgggataaattcggatacccgagtccttacacggatattggatacaaatacggatattttctggcagatatgagatcgggtttggaaggatggtatccgacggatatagagtgtccggtaaattatacgggtattacccggtaaactacccgtacattacccagattgctgccaccaccactccatcatgtcaacaaccaaaggcagccagggagggggcaagcagtcaccgtctcatcgagggtgccgcacgccggcacgccgcgcgcgtgcacaaccactcgccactcacgagcgccgcccagcaccggccgtgacggtacgatgccgatggcgccgcacatatgctagccgctagtggctacgctgccgcgcacccgcgtccgccggccactgtctcgcacatcgccgcgtggatgcgcgacggccgtcgtaccgccgccgaccaccgtcgtactactttgatactgctgtaatagcactgttacttatggtgatgtacagtagtagttttactactgatatgcagctatggtgaacaacagtctacagcattgagtctctaagagcccactactagctccaattcatctatagccgatctaatagctaatttatataatagttgcttactatactattaatatatactcccacatatcatacacacgttgtgtcttagagtccgtgcttgaccgttgctcttctctctcatattttatctcattaaaatatatttatagctggctaatagtcttctattgtacgtgctcaaatatattcatattatacatatatggaatggttgaacggctattatctatatgatatatatggtcgttgctttgatttgatgtccgaataaatattcgcaatcgatagagttcgtatccgtattggtgcgtattcgttccgtatttattcccgagattattcgggtctgtatttgtacccgataatattcatgtctgatccgatcccgattataaaatatgggttaggaatgggaaggatgagaaccaaccgaaccagacccgttttcacccttgcatgacagcaacacctcgtggatgatccgatcaaggttggtgtccccgggcccacttggcatcgttactcgtacggccttctccttccactctttgagcctcgccagcagcgcgaggaggtggccgaggcagttcgtcatggtagactggcacagcgcggggatgtcctgcgtggcgtcctcgtcctcggcaccgggcgtcgccaacgggaaaattaaacttgtacaagttgcaacaaaaagagcaaattaaactgaaaatagttatcgtatattcgcagctatatttgttatttttgttacaacatgtagaagttgaatttaaacttacatgtttgtggagtgatatatttcatattaatctatgttgctaattttttttaaaatattttgatgaatatttaggtgacatgcacgaaacgaggggatatcccctcaagggatgaaatcaccttcccgctttaatggtgctgttagctagaatctgttgctgctgctgttgctggaatgatattgctactgctgaagattggtgctgttgcttctggaaattctgtggcatctggaaattatgttgctgctccaggaatttgtgctgctgcttctgaagctcatataatgcaagaatttgtgctgatgctgatgctggaacgatggaatgatgctgctgttgctgctattttttttttgtgctgctgaaactgcagtgctgctgctgctaaactgcactgaaattgctgctaattaatgctgctgagatagcttctgttgctgtgctagctgctccttctgctgaaactgctgcttggactgctgaaaatataagcagtttcagctgaaaattagctgctgattctggaatatatgaaaattagctgctgcaggaggaattttgctgctgttgctggaatgtaactgctgctgctggaaaatgctctgttcttgctggaaatgctgctgctattcttgctggaatgttgctcctactgatgcataaactgctgctgataaaattgttgttgctggcttgctgctgtgagtgctgattgtgcttctgctgctgaaaattgatcacgaaaatgcagacatgtgtgttgattgtgctgtgtggtagcagctgtgtgtgctgctgctgtgtggcagggatggtataggagatcggcgacgagcagcagggcgcgcgccgagagatcggccagcggcgtaggggcagggagcacgcagtggagggatctgccggcggcgttggggaagtgaaaaaacggaaatatctgttggtaagagaagagcccacttttagttttggggattaaatcttgattatctgttggagggaggagttttttcacttcctattttcagtttaggaaacccaaaaatatttttttgggagattataggaggactgctggtgaggctccaagggagagcgagtggattagctggtttatttctaaacataatagatcaaacaaattaattagtgggtccacatgttaatagaaatcaacggttgagattttttcagaatatttaggatttttctaatttattaaagtgccatgtgatggcttatgaacgtttacataaatttctcgtggcagcttaagagcgtttataggaaatataatagatatttagtatataatatataaaatataaatagattagggattgacagctattggaaaactatccaatcaactacgtggcgcaaataaaaccaatcgtttgcgccatgcatctctttccataatgtagctgcagaggagatgcaaaacgcaagactacataaagcacataacatagctgcttgattagttggtggaatattataatactccctccgtttcaaaatgtttgacaccgttgacttttttagtacgtatttgaccattcgtcttattcaaaaaaatttaagtaattatttattcttttcatatcatttgattcattattaaatatattttcatgtacacatatagttttacatatttcataatttttttaataagacgaatggttaaatacgtgctaaaaagttaaggccgttaaacattttgaaatgaagggagtattgatctgcgatctaacaagtcatacaatgttaagcactctcaccattcacgctgagagttttatccttacatgacagcagcacctcgtggatgactcggtcaaggttggtgtcccagggcccacctagcagcgtcacttgtacagccttctgcttccactcttctgcacgctgccgcatctcacgccccttctccccttccatggcctccagtgtcatggccgccacctctcctcgccacgcctcgccgccgatctccatcgcgacgccccactctgtctgcttgtaccggcagttcgtctgctgctccgcgaagaacagccagctcagcatcagcacgccggaggcggggctctccagcgtcgagttccacccggagtgcgtcaggaacacacccacagcgtcgtgctcgaggaccttatcctgcgggcaccacgcccggaggacgccactgcccacgacgcatattttgcatgctgcttttcttcactattttgcatacatagatccaccacaaaaagaggggtttaaaatcataaaaaaatacatagcaagagtggaaaggcatgtatctaaccaatgtagaaaaatctcccgaagatttcgagttcaaaacctttccccctatattttgttgttttcggagagaaacttcggttgaaatgaacagttctcagggaggaagaagactataagaaaatgtttttgcaggcggaccatataaggtttcgcccgtgaaacaatctttgcaggcagaccatatattacgtccacctgcaaagatcctaattatcgcaggcagacgtattatacggttcgcctgcgaagatagttttcgtaggtggcaccttatgtggtctgcctgcaataagtttttttttaggtggacggctagcatgatcttggttgctattatcgtaggcggccctttttctccgagggcaatgcccgcttgggaaaaaaatccccacgttgggaagaacgatttttctagtagtgctggtggtagcttaactgattaggctgcaatttctagtttataatagtcacgttgtcacatgtagcatatgctcttgcaagtgctttcatatgctgtgcgtctgtaccctctcatatcgtatatgtcattcacagacatggccagaagccctgtactattgtcacctcacccatcgcgcttagggttgggaagcattggaaatattattgtgtccgtttcggaccatttgattcgaatccttagatcattttgatcataacccagaccagtcgaacttaggggtgagaagcatctggaatattattgtgtctgtttcggaccatttgattcgaatcctaagataatttttccagaccacatagtatgggggagaaattgttttttcatccttcggtatggtgaaattcgaagatttggcaaacacgttttcttctgtttatatacgctcttcttcaacaaaagcaaagacggaatgtggacctacatattagcataagcatcttttatagtcgcagcttaagacacaagccaaataaattgtgccaggggattacgaccatttagtttttattttatttgtctatcctcacgcaaataaagaaaccacttcgacaaataatatatcggttcaaattgaacatcactaagataaataatttttctgacatctcttctctattatgagtaattgatttaccacctagtcctcgttataaagataaaaaataaatataattatcaaatatgtttttaataatcaggggttgacagcaattagaaaactatccaatcaactccatggggcaaacaaaaccaaacgtattcaccatgcatttctcttccgataatgtagccgctgaggaaatgcaaaacagaaaaaggcatcccgtgaagacgggataagtggataaccttccattcttatccgttctctttctgtgtctctctctctccccgatcctcgcttcatcgtcatccaccgccccaccctccctctgtaacttctcttttcgttcctagcagggggttgggacatgattcccatggcaagccctttaacaagattggaattgtccagcgctcgctatgctaatgtcacgtcgccggtggtggccatggggctctcgtatgctagggtccgggaagagatgcaacgagttcaaggtgggaggtgagttgaggtgtgtcgcaaacgatgtctgcgaccatcacacttgtgtgggtgtcgaggatcagggcagcgacgctccgaatcaaggatggcaacgagaatgaatggcatccctccacctctaaggaagtagccatctcattttcgcgcttgctttttccttatttcctttctcctcatggctctcatcggtgtgaagacatggtactcacagtatttaatgtctgggtatcatgttcttgatacctaggtatcaagtaactggtacccagattatccggattagtaccatatgtaacaggcctgatacctcaggtatcaggtaccaggtacctagatcagtctaacacccataggtaccagacctagtactggtatcgggtacctaggtatcaagtacttggtatctagatcggtctgatacctgtaggtaccaggtacctagatcggtctgatacccataggtaccagacttagtacttgtaacatcctgaaaatttccaacaataaaaatcactaaaatttcaaactttttaaaacttttgcatcatgctggttgttatgattcctattgcttgccaaaccgtaaatgatcaccaagaaggtaaagaaaagaactacatttaagcaatagatatgatttatgagaatataatattgttaaccctacaaataattacgcacaagaaaataaagccagacaaacggaaggttaattactaatttaaattagggattaaatactaaatacgtgaaccatgtgttgcgtgctatgacgtctaaatacacatgaaatgatgaccatttataatggaactctatctataacatagtttcactaggagtaattaatgggatattactaaactctaatggtctatataaaggtaaaccaattcacatgaaataatggtcatgtaaacaaattaagctttatacataaataagaatgcgttggtgtttaactaaacaattagattaatagtgtaccgagtctaaatttgctatttgtagaataaatagattaaaaatatccgtgtaaaatataatgctacacaaagaaactcgaccaatatgccattgaattaataaggacacatcgttatattaattccgatattacccgaaagtcttcaaaaatatataagttcactttagggcgaataatctagattaatctaaaaaggactcatttgtgcgataaataaataaatatgggtaatattaatctagggtgaatacattggttagaataacacaaatattgagtaaacttcatttgtgtaaaaattaggatttatagaataaaatttatataggaaataggcttaaatagggttaaatagccggctagcactgttcattagcccctaggtgttcgacgtggtcccctagccctagcccctcctctgccacgctgcctcgcgccccacgcgccgcgcgccgctccgcctcccctctgctgcgccgctgccttgcgccccgcgccgccgcgcgccgtcttgtcgccgccgtcgccctgccgcgtcgccgcgtcatgtcgccgttgccgcgccgtctccatcccgccgcgcgccgacgccgtcgtcggtcgcatcctctcgagccccactcctccgcgcgtgccgtcgtcgtcgccgtcgcatcgacatcatcgcctcgccgcgcgctgtcgccatcgccgtcgcgtcggcttcactgccgcgtcgcgcgccgtctcgtcgcgcctcgcgccccgcgccgccaagccatgtgccgctgctgcgccgtcgtccgtcgcgtcgcaccacgccgagccccgtgtcgcgtcccatcgccgcttcgagctgcgcgccgccgctaccgcgccgcgtcgccgtcgcgtcgcctgtcgccccgcgcgccccgcgagccgtcgccatcgccgtcaccgcgcgccgcgcgccatcgtcgtcgcgctgccgcaccctcgagccccgcgacccgtcgctgccacgccgctcgcctgtcgccgtcggcctcgcgccccgagccgccgcgcgcccgtcccatcgcgccgagccccgtgccgccgtgcgcgtcgcgtcgccccgcctgtcacgccgctcgccgcctcgagccccacgcgccgcgccgtcgcgtcgccattagggccggccacccctcccccgcgccctataaaaccccccggccaccccccctttcaccccacaccatccccacccattcccctcttcctctcctccttcccctcttcgtcccctccaccgcgccgcgccgccgccttcgtgccgccgcgccgtgcgccgtcgtcgcgccgccctcgcgccgccgcaccgccgccttcgtgccgccgcgccgtgcgccgacgtcgtgccgccgtcgccatcgccggtaagccgccgtcccttccctcgttccgtcgccgtcgccgcccgggtggaaaggagccgagagagagagggaggaaggagccgggagtaggatgagagaaaagaaaagaaaagagagagaaagaaaggaagaggaaaagagaggccgacagagagagaaagagagaagaaaggaaaaagggagagaaagaaaaagaaaggaaaagggaaaagagaaaagaaaagaaaagaaagagagggagagaaaagagagaaaaagaaggaaaggagaaaatagaagggaaattgggggagaaattaggaggatttaggaaataaaaatggtcggggttaataatagattatttttggaaattcctcgagcgtaatggtatttcgatcgaaattccgagttaattataaatatatgtttcttgatcagattagattaaaattggtagtaatttagatataattaataaccaaacaattagatgaattcttatagattattatagattatttttggtaatctctataagtcatcggttcatggtagaaattcggattcaattactaggaatcttagccgtgtattatatttaatcgtttagtcatagactaaattaaattgtataatatttctaagatttcgtccgatatttagctcgtaatagaaatttctaacctgttatatggatataatgctcgggatgagtaaattaaaaacttatgacaacaaaatatttatacccgcaaaatagtttaaatcgaaattgggtttgccgtagttcgcagatagtaaagttaataaaaagtaatcgactttcgcattcgacttttactcggatttaagtgaaacttgaacctaaattcatctaaattcataagctttccaatgatatataattcactatttaacaaaatatatttataattataaattaattaatatcaaatgattagataatagttaacctaaatagtgtgccaatgaataaaaatggatattgtacagtagcataattatctttaacatgtattgtatagcttacagtaaaaagcaactactcaaatatatgatccaataataagatattgttgcttacacatatactatacatcccattatagtggtacggtatagtattaatttgcgtgttgcataaattaaattaagagggagagtatgacaaacatgtatattagataaatactagttataaatcttgacctcatataattataattatagttcaactgtaaattaggattattcattgtaaaattatgtgatgggataatctgtacccataatatgattaacctgaacaactctaacatacaaagcatggataattattaaccttttataatttattgtgacaagtaaaatatgttcataattaaagtaaagcttccatcaataaaataataatacaaatgattcactataactatttgattgatcctaaatccatctaacaacagaacctctagtaaataaccgtcctatgtagatagatgcatgcttagccataatccttccatagccacttgatagactaaaccactgattagccaaatatatatgtatcccataaatgctatgtaggttaactcctaaataggccacgatgacaatagaaagattaagaaactttagccttagcatgattgggatccattagcaaacacgaatagtacattttgttgcgcatatttgattgttgtttgaatattggtttttctcgcgtattatagaccttgtgtatcggttagtcgtgaggcaacgtctgcaacttccaggaggtgaaggttgatcaagattatatcaataataaggattatcctgagcaaggcaagtcatcactattctttgaacatgttgatcccaattgcgaaattattttgtttaccaataaaattgcatgcaatgatgaacatcctacttgtgattataccatgccttgattattgttcacctttaaatctttgtaaccatagatacgtacgagtccctagtcaactatgacacttgcttagaaatgctattttagattcatgcatactcatatttatcaaatgctatatgcttgggcaattacctttgggaaggtaattgagatgcggcatgtggagacatgagcgccacattgccatgatattgatgacatgatttgtgaaaggaaaataaagtaaaacaactgttttcgactggggcggctggaggacttgggtggtgtccggaaaaggctagtgccgtccctggtcaattaaggaccgagccatgaagttaagcatgaaacgaccctcgtacaaccgtacttctcgaatgggtatagacctagcggattagatagctgagcggaggcagtatccatgcatagtggtttcttgatgtgtgaggcaggggctctacggtggggcagccattggtagaaccgcgaggcgggtgtctacagtggtgtcgtcattggtaggactgccatgtgagaatctaaaacataactataacttaatgcatgtgtgagtcttcccttcccgggtgcgccagaactcctctcactgctagaaaccgtgtacgcctagagtgcatgaggatgaaaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattcttaacttgtgggggatgggatattgcatgatgaattttatgctgatggagccacttcccgagaggagggaaggtggacatcctcagaaaaccatgacgattcaatggcgggaagctatccttgggatcacaatggatggtggacagaatcgtcgttgtttaaagtgaacactggtactaaaatttgatcagtctatgctaggttttaggcttgtgaaaagaattgtaaaattagctttatgcaaaagaacctgaagccattctttgaaataccctctatcatatgcattgttgttgtggtggcttgctgagtacggttggtactcacccttgctatttatatatcttttaggagagtgttgaagagaagcccttgtcggtacgcttgcgtatcccacaagatgatcggagtgcggtcttgttctaggtctcgttccccagtcgactgcctgtggcatgttaaccgggcccttatattattttgtcttccgctgttgttctctgatagttgttggcctacctgtccctaatgtaagtatttaactcttttagcctaaattcattcgtgatatgttgtgatccaactatgtatgtgtgtaccaactgctgatccagggattggtacggataaacacagaagatttccgatttccaaaatcgggggtctacagtactggtatcgagtacctaggtatcaagtacttggtatctagatcggtctgatacctgtaggtaccaggtacctagatcggtgtgatacccataggtaccagacttagtactggtatcgggtacctaggtatcaagtacttggtatctagatcggtctgatatccatatgtatcaggccttgtactaggtatcgggtacctgatacctagaccaatctagtactcaaattggccctggtgttagcatcataacaatcgaaacaggtgcgttgtgtctctagtgagaaaatgtgcactgacgtgtggtcccttgtgaggacacgaagagacgtgggctgacaaatgaaccctcacatggggtgaagttgataaaataataggagagagtagttagtccgaaaatacttgtatccggtcgaccggcgcggggggagccggatcgggcgctccccccgcgcactcctccccacgtgcgtacctggtccgcccacttcccctcctattttcccataaaaaatgtttcacctagtatacttataatgtttcactatttataggtctaatgttgcagtgaattaaaatattcttttgcaagaaaaaacccacatattttggaaactctctattaagaggatttggtttattttttgttccatcaaaaatgtttcacataatgtattcacaatatttcactatgtataaatttaatgttgtagtgaacaaaatattctattgcaacaaaaaaacccacatattttgaaaatcccctattaagagaatttggtttatttttttgttccaccgaaaaatgtttcacctagtgtgcacataatgtttcactatgtataaatcagatgttgcagtgaactgaaacattcttttgctatttgctgaaacattgtttttatataaggtgaaacaacgcccgatttaaacgagtgaaacattttcgatctacttagtgaaacaattccgatatacctagtgaaatatcgtgcaacatttaaaaaaaattcaataataagctaaattttttttcgtcggaatatatccatgtgtactcaatgcaaaacgcaagaagaattttatattcgaattagatgctcttattaagactaaataaaccacatgacatggctacttggttagtaggttgaatattataatattgatctgcgatctaacaagtcatacactctcaccattcaccctgctaattttatccttacacgacagcaacacgtcgtggatgactcggtcaaggttggtgtccccgggcccacctggcagcgtcactcgtacagccttctctttccactcttgtgcacgccgccgtatctcacgccccttcttcccctccatggcctcccgtatcatcgccgccacctcccctcgccgcgcgttaccgccgatctccatcccgatgccccactccgtcctcttgtaccggcagttcgtctgctgctccgcgaagaagggccagctcagcatcggcacgccggcggctaggctctccagtgtcgagttccacccggagtgcgtcaggaacacgcccacggcgtcgtgctcgaggaccttctcctgcgggcaccacgccgggaggacgccacggccctcgacggcggcgtggaactccggcggcagcgcggcggcgtcgccctctccccccttgacgaggtctgggcggacgacccacacgaaggcgtagccgctgtcggcgagcccccacgcgaactccagcagctgctcgctcgtcatcaccgcgatgctgccgtagctcacgtacacgacggagctgggccggtggccgtcgagccactcgaggaggccgtcctgctccttccagaggttggaacccacgccgtgcagcgggcttccggtggggacggcgcggcggacgtggaggtggagcgggccgacggcgtagaccggcggcgggaggacggcgcgcatggcgtccagcgccggccgctcgaggtcgtcgaaggtgttgaggatgacggcgtcggggagggacagccgctcggcctcgcgcatgatgaagttgagcatcacgtcgccgaggtccgtggtgcggatgaagctggggtagtcgcgcagctggacgccgtcgcacatgccgcgggcggcggcgccgtcgaccaccgtgtcgaggtacccgtcggtgagctgcgccgcgtcccggagcggcaccaggccacggtcgatgagctcgcggtagaggcgacaccccacgaagccgcaggcgctggccgtccacagcgcggcgcacggcacgccgatcaccctggcggcgtcgtacgcgaacgacatgaggccgtcggcgacgaggcaggtgaccggcggcgaccccgacgccggctcattgagcctcgacagcagcgcaaggaggtggccgaggcagttcgtcatggtggactggcacagcgcggggatgtcctgcgtggcgtcctcgtcctcgccagacatcgccggtagcccgtcggggatggcggcgaagacgaagcccggcacgccgtcgagcgcggcggcgccacgggaggcgaggaggcggcggtggttgaactcggtgttgacgaaggtgacgtggaagccccgggcgtggagcagcttggcgaggtgcagcgtcggcgtgatgtcaccctgcgacgggtacggcacgcacacggcgtgcggcggcttgtcgccggtggcgcccatcgccgatgccattctatgcccgttaattagtttgcagcagagaaagagagatcgctagctgttcgtctggtaatggggagattacattggagtctgttttatagtcaactgagacgtgttaaagttggggtgtggctaaggagagatggatcgcttggagcgatcaccccttgtccccctatacgctcatcccctttcttctccgcttcttctcttcctactgcaccataaattttaaaaaaaataaaaataaaattgaaaaaaattatgtatagaaatactatatgtaaaaaatatttgaattcaaattcaaatttaaaacgaatatgtaaacttttaacttataaacattgggtctataaattaatatttgaattcaaattaaaatttgaatcgggcatgtaaacttttgacttataaactttgggtctataaactttaggtttataaacattagtacagaaatactatattaaaaaatatttgaattcaaattcaaagttgaatcggatatataaacttgttgacttataaactttgggtctctaaactttatatgtgtaaacttgagctgcataaatctatctatctatcaatctatctattattatatatactaaaagtccattaaacttcctacaaacgttactaagccgccacatggcatttctataaatgtttctaggccgccaagtggcgctctaataaaagtccaagaaaaaataaaaatattccattttcatttaatctggtgaacctatattttttaaccgttagatctaactaaaaaaataccaaatagaattatatttagaaagcaccacgttctacgtcgatccatcccatacgtgtacgtgcatgtacgtgcatacttcgtacgtggccccttcccttcctttcttttttttctttttttttcactctcatgagataaaaaccaaattaataatttcagccaatagttgtaaaaatatatgttattccgagttgtattctatcacaagttcattaaacttcctacgaacacacttaagtcatcatgtgacaccctatatactctcctgaaccatcgcgtggcactctaataaattagaaaaatcttaaaaattatgagaaaaaagaaaaaaatatctgaccatccattataacttataaaccggtgaacctattatttctaaccattagatatatcttaattatctgtttccaataaaagaaatctcctctctctatatatgtactcctccctcagtggtatgtacgtgaatttcctattttatagctagcaaccccatataaaaacttaagtgaccataattgttagtaagttatataacaaaccacaacgatgcagagaaatcaaaatattgaataggttttcaacgtgcgtgctgcttgctttaatttggttatccaaataggctaacctattcttgctaggattatcaatgcaatgagcattaggtctacaaatgagggtgtgcatgcacgtgttttcatcctcctaagctctactagttttatcttttactggctaaacaacaagcaccctaaataatcagcaaatttgcgaacacatctaaatttagatccatggtgcctttaaaaaaattaatgattcaaccgtggtaaacttctacggaaaaaaataatttctagggcacgtcatcctaattaccatttaaatatatatatatttagatgttcattaaacttcatacaaacacacctatactaccacatgctacgcatataaacattactaaactgccacgtggtattatagtaaatcagtgaaccatatattttcaactattagatttatcttttttttttcttaaaaaaaccaatatccacatccctcggctctatcccaccagcacaactctcctctccccactggcccacccttcccaccaccccatgcacgtacgtatacatacatacactttttccgtctccaataattctttctctcatcttcctattttataaataataattttaattataaaaatattatgaagaaaacaaatctaaccatcaatttttaattaaattggcagacttataatttcatcaattttcattcaaatcagtcgagttataagtttaacaattagatttaaagacataaatatttcaaactgatgaacgcattaaatatacctcaataaaaacaaagtatccttgccaaataacaatgaaacattgaaaaacatgaaaacatatattatatattcttgaatcgttttacatagtaaagatcgattaaacgtgctctatagcactctcaagtcaccacgtatgatattttaaaaatttgaaattcaaagagaaaataaattatatatctatccatcggttttcacttaatttgatgtcccattatttttaactattagattgcttttctctttataaaaaaaactttaagccaccacatgtcatgtcttaaagatccttagaatgagaaaacaacaaatcataggttcgcacttagattgtttacaaagattttctttttaaaaaaacaatgtaccgtccacttcccctccctgtccaatcatatgcacataacactattgcattgtgaaccctttctaatatctgatttgagttctacgctattcgtttctctccagtctcctccctattttcagctacaaaactaaagagagaaacaaatattaaaaagagcataattttaagctacactgataattttattttatatatcatgtaatcgattttagatgatggtttcttttttacataaagtcgccacctattaccccataaatcctcctaggccttttaaaccgataagcccattatttccaaccattagttctatctcatcttaaaagacaagtgtgtattcataatacatcatcttccaaaataatatattgcacaaccatatttcttcatccaatattatttgcgctaggttgcatggagtctcacacactctctacatggaacgttcgcatatggattctttctcaaattaaacaataatataaacccatgcatttagtggagcctcatatcccacccaattcatccatcaataaacaatgacaacctatattcaattaaaaaatatcttacttttgattttacacataattttctatacatgttttctaacacaaaatatgtctacctacttagtagatgatgaagaatattataaatatttgcttgtagggattaattaaatatgatatgttataaagataactaatagtttggttagacaattataaaagcaatgctaatgaaaacaatttatggagaaatcatatattgtagatgttcaaacatagcgtacgacacatgcccgcgcgaatacgtggtctatcttcttagtttattaaaataggaaagtaatgcgatgccaaaaaaagaaaccacgtggaggagggggtttgatcgctccaggcgatcgatcgcctgttagccttttcattaaagttgtgcgcgtcaatatttttccctgtgcctgacaatttgagaggggaagtttagtgaagattaagaagatatacaaaacgagataaattattaacgtatgattaattttttaaaaatttaacactcgatcaatataaatttttaagcaactctgatataatttttttaaaaaacgcaccgtttagtagatcggaaaacgtgcgcgtgaaaaacgagcgattttttctatcaatcttctagggccaaacacattggaaacaaaaaaagccttaaaattcgagcttcattaatagcttgaaacaaaagttatctaaatggcactgtttgagctcaagtttgagccacaagagtgcaacacaacaaacgcccaaaacaccttacgctatcgaagaacaactcatagttacataacaaactcatactgcaactgggggataataacaaagaaattgatggccaagcagttgttgcatatgcagctctaatttctcatctggatttttccggtcacttcatgctccgcagtaattgcagcttgacaatgagcaactgaacaagtcattgaaagcatccacctcctccgtgtcaccttcagtatggccaacgcctctcactgccgacacagtaattttacactgagtagagccgcacccgttattggtacgtgggtgaaatagttagagaaaaaattactgtaaaacaatttggtaacatcatctaggataacatatattaatctatattcaaaagtccaacactaaattaagtgtgaaaaataatgtctgccctcattgtggcaagctcaaagtagaccacccatatatatcttattaaacagaacacagtagagaagacctccgcggttaacaagtgttgcaattggaaagaaaattacgaatacgtgatccaatcttttacaatatctgtctctatcattgaaaggacagtaccttacaaggacgttgtacaacattacaaagcatcatacttgtggacggaaatgcttaaatttatagataaacttaaaatatgcttcacatacttatatatattttttctggacggagagaatactgatgtacttccgtttgggtgagcataaaagaaattcttcatggcacggttcctaggactaaattgcagagcgtgatcgagcctgcatgtggctaaacgaacaaaagaaaaacaaactttaaaaatgagagagagagagagagatcaggaaggcaaaggaaagcgagttgggggagaggttgttttagtatctcaacaactatgcacgactacgtcactgatgtttaaagaactaggaaggtagcgcatcagcgcgggcatcttatttagtggtgtttgaaattttgttacgaatgtttatgtatatgattttttttaaaaaaatattttttctcttctaaatatgtgtatatcaataatttgtttgggattgttttgaaagttagtttcgatcactggacgtacagacgtgcaaagaggggatatgtttctgggcatttaatttatctatacatatgttggaccgatgggtacgtcaggtcttttgagggggtgtctgtgacatcctagttcgattagatatggcctatgttttatttaaaggatgtgatttgtgttgtgtgcacttcagtagtactatcttgctagttaagcaagagtgcaactaacttgtaaggcattgtccctctaaccatatcattttcgtgttgactattttacatgaagcgacaacgaaagtgtaagtggggtgatatctgtaagtgagtgccggttaaataggctgtgatgtgttgttctagagaacggattgttacaaattgtaaactaaaattacatgaatcatgtcatcttaaatttatgagaaaaaaatgtcgcaacagtggatatggttcatatgaaactatcatttatactatatatgtttcttttttgaaaaaaattagcatcttaatttaaacttttaagtaatactttttcttgtatactaaagatgcatttatagattttaggatatattaatttaagaaatttcctattaagaatatggtaatatggcttctttatctaattaaagacataatcacatacttctatttgcttgtactacctccatccataaattaaaggattcaaattttatacattttaatactactcatcccatcgaaccatccattattcattttttatccaataatactctaaccatcttctaactctgcacataccacatatttaatgagccttatttagagaggggaatcttagtatatttttacattctttcttaattcctataaaattgtaggattcattataggacagacatagtaattaaaaagagcttcattcatagatggatttacagatttatttgtacgtttgtagattgatttagctttacatatttatataggtaaatagacctcatatacatgttgagagatataattaagttagtagaagttgttagatgtctaatggtataaagtaatgtgcctaccatttttgttaaattctttttaggattttcttttattcagttgttaacttaattgtcgtaaggaagaaaaaagaggcgaaagctagtgggttcgtctcatccgtgaggagggaagtggatatgtgaattgtacatatggattttgacagcctgatcgatcggtaggttttatttttaagatatagatctaacattttaaaataaggtccaccggtttgggtaagattttttttctcaaaattttttatataaagatatattagagcgtcatgtggtgatttaggaacgtttatgggaagccacgtggtagcttgagagaatttgtaggatatctaacggatctttagtatataataatagataattcatgtcatattaattaacatatcactcagtaattaaataatttgtatgtgtagtgtccctgataatatccaagtgatgtcccgattttttttctgagttcacccctgaaaattaagggtatatacatccaagtgacgtattataatttttatatagaaatatatgtaccaagagattatttagctatctaattaatttttatactacacgtatttggtgttagccaaaaaaataggaaatatggaaggggagggttagagggggagagagggagtacgtacatacatgtgcacattttttttcgttttaaaacgtattaagtgaacttgtgattggagtgggggaacgtacagattttttttttggaagataagatttagtggtgaaaattaataatctaatgatttaaaatgttgggtccaccggtttataggaaagtgccacgtggcggtataggagcatttgtaggaataccatatggcggtttaggagcatttataggaaatttattagacttttagtatataatgataatgatgctcaaatttctaagaatttttttctaatttttaaatgtgataagttcgatgaatctttattgcgtagaatgatttaagatgacactaatattttaatgtttcgtggttgtttggttgttgccagtatgttcaaatgatgtatttaaatttttatagagcaaaatagtaatatagatgttgatttacttaattaattacaaataaaattactgtttaaataaattaaaaaccggattctgttttgatgcgatatgatcaaataatgtattttagtttttgtacatagtaaaatatgggtgatatggattttaaattattagttatttttctattgaaaaaattagttaaaaaaagagttgggagaaggagtaagacgtaagtacatactatatacgcacgtacggctggaggggtgggaggatagtttgtttgttttgatagatttaattagttttgtgttatctataacagatctaatggcataaataataagcccactgatttaagtgaaaatcaatggtgggttatttttagaaatttttgatattttttaatttattaaaataccacatgccacatggcggcttgagagcatttataggatgtccatgtggtagcttgagagtatttgtaggaagttttatgaactggtgagcaacaagcctgatgggagaaaaaaccaagcaaattggattggcatactctgtttattgcgttcttcacttgctcgcaactgttacaattatgcgttcggcagcagctgactcattctccacatgcatactttttgaactactaaacgatgaatttaaataaaaccagctgcccctcctctcccctttattggcaccagctgccagataaaataaaaaacaactttttttttctccccgacctcctctctgccacccaggctgcctcaccgccacaccgtcctcctgcagggcaccgccgcggccaaagctgaacctgctctctagccgactggcgcacaactccaccctggcctcgacccttctggtaaagctcgcctttttttcttttctgttgggcttttgtcactagttgtgcgacttgatttcttgttagagtgagcatgctgtttttttttttaaagtgtaccactcataggtaccggcatccatgttaccatgtcatcagtgttgtctaacgggcgcttgttttaaatttggcacctaaggatggtttctaaccggtaccaaagtcgatttctgtagtagtggtccgagccacagacatgctaaatagcgtccacgacttatcagctagtactttcattttctggtttctccaggaacgtacctgacctcatcaagatgatcacatatccacgagatccgaagacagaccccctcctatgttattactcttactgtttctggggttagaatgcatatgtgatcatctttagctagaacttcacgagaacaactgatgccgtatgtagggcgactgctcttggatcctcccagtccaaatccttatggtcgagtatagttgtctgatacatgtatatatctctgaaaattgtaataacatactacctccgtttcaggtaataagatattttaactttgacatactacctccttttgatatattatcatatttatttataaaattagtcaaatttaaagtagtttaactttaatcaaagtcgaaacgtcttgtaacctgtgcaaaccactcaagtacaagaacagtagtctatagaagttccagtatctgctgtgcctcgtagcatactttgtgataagagagatcgcagtccaacatatcaccttgctgatatttcaaagagcacacaacatataaatatagaggaaaaagtgtgcccgattgcccatccaattacgatattctctccgatcagactgttttgctcacaggataacattcttttaaacattacctgaaatactcgtccataggttttgagaaattactgacttactcgttctttataatatattttaacttgcttgtaaggtttgtgtcgttcctgcaacagcgaagggcgttgccgctgctgaagctgacagaggggactgatgctttcatcgacatgtccctgtaaaactgcaacgattaagaagccgtacgtgacttgaaatatgataaatgcagatgaggaatctggaaagaactgcttccttcgctatattttctagtttccggccgtgtttagttttcctctatttttaactttccatcacattatatcacatcaaaaacttttatatatacataaacttctaactttttttccaaactcccaactttctttaaatttttaacttttttcaggaactaaacacacccggagtatgtgagtctgaattagttctctgaaagtggtcggtgttttggcatgttctgttctgtcactaaaaaatgtaagctctaatggcgccttttacgccaactttggtttcttattagttcctttcaatctagttgcccagcatagacccaatcaaagccgggcatcattttcactaaaaatgtcgaagggagacaatcgtgggatcgaagatcaactagaatgtactcaaccaagtagcgatgttatttatttaatcttcattagtgatccctttgagttttccacgagagcatgtagttgagatataaaatatcttcatcttggggacttgcatatcctctgcggctacatgattgcaagagaaatccatggccaacatatggagaaaacgctgtgtaatagatactataaaaaccaatattaattttatcttagctttattaattgttatctctgttgcgatgtaactaatttcagtaacacaaaagagaaagggaaaagagaaacatcgttggtacgtatgatatcagctcagcgtcaactcttagtatctatcttatataagtccattaaacttcctacaaacgctctcaagccgccacgtgggattcctataaacactcctaaatcgccacgtggctctctaataaattataaggaaaaaatccaaacaataatttccacttaatcacggtggacccatgcattattttttaccattagatttatctaacaatataaaaacataaaaagcccactttccatcccttcacgtgacgtacgtgtatcaacctccacgtgtagatacgtacgtatctttcctcccccctcacatcctctccttttccccccctaaaactgacaacgttatatattataaaaaaattacatagcttaacaattataatttttaaagttcttttagttgttcttttatttataattcaataaataattcaagtttcatattatctatattttattttactatataaaattgaaatacatcatttggacattatatggaaaccaaacaagaataagacattataaaaagaatttgatgatatgcttcattttatcttaagtcaatccagatgatcaaaattgatcaaacttcctatagagcgctttttaagtaaccatatatcacgtctacggggaaaaaataatttggtggttcaattagctttaaccattagatttatctaaaaaacttaccaattaaatttatctgtaaatagctccacatctataatgtgtacgtgcaggtaagtagttacatacgtactaaaaatagtactacgtacatgcatacttacgcacaccaagccccacatctttatttctttttccctttctcacttaaattagatgaaaaaccaaactaataattcaatgagcacgtgtgtcatcaagcacctaagataagaaataatactaaataggcaatcatcaacaaatgataagtagaggttgccaccaagccacaacaaataatagttgactacaaatagattgcgagtatgactaatagggttcctacaatcctaagaagccacgtaacgctttgataaataacacaaaatctaagaataaaagtaaaacaccttgccatcaatttacacttaaaccggtggatccattatattcaaccattatattagatctatcgaagtaatgccttgctcctaaaaacaattaatccctccctatatacgtacatacacgagagatgtaaaaagaaaaaaaagagagtgtatataccatttcgcatgtatggtagattttttttcagcgttaactcctagcgatgttgtcgaggaagcaatgtcgtcttggcaccacttgtatttttttataatgatgtaaaaaacagttgggcgctcatataaacacatgcatacccatcctgtgaatacacatacacacattatcccctacaaggggaaaatatttgtaaaaaaccaagaaaaaatatatagatccgagagactactattcaccatgaaaaacatacctacttacgtaggtacgtgcgtgcgttcgtacgtacgtacatacatacatgttacatacatgcgtacgatcgaaaatggcacgtggaaccacattatatctctttatatttagggaatcatcttaatagtgttaataattagcataataaattttgacaatataaattattctttcgtatattacccatgaaaatgcataagtgaattagatgtatagtaaaagaaaaaaaaaaccaaaacacatattaactagtatgttcatatgtttgtgaaggatggtgataataaagtgatttttgtttgaatataataggcattatcatatagtatatcaaagtttatggtctatattacagaataaatatttttttattataaggtaatgattctcatagtgaatatggcgagatatcttttagtactctttttataaacaataagtgaattgcccgcacatctgcgtgggcttccttcctagtttattaaaaaaaatactacatgggatgaaaaaaaagaaaaaaatatgatgaaagaatatttgggggaattaatagctaagagaacatatgtgtcgacatctttctagcaaacctgaaaatattttaccttagttttattgatggttatctttgttgccgcgtaagcaattttaatgtaaaagaaaaaggaaaaagagaaacattattattgatacgtatgacatcggctcaatgtcaactcttagtatttattaaaaaaaaattactacatggggtgaaaaaaaagaaggatggattaatacatataagagaacataaataaatgtgtcgacatctttgtgttacatccgaaaatattttacccttgctgtattcatggttatctctgttctgttgccgtgtaagcaattttggtaacataagatagaaaggggagaaaaaaaagaaacatcattcatacgcacgatatattagctcaacatcaactcttagcattttaaaaggaaaatttactgcattggatggataaaattaagaaaagaacgataataaaatattattttggtaaattaatagctaacagttcttgtcttatattgtaaaagggtagttttcttagtgacaaccatttactaagggctccaacgagattctagtaaagcttaggttttgttcgtttaaaactaattagctcgtaattaattaaatattaattattgtaacttaaaaatagatttatttgaactttttataaaacaacttctatataaattatatttaaaatatgcaccgtttagctgggaagcgtactaatggaaatggaaaccaaggaagatttgtggaagtgatttctgtaacttagggcatccacaatgtagtctaagggtgtgtttgaggagaaggggattgaggagattgggaagatacgcaaaacgaggtgagctattagtgcatgattaattgagtattaactattttaaattttaaaaatagattaatatgattttttaaaacaactttcctatagaaaatttttgcaaaaaacgtaccgtttagtagtttgggaaacgtgcgcgcggaaaacgaaacaaacaaactcactctctcaccctctcgaacgctgcctaaaactagtcaataagcaataaaatattccattcagccacctaaccacattgtgtaactagtccatagcaagaaaatagcaaaagccacccataagcatatgggctgcccatatagaataaaatatattatttgtctctattttctctctcctcctaatactagttgctatccatatacattgtgaagataacattagttatagtctatatatgtgggtcccatctatatggattacttttgttatatacattggtgttacccttagccggaaagctgccattaattaattattacaggagagaaggcttagcatgtgggtagaccaaaaaaacaaaaagtgaattgagattctttatttgggttgtctttaagcttgcagctactatcagagcaagtatagtaatgtacaggcagccagcgaaatcgacagctacgtcatcgaatccaacgtggaggagcgagaaaccaagaaagagaaggaaatgggtgagtcgcgagtcgccggctcggagcgttatatccgaggcgaaacgcccgctcccagcccgttgctggcgccggcgcttgctccacaacggatgttttgtacatgcatatattaattgcttagatgttttaattaggtaatgtatcagtcaacttatagccaacccattatacaggtgagtttttagagcatggctaagtgacatggcagtgacttttagccggctgctggctaagttattatccttactctcatggactataatcaggattctagctgccgcagctagctactatcagattctttttcacactattgatggcacggcctatggccaccgaacggccccgttgaagctattccaaaagcataaaactcttgtatttatcttttcttca

SEQ ID NO: 82931 - DNA, 58722 bp, Oryza sativa
atgtaaatgtataagatataaatcacacttaaagtactatgagtgataaaacaactcataacaaaataaattataattacgtaaattttttgaataagacgaatggtcaaacatttgagaaaaagtcaacggcgtcatctattaaaaaacggaggtagtatttgttagtcaagaattgtaacccattaagtgctgattagttcattagacattaagcctgttctaaaaaaatgcttggttaaaatacagttctttaatcagtaaggatttggaggcttttttgtttctattcttgacagcatctatatttcgatctctgttgaatactattttgtgtagattatattgatcatataataacttgtttacattgtatactgccaatgcgtatgcggccaacgctactagagaaaccaccatcactaacgggtgaaaacaactattattatattgttcacaacgaagaacactacgaaatggaggggggagaccaagaagaggaacattagcttatcgtaagaacaagtagtgttcattgttttttctttaatatgagatgtgtctgatttctaaagggctaaatatgtcataaacgtttaggaataaatttcttctttcgttgttaataatggaaacttagcctctttcataccatacatactgtctaagcaaagccccaataccactctatcttaatttgaagaactatattatattatacaagtttaattctttctatgaattggcaaatgccaagtaaaggttgagcataaatactactacctttgtcccaatatataacaacttttgactataaatttggacacacagttatctagatttatagctaaaaatacttatattttaggatggagggagtagctagcccctatgctgcaaggcactagatataaaaggttcccactgtttactacatcgatcctatctacacatgtaccagaaaagtaataactttatggttttgggaggagaggtcttgatcaagagctctaaccctagctgcgtattagctgctttgtaccagtctcatatttatattccgttctagatgtttgtaccagttatctccggttaggtggtcgatacatacggaagattgcctatgcatccgcttgagttttcgttccgtacgcaacttctatgaacttgacacttgcaccattgttgatacgcccctcttaagttctcatcatttctttctcttgcacccagaaaaggttaattacctgtttaattattaataattcaaaattggacaatatgataatgatagaaatggttgttctagaatgtacatgtttcagactatatacagatactccctatgtagaagtcgttttggacagcgacacggtctccaaaacataattttaacttcttgttactataaaaatatttattgaaaagtgatatatgtataattttataaaagtatttttcaagacatctattcctataatctttacattttcaaactcaacaacttgggagttattcatgatttatattttcaatgtttgacttaaatattattataaacgacatggaggtagtacatgtgttgtgtctgttccgtgcaagcacagactcgcaagcattgtttgtgtagaaagcaagcaataaatccaattaattgtaacaagaaatgttctggtcaacaattaataccagccatgttcatgttatttgttttcttacttctgttttcgtcaaaggtgttttgctgtttgctttgcccttcattgttttttttttttggaaatgtatcgtttcaaaagaatatctgaattttgtgaattataatacgtatttttgaaaatctttgttgttgttctggtattttcgaaaattgaaaaaaatgtaacattgatttttttttaggattcttatgaacttcaatgaattcattgagtctggcacttaattacaaattagttgagaattttgcaatatgtcttctgctgacggatgcagccaagcagtggcagcaacgtggatcgacgtcttatatatccacgaaagggcaaagagtaatgtaagtcaagtactactagagttctttctcctctctggtaaagccttgagacagaacccatgcatttggcagcattcctggccaaattatatcctccttgacattcaggccattattttataaggccaaaccccactataaatactagctagtatacctcttcatttctggtcgtctcaagcagtgtttggagagacagggaaagagttgaacttgcaatggttcacatttcaaatttaatctcctgaaagcctttagtttgggttttggaggcaccaggaactgcgttggcttcaactctccgaattccttctaagttttttgcaatcagcacagtgcagacttgtcattcagtacgagaataattgacgaggtgatttggctgcgcttggaactgaggagagtttagctctttgtttcctactcgcctagtttaaactatgctagactcaatatttgtactcggcagctgccactttcgtggggttatccaatagggccataacataacaaatttaataatatcaccagctgatatctgtaaaaaaggtagtcccacatgtcagcaagagatagctctaaatctctaatagctgatgcgtatgatagctagctgtccaactatgtgtacatccaaaaaaaagagtaaatctttaatctggtaagtttgcttctgtcccacctagtcaggctatatccgtgggggcgttacaaccatgtggggacagcagcagcagctaaacttcatttcagcagattagcagctaaacttcaacttactcgctttccattaacacatatttcaaattgttaaatggtgtttttttcgaaatcattttatatagaagatgtttaaaaaaatatataaaccaatttatcgagtttataatgattaattcttaatcaatcatatgctaattagttttctagtttacatgcgtggagaatgtctctttgaagtctgcggctaagactctctttcctctccagccatccttagaccctatttagatgtgactaaaactttttagtccctatcacatcggatgtttggacactaattataaatattaaacgtagactattaataaaacccattctataactctggactaattcgcgagacgaatctattgagcctaattaatccatgattagcctatgtgatgctacaggaaactacactaattaaggattaattaggcttaaaaaatttgtcacgcgaattacatcgtatttatgtaattagttttacaagtaggttatgtttaatactccaaattcatccgatatgacacggactaaagtttagtctctggatccaaacaccaccttagaactgatgtggcaatatcatcagcggctagcctatcctgctttacctgctcttaggatgactcgacctctatctgatgtgcaagcattgtaacttttatatggctgcttggaagttatttaaagaatacaactactcatgcaaataaacaacttttcattggaaagtagtgtttcaattctgtacaaaatgaaaaagcccacaagtaagccagagaactgcctagctatcagattttatttatcttttttgtctttcaccatggattgctcttctatcagacaagtgtgtcatttttatcgaataacccattcgctcatattaaattatcgacgtatacattgctattgttttttttctaaaaaaatgaattatttggtattattagaagaaactagaaaggtaacccgtgcacatgaacgtgcacctaatttaatatgtgtgaaattttattatgaatgtccatgtatgggtgacctagtattaaaatattatatctaaattataattgaacttatttaatgtgcttttaaaattagttatgattttgttctaaactaaaattactcgaaaccgtataattttcaatttatgagaaaatattatgtcgaaataatatatgcagttcctatgagaaaatttagggtatttcaaatccccacggggatatcttagcccgaacattttcccaaaaagtcaaaaaattgttacactctatttgaaattttagaatgagatttctcattctattagtcctgcaaaaatatttgaatatttctatttagaatgggttttgaacccaacaattatttaaaaattttacataaattttttaatccttttcatgtccatttttttaaaaaattggaaaactccactctatcaagcatatttgaaatgatttgatctaaatatcttcaattgagtaagaatattaaaatagaggtcatataataactacacatttctagattattctacgctaaatcttaggaatttaccatgtagcatagcaagttttaccaaaaagaataagtgaacatggtccttaattcttatatgaaattgacttaatatattggtaatgaaacctcatggttgtttcactgctaagatttctttctgcagcccacatgtttggtacaatcagtatgatcttcaaccgagcacgtttatagtttaaaaatgttgtctatgaaaaattaacactagaggggtacacattatgacataaaaatagatatcatttaaagatttttctcgaatttcttagtgaattcatagatcatatatataattttatctcctaaaagatcatttattgataaaagtaccgaaatcaaattgcataggtaaatagcccccatatacatgttgagataaattaattaagttcatagaaagttgttaggtgtctaatgggatataagtaatgggtctaccggtattattaaaaattaagatacgatattttgatttataatgacgaattttattttttatatttaatggaggcctcaagatggatgtggatccagaatgtaatttttatgatagcatttatatatagtcaatatggatattaaagtattgatttcatttaaaaaatataatagttcaaacagaacataagttgaatatagattttaagaagtgctagtaagagaagaaagagaagaaaagggacagtgggagagctagctagacaaaggagggcgggatctttttcttaaaaaatgattgatataatgacctaaaataatgtgttggatgtttttaagtcgaaaccgacggtcagatgttttgttctttttcataattttatacgatttttttaacttaagagagacatgtagtggcttagaaatatttataggatgtttaatgtactttaagtctttaacattgtagaggcggggcgggaggaaaggaggtttggtagcttttttttaaaaagtctaataacaatctaaatggtatgtccatcaatttaagtcgaaaccaatggttaaatgtattgttcttaaatttttatgattttctctaatttagaagtgtcacatagtggtttagaagtatttataaggatagttaatgggttttaacgccatatgggagcgtagaggaagtttgggattttttttccgtaagaaaaagaaatatctaataacctaaaataatgtaaaaagatggtcaaatgttttagtatttttatattttctctaactttagagtgcgatatgtttagaaatatttatatgatgtttaatgtacttattaggagacgctagctagtaggttgatgggcgttttagacccgtatttttttaatccttattattattatggatattaaaaaaaggaaaaagggaaacggatggatcatacgtacgttgctctaaaaatggatagtcgtacattgtggaggcgtacgtggatggagggagattttgttttctcgtgaagataaatctaactatcaaatttaatgggttcaccaatttaaataaaaattgatggttagattttttctattttattagagtgacatatggtgacttgagagcatttgtaggataccacatggcgacctaggagtgtttatagaaggtttaatgaacttttagtatataataatagatagatagataataggtagatagatagatatctcatgagttacgtgtttagaatttgcatatttttttatccatgacattaactaatcaacattagtaggaaataggaatagctagcctcttttacgttgtatatgatcggagcttaacatagcctctttttaagaactatataatatcaattttttgattgattgtattttattttttatatattttttcattcaaatagaactcgtaaaatgtttgaatttttctatttacagtgggttttaaatctagcaacatttgctcaatttccaattgtaaaagccgcctcaaggttatttcactgttaagattcctaggtgcaacccacatgcttattggtatgatgttcaactggccacacatttatttttaacctattgtctatattgctagatgaatacctattatgattagtgacttcatagatcatatgtgtaattgggatgctatgatcatctttcttatgaatatttatttatctcctaataagatcgttttaaaagtatcaagatcaatttgtataggtacatagccttcataggcatgttaagagaaattaattaagttagtagaaagtcgttagaagcctgacaggatataagtaatagatggaggtccatttgtgtctttttttacatatagataattttaatttcagttgataaggagataaaaaatagagagaaaagaatggcgtacgctgtacgcgagcagggaggaagggagatttcggatgttctttttctaaatgattaatctaacaaactaaaattatgtgtcagatgttcaagtcgaagctgatggtcgaatattttgttttcttgtcagaatttttacgattttctcttatttaagagaacgacgtaatatcttaagagcgtattttctccgatttaagagaacgacataatatcttagaagcatttataagatgcgcactttttactgtgttacaatgttggggtggggctatttttttaatattactcatagttctgttcattttacttttattagatataatttaactattatcaagttatatacgatgacaaaaatatatatcattaatttttatagttttaaaattgcttaaatgacacgcaaaagtcagaaaatgtagccccaattaatgtgacatttctctctttacaggtgaattaaagaggacatgagttttaaaatgtaaaatatctaaagacataagcaaatcaaatattagcattataatttagatgctgcatttgcttaattgtttggcatacaatttttgcttttctaaaagaatgaaaataggagaaaaaataggtgataaaaggggtgaaagaattagggggggattgagcagacgcaagtacgtatgtacatgcaattgccaacaacaggccgaggtgggcctacagataaggatatgtttttttctaataaatctaatggttacaaataatggtccataaaatttaataaaaatcaacagttatatgttgtgtcattttaagaatttctctaatttattagagtgccacgtggtggcttaggagcatttataggatgccacgtggaggcttaggagcgtttgtaggaagtttagtgttgattaattttttattataaatccttatgtggaagacttttaaggaaaaagtctgaattacacccttaaacaataagaatggtacgaattgtcctggttatatataatctgatctctcaccatctttcgcaaacacataagctaatatattttttgttttgttttttcttttattatacatctgatttagatatgtatgttcatgggtaatataggatggaataatctatattgtcaaaattatttgtcctaattattaacattatatagatgagaatgacataattaaaaagatataatgtggttctatgcggcattttcgatgatatgtgtatatgttttttctagcaaatactaagcacatattttttcctttttttggagacaaatattttttctcttagggcaggtgtgtgtatgtgtatttatatgatgggtgagcacacgtttatatatgcgctcgtgattgctttttttaaggaaacgtgattgccttatacatcattagtaaaaaaatacttttaaaaaatttagcgagatggcgtgaagcggtgctgcggccgcgtgaattctttgacaaactcgccaagggtggttgctacacatatgcacaatttgaggaaaatctcagagccacaaagaaagaaagaaaaaactactcgatggagctgatcttgtacacattcttcttttttttttcctttatgacatctcttgcgtagatatagatataaaataatggttgaaaataataaatccatgggttatgtataaataagttgctagattttgttttttatatataggatgacccttatatatatacagcatgtactcctgggtgtatagaaccatttttctatatattttttgttagataagcacgggatatgcaatatttgatacttaattaatcttacgctgatggcatgctttgtttcgcgtgtcctagataagctcatccaatgagatagaccgaatgaagcttaagagataaaagggcatccacatggtgtaaaaatatatatatggttgttaattttccaaaaaaaatatatgaatacagaaacatggaatatatgaaaatacattcttgataaatttaataatgtcatttggatatatcagtattacacgatagggagtgagtaaatttttaaaatgctactcaaaatttaaattgttttttaattataagtccaatttaattgtgatatacaatcatatagtctataatgttaattattaatatttttttatggatgtttcaatgagatgcgctatttagaataaaacttaaaataacatatatttttacaacttaaaacatatggttaacattaactttttagtttttcatctaatctaagtatataagaaggaaaaaagaaaaggacatagaggggatatgtacgtacatcggacataaggacgtacaggtccaggggacacggccgagtaacgtgggatttttttagatagattgatttgtttttttcttaaaataaagatctagtggttaaaaataatgggtccaccagattaaatgaaaaccgatggttggatgttaaagcgccacgtgccgatctaggagcgtttgtaggagcgccacgtggcggcttgagagcgtttgtagaaagtttaatggacttttagtatataatagaagatggaagttttattgaactcgaaaatctgagaacactcccgatctctgcataacaaagtgcacacataaaaaaaaaaagacactcctctgtttcctctgtttttccttgtttccaactgtaattaggagcaaattgcttcatatagtttgtgtccttgaaactcaatttcaaattaacaccatgaatagctgatattcagtttgagttcaatacctatctacaacgtacgaataacagttgaggtgaaaagttgaaagaaaaattctacctaggatagactgaagcaaagaaaaaaaaaggcaaacaaacaaacaacctgctggatgtatgggatggacatgttttaatgcaaccatattcaaaatcgaaccacaatgttgtgtacaaccatgcctattaaatgtgatcaaatgtgtggcttccacggttcttgcacttgaggtgtttgtttcatcagtacatcctactgtgaagtatacatgtatcaaagttgtctaaccttatagttttggattgggatgtctcaggagatctagccctacatagcagataatgcatactagggtaatatttgtagtcctagatgggcacatttgcataggtactggcaaaagatggtgattatctgtcaattactccgtagctttcaagtacagagtcagcatatgttcttgtgtgaagtgtagaaggagctgatgtcctaattgatgtatacagaacacatgtgaatctacgtatctgaagaggatgctatcagcgtcgaacatttgtgtcattcttcatagatcacactttcaatgtcaagtcgaatatgtttcctgttagcatatttctgttgtgaagtgcatgtgcattttatctcttaattagtagcggactttgttatatcctctgcgattctttcgtttttgcatcgtatactctaagacgtgttcagtccacgtaggttggcattgttggaggtaggatcgatcatgcccgtgtgtgtagaatctgcgtgtttatttctgctatataatgagaagagaaaacccaaaagctgcagaagttagggcagcaccaaacttgttgtttgtgttcctgcgctctgagtttccatgaaatcgtgtgcgtgtgtatttaggattagacaccaacgtttcctgcaatcttgaattgcctttgctccattgcccatatgcggcgatgagttttctgcttgcaatattttcaataccttgtttgtctgcacttccattatttcctagcaacccaatatttcagaaaaaaaaagacgtttgaaatttcaaaatggattgaaatatttttgaattttcttgtcgttgccgtgatatttgctgaaattgaaaacgcatcgtggaacttttactggatcgagtggaaatttaaagggtgaatagctaatatggtccctgaagtttcacttcgggctcagtttagttcttgagatttcaaatcgttcaaataagtcctccaaattaatactttgggtcaatatacccttatataccgtataaaaagaaaacaaatgtttcacacatgtatgatcgttttagaattgtcacttacgattgctgcagccaagcactgatcgcataaattcctttgtcggccacccttcacaacaatgttgagcctgggttggtctttttttttgtattttcttttctatatggtatataagggtagaatgatcattttattcataccgctgcatgcgagacgactttggcatgtttacgtggtattttttgtgggtccaaagactatattagcccaaatgattaatttggaggacttgtttggacgatttaaaacctcaaggactaaactaagcccgcaacgaaacttcagggaccatattagctattcacccgaaacaatacatcatctgatgattttctcttaagaaatgcatcaaactgtgtaagagagaaaactgaagtgatgccagttacaaccgttcagtaccattggacacgatgcaactgtcactggtagctcgagaaatggcctttaccatgttgctatgttggcaccaaattgtattaccacaccttgattatgttatatgtgaccagtggcggcactcggagacacgccgtaacaagacaagatctcactgaacgatgacctaggagggacccatcactccatcagggtgaacgttcatcggttaattctagattcgacaggttaagtagaacatcctcaaatgcagaaatggcctttaccatgttgccgtgttggcaccaaattgtattaccacaccttgattatgttatatgtgactagtggcggcactcggagacacgccataacaaggcaagatctcactgaacgatgaactaggagggacccatcactctatcagggtgaacgttcatcggttaattctagattcgacaggtcaagtaggacatcctcaaataccttagagaccagagagatcgagcattgaagggtgaataaacatgggatacatcggaacaaataggaggaagatgtagaatattgaggaagtcgaggcatctcacgtatgccaacctaaaaaggcaaagagattttgtttagagaagggtattttttacctagcttctacatccaaccggatatatgcggccatttaaattaggaacttagccccgcaaataagccaatctaaaattcaatcatacggagatttgaactcagaaccttgggtactacttaggtcaatacaatcactaagctacgtaccttttcataagtcaaatggcgtattgcatcttgttatatatgacctgtgtacggttcatacgattgctatgacatgttgcatattacttcctccgtttcataatataagtcattctagcatttcccacattcatattgatgtatgtctaaattcattaacatcaatatgaatgtaagaaatgttaaaatgaattagcttgtgaaacggagggagtacctcatatttatgggtcattccctgcatctacatattcatgggctcctttatgagctattacagatgacccatcttatatgtctttatgtggcagtggtggaatctgtactatcatgaacctgggctcatgggctcatagatgtctacctattgctggaaaaagccagtaaatggggcaaacatattattttgggaagacagttgtatttgttggggggaggagggggggggggggaacctttgtcacaaaaatgtccacacttatatagaatcacagacacacacagcagataacactggccaggtaaaacgaaaaggatgaggaaggatgggggagcataactttcaggagaattttgtcaggtaacaagttgttggactggaataacataaaaaaaatattatgacaatataaaggatgaaataatttggggcttgaccaaaaatggagtttttagtatcaaatctttctacacagctatgaaaatgcaggaggcaagttcaatgataggggagatacataaaaaaatctggcacatcaaagtacctctaacaatcaggatttttttgtggttactgataaggaacagcgtgctaactaaaaattacctgaagaaaagagggtggagaaaaggaaatgaaacttgtcagttttgtgacaaaaaagaggcaatacaacatttgttctttgattggcccatgacaagatttacttggaatgtggtgtcctgtgcttttgatctgaaacctatgaagaatgtacaacacaccttgggtgcttggactcagaattgtgataaagttacaaaacaactattgctagtggcggtggcagcagttctgtggtccacttggaaagcaagaaacaaggtgtgctttgaacagattctaccacaggatcctactgacatcttatatagggctcgctcatggatgaatgactaggctgttttgcagaaaccggtggaaaaacaagaacgactacggtggggaatccagccgctaaagcaagtcacaagtgagatgttcaagtcacaatatggatggcgagcaagtatcagaagactcccctggcaactgaaaatggaatggcgccttttcttcctggaagtagccgatggatgttttttatttttattttttgttaactgccactctttagatgtgttttgcggcaagatgtcttttgttatactatgaacttggagtgcaagaacgtactccctgtgttctttatcttgtaatccctgtcatttctcttaatggaaatggagggattttgccctttgctaaaaaaataattatttattatcatcaattttcatctgctcgttgtcacaaatgtacgacttgagaagtctcagccacagaatgaatccaacaggtccatcataaaaacaaaagaaatcctgccagccataatatatatatatatactatgtgagtacatgggtatacatctatatgttgtgtatgtaccaactcttggctacaaaagggaaccaagtggtgatcggttcaaccagccaataccatctgatacacggccttgccaatcgttgtatccagcttgtacaaaagaaagttcagatcaaaccaatatcctttggtttgaatagaaaaggatcgaatagaaaaggatcgcattgctgtgtaagaaatactgttgaatgggtcacatccagtttcccatttgtcagaactacatgcaaaccgattgtttgtttatttttaggtttggtaggcaacagggaacaaatatgcaagtaagcagggcattactgcgagctttggagatccaaagaacagatttgagatgagttcaggagcattgtgcaaagcgtctcgccacctacatctacgtacgtagctcataccgcgaggcgcagcaggtaagcatgagtcatttgactatgaagaaaggtgatacgaaactatctagttgttcatgcaagtcagcttgggcaagctgctaatcataaacatacatcaaggctggtatatgtactactaagcacgtggatacgaacggttgcctgaactttcttatgtgttcatgatgataaagtattggcattatctgttgctagggtgactacctttgataaaatgacaccttaaatgatacgggtggcagcagtggggaatttcggacaaccagaggtttctgaacccgtggaactcttgttttgaggacggttgaaataagtaaagtgattcactaattaatccccaatggtttggaaaatcaagttctccagcaagcaaagaatcgtataaatgtataaaaggggggaaatatatgtggtaaacaccgtcgagtaagtaaaaatttgtgaaaatcatatttaaaaggtttatatataaattaatgaaaaaatacactagagtttggtatagccacaggggcggagctatagtaatagggccggtgtcaggtgacaccgacgactttcgacaaaacgtatagcaaaactgcttatccataagttataacaccatgatctaaccataattagtatactatgacaccgatagacacgttatgacaccaacgaatcaattttctagatccgccactgtatagccatgaaatatatttccatccaatcttaagcctaaaatcaaattcaattttagaaggaactaaagtgacagcctgtacttttcacctaaaatctacgcttttttcagaatttgtaattttttaattcatgttttcatgggttttcatttcattgaaggttataaatgtcatgttcagattgtagccaaaataaccttatcaaagtttggacgagattgacaagattttttatgtttttaccagagttttggtaaaaaaaactaaatagatgtatgtatttagcaattttactaaaaaaaatagtatagtttgaaatgaaatcaatctaacaatcctaaaagcccttcctcacatgattaggcagtcaccagctagctaccgctgcttgcagtaggtcgtcttgcgttgctactgtactgattacatcatttgactaggtcgttgcacgcgtcagccggtagtccggacagaatttcagtagcatcattggtgcatatgccaaccgtcgagaatgtcagggatgatcagccaacgtggcaaatatgctaatttgtgttagtaaactaataaaaagtacatggacaactaaccggacttcatactactagcaagtagtgtatatatcagtcttttgctaatacaatattctcggtcaacatgctgcatatcgacatcgtacagtctttacatacataatatccatggcaccagtttggcactctagaagaggccatattaaagcatatgcatccatgtacagctagaaaacaacatagattcacatggcaccattccaattccttgctaatagatacactgacaaagtggctttatccaaagcaaaaatccgttcaaaaccatggattatcctgatacaaccattaattcatgccttaatatataaggttttgtacatgtttcatttgagtaggacaacaatttggaaatgtttataccggaaaagaaccattcaaatgtgaattatttcacatgctactcatgctgagggtggtatatatatgtattggcagtgtgcactgaaatactcatccatgcatgcaaagaaagcctgaaactcccaagaaatatggaaggagaagaagagagtgaaagctggccgccgcagctcgcaccgccgtcgtcgccggcgagcgccgtgctctccgacgaggacctcctcggcgagatcctcctccgcctcgagtcccacgaccacctcgtcgccgtcgcgatcgtctgcaagcactggctccgcgtcgcctccggcgagctcttcctccgccgcttccgtgtcatccacccgccgcgcctcctcggcttctgcgtcgacgacggcggcggcggcgacgctgggcggcggccgcagttcaaggcactcccgcagcatccgggcgtcgccgctgccgccgcgcaccggacgcggcaccggttcttcggcgcgttcggccacctcgccggctaccaccgtccgtccatcgccgactgccgcgacggccgtgtcctcgtcgagtcccccgacagagcgccgcggcggctcggcatcaacacgccgtaccgctacaccgtgctccggccgccccacccgcgtgaatccgtgcaactcctccctccgctgccgccgccgccaggccgcggcgccgggaagcacgtcgtcgaacgcgtgttcctgcccgaggacggcggcggcggcggcggcgaccatggtatcacgctggtgtacgtgttgctggtcgagcggagagtgaccgcgcgagtgcacgttcttgactccggcggagcgtggggagcgccaaccaccgcggagacggagctcccggcgccgtcgtgcgacgacgccgtggacaccgttctgccgccgatcaacggcgatgtctacgtcgtgacgacctccggctacacgctaggtttgcgtctgggcaccacgcgcttcaccgtcgtcgagctcccggacgcggcgaggtcctccgccaacttcaggatggcatggtcacacgccgccgccgccgccgacgacgacgacgtcgctcgcggccggctctgcctcgtccacggcgacgggacgcggctcagcgtctggcaccggaaaacgacgaccacggaggacgacggcggcgcggccggagttgggtggcggctggccgacacgttctgcgtgcgcgaggcgtgcgagcggatcgagtggcttcccgacggctggtggaccggccgtgtcgcggtgatcgccgtcggcgacaacgccgagttcgcgctgctggacttggagaacgtcggcgtcgtgatctacgtgcacctgcagtggaggacggtgaagaaggtctacgagaggaaactcgccgacgccgacgatggcggcggcggcggcggtgaccgccagccgccggtgagggtgttcccgctgacgacagtctggccgccaacgttcccggagttggacaaaccacgacagaattgctgcgtcagaagcccggacggtctcgtcggaggcgtggtgatgacgtgccacgccggctggtcggcgacgtcgccgtcgtgctcccgccgggatggggacgacgacgacgacgacgacgaggacgtcggagcagtgctcccgggctgttcgtgggccggatggttcgatgacatggctgcaatggtggcccagctcgctgaatgggccgcgcagcccagaagcccaagaagatggcgttggtcttgtctctgatacgacccacacatgacacaccagatactgtggcagctagccgagcgcgaactagacactgcgaccctgtagatcaggtgcaagctggatgccactgggtgtactccacttgtgaaaatcaatttctaagagaaggtgaacttaattacgacaactgtctcattttattggacaatcaacttaagaatctatctataattattggacaatcaacttaagaatctatctataaaaaccgtttattatagtcaggtgtttgacgcatttgtatctgaaaattgattttaaaaaactggcacccgtaaaaaccgagctgagccgaccggtagtctcaaacggataaggcctagaggaggactcggactctccggtttcctcattctttcacgctcccccctccctctctctctcctgcgtgcgcttctctctctctattgtcctagtggtggctccgcggcggcggtgccctcccctgcccgtcgacggtggtgaattttttgtgttagtgttgatatttttgagttcttggatgcctactaattctatgaattaaatgttccatggaatcgggatgaaggggaacagcttgagctgtttttttcccttgattcttgggacctcaaaggttctcttatctatgctgccttctaggtgccggttaggaaatccggcacctacgcagggttccaaccagcaccaatctatgtttatgtaatcgtgtctttttgctgcacgaatttgtttaattcatatgagcttggacgataatggcaaggttaattttacacagtttgtgttgatcagtatgagacatgtgtagtgagtacacataggacatgctatatttacaaacatggtctctactttgcttcatcatagcttggtttttaatttctttctgtacaatcagtattgcttcatttatatcttttgaagaaaaaaaaaatctaaaaaatgccattaacaaacgccaaattctaataaatatcatcgataaatgtgagttccataaaatgctatcgtgcgaacgacttatcacataaatgccattaccgttagggttctatccaacccaccccatcaaatgcacagttcatcttgtatcacttaatgaaaggctactaacggaaccctaatagcaatggcacttctgagataaaattacttatacgatggtattgcatagaactcgatgcttgttaatggcatttcttcgatttttttttctcatgttttcattgaacacatgtatgtctaaatagcatctttatgatatatatatatacttatgtaatatcctagttggcacctaaatcaataagattaagcatgtagtcaaatttgtgcttcaaaacaagtgttttaaattcgtgcactatattgcacccatctaacaagtttgtgtatcaccagtgcaatttacccttgaatcaactttacttttattggattgtttacccaagtagactttattggattaattgtgtgcccatggatatatgattatggtgggaggtttggggcttcccctactaagttccggtaaaaaaattgatattaagaggacattcctcatatatacacggtgaattcaacagactttctagggccaaatacaccacggatcatcaagataactctagggccaaaatatgctaccaaattgaggctatcattccacagaacgaaacaaaaattggaaaaaaatagcacaatttcttgagtaatgtaaccactgaaaagtactagcttgctgcaacaatggggggagtgcagtaaggttttgttctccgatgcttcctgccgatttcccttcaaaatcagacccaaatagcatttatgaatcaagatatattcgtgaatgagcacaaatgaaagaaattgaaattagaatgcaattgtttgactaaaagaacattacgagctaagttcaattaacagttacctggatctgtcatatatacaaccatgtgtttgttctgcatcaaaattaccagacaacatgcatgctgcggcgcatacattggaggtgtaggggatgcgaccatttgctgttcgccagctgccggagcttgcacttgggacacaagctaagaaaagaaagagagtggggaagaactaatgaaacgagaaacatggatctggacaatggacacatgattatgtggagaaaaaggtgttgtggcaccgacggtagctccatcgtctacagctcggcggccactccggaagctatcgctggatttgcagcacttggacatgttaatacgcacatttagctcttaaagtatgaaatagaaaactatagttaaatttaaaaagaacccaccctaggccgatctgaccacagctatcgggctgatctgatcggcggcatgtggtcagtcagactagcagagtccgattccaagttcgatttattggttcttggggcttcttgctaagacatgagattttagatttctaattggatatgaaatatatacgggaaagcaagtccaccactcctataaatataagggagcaaagaccgattgaaacaacaaccaatcaatcatcaaaatcaatttaatatcccaaccctctatatcctatatctctctccttttgtttacctatgccaagtctattctcctcaaaccatccaattgtttgtcgtctttcatctctatggtgttagacgacgtcctagccggcatgccgagtctaggacaaaccggtgtgtgttcactttgaagggatccctcccaagtgtttgttcagcagtatctacccgctccctatagcagtgcgcctctaggcgccacgccgcaggttgcacataacatgtgtagcaacacgattctacgtcaattaaatactcgttggtagctggtgtatggagctcgagcttggctaatgcttggtagttacgagagggcaagcactggccacccatggaagaagaaggggaggacgtagacaaaatgggtccaaaaactactgagcagtgaatttatatttgcaaggcaaggaattcttggcagggagagaaaaaaaaaaaaggaaagctaatctggccacgctgatgctgatgtggcactcctttgtatcctcctcgtcagaagttccctaggaacatggacaaactcctgtaccaagttctggtaaaaactataattggattaattgcgtagccatggatatttgatgatgatgggggctgtgggtcctcccgaaccaagttctgttataaaaatgatatgataaggacattcttcatacatggtgctaatgacattcaagaaaaatcaaatagaagtggaaatgtttcttagaattaatattatttcaattaataataatttgcattctatgtgaaatacaacataaacttttatgttggtggtattgcagtatatgcacaagatgacaacactcaaccgaatgtcttgaaatggagatgggtggtttagttactgcctggaagctattatagtaaagagggaagcacaacaccatggccaaggatgatggttcaaatctatgggatttcagaaaaaaaaaaagcaaaggcatattgactatccatggtacatccggaaaataaaaaactttgcctggtatatgagatctatttttttcaaaaaaaaaaaaacagagcagacaaaggagaatgttaatcggaaggaatcaatataatgtagcccaagctgcatggaattcaaggattaagtgtcttgggggattctttcattcttaggtattattattagaattatataaattgtgtaacatgacaccaaatgaacatgtgcaatgacaaaaatgacccaaaaccctatcactgcaaaccacctcgaaaaaagcctaaacccccaaatgggcaaaaggtggggcaaacccattctcatcctctccacactaccaccgtttccttcctcaagctcccgcctcctccctataggtcttcaaggttgagctctctccttctctcccatggagggacacttgccatgttcgctgagaaaatattttgtcccaacaaactgtatgttctttcataataaacacaaaatgtatcagcaatatgtagcacttgtaccacataaatgctttaattaggtccgttatgggtggttgcattccaaatatagcgcacatgtgattggtcacttaaaaccagcacgatgcaaagaaagataggaaaaacgtgtctgcctcattaggtcaacaaatattgtgggaaaagattcatcttttggcatgagaacctatgggacaattaaataagtttcttgcttcaaatatttcatatggtacagcatgctgaattgacaaaaaaaataattttccttgcatttaagatttttcttgtgttgaacatagatcttttttaatttatccactcatatattgtttttctagtagctcattttctagataggaatttcattgtttattagcattaagctggtaatcagatgcaacaaatacatgaaccaagactagtttgtagggatctagaaaagggaaaagggataatatgattaaaaaaggaaatcggatgatgggatacaaaatagaaagcaatgatatattggaatgtaaataaaggagcgacaccctccaaaattgatagttgaccatggtttctctggcaaaatatcatctaagaaaaagtccacctttgccatgttggccaagtaggcaaatgataatgagtctcgcattacttgggtgggactgaaaattcctaattggcctatgagaatgctgcaacactgttgaaaggctaagccatgtcaccattggatccagcagtgccgcttacactgctaccttcgaactgattgtaccccattgagccagtgccccttgcaacatccatcagccatccctccctctggattggtacctccgtgctcgacaatgagacagatgcaggtatgaggccttgctcacggagcttcttgaggcggtcgttgacaatcttgaggcgtgaatttgccatccttccgaggctgataatctgctcgatggtgagaccatcgaggcttgggtggcggccattgatggcttcaatgaggagtagcttggtctcgctttcatcagcttcgcgtcccagcttgtgcaacttctccttgagcttgtcgatctgcttgttgaggatgccctctaggtctatcatcttcttgtatctgcccagctgcggcatggccttgaagtgctcgagaactctggtcgcctcccacaccgacggccaaaccttcgttgcttgcacctcaacctcaccgtacaccatgaggaacagtgttgcgaactcactaaccttcttcatcaagcccttcagatgcttcctaaatgtcacccgccgcttcacatcaatgacgatccgcagaagcttcatcttcttgcgagccatggcctttgcagttcaccactttctagcaagaatgcacctgtaaattgatgagagatggttagattgatgtgaaatcaaagaaaggggaatatggtggatttatagtgggagatcatattgcaacaatcgccatgatgtggaaagaaattattttgcaaatccaaaaatatcaaatgaatcaatgtaagttaatgctttcctgaaaaaaatgatcggttaatgtgtagctggcgagcatatcttcaacctttaatcgtgtccgtctttagaaacttccttgcaggcatgagctagcaatagccaatagatattactcgctagatgataatgagttcacaccaaagatacgttcatccccagttcatcatatatgtttgagttaatcctctttcatatgcgcaataggaattcaatttacaactacagaaatgattttcgctacattcaaagagttccaaggattgatcctgtcacgatagctgccatcggatgggccatatctgccacagaatggatgatttcccccatcactcataaacttgtgaacaagggagccgccttcatgctcgctcgctgtcccagcttgcatctgttaaaaagcatacatagttatcttgttaagaaagagaacactagataactcgcaaaccgtatttttatcaactctactattattggattatttatccatttattgcagttgagtggagagaacagtgaagctagctatgtaatttgaggctcctattaaagccccattggtctaaaatctcaacatatttgttgcaagtcatcaattatattattaaaatttagtaaagccacaatgctcagcaaaaagaactagcaaaacagtactatattccaagggaaaaaagaatttacatctttgatcatgtagaatttagattgtatcaatttagactattctaccacctccacaacatcaattggagaaaaacaagaaagattaacaccgctatgttcgatgggtccagattttctcactatactgcagtaaattggtctgcctcaaccgtgtaagaaatatactagtataactctattttacagcgaagatagcgtgaagacctcggctagttcgtaaaattttatcttatatctgttcatggttttcaggaaacacaaaagcacatatgaagttggcttgcaatttgcacaagaattacatttggcagtttccatgccgtaatcatttccttcagttcttggacagaagttgactttttatctaaccagatcaactttgcttgcatttgtaggatgttgttccaagtgtaattatgtccaaaaatagcttgaagaaaccgttggagaaaatagaaactaccaacgctgaagcgcataagattgttgacctgccaaacttgataagcaagaaaaaaaatgacaaccatagaccaaatgttttgccatatatacatccattccgttgcagatccaccacgctaggtaatcggatgaaatatggaatgtcggtagagaaaaaatgtgctcaatgacgatgacaacccaagtcctggtgttattatgaactggcatccatggtatccgtggatctagtaagataactctcgcacaacatttttgtgtcggatgcagaaaaagtccgctatttcgaacttgttatgtgggttcttgtttccaagaattttcatatagatacaagtttcacttagatgattgagcaagctacagggcaatcaattatttgaccagccaaatttgataagcaataacaaaaatgacaaccatagaccagatgtttttgccatatatgcgcccaataatgccactgcagatccaccacgctaggtaatcagacgagatgtggaacaccgacagagaaaaaaatgtgttcaatgataatgacaacccaagtcctggtgttcataaaatattattctgcaattggcatccatggtatccgtgggtaggaaaagataactctcgcacaacatgtttgtgtcaaatgaagaaaaagtccgctatttggaacttgttatgtggattcatgttttctagaactttcatatagataccattttcacttagatgattgagcaagctacagggcaatcatgtcgtcagttaccctcggtttaagagtctaactgctctaaaaaggagtctgaaggaagccttggatgaaaaacgtttcctcttgtacaaaactataatcgtggaggacccctttctccattgaaggttgataagactggcagcaagatcctagcaactagtccaaccagagatgcaatattattagctttgggtgttgtgacatccaagtcatcaagtgtattactcacttgatggtgcagagataggtgaacaagatcaaggagtattagagatgattggggctgaaactgccaaaaagttgaagagatcacctctagcaggcataacagtaggaggacagctatatatatgacaagacttttgagatatgtggatgcagccaattggggacctgcctttctgatgagttatttattcacctcacttgacctaggtcaccttgccaggtaacatggagtgcctcatgacgcttaaagatttgatgatcccctattagaggaactagtcgcacgggatattattattgtaatttttagtacataaaaatgttgaattataccagcttagactaattgagagtagagtctaaatcaatcataacttgctaaattctactttcaaaattaaattaatacactaaattaaaaatcgatgatagttacatcattgtagtattaactttgaattctacaattattaatttttggaaaatgaaaattaaagagtccatgctattttcgtcttgcatgttttatttaacacaaactggcaatacaatttacgatcatcgtaatacgcttttaacagccataccattttgagttataataagagcgtcaagataatgtccaattatataatataggcatgaaataagttgtgtatcaacatacacaaagcatctccaaccattaatattataccgcacggttcattaaaaaaatacactactttgcaatttatcttattgtttttgctaacgcagtagccacaagtataataccatgagcgaaagcaataaacccatataatacaccctatcaatttttctctcaatcacaattgcaatggaagtatatagattccataagaaatctgtatatgtcagaattatgattctttgatgaaagcgataaaaaaacacaattatcttgacctcaccgagccaagtgcatcatatatgtacctccttgtgcatggagacattatgtgataaacctacgattagtccttcaaaggatgcatgtacgaccatataaattaggaacaaatctaagaaccggtacctacaacttcctaattatatataggtgccggtttttttaagtagactggtacatataggtgtgttcacaagtactccactgacgactggatcaactataggtgccaacttttttaataaccggcatataaagtattggtgctagtttttgctagtaaccagtacccataatttatattagatgcaggtttcttttctgaacatttatatttaggccggtaccaatttggggtgagtacaatatggacagcgtggcaattcgttgtaaatttatacatcaagaaactgtagaaatttgtcataactgcaagtcgattaggcccggagatcgaggtagtacaacaattgtggtatgtttgatgtgatatggccatcatagtttgaataagacaatttcttcacctctaactaatttgatatttcataacaaaaagcacatcgttcaaatgtatggctaacattatcataatgttgaaccaagaagcgattgatattactattttaaatcaataagattaagcatgtagacaaatttgtgcttcaaaactagcattttaaattcgtgcactatactacacccatccgacaagtttgtgtatcaccaacacaatttacactttagtcaactttatttttattggattgtttacccaagtagactttattggattaattgtgtacctatggatatatgatggtgggtgctgtggggcttcccctactaagttctggtaaagaaattgatatgaagaggacattcctcatacatgttgaattgaacatcttctctagggccaaatacactaggattatcaagataactctagggaacaggttcccctagattaacccctacggaagacaccctaggggtcaattctaccggaaagacaaacttccttggagtttttcatgaataccttggggaagatatttgttccctagagttcgaaattctacagatagttgtacatgtggcatgttcatcctacgtgtaaagtacattcccctaggttttcagctacaaaatgaaatcttttattattttaattttttatacatgttgtattatcctcatttacctcaatgttcaaggaaaaaaatgattaattaacaacaatgttacttttattatgaacagaaaaaacttaacttgaactgaatcttcaatttgcatgcttttgtagtacagcaacaaagctggaaattaaactgggctaacatttcttcttacaaacacgctcacactttcaaaatatgctacctaattgaggctatcattccacagaactgtaacatacccgaactctagaccttaaaaattttctgtcaaaatagttggaagctaacttttctatttttgagagccaaaaatttccattttaaaacctaggtgaagttgatataactcttgcatgataaaattttagaacaaattaaaacctttgcatctctaacctaggacaaaaatataagtttatgtgtaagcatgcatattctcatagccatgtttgacttgagtccttcatatgcatttggattgcatttggattttcgatttgcatttcataataggtctcataaatattaactaagatctagataaacaactgaaccattagggcctagtgctagctagaggaagttaaaataggaaccatacatcttaaaatatatcaacaaggccaatgtcaagccccacaaaactatttggtcatccatctgaagactagtcatgaacctggaagtgaacaaataaattaactcatataggatatattccaccttagttacctttataagcattctcttaattaaatactagagtaaacttatgcataaatagttaaggagcttattacatgtgtaaggtaaactaaaattctaacatatcaacatcacctcaggttaagaagagtctaaatataaaagttttaaaaacatttacatacatttaggaaaggaaaataattcttgctaattatttaaaataatctgtgcaagataaaatcattgaaaaattcatgtaggctctaattaacatatacaacacacagtaatttcggtataatttaataactaaatttgatacctcaaataaataagttaaaccagacaaataatagactaattataactcctaattggctaaaaccataccttgttgaaaagtgcatttaactgcatggaagtgtataggggaaataatttattaaaatactaggttaattatcatgactaaatataatttttctagaatttatcttctctgtttaggtctcctaaaaatccaaactagtttccaaagaacccatattcctctaatttctgtgagtaatctatccataatttttgaggcaaccaaagaaaatggaatctaggtatcttcatctaccttcagaaaaatccacactaaattatcctacccacaaattaaataattgaattactaaagtgggagagagaaataatcctgaaaatcattcaaatcttttgttcacccacgtttctgcccaaccctctcaccctagcttagtttgccacgacctggacccacttggcagccactctggctcatcctcaccctgtgcaaatcttccagccgaccatagacagccgagagagagagagagagattggcgccggctgtgtacgacgcgtggcctcgacgtggcagcgccgaaccgaggcttcacctccacccagctgtgtcgccactcttcacccaccatcccagtgccgatccaaccgagggaggaagctccagctctccctctctacctctctttcgtcgccggccgccaagaagagggacattgccaaccgtcgtcgagccctctccatctctaactcatactcgttccattctcatatcgccatgccgaacaactttggttttgatcccattccatttcatcttctacagcagcgggaacgccgccatgtcatggtcgctctagagcgcgctctgtgcaccgccgcagcgacatcatcgccgttcccgcttatctggaccaagccggaccaagctgtcgcgccagcgtcttcgcctcgacctcctctccatttcccctcaagaatctcgaaggatggtgctacgagtgtggagatcgtccaccgtcttcttcacctccggtcgccgtcgccattgtcgattccgcctcctccggtgagccattgtccgattcttcgcgtatacaccatccctggggcctcactaacctcatggacacacatacatgatagttcttggagctgattgagccatcgccgttcacccggaggttcttgccgccgccgagccgttacatgagccgccgtcatcaacctagctaccccagccatgtctagcatctcggtgagcacccttcagcctatagaacatacatgcatgcacccaattaaccaatacatgattgtagaagcacatgcatcaccacccgaaaacatcctcctttcggactcgccgccggcgttactccgatgtccactgaccaagaaaagtagaggaatggaatcgcaatatcatgatcttcattttgtcttttggtcgcacccccaaacgagccatcgtttgtcgccggtgagctcgagatcgagctcagccatggctgttctgcctctgtgcgtgagaaaagaagtcagggaccttgtttcgagaatttaaacaactataaggtttaatgtgcaacttttcaactcactgacatatgagcctaggtctgcgggttgattcttagaaaccgcagggatctttttgtatattgatctctcactgacagtggaccccttggaaacaaaaatctgaaattataaaagaaaagtacctaaaacctgtaaaatccatataaaattaaatatagctcattttaagatgattcaaatttctgtgaactcaccaaattgtgaactttgatgttatggaataaaaacttgcactcacagtacaaatttagcctctaaaatttatccaagttaaatcacacataaagcatgcacaaatttataaaatgcatacaaaattcatttcaactcattttagagcaaacttagtttctacagatccaccaacatgttctctaaaaataaagtaaaataaaacatataaacactttacatcaaatgcctctaaaactattatctttaaaataactagttttgcataagatgaactttagaagtttatataaaattcatcttagatcctttttgagtaaacccaagttctgtagaatcaccaaaacatatacttccaagttataaaataaagttatatacttactgtatgataaaagcctctaaattcttatgtaagtaataaccatcatagagcaaccttaaattgtaaaatttgtagaaaattcatctttagtctaaatgaagtgaaccaaatatctatagaaccagcaaacagtgggcttcaacatagtaaaataaaatatggaaccttctgtacaggttatagctatcgattgagcaatatgtatatatataaatgtatatagaaatacactctagctataatgaaacacaaataaaacctgttagaccagtgaatgcataatgcatagttccatccccatccaccaaaacttaaggcacttagctcatataataatttttaggttgatataataaattgctagcatggactagagctcccctagtttataaaatatgaaccatggtaataaagaccataagcctatgaactaaggttagattagttaactaaaatactcattttatacatcactagctagatgaggcaagttctggacctaaacctctaaagctatgaacctatagaacactatacacctataacacgttataacttgtaaaatacataaagaattcatattaactctaaaaattatgaaaccaaatgtgttggtcttagaaaacacatatcttcaccccagcaaacataaacttaacaagaatcaccttacaacagcatttcacaatagtacctaagtaaatcctacactataccgacgaaacttctaaaattcataattctcaaatgaaatgagataaaatataaattctttcacctaaattcattttagaccagtacctattcactgtgcacaaatcatccattttagagcattttggatttttcgcatatttcggtgtttaattgcataacgtgtactttgtttagatgattgcttaaacggtgaagaagtgatttaggtgctgacattttcctgattcaaggcaagtcccacctccctctctttgatcactttgaacctatgttttggaggttattgaaaatgtttgaacctatgttttggaggttattgaaaatgtttgcaaatcctgcatgtcgattgtacattaacaaattaaaattgtgttaaacttgttagacaaactcctattatttacattatcaccttaaccccacatatatccatatccatcattcctatccttaggaacaatatgactataccacgttatatatgaattttggagtcactaggttattataatgcttagccatgcttagaatggtcttccttgtcattatgggttcattacaaatatgaaaaattgattttgaaataatctggacagaactttaatacttgtgattttcataaataaaatgatggaaaacatggattttaggtttgggcctcaactggtgcacatatggtgattagttgtgtaccgatagggggagagtgcacccaaaccgacctaaggacttcactcaatgtcagttcatttcgtatacagtacaaccacatgtgctagtatgggatagctcaagcttagtaaattatttatggtttagccttacattctggtagaccggtgcgtatgaattcggataactcagaggaacttcctatttaccccgacgtggtagtttaggtcactaagtctgtccaatacaacggtattgtgccacgtgggtgggttcccgttgtgtccgccaccacggcgttaagtttaaggcgtgagcccgccacttaacggttctaggtcatataacgtgtatggcttaggatggagtaacacgtatcgtgctggtgtaaggctaaatcatgaattttggaaaagctttgttgcgggtaataaatcgggtacttatgtatcgcgtgccatgctcttgcatgattattatttcgcatcatgtgggtaaagtgtacaaactctgcagagttaaaactaatcgattcgttgtgctcgcggtcatgagcggcgtgtggatatctattgagtatagacttgtgtttattctcctaaatgctgaaatttacctttaaatcaatttaaagagatttgagaatgatctccttgctccttgctgccatggaaggcaatgaggtgcatatttatacatgattaatgcctattttgatgcccaatatgacaagtactagcttgttgaaatttatttgaaagtaaacctgatttggaaatgttttatgcaaataaaacttgctttatgctaaaaagaaccatattatgtcttccttgattatatgccttgcaagtagggtgttaggcttgtcttggtgcttgccctaataatgtactgactcttgctattgaattaatcttttgcttgcaggttttagacttagtctttgagtgatgcgggtaatcgactgcttcttctagtacttgaacttaatggggtaaacccctagtcggtgtgcttgtggattgggtagacaagcttccgctgttctatatatttatttggccggtcggccaatgtaactaaagtagatgtagtttataatcgctttcatcttatttgtgtttgctatgtataatcatgcttgagatgaaagtgtgaatctagtgcacatcctgtgaactagattcacatgagtatgagttaagaatatttgagatgttatagatctttagccatttttgttaagtctcctgaatgtgtaacacatctggtcactgccttcgagtggtttgacgggcgtatctcaggctgaagttgactggcaggttaaaggctcagcaatgtctccaatattcctctctcgaggcgtcggatattttattatgcttgtttgatgacttgaattattcatttcatctctcaattataatggaaggtccggagagcctatgacaagaacgaaacaaaattgaaaaaacaaatagcccaatttcttgaggactaaaaccactgaatagtactagcttgctgcaaaaatggaggaagtgcgcagtgagttgttctcggatgcttcctgccgatttcccttcaaaatcagacccaaatagcaattatgagtcaagataaattcgtgaatgagcacaaatgaaagaatttgaaattagcatgaaattgtttggctaaagaacagtacgagctaagttcaaatatgtacaaccatgtgttgttcggcatcaaaattaccaggcaacctgctggctgtggcgtgtacattggaggtgtaggggatgcgaccatttgctgttcgctagctgccggagcttgcccttgggacacaagctaagaaaagaaagagagtggaccggatgaactaaagaaccaagtaacatggatctggacaaatgattgagtggagaaaggggcgttgcggcaccgactgcagctatagctggatttgcagcacttggacgtgttaatactcaaatttggctctagaatataaaattgaaaacttttgctaaatttaaaaagaacctagacttgtcatacgaggccggtcggaccgatagcaggggccggtctgaccggcagcatgtgatcggttagactggtagagtccgactacaagtttgatttatcagttcttgggttttcttgctaaggcttgatatttgagagttctaattggtttctacagctaattgaacgtgagaaagaacctgggaagcaatttcaaccctcctatagatataagtgagctaaggcggattgaaacaaaaccaatcaatcgttaaaatcaatttaataaccaaaccatctatattttctatctcactttttcttgctacctatcccaagtatattctccttaaaccggacatcctagctggcctgttgagtctaggacaaaccggcgtgtgttcaccccgacggggtctctccgagtgctcgttcggcgacatctatccgcgccctataacggcgcgtctctgggtgccgcgccatgggttgcacataacgtgtgtggcggcagcacgattctacgtcaacagaacgctcacttgtagctggtgtacagagctcgagcctggttgatgcttggtagttaggagagggcaagcactggccaaccatggaagaagaaggggaagatgtagattagatgggcccaaaaactactgagcagtgaatttgattttcaaggcgcgttgttcttggcggggagagaaaaaaagggaatgctaatctggccatcctagtgctgatgtggcacaacttagtgtccttctcgtcagaagttccctaggaacatggacaaactcttgtaccaaaataaaaacttttattggattaattatgtagccatggatatatgatgatgctaagggctgtggggcctctcttacaaactcctggtaaaaaatgatatgacgaggacattactcatagagaaaatttcctatgtacccataaaagttcacctaatctcttatttgcttctgaattttgctcattctcttacatacccctgaattttagtttggatcgcttccacgcccttttctctagttgactgctaaattattatgaaaaagtccatttttccctttgctacgagaaacataataaattaatggagtacattgttggatgtagaaatttgttggatgagactattatatttatgagtttgttatgcaccatattaactgcgacaaatttagttttagatttgatataaaaatttaatatttatttattagttattgaatgtttttttatgtagcatattgttgacgaaaaatccgcactcggccagtggtgccgggtctgtgctggcgcaaactaagtcgacgaacataacggtctgggagatctgcttagctccagtgcaggtccaaaggttggtgaaatacaggcgtgtcagtcaggtttatcctgaaactaacaagatatacaaatagcaggtcaatgagcctatcggctgacgagccgatggagtagttccagtcgatgccgataccagccgatagtgatagggtttggagctatcggttatatatccaatttagattctgatacttgagacaatcggctgataataataaataacaataatataatccagtagaaaccaatcggctaacattgatatgatagaataagcactgatccgaaggttgaagaatacatcggttggagatccgatgtcataaaatccagaagattagattaaacagtgaaatctttgttatcatcgtctaaatccaacttatatgcaatccttgtaaaccgatgcaacatctagatacctcatcggctgaaaccctgatgaaacccttattggcagtccaaaagcaggctagagattatggttctaaacatgacttagtagatcaaacttaactgatgcagcactaagtttgaaaagaaacacaatatctagataatcaagccgttgactgatttttcgggtggtagaagccttagctaatctaatctagtaaaataatttagccgataccggcagaaaccctaaagcgagagacaaccgatagagctaaattgagaaactaagactagattaactaagacatatgataaatagccaagcaaatatatcaacatcccatagaaatccaagaagtcaaatgtactgatgcagccttgaacgacaccaatgtagccaatacaattgactaggccggtagaacattggacttaccccttcgccggagatcgaatagcgatgtagccccgcgtcaggtgtcaagttccaccgtgataaataaaataaagtagaaaaggtaaaaggtggcgatccaccgaattgtattgatcgtggagatattacaatgaccccgggtgtacatatttatacccatgggtagatactagtccttgtaggataagaaagagactttcctaaagatgaaaggaaaacataaagtccttataggacactaaacatactttcctaaagataaaaggaaactgacaaactattcctaattagtagataacttgccatggcgcatcctccttgaacacggtcactagtggataagcttcctttaatcgattaatttccttaaccgaatatagctggaatccaactatatgtgttttgatagtaatacaatagatagattgttgtataagacaaatatatttatatgcaacataaacaactttcaataagtaataattaagtattattttttatgtcatctctaaatgtatatttatcgcaaataatatggtgcataactaactcataaatataatagtcccatttaacaaatttttaccctccgataatacactctattaatttatatgcttcttcaaagcaaagggcaaaatgggcttttctcataagaatttaacggtcaactaatggaaaattcatagcctaaactcccaagtaggcaaaaggtggtgcggacccattctcatcctcttccttcctcaagctcccgcctcctccctacaggtcttcaaggttgagctctctccttgttaagataatattttgtcccatgttcgctaagataatattttgtcccaacaaactgtatgttctttcattaaaaacacaaaaatgtatcggcaatatgaagcacttgcaccacataaatgctttaatcaggtctgttatgggtggttgcattccaaatatagcttacatgtggttggtcacctaaaaccagcacgatgcaaaaaaagataggaaaaacgtgtctgcctcgttaggacaacaaatatcatgggaaaagattcatcttctggcataagatcctgtgggaaaattaaagttttactaagtttcatatttcaactatttcatatggtattgtaggctgaatcgacaaaaaaatcattttcctcgcacttaagatttttcttgtgttgaacatagatcttttttttaatttatccactcagatcttgtttttctagttgctcattttctagataggaatttcatcgtttataagcattaagctggtaatcagatgcaacaaatacatgaaccaagactagcttgtagggatctaaaaaagggaaaagcgaaattattattaaaaagggaaatgggatgatgggatacaaaatagaaaggaatgatatattgggatgtaaataaaggagtgattgacaccctccaaaatcgatagttgaccatgctttctctggcaaaatattatctcagaaaaagtccacctttgccatgttgtccaggcaatcaagtgataatgagtctcgcattacttgggtggcaaatgaaaattcctgattggcctgtgagaatcctgtaacactgttgaaaggctaagccatgtcaccattggatccagcagtgccgcttccactgctacctccgaaccgattgtaccctattgagccaatgccccttgcaacatccaccagccatccctccctctggattggtacttccgtgctcgacaatgacacggatgcaggtatgaggccttcctcacggagcttcttgaggcggtcgttgacaatcttgaggtgtgcatttgccatccatccgaggctggtaatttgctcgatggtgagaccctcgaggctcgggcggtggccattgatggcttcaatgaggagtagcttggtctcgctttcatcagcatcacgtcccaccttgtgcaactgctctttgagcttgttgacctgctcgttgaggatgtcctctaggtctgtcatcttcttgtatctgaccagatgcggcatggccttgaagtgctcgagaactctggtcgcctcccacaccgacggccaaaccttcgttgcttgcacctcaacctcaccgtacaccatgaggaatagtgttgcgaactcactaaccttcttcgtcaagcccttgagactcttcatgaatgtcacccgctgcttcacatcaatgacgatcccctgaagcttcaccttcttgcgagccatggcctacgcagttcactactttctagcaagaatgcacctgtagattgaggagagatggttagattgatgtgaaatcaaggaaaggggaatatggtggatttatagtgggagatcggattgcaacaatcgccatgttgtggaaagaaattatttcgcaaatccaaaaatatcaaatgaatcaatgcaagttaatgctttcctgacaaaaaatgctcggttaatgtgtagctggcaagcatatctgtcaacctttaatcgtgcctgtcaatagccaatagatattactcgctagatgataatgagttcacaccaaatatacattcatgcccagttcatcatatatgtttgagttaatcctctttgatatgtgcaattggaattcaatttacaactacagaaacgatttttgctacattcaaagagttccaaggattgatcctgtcacgatagctgccatcggatgggccatatccacagaatggatgatttcccccatcactcataaacttgtgaacaagggagccgccttcatgctccgctcgccatcacagcttgcatctgttaaaaagcacacatggctatcttgttaagaaagagaacactagattactcggaaaccatatttttatcaactctacatttattggattgtttatccatctatgcagttgagtggagagaacattgaagctagcaatgtaatattaggctcctattaaagcccctttggtccaaaattatctcgagatatttattgcaggtcatcaattatattattaaaatttagtaaagccacaatgctcagccaaaagaactagagaaacagtacaatattccgagggaaaaaagaatttacatctttgatcgtgcagaatttagattgtgtcaatttagactattctaccacatccataacatcaattggagaaaaacaagaaagattaacaccgctatgttcgatgggtacagattttctcactatattgattggtctgccccaaccataaaagaagtatactagtataactctattttacagtgaagattgcatgaaaacctcggctagttcgtaaaattttatcttgtatctgttcatggattttgggaagcacataagcacatataaagttggcttgcaaattgcacaagaattacatttgggagtttccgtgccgcgatcatttccttcagttcttggacagaaggtgacttttatacctaaccagatcaactttgcatgcatttgtaggatgttgttccaagtataattaagtccaaaaatagcttgaagaaacagttggagaaaatagaaactcccaacgctgaagcacagaagattgttgacctgccaaacttgataagcaataaaaaaatgacaaccatagacccgatgcttttgccctatatatatcgattccattgcagatccaccacgctaggtaatccgatgaagtatgaaacgtcggcagagaaaaaatgtgatcaatgacgatgacaacccaagtcccgctgttcataaatgttattatgaattggcatccatggtatctgtggatctggaaagataactctcgcacaacatgtttgtgtcggatgcagaaaaagtccgctatttcgaacttgttacgtgggttaatgtttccaagaattttcatatagataccattttcacttagatgattgagcaagctacagggcaatcatgtcgtcggttgccctcagtatacgagactaactgccctaaaaaggatattgaagaaagccctggatcataacttgctaaattctactttccaaattaaattaatacaacactaaattaaaaattgacgataattacggcatcatagtattaactttgaattctacaaatattaatttttggtaaatgacaattaaagggtccatgctatttttattttgcatgttttatttaacacaaacttgaaatacaatttacgatcatcataatacgattttagcagccatactttttttagttattataagatcatcaagataatgtccagttaatattggtatgggtacttagctgacacaaaataagttgtgaatcaacataatgtaagcatctccaaccattaatgtgtaggatagaacacaagtaaccaaggcatattgactatccatggtacatccggaaaataaaaaactttgcccggtatatgagatctattttttaaaaaataaaaacagagaagacaatggagaatgctaattggaaggaatcaatataatatggcccaagcagcatggaattcaaggattaagtgtgttggggattatttcattcctaggtaatatttttagaattatataaattgtgtaacatgacaccaaatgtacatgtgcaatgactaaaattccccaaaactatatggctgcaaagcacctcaaaaaaagcctaaacccccaaatgggcaaaaggtggggcaaacccattctcaaccgctccacactaccacattttccttcctcaagctcccgcctcgtccctacaggtcttcgatcaaggttgagctctctccttgtctcccatggagggagcacttgccatgttcgctgagataatattttgtcccaacaaactgtatgttctttcattaaaaacacaaaaatgtatcggcaatatgaggcacttgcaccacataaatgctttaatcatgtctgttatgggtggttgcattccaaatatagcttacatgtggttggtcacctaaaaccagcacgatgcaaaaaaagataggaaaaacgtgtctgcctcgttaggacaacaaatatcacgggaaaagattcatcttctggcataagatcctgtgggaaaattaaagttttactaagtttcatgtttcaactatttcatatggtattgtaggctgaatcgacaaaaaaatcattttcctcgcacttaagatttttcttgtgttgaacatagatcttttttttaatttatccactcagatcttgtttttctagttgctcattttctagataggaatttcatcgtttataagcattaagctggtaatcagatgcaacaaatacatgaaccaagactagcttgtagggatctaaaaaagggaaaagcgaaattattattaaaaagggaaatgggatgatgggatacaaaatagaaaggaatgatatattgggatgtaaataaaggagtgattgacaccctccaaaatcgatagttgaccatgctttctctggcaaaatattatctcagaaaaagtccacctttgccatgttgtccaggcaatcaagtgataatgagtctcgcattacttgggtggcaaatgaaaattcctgattggcctgtgagaatcctgcaacactgttgaaaggctaagccatgtcaccattggatctagcagtgccgcttccgctgctacctccgaaccgattgtaccccattgagccaatgccccttgcaacatccaccagcaatccctccctctggattggtacttccgtgctcgacaatgacacggatgcaggtatgaggccttcctcacggagcttcttgaggcggtcgttgacaatcttgaggtgtgcatttgccatccatccgaggctggtaatttgctcgatggtgagaccctcgaggctcgggcggtggccattgatggcttcaatgaggagtagcttggtctcgctttcatcagcatcacgtcccaccttgtgcaactgctctttgagcttgtcgacctgctcgttgaggatgccctctaggtctgtcatcttcttggatctaaccagatgcggcatggccttgaagtgctcgagaactctggtcgcctcccacaccgacggccaaaccttcgttgcttgcacctcaacctcaccgtacaccatgaggaatagtgttgcgaactcactaaccttcttcgtcaagcccttgagactcttcatgaatgtcacccgctgcttcacatcaatgacgatccgctgaagcttcaccttcttgcaagccatggccttcgcagttcactactttctagctagaatgcacctgtagattgaggagagatggttagattgatgtgaaatcaaggaaaggggaatatggtgggtttatagtgggagatcatatttgcaacaatcgccatgatgtggaaaggaattattttgcaaatccaaaaatatcaaatgaataaatgtaagttaatgctttcctgaaaaaaaatgcccggttaatgtgtagctggcgagcatatcttcaacctttaatcgtgtccgtctttagaaatttccttgcaggcatgagctagcaatagctaatagatattactcgctagatgataatgagttcacaccaaagatatgttcatccccagttcatcatatatgtttgagttaatcctctttcatatgcgcaaaaggaattcaatttacagctacagaaatgattttcgctacattcaaagagttccaaggattgacgatagctgccatcggatgggccatatccgccacagaatggatgatttcccccttcactaataaacttgtaaacaagggagccgccttcatgctcgctcaccatcccagcttgcatctgttaaaaagcatacatagttatcttgttaagaaagagaacactagattactcgcaaaccgtatttttatcaactctacttttgttggaatgtttatccatttattgcagttgagtggagagaacagtgaagctagctacgtaatttgaggctcctattaaagcccctttggtccaaaatctccacatatttattgcaggtcatcaattatataattaaattttagtaaagccacaatactcagctaaaagaactagagaaacagtacaatattccgatggaaaaaagaatttacatcattgatcgtgcataatttagattgtgtcaatttagactattctaccacctccacaacatcaattggagaaaaacaagaaagattaacaccgctatgttcgatgggtccatattttctcactatattgcagtaaattggtttgcctcaaacatataagaagaatactagtataactctattttacagcgaagattgcatgaaaacctcgactagttcgtaaaattttatctcaaatctgttagtggatttcaggaagcacagaagcacatataaagttggcttgcaatttacacaagaattacatttgggaatttccgtgccgcgatcatttccttcagttcttggacagaagatgacttttatacctaaccagatcaactttgcttgcatttgtaggatgttgttccaagtgtaattaagtccaaaatagcttgaagaaaccgttggagaaaatagaaactcccaacgctgaaggacagaagattgttgacctgacaaacttcataagcaataaaaaaatgaaaaccataaacccaatgtttttgcctaatatacatcgattctcagtatacgagactaactgccctaaaaaggagattgaaggaagccctggatcataacttgctaaattctactttccaaattaaattaatacaacactaaattaaaaattgacgataattacagcatcatagtattaactttgaattcaacaaatattaatttttggaaaatgacaaataaagagtccatgctattttcattttgcatgttttatttaacacaaacttgcaatacaatttacaatcatcataatacgattttagcagccatactttttttagttattataagaacatccagataatgtccggttaatattggtatcgatgcttatctgacacgaaataagttgtgtatcaacataatgtaagcatctctaaccattaatgtgtagaagagaacacaagtaaccaaggctacaagagggggatgaacgattaagtcagtggaagtcaaataatctaatcttgatagatctggcggtctatctgacctgttagggtcggtccaaccgaggcatggccggtctcttaatgtcaaatgtcaatttctcttatgccaaccgttggatcaagttgaaaagttgacaaaataaactagacaaaccaagaaacaactccaccggagggatatgtaaactaaaaaacggtttaagagaaaacaccctcgaaagtcagctgtctcggaatttcagcaaatctgaactaaacataaaacttaagcaaattcgaatcaagcacgaaccaacgaatgaaactttccagatctgatcaatgaagtattagaaaggttttcgatggactaaattgaacaaaatcgtagcaaaacgaacaatcacaagttaatgccaaaatcaaacataaacgcaaaacttacgaaactagaatagatcgtcgatgccttgatgattaaatatgatctttattgctcaagtattgtttataaagtgcagccacagcacccctcgcaagttttcacgaaaccctatctaatctctcaaacttggcttaccctcaaggcatagccttcctctctatttataccgaaaacctcctactcaaagtagaaatacaactcatattcccaataggactctattgctgaatttccaaaccaatctacaatttccaaattgtaaatatctcttccatataccgcagctgcagataatcctctatgcatatgctgcatgatacagtaccatcgctacagtacatcaagcactgtagaaaccatataatcctcaacagttttccttccgttttccttcacgaacaccaacgcttaatgtagaaacacctcgtgaagcccgttgcaaagatctctcccacacggtgtccatccactatgtgccatctcatatccaacttcgtcacccattatcactgaccgtttgcacctcaactgctcccttgtctagtcccgatcccacgttgaccgaagttgacctccaaaaatcctaactctagtcgctttctcacatggtatcccaaccgcactggacatctgctcctccctgagcatagtctcgatcctcaccattaaccaagactgaccataagttacctacacactatcagacaacacgaattgactcgcattagccaacttgcgcttcttgctttccatcttcggtgcttgtcctccaagcggatcgccttgtcgactagtttttggaagtcttcgtagtcaccagagatgagatggattgacaattcatcattcaacccttcaagatatttctcttgcttctcttcatcggtgcgaacgtcctcgggagcatagcgggccaacctattgaactcgtgcaaaaattcagtgacggtcctgccatcttgcttgagttcacggaattctttcttcctcagggctaaaactccagcaggtacgtgagctctgcgaaaagcaatagagaaacgagcccaagtaataacttgtccagctggttgggtggcctggaagtggtcccaccactcggaagcagtgccatgcagttggtgagcggcaaaagcgactttctcctcatcagtacactagataaggtccaacttcttgttaaccgcgtgcagccagtcatttgcttcgacggggttggttgtgtttgaaatagtgggaggccggacttggagaaattccgacagctttgattgtggtggagcgtgtatgggagcttgagcagcaggtgcttgcgggttttgcatttggtggagcaaagctgcgatgagatggttttgattggcgagcacttgtgctaagttggggtgatcatggattggtggaggtggcggtggtggtgcgtggccttggttctgattctggttctggttcttgttctgattctgattctgagctgagttcccagcacgagcattgttagtagcaatactccttgtgtttaccatctgtagtaaccaagatgagaggaaaagaaagaagggagatattaggacaagaacacgagctattaaaccaacttatttaaattttattgatgtgatgttggttacatagagttcaagttgcttaagcaccacaaaggtacagctatatcacaacgggtcgatatagtccataccaaaaagcacacaaggcaacaaactcaagtagaagataaatgataaaaatagacgcgtactaagactacgcgtctactcgtcctttgttgcgttgtcgtccactgtcggctctgactcatcatcaccgtcataggagttgtcgttggagtcatcttcattggcaagagccacagtcaatccccttcgctccaagtagttctggacaatcaccctggctgacgcttgagcatcgtgcaccatcggaggaaggccatctcgcttgcgtgtcgtgatcttcaaggacggtccaacacggcaacgcttagaccccacaacagagcttccttctccaacctgaccatgtccgagctcgaggttacgcaattcccgcttcaggctagccatctccaacttcacacacaggttcttcctccttagccgtagaatcctactagaagcttgaataaaacctctcttcgccatcttgtagtagtcgacacgagcatcatcatacgcctgcaccatcttggccaggtgatcgatcgtggtgtcgttctcgtgctcggcatccctgaaggtggcatagtcctccgccaaactgcgagtaggatgatagcggaatggagtgtgttgcagacgtgtccagtgtcgttgaagcagcctgccaatgcccagaagcaccacttcttggcatgcgtcgatgaaggtgtcagtccctcccgttagctccaatgattccaagctagggttggtggagagcaaggtggccttgactgaccatcggggggatgccaactctttttctccttcgtctggcacagtggtaccaacaaactggacttcttcggtgtagcccagctcaacgatcaagtggcgaagctgcagaactaaccccttaagtgagacgccattgtaggggccaaggctggtcatctatttttcaaaaaaacagaacaaagaattagtaaacaattttgcaaagcaagagagggtgaagatagaataaaaaaagtttccacaattaaagaactattttctaaaaaaaaaatatcatcctaaggcttagaccacttgctcatcctacggtcaaggtggctctgataccaacttgtcacgcccggaaatatacaccatttccaaacgctcagtgcattaatcctcgtcccagaaggcgaggtacacatagacattgttgattattacaagccacacttgcggaaatgtaaagcaagtactttattacatgggcgacttaggccctcacactcaaagataaacaaataaaacagcggaagactacagaacaggcacttgatggcggagcgaactagagatccaagccttcatcttcctcaggtccatcctctggattatttttgtgagcaagactgagtaccaccaccgtactcagcaagtcacaccggaaatgcaacaataatgcatagggtaaacaaggaaatggcctaatagggtttattttgcataaagccatagtttaaacattttaatcaggttaaagctcattctaaaacacgatcctgttctaagccaatattttcatatcatcaaggtcgcatgagcctgcgaacctgtcttaacccaggctaatctccacatgactacaccatcatgatttcaccctcccaaggttttataaaacaaaactaactttgggtacattgctcagcttgcccataaccgagggcgcggctattcgaataatttttaactctgatcagaggtgtacaactttacccacaagacacaacctcaacacacgttaccacgcaccgggtactatcacagtactcgaatagaggtcgtgacaagactatccatctaggtctacccaaaacaggagaacccgctgaggtttcgccgcccgccggtccccgacaaggtaaaggatgccggatcccccaggacgagacaggtccccccttgcaccgagtgaaaattggccttaatccaggccccacacgcttccaaccaatggtctttgttttgagaagatctaaacttctagtcaggccttacccactagacttgtggttgcacgaagatgccttgcaacagaggcccgaagaccggtccttatattagccggggtgtgactaccaaaataacctgcttgcaccccaagcccagcccaaaaatatgttttagttgtacaaagcattttatcacccatctattgacaaaccagtcaatagtccataactaatccagttttagttgttaaccaccatagtctagtttatccaaaagttctacttcctccgtttcacaatgtaagactttctagcattgcccacgtttatttagatgttaatgaatttagacatatgtatgtgtgtagattcattaacatctatatgtatgtgggcaatgctagaaagacatacattgtgaaacggagggagtaggttggaactaagcatgactaagcatttacctaaaacaactagttagtccatcatgtaggatactagactagtcaagttataattttactagggttcacaatgatcatggatatcaaatcaacatcatggccataacaaagagcataggaataactaataaaacaatattaataatgaacggtataatctataaagcaatgcaatataagtaaaaccacataattttcacaatatgggattcaacatgttcaaggtagatatgacttgccttcgctcacaaagtcttcggcgtcaacggcgatgaagagctgatcttccggaacagcgggatctacacgaccaacacgaagaaatataaaaaggctaataaaaaccacatgaacagaagcgacaaagcacataaatgggttctactcatttttaaggggaaactagagatttgaacgggtcgattctgagttcaaacggtcaagatatggccatttgaagtttagttgttatttaaatggaaatttacaattttgtgaattatttttctaaaggaaaacttgaattattgagagagagcgcacgcggaccggtccacgagcgggtcccacttgccagccgctcgatccaccgtgagccgagcacaccgagggcggctcacggcacaccgacgcacaggcacgacagcaaccgagccaggcggctcgccggcgacggccaacggcgcggcggcggtgcgacggactacaggaaagggaaaaacgaaaagaggaggaggtgacggttctcaccgagcagacacggcggcgagaggtcgacggtgttgctggcggcgagggagaaacgacgaggaacttcgggttgtcggcgtcgtcgtcgttcccgcggtcctcgtgctcgacggaggggtggacggggaagaggaggaagcgaagaagcggatggtggcgacgccgggctccgacgaggtccggaccaccggcgaggggcgaccggagctgtgacggcggcggcacaagaagagagcggcgcggcggccgcgaagagaggagggacagagcggcggtgtgtggggagggaggagggagtcgagggtcccttttataggccagaggggagggataagggtgccggggagggagatcgacgccggccatggtggagctcaccattgatgaacaccatcaaaatccaccgcaaataatgcgggatcgagtgtgaaattatgggggaattggacaggatgaggtggaaattaattcccctcaattaatttgatgaaacggcgagtggaggaggcgaatctgaggttgccgtcggtaggaattcggccggagagagagaggatggctggaggttagggatgacgggtgggacccacctgtcatcgagagggagcacacctgtctctgactgggcgcgcgaaggaggaatgatggacttagtccgagggagaaggaatgagctgggctggcccaaggagagggagggggaggggggaataagttcaccttgggctgggccaagagagggagagatgggctggaagcagcccaagaggaggaaggggttttcttttagcttttcctttttataaaattcctttaattgtttttgttgccttaaaattatttaggatgctctgaaaattcaagtaaaaattggttacacattttgaagcatggggaacttattaaaaatacccactagccaacttgacataaatcttggtgaattttaattgttggaggctcttttaggctttttaaatttctagaaatgcattaaagcacaatttaaacttagagcgattttcagggcgttacacaggcccaggaagccaatcccggagcccacgagtcaccctcagcctggcctctcctttcatccgcgtcgctggcccacgctgccgtcgatggggaccgactcagcccacgccctacgctgaggcatagccgccgctgaacttccacaagccgcgcaaggagaaccggtgtcgtccttccttaaattggtgttatgcatcgccctaacactaacctctccctctatagataccgccggtcgtcgccccttttcctccccttttttcctgctatttccactgtcgccgtgccaccgacttcgcctctgcctcctcctaccgacaccgcagctagccagtgcctcggtgcgccgtcgccacagaacgatgttgtcaatgccgttgtgccggagcgtgcccatggagccatggctgctcttcctcctccgttgtgtagctgatctgtgggtcccgcgacaaaaaatccccaaataatcacagccatccaaacccttgattcaatctcaaccattggatctatttaaccctagatccatccctgtcagcgccacatcattgccctgtatcacctcatgtccatacgcatcagctgagtccacatacaccgagtccaccatactccataacactgtcagtgggccccacacatattttcttgtcagaaaaaattcaatccccgaaattaagtatccaaagaatattcccggaatattacttttttcttttaccctcagattttctctgaattcaaacttctgaaggctataaattttccattcgaactctgattcaatccattcttccaccttaagtcctctaaaatcgagctctacgtcctggtttaatttgttgtttcattttatgttctttagttagatttttcttttgtttatttgtttttcgtttgcgatcgtatagacattggagcagaagagcagtttgtttcagaagatgtcgtgcaagactgggatcaacgcaagtgcactctttgaacatattgatcccatttttatcaattgttttgttttgaatacatgcattattttatttacgaactaatgatgggtagcgtaacctaattttcattatatcctaccttgataacttttgattacccatgataccttgtcaccctagtctttgtgagttgaacattaggctcaacaggatgcaatgtcgtacaccccgtaaaatagtgaatgctgtacaattggaaactttttttttcttgttgtgcattagcttaaattgattaacgtaaattattattactccgttatgctctatagatagtagcaatatgaaataactgcatacatatatttgtattaactactcaattatagttgtctcatttatttctttcagaggataccatgaaatgcaaccctacaaaagcatagtgctaccaatgatatatatgtttgggcttcaaggatagaaactatatcaaggcggcaatatattactatttattcgctcttacagttttataacatcggattgggaaaaccatttcatgaaaaaaagtttcctgcacatggagaccaaggtgttgccctcaagtatattaggaacccaaccgccgctttattggatttaggagttggttccattgtgcaacatgtgtgctagtaggggtgaaaacggtacggaaaccatctttatcgttttcgtttcaattttttttcggaatcggaaacgctggatacaaaaacggaatcgaatattatcgaaaccgaaaacagagtgaaaacgaaccggcgcgaatacggtaacgaaaatttattagaatacaaaaacccatcaaactgataaattcaattctcaagtctcaacggtcaacaatttattataaaacacaatcatataagtccaattgttaagtctcaacagtacatcacaaaacacaaatctatggaataaattatctatatttaagagagtaatgttgttgataaatcccaatgcagaaaaaatatattcttatgtaacttcaaatttgcataacaaatattttttttaaaaaaataaaagccaaacaccgtggtagatttgcataacaaatatttttttttaaataaaaaagccaaacaccatggtattcactattcagtgctaaaaaaaatccagggtattccgagaaaatttccagaaagtttccgactgattccacgttccgacaaaactgcccttatcattttcgattctgtttctgagaaaatatttccgaattcgtttccatttccgaaaaaattccaaccaacagattccgttttggaaataagtccggaatccggaaagtttccgtaccgttttcacccctatgtgctagtggcgtcttgtgcttgcttaggttgatttctgacctggtcatatcttatttcatattctgtaaattgctagcatgcaaatatatttcgagcatggggagcagctctccaacccctgggaaaaccggttgatgcaattaagtgaagttacatgcttttagactcaagtcttaaacagtatggtgatgttatgaggttgtgtctttttaataagaaatgttatgtcagtttacaatataatcgcataaattgatatggatctgcactccaagacgctgtttgtgctaaaatacttaattaatataataaaatcatagtacttttgtacatatagaaacagcagaatagaagaaaatttctcataaatattagccatataaatttcagctctttccagtgggaatatacaagagtgcagtatatcggagatattaaagaggaccatagaatgctcgcaccacagcgattctgcggtttttcggctggcgtgttcgcttcccgtgatgtccacgctgggcgctggagctggcaatcttgcaaaaaagtccttgattaacttgataatcattcttaagtccctcactgtatgtttctgtattttgtattcttttgtaaaagccctcaatgtcttggtatatcctacgtgaaggagacgaaattccaaatataggaccgcgctctgaaaaaaggaaagtaagggtgttttctgcaaaacagaacatccctatcccctccattcccctcaaaccctagccaccactgttcacccaccccttctcttcctttccccgctcttgcgccgccgccgccttgccttccctccccggcttctcctcgccaacgacaacttgctcctcgcgctctcccctatcctccccttctcctggtgctccctccatcactctcctcccagtggagcaaggggactgggggactcgatggtgcaggattggatttgggtgcggtgatggagtttcgccgacgacagcctccccctcgagctctcccctgttctcccccatctcctggcactcccccaccgctctcctcccagcaagcagagggagcggacggcgtggcactagatccgcggcacggtgatggagttcgatagtaaggaggtcaatctgttgcctcaccccttgacccattggggaagtcgttctgatgtgtgcaagggaaaaaaagaagaagaaatccccttcatgttggatctatgcatgactgatctgcttcccgttctgtgtctaccacctgccagccatgttttttctcagatgagtgcaaacctttcctctattcttgcttgtccatggtcatgagctgcttttgacttattgccacaatcttagccgcttgccatctatatatctatatatatataatggttggaggtcagagattaatggtatggcccgtgcaaatatctaccaagattcatacacctacatgcgctgcttagggactctgcatttttcttggtagaacttgaaatcttggtacatatatagatggcaaatcttttcctgtagaactgcaaatgttttttaattaaaattgatacccccatatatttcttgatcactgcctgcgaacctctgtaactattagattcagctataacatgggattctaagtagtgaataagctggttatatttgcatatttaaatccgatttttaggtgccatctatctatttgttgtagttctctacagaatcaaatgcaaaatctgaatgttcataaccactttataatttaggccagtttgaggttgcgtcattgtgtgccatgccgtcgagcacctacacacctgctctttttaggttgaatgtgctttgtgtttctatggttcatcctatgaaatgatttattctctgaaaagttattgttatgcatggactacttttgttccagcatgatgacccttcttgggggtggatcgacagcttgagtaaccatggctgtaaaagttcaagcggagaaagttgcatggtgaatcaaattatttttctttttctagcattcttatatttgccgtgtaaaatactggcatattcagtagatgtttattatgtgaaatgatggtgaattaagttttcttatgttactcagtgcacatcagccaataaaacctgacatgctcagatttttttccgagctggtataatgttgctttggatgttgggggtccctattgactttgcctggcaaacataaccctgacttgaaaatagtgaaaacattatttgtgacataactcaagttacttattcgggaaaactttattaaatgaaaatgtatgctctagactggattgggtttaagagtaggagtttaattaagtatgcaagaaatggtttatgtgctttcatgcaattatatttaagggacttacaatttcatagttgctgttgatttaaatccaaaaaacttcttgcctaggagacacaacttactcttttttgctgagccatttattttgcatcttcctagctctgttaaaattaccgtcctcatcggctaatgaaaaagcagattaatgtacattacagttgtgtttctatgtacaagaaggtgaaagattgttaaaatctatgtttttctcttcagtttgccttctactctaggtgatactttgaagtgttggtcaatagataagtggaatcttttttcaaaaaagagaaaaaatgcaatctaattataaatatgaatatcaaatatgataattgattttgtcttatctgtataaaaaggattggttgctgccatagaaggtgctcaagtttgtcaatactgtgggtgctggttagcttgatgctctgtcggccgtgcggcaccaccactgtttaacgattccagatctggtgatattggaaccatgtgttgtcgccttgcccagggtccatttgtagtttgcttctcatggtcacttttggtgagttaagccacaacccgttcctttctacactcacttatgtatgcttggcatgtatcttccatttcctgcctccagttccctcgctagctttgctttttcatacaccattattcccttacaaatgatagtctacctttttttttaatcaggaatgctacagtatttctgatttgtactgcatatctttttctttggttgtgtttgtatatagttccaacaaccaaagcttagatgttcactccaatggttttcagccgaggcaacagctctggcataactgctcccagtaggtgtgttataaccagctgacagcatgctgaaagtgtcaactgattattttcatgaaaccactgtggttcgctctgctccattacatattttaaggagatggtcaggagtcaggacagggtttggatggttgatggttttgcttcattgtgttttttaaggtgtcatctagctgtttgatataatgtcacagaatcaaatgcaaaatctgaagattcatgacatctttagatttcaggtcaatctaatctgaattaagactcaaattatagaacatagaaaatattctctttttgtttggattatgtttaataactgcataagttagaatcacaaatcagaacatggaaaattctctctgattttttttttcttgggcctatgtaccaaataccagatattgaagcagagattagtccgaaaaatgttctttgtaagctggtatgattgagggagcatctagaagtggattttagctgataattcagtggattgatgtaatcaaataggtttagtaggtgctgtacattgttaatgtgtttttgttctatatgctcctttcagcttaattgtgcattgtatttctatagctcttcatctgatatgatgtattttttcgaaaggtattgttatgcacgcagataagtcagacctttttagagagtaataagtgcaatcctattataaatgtcaaatccgatgactcctttttcttattcatgtaaaaaggattagttgccaccatatatgatgctaaggtatgtcaaaactgtaggggcatgtttcttcctaatatgtgaagtagatttttaactatcaagcaaccttgtggctgtgctttctcatgttatactatgctaagcagttgcattgcagtttaagatgtatcattttatacccaaatctttggaaatttgtgaacatgatgtcaatcttttccttttaaattaatataagggataagaggaagaaaccagggctggcagtcttttttttgtttaccaatttttccactatgtgcaagtgcaaaagcatttcattgtcttttcagagttcacgaaagaactgggctatctatttggtagcaggacaggaagtaggaacattctttacacctataactgtttagtaaggaaatttgagggtgcctctccctcatgagtgaacaccattatttccagtgaaaaggggtaaaaagtgatttaccattatacctaactctgccatttccacagtgtgctgcctgtaataatctccatgtcacattaaacatgcgcgcgtgcacaccagtaaagtgtctactcaccttccaggattgctaggaacttaattttacgggcaatgaaaaccagaaacctggtgcatacaaattctgagtctccatgtgcgattgaagaatatttattttcttaagtgattgcaaacatagtcctttacattacaacttagttgtgattcatgccccgtaatggaactgaattaacctcttttaaaagaggatgaatgattaaactgtttttcaatacattattataccttttcttgctcttttgggtattataaataattgtggtttctgaacttattaggtattttttatctgacagtattcagggtctatttcaaatcatcatgtaacatcggaattcaagttatatcacagcctgtgctagaatgaagtcctttcgtactcaacatttaccaatataagtgcatacatatcctgacttgtgatactttttaccaataacaaacgggtagggcgccgcgaagcgcgcctaaagttctagtatatataacaagagagtgtgaagtttttattggattaatcgcttaacttcctatatgtattgaaagttcgataaattcatgttgattttggtttgagtttaggcatggaaagtatggggaattctagtgtcacatgcattgcttaattagctccagctttccaaacatcatgatcaatgtattgggatctcttttcttttgacgaaatggacacatcgacatatacatagaccaatgtatagtcctaaactcctaatgaagcatatgaatgcattcatgcataattaggcagggtcccatgtagcttattcagaagaggtgagaataagatagttgatttaggaagctttacggtcgcttcaggactaaaaacttgagtgttcatttaacgatcgtgctaatacctcgagggtgtacttcaggagactgcgattcctcgcctgatcgcagctttcttcgtggacgcagtgcatagctcaggtaaaacgaaagtatagcgttacctaaaattgggcattactatagtgccggctctaaaagcatcaagcgtggagctgggtcgtctctaaattcttgactatcatcgaatagcatgttgtgttgacgcaacatggctcattcaag

SEQ ID NO: 82932 - DNA, 921 bp, Oryza sativa
cggcacctacccatagcccaacgtcctcctccctgaagccacccacgtcgctttcttcatcatcttcccctctctattgcggtttgcgacaaggcccacgagcaagaatgggattgagcgagggtggcgacggtaacctgaggcctggcggagtgcgacgatgccaacattgtcgaaggggaggcaaagcggcagcgtggagcagagcgaaggacgcccttcgcgaactcgattgttgaatcaattgaagaagggattgggcttctgcgagcgtggggttacgtcgttgtcgtggagggcagcaagttgtggacatggatgcgcctggtgctaccaatgccggagaaggagacggtgtaccggcttgtgaggggagggcaacagtagggcgatgaccgcgatagcaacccaacatggccggaaagccatgctagggtttttttttctcttcctcctaccatgcctccactttcgctccgctctgctcctagcccaccatctccctacccccaatcgagctcgtcgatgtgggccctgcatgctgactcaaccagttggatcagatcaacgagctatgtcagtgcaaatgttgaaggagacaaattataacggtttcaatagctagagggttaaaatatcttaaattgggtttgagggaaacaattttgattggatatagtagtatattttgagggagtcacagtgaacttattccccaataaaatatgtaaagattccttgaaaaatccggcacgagatcgagaggcccattaccatatggaccacatggccccgcaacgttcgaattgagaagacaaatcggccgcaaagcctcgactgcctaacggtcaaatgcctcctcgaattcaaaaccacccccgctccgcctttatatcggactcccacgctcccttcccccat

SEQ ID NO: 82933 - DNA, 1936 bp, Oryza sativa
actgttttgtcctaaattagctagaaatataatttttatgggacggagggagtaagaaaaagaacatatataattactcgtaaatacgattatctatatagagtcagagaattcgaaccaaataagctacatgagtaggtttctactcgcaaatatacatgtccaactaaagaaacctaatcaagtgagctacgcttaaccctcacgacgacgacaattttcatgttctccgagctttgaaagaaaaagggtttgaaaaagaacacaccaagttgctagtttaaggagctttcaggcaatttaagcctaacactttccatggcatgtgctgacaacgagctgaggcgagaggccccctgatttggatgaagactcatccatcaacttaatttttctaatccctttatagctgaaatgttggacttggcctgaactagtccatacacacacacagtgcgcacatatttctgcatgttatactagctgacctgacagcctaatatactgtacctaattttgcttttgtgtttgggtctaattaattaaagtggagcccttttcagagggggggtttggatgcatctccaggagtagtcatcgtctttagctatttggatccacttctacttggaataataacacaataccacattgtgtgtgaatttgtctgctctcatgcatttgaggccactaggcatgtgggatgttgtccatctttgcgtgtcctcgagttcacatatttatttgggtattaattcatttgcaatatgaggctctgggtcctatcaatgtatgtgtacgtatgggcattgctcctgccgtacagtcccagactttggctgtctttgcagcttaattcaatttatttttggatacgtcgaccacaagcaaattaaatcatatgtcatcatatacaagcatgcacggttaatttgtgatcagtagctatatatacaattaagtagtgatgaagaatggctggtcaatttcttgacgatggcttgtttgaaccggataaattagaagcaaattgttcgtaaattggtgctgatttcagtccagtttctccgacgacgacgacccgaatcaagtggaactaatgtatcccccacttgagcgaattcaaccaaaacaaaacagagaattacgtacgctgctgcatttctgttcttctgacttttggggggaggaagaagaggaggaattagcggctaaactaatcatggtactaacatggccggcacatgtgcttttgtggccacactagctatacaaaagttattcccactttcatttgacaccgacactggtagtatcctcattcttccccttgttgcaggcccaaatgatgagcacgaaattactgccagtgattgacaaactctgctttcaattattggagtacctgcatcttgcctctctgctggacaaacattgtaggagtacgctacagcaagtgaaatatgatactgctctgaattaatctattagaagtttagtactatataccttcgtttaaaaaggaaaaaaaaacttcatttatgataatgaatttgaacaaagcactactttggtttaattgattagttcaaaataagagtttatgtaagtgcaaacatgtatactcactgtaacagatagcaggtagtagtagtgtcaagtacactaatcaattaacccaaagtacattccggtaagtaactgctacagctaccacttttggcaaagatctgatcacaaggctcacaagcaacctcagcagttacacctcctagctagcccctatggttggttggttggcaaagttgcttgtactagttgctactctatctctctctctcacacacacacaaacaagaaacaactacagtacaagccctataccaaaagcaagattggctctaggctctagtctagccacaatgcacttgccaag

SEQ ID NO: 82934 - DNA, 2939 bp, Oryza sativa
atgaaacaccaaagagcctcttgtgtatacttgactcagcgactacatataacctgctctctgattccatctgttcatatcttggttcaagaaacaataaaatgactcatagtcaagttgggagaataactatgcttcttctccatgcagcaaggttggatgattcgttgatttcacagcttgtggaatatctagacagaggttctgagtgggcaactttttttctatcgttgaagaagtatcttgacaatggtgttagcagagacatcttactcttggacttcaaatttgctcttgattgcacttataaggcaaactggagggctgaacactacatatccccgatatgctatgtagatctcattgagtgccttggctttttggctacaacgcatcttgtactgaatgactatatgttttgcacaaaatctctgttggccaaaatgatgaagtgtcgcactaccaagggttactttgagacatgtatggctcctagcacagatatcgatctgggctatgcaggtcattcagcacggtgtttcatatacctgtcagttaaggatcttttgggaagcaagcgtatgattgtagagtgggttcagaacacctctactccaactagttcttatgttccaatccttctgagattagttatcacactttatcttgtgactgtaaaccaagacgatggagatttgtatgaggttacagctttcctcgagaaaaatcatgtttttacggatttacctcctgagttctctgaaaagattagaaatgctttgaggatgaagtctcgcacagtgaagaacttcatgagggtatttgctgatgcccttgcagcaataggaactcgcatggtagttatgggtgatattaagaaggcaatggcacataaatgccagccagacttgaatgctgatatgattagcagtgtggatttgagtgatgctaagaaagtaatggcacttctttcaacagagaagtcaagtagtttaaagcaggaacctcagctgccagagatcaaatctgtttgtaacaaaatttgcaacgctacttctggtcacttccctttgacaagtgtaggaggtagccagaagagtacaagtaattttaatttgagtgatgtggatcatcctttgttggagaagtttgaggcgtttcaagtcaatatgcctcaaaaggtgagttgataatttggtaaattcgtttggtcatcttcccttttgttcaattgtttaactacggacagcgtttttctgcagaaaaatggaagcttaatttctcaaattcttagaagtcccctttcctggatagagcaaagagctcctcctgtgcaaatgttagagttgagacacatttgcaagcaagtcgaagaacagcatgttaggtaagcaaatatggttgagttgtgtgacctcgtaccatccttgtgctgcttgccaacgtgtataaaatgtggaaacgatcacctgagctcatcatgttctagcagcttaacacagtacttttcttgtcggttaatttcgtgtgttctttaaacttcatctccatttttctgccatcacagggagaagagagctttgtccgtgaaggatctccattcaaaccgggaacatggtgatggtgaaaaaaatattgggaagatcgtcgacgtgcaaggaagccaatctaaccctgacagagctagcgaatggagtggatgctcagatgacgagcaagagacgggaggaagtaatgtggtgcagtcgaccaaagaagcaccagccgctgccagctccggccccagctccaaaaacaagccgcagaaaaagaagaaatctaagaagtccaagcgtagcggcaggaagtagtctctgttttgttttgctcttctgcctgaccaggcgtcggatggccttttttgcttacaccgttgtaagtccagcagcaaggccagctttgcttaactggatgtactccctccatactgaaatcgtttttgacagcgacacggtctccaaaacacaactttaacttcctgtttctataaaaatatttattgaaaagtgatatatgtatacttttataaaattatttttcatgacaaatctatttatataatttttatattttcaatctcaagttgagagatatttataatttatatttctaagttttgacttaaccttatcctaaacgatctcctttacgagtacggagggagtacttgataagaattgtttgcttatacagtgactgtccgtgcattagtggaaaaaaagggaatgctttctcacccccagtctttgtgtttgatttcaaaattaatttttaggggcttttgcccccccttttttttgcacagttctccattcaatgttgctaagaagagttaaaaaaatcaaactaaaattcatccttaattcaagttatgaaattcaaaactgctccgtttcctattatgtctctttttcaaagttagaacttgttaaaagtttgataaagtttatagaaaagtgtaacaacatttataatactaaattagttttattaaaccgatcattgaatgtgttttgatagtttttgttttatgttaaaagtattgatatattttcatacaaacttgatcaaagtttgaaaagaagttaaaggaggttgacttataaaaaaattgaaaagaagcattgtactactccagtagttaaagaggctgtaccgctgtactactaagcaggcggctccgcctggccggtgacggtgagatactccagtaaaccccacgaaaaccctcaccctgaccctgctgctcccccgcggtgggctccccgtaaattctcccccgaaaccgcccgagatggcggctgcggcggcgcggctgttggagagggcgacgagaaccgcggcatcctgctcctccgctcttctccgcagtcctctggattctttctccggacgcttcc

SEQ ID NO: 82935 - DNA, 12793 bp, Oryza sativa
actttatatctaaactcggccatagtatctcgatactgaggccatgtttagttccaaagttttttttccaaactttcaactttccatcacatcaaacctttcatacatatacaacttttctatcacatcataccaatttcaaccaaacttccaaacctcggtgtgaagtaaacacagcctgactacgggtgtatttagttcatgtcaaaattgaaagtttggttaaaattggaatgatgtgacaaaaaagttagaagtttgtatgtgtaggaaagttttgatgtgatggaaaagttagaagtttaaaaaaaaatttggaactaaactcggcctaccttctggtggtaggggctgcagctgcaccatcttggttgctagcatctctcttattaactcctatcaactgatccaccctcactgatcactcttgtagagtcttggtgtacatttactcctactgcactgcactaccaaactctccttcggccctcacctcacaccttctgttactgttagtgggccccacatttgcaaccttctctctctaccactctcttgcgcaactcctcctctatcgatctccttcctatatatacatgctcacttggacacaacacattccatctcccaaagcagcagcagcagcagcagcagcaggccagcagctagcattatcagagagagagagcaaagtgtgctctcttcttcctcttctctgctactaatcaaagctagccagctagagacatctatagcttgggagaaagaagaaagctgagagctctttcttgctagctagctagcaatggcggcttctgctgctgctccggccaccgtggcggggctgctggtggcggtggcggcgataatggcggcgtcgccggccggcgcgcagccttcgccggggtactacccgagctcggtgcacagggcaatggccttctctcgtgactacaccaacaagtggggcccgcagcaccagaccctctccgccgaccagtcctccctcaccatctggctcgacaaaacctgcggtaatttgtttcattagataactaattaattatattagcagctaattatttgggtttagttttaattaatggtagtaatgttctcgtcggaggaagagaaaaattctttaatatactttgtcgtgtcacagcgacaacagtcgccgggcaatccatgtgggtcatttgacgtgcccagacttgtgttttttttttgtttttttggtgacagttacaacactggcgtaatgttaatgtgggtttttgtttgtgccttctgaaactctgaaaaaggagggggaagcacacatggttttctctgtcctttttactgtttccagtcgtgtgtggtccacgtcagaaaattaaacagaactcttaacaatatctcgtgtttgtatatcctaatctttatctaaatgtggtagcttataaattaattaaccaagttcaccttttagtttacgtgaaagaagaaatgggtaatttgttggttaatcctgccgctaattgtgatggtaattgatgcacagggagcgggttcaagtcaaggaagtcgtacaggaatggctacttcgccgctcgcgttaagctccccgccggctacaccgccggcaccaacaccgccttctacgtaagcttagcatatttcatcaaatcagcctcaaatttcgacccaatttcaaacgaacaacgggtgaattcaagcttaatttgaacactattgcagctgtcgaacaacgaggcgcacccggggttccacgacgagatcgacatggagttcctgggcaccatccccggcgagccctacaccctccagaccaacgtctacgtccgcggctccggcgacggccgcatcgtcggccgcgagatgcgcttccacctctggttcgaccccaccgccgacttccaccactacgccatcctctggaaccccgacgccatcacgtaaaacccgatcacaaatacttgtcagttttgactattaaacgttcgtcgctgacgtaaattgattggttcgggtacaggtttttcgtggacgacgtgccgatcaggaggtacgagaggaagagcgagctgacgttcccggaccggccgatgtgggtgtacggctccatctgggacgcgtcggactgggccaccgacgacggccgccaccgcgccgactaccgctaccagccgttcgtcgcgcgcttcgaccgcttcaccgtcgccgggtgcgccccgtcggcccccgcctcgtgccgccccgtcccggcctcccccgccggcgccggcctcacgccgcgccagtacgccgccatgcggtgggcccagcagagccacatggtgtactactactgccaggactaccgccgcgaccactccctcacgcccgaatgctgagctacttttttttttttacactcgcttattttgatttataagtggattcacgagtgccgttgccgtgctgattcgtgtgtgttgtgttcttgtttggattttgggaaaggtaatgtgggtgtgtgtgggccgctgccctaccgctgctgccgcctgtgaggccggtggttgaggcgttggttggtcgttcgtttcgttgttttggcatgtttttgccaaaagggcactcgtcgtttgctatttttttcctctttcttttggcttgtgtttgtccgttttcatttcacatgcttgcgtgccccaaaggggcaggattaaaggtgaaggtgcatgatccgtgatattctcatgcctgcttgctgtaaacacaggatatatatatatatatttgtaatattgatacgtctcgtgtcggtaatgatatttatgaaccactggaattaatgtggttggtttgtgtaacatttgtttttattctctctctccaaacattgatatatatccattttcgtcaattcagtttaaatagaagatctagttacttgtgttccaaggttgtgtaccatatttccctgtctgaattttgatgcatacgcgtcgggtgactagaactttcgtactactaattaattatcgatcaactagtaacatttttcaaaacatcatttgattgatcctggatttttggatgactcagtccgatggccagacacctttcttcaacctctcttttttctccatttgctctatcttcttatctaccatcaattgagctttatactaaccctgtacgtttcacttacctattgtctcctcaaccactactgattctttcctcgatgatggcaagcaccaaagaagttagggcattggggtgttgcagctaaagtacatatacatggaggccttgagcagtcggtaaactagtggcggtcagcgatgaagacgatacaatgtggagaggtgaggtggtgccaccggagctatgagtaaagaggaccggatgtaggcggtgttggcggcatatgaaattcaaagcaacttaaggagtatatattaggccatgttcttttctccaacaaaaactggataaaattttggatactcgtgacacgcttttcaaactgctaaacagtatgtttcgtgcagaagctttctatatgaaagttgctctcaaaaatcacattaatctattttttaagtatgtaataatttaaactcaatcaatcatacattaataccacatcgttttgcgtaaaacatttaatcttcatcttcagaaaaaaaaagaccaccttagtacgagatgggtaattgagcacgtgagagtagctctagtgcgaatctaaaaccaatttcaacgctaaaaatccgaacagtacaatctattttaataccctagggatcgaataaccaaatttttattcggcttttatagaccgaacttgccgaacgaacactagagctgatctaaaaatagatagatgcagagaaaacctacctatcaattgaatgcacgtccaactgccgctatgacacatggacaacctcattgaagcaacattgatgttgctatagctagatttgcggaattttctgttctaaaaccctatttgcataatattctattgatttatcgctgcaaataggaaaatttgaaaagaaataaaaaagaggttgcattgatatcgaggggaccaggatacatgggaagaaaggtgcacaagcgaaaacatttgttgaccatttccagtggcggtgccacttgctacagtacaggcgcaggccctcatgtgtggacccgggcacgatgcttccgtgatacactcaagatgctgtgacaacagtagcatcggtattattgtttcttctcccttttcgtgaagcaaacagctgcgacagtaataactagtctagggttgtgtttagttcagcgtaaagtttagattttgattaaaattagatatgatgtgactaaaaagttgtgtgtatgataggttgatgtgatggaaaagtactgaagtttggatctaaactttagatataaacacagcctagatgaatatgatcgattttggttggtataacccatgtcacgcaccttgtgcttttgggtgtacatatatatacatgcattggctatggtgttttgtctggtacacatgtgcagtagtcgtggcatgtactgtaggtgtctgtactagcttagggagtgtttagaatcatgggtataaagtttcggcgtgtcatatcagatatatagacatatatttaaagtattaaacgtagactaaaaataaaacaaattatagatttcacctgtaaactgcgagacgaatttattaagcctaattaatctatcattagcaaatgtttactgtagcaccatattgtcaaatcatggagcaattaggtttaaaatattcgtctcgcaatttacatacaatatgtgtaattagttatttttttatatttaatacttcatgcatatgttcaaatattcgatgtgacaagacgaaaaatcttgacgggatctaaatacaccttagtaggaaaacactgttctcacgggtactgttttcttctgtggtactccaacgagcaattattgtccgttcatcgtcgattggacgggtgtgatttacgcaaagctagtatatatggtgcgtagttctttgagtttgctcaatggagtttgatcaatctaagtcagaccatgtatggtttttcttgttttggggacgaaatgcaagcctagggagatggcgaaattcgtaaaaattgattgattttgttcaaaattcgacaaatcctgagcagtttgggtgacgaaatcagacatcgttttggtaggtatcgttttcttctactctataatattattacttacacagttcgggaaagtaaaatccccgatccaccgcccaaaacaaaatatcatacataacaataccctaaccctttatccttttagaaggtaagggtaaacggactatcaaaacaaccttgcgaatgaaacagtacaacagtaatggatgtttcttagggtgatcactactagagaaacaatttttctgaatgagaaccctataggtggaccataattgttgccgcctgcaaaaatcgttttccaggggagtgtttcacgagccacatgtgaaatacattttcatatgcaactccttaagaagtccgcttatgcaaatagacttattttttcagatgagcattttaaatgaataaatggaaaaaatgtattttagaaatctaacttacctcctatttttctagtcgacacttcaaattttttcaagtcatcatccttatatcctcaccttctctctcgcatcctctcctgtatatattatctcccactcctctctctccctcgagttcccctctcaagcgacggcggcaggtggctagctagtggtcggtagcaagaggtggggtggcttagtgacctcgtgtcgtagattggattggtctggcagtttttgagacggggagttgactcagatattaagagttttttctttttcaaggattatcctttctcatctatctcgaaacaaaatacccttaaaatgaggcttttcctaatcttacctaatctgttcctccaaccaaacacgtgtcagagtttcgaaaaagatacatgcatggtttggtatacagcatattgggccttggtaagggacagtggcatactcgtgtacatggctgggccttcagtgaagcaggccgtacgtgcgcgtcaacggcggcggccgccgagaccttcggaattgccctctcgggtggcgccaaattggaggtcgcaggatcgcagcctcgcaggtgataaaatcaccagccactagcgcccgcacgtacgtgtcgcgaactcgcgccacggccgcgccgctcgccgccgtcgagcgacaggcgtccacccctcacgcctgcatggctgccacttcgcctcctcctgcatcttccaacgttgatataaagaccagtgtcataccacgccaagattctcgatctctcccaccaccatggctgctgcacctgcacggctcgtcgtccttgtcctcgtggcggtcgtcgtcgtcgtcggcggcgacggcgacgccggcgtcatccggcaggtgacggacggcgggtactggccgccggggctgctcccggaggcccagttcgcggcgttcgtgcggcggcacgggcgggagtactccgggccggaggagtacgcgcggcggctgcgcgtgttcgccgccaacctcgcccgcgccgcggcgcaccaggcgctcgacccgaccgcgcgccacggcgtcaccccgttctccgacctcacccgggaggagttcgaggcgcgcttgacgggcctcgccgccgacgttggcgacgacgtccggaggcggccgatgccgtccgccgcgccggccacggaggaggaggtgtccggcctccccgccagcttcgactggcgtgacaggggcgccgtgaccgacgtcaagatgcagggcgcgtgcggctcctgctgggccttcagcaccaccggcgccgtcgagggcgccaacttcctcgccaccggcaacctcctcgacctcagcgagcagcagctcgtcgactgcgaccacacggtacatcacaaatcacatcacacgcacacgcaacactcctaatctcatctctgaactaatcgagatatggctcgtgatcgttgaagtgcgacgcggagaagaagacggagtgcgacagcgggtgcggcggcgggctgatgacgaacgcctacgcctacctgatgagctcgggggggctgatggagcagagcgcgtacccatacacgggcgcgcaggggacgtgccggttcgacgccaaccgggtcgccgtccgcgtcgccaacttcaccgtcgtcgcgccgccgggcggcaacgacggcgacggcgacgcgcagatgcgggcggcgctggtgcggcacggcccgctagccgtgggtctgaacgcggcgtacatgcagacgtacgtgggcggggtgtcgtgcccgctggtgtgcccgcgcgcgtgggtgaaccacggcgtgctcctcgtcggctacggcgagcgtgggttcgcggcgctgcggctgggccaccgcccctactggatcatcaagaactcgtgggggaaggcgtggggggagcagggctactaccggctctgccgcggccgcaacgtctgcggcgtcgacaccatggtctccgccgtcgctgtcgccccgccgccgccgtgatcgattgatcgatatcgatcggccgccggcgatctcacgttaccgatgtgttatgtgaagtacggagtactactgtatactggatgtgcttgattaaagctttgcttggttagcggtgggagacgtggcggtagtaggtgcttagtactacgttttacaaatggttttacatagttgggttgtatgtcgatctactactagtgaatacagaataacaaaaagttatggacgtgtacattaagctagggtatattgaagtcatcttcaagggctttattattaaaccaacgcccaattgtgttgtgtatcaactatcaagcactcatcgagttcacaatagattttaaacatagctacccctgcaaaaaaaaaaaacattgtaacacaacacactagttcacagagcatttttaatgttctggattgggacccatttagattgcagatcgttgggaaaaatcgttctctcatttttaggcatttttaggtgttctcccatttttaggtgcggtcccatttttaggcatttttaggtgtcctcccatttttaggcatttttaggtgcggacctaggcccgcaggagaaaatcaagagaaaatcaatttttacatgtgagccggttaagatccacacacaaaaataattaaaatttttttaattatttttgtgtgcggatatttaagagacccgcaggcgaaaaaataaattattttttacccgcgggcctcttaatcgtccacacgtaaaaataagctatttttgcgtgcggacccttaagaggtccacatgcgaaaattgattttcccatgcggacatcttaagaccaccgtgcgaaaattgattttcccatgcggacatcttaagaccaccgcacggaaaataccctccctcttttcccctctcaacacttcaaaaaaattccatcctcgtccttatcctcacctccacctccctccctcctttcttctcctctcacaggcgcgactcggcatcccgcgagcgacggtgggaggagcggggcctcgaccgccctgctgccgtcgccgccgccgacgaggtggccgggatccgatagcgcgacgcctctccgctgttcagatccgacggcagcccccctctgccgccctccgtagcccggatccggcagcgccgcccctcttccgccctcccccacgcgacggcggcggcgacgacgaggaggtggccgggatccggcagcgcggcgtctctcggccgcccgtatccggcggcggcgcggcgcctctccgctgctcggatttttatttttgtgtgtgggcaacataaccaccccggacgctaaaatgtgattttcgtgtgcgggtacaaaaattacgatttttctagaccccttagtgtatttaaattacgattttcctagaccccttagtgcatttagagattcatttgtaaaaaagtttttattctgagaagaacattcaaatattggattgaaatttcatgatttcgagcggaaagtttatgaatcttttgaatttatttggaatttcatatgtacaaagttccttcgcaaaagtttctacatttgaaaatttacgtggataaagtttctgcgtgtttttgtgcacaaagcttctacattcacaaaattacatagatcgataaagtttttgcactagaaatttattattactccgaatccgatattcgcgtgcacgtgttcacgcgtgaggattctcggacagttcgggacccacacagccacactccaaaccgcacaggcccagtttgggcccaaaagaacaatcccttccttgagacgtcaccgaactttgggctctatgggcctaacgagctccactgggcccaaatcacaaatgggcccatttcctcccactccataatttttttcatttttaaatttttattttttaatatttacataaatattataacatctaaaatatttacagaaatgacccctgccgcctatgtggagttttgccgccctctgcaagggctgtaagggggcaaatgcaattatcgtcctgccaaaaatacatttttatagtttttcttttcatcttgttcgtccctcatgccaggtctacttctgtaaaatattttcgtcgtaacaatatttctttctgtaaatattaaaaaaaattaaaaatgaaaaaattccccactctagggaacgccgagactgagaacgccccctttcctttccccctcctctcgttggaggcggccggggaagctggtgggcatatggagtgcgcggcgaaggggctggtggcggagccgtgtgccggcgaggcccgccggcgctgcggcggttgcggcgccgtcgcctactgctcgcgcgcccaccaggtagcgcccggtgaaaactttctaccttttctgcccccccgttaaatccgtccagctgttgccgttctagggagggtttcgaatggcgggcgtatgcgtatgcctcgaccaaatctgtgtttcgtaagtaaggatttctgttgggatttcctggaatcccggtaggtgagagtatcctaacgttgtgggtgaagctttgagtttaatctgaaaattttaaggaggagttatttgtattttacatatattttctttgcaactgtgtagctatgtgtaactttgaaacctacaatttgcagactgtgcattggggatttcataaagaagaatgcgcaaggctcgcagagcagatgagccgcatcgatatgctgaaacaatttccattcacgttctctgtggaatctcctgctccggtacttgactcattgtgatctccatttttttttttgcatctgaagttctctccgtgcatctaaagttatttttccccctctgtcataaaattgtttctacctatgcttcctgaaatgatttggttaccccttgtgaaccttgttttgtcccttagtagtattatgtagctctctctcacacttactgttcttacagaatcatacattccctagtctaagatgtttccttttggaatcattcaaacttcaccaaaaaggactctggaaatcagaatgcatatgtgatccagaggttacttcagtcaaggacttaaggtttgcttttgccctgagatctcatgatcccagctaccagccaactcgttaattctataacactagtatatttgctcgtgcgttgtaacagatctcaaataaatatgccataagttctaggcttacacaaatgcataatagttacccccacttttaaagcattcgcatcagattgacctatgaccatatatttgtatgctctaagaactcaaacctctggaaaactatacggttaatgatatcaatgtcttgttgtgtattatacaaactaccaggctttatgtcctttaatttttacctaattttagtctcagctaattttacttttatgctctttctgcatattatacagcaaaacaactgactggagtatgggaagcgccctctgcccatgcacaggtggatatctcattgtaatgaggtggttggcactattttcatttcatggctcctaaaagcatttgattttgtgtacagagcctgaacataatgtatccacacccctgacaagctggaaagactactataggtggagatcgcttcctttgcaatcacctgttgctgttttacttcactgggtatgcacaccacaccaagttttgagaaatattttgttgtacgatcgtagatatacgattctcttgtttgtttttgacgaaaatatgattctcttgtcaatccagaccaaaggttcgaattcatttagacaggtgcaccaagaaataatcgtgttacttatgctatggaaggacagaatgaaaacaagatgcaagcttgtattgtcagtatcaataaaaaagagaatgataatttgttcattatctactttgggtgatgcggtcattggtttttataatttgacatacttcaaatttactgattgatttcattattttgcaaatacatccaagcatgctgtgcttgtgcttgctatattgcctatatatgcaatcttctgcttaaaaaaaaacagttggctactacacttcctgtacgtgggatgttttccttaaaatatttaattgaagcaaatgtcagcttggcagaatttgcgttattaaaaatatggtgatgtttcctatcatgtcttcagtcttatatctacattactagctatttctttgaaaacttcggcaaagaaccagtttactgaagcattctttccagtttacattcctggtcctcttttgttgagaaaatcgccttgatttcctttgtagattcctcttgaccatgtctcttaatatgctgtatactgcatttatagctcatatcatacatgttgaggttatgaatgtgtattgtgcattactgattattttgaaaggagcatcactttttttactaatatctgtttacaccaatgactagtatatttatcgcacttccaattttgcagccacttactttatatcattgcgttcaactatcgcacctccaaacctcaaaatatgatggccaagacactctatgtattcactatttaggtaaagtatattgtgcaactctcttctctgttgaagtacttatatacatatgtaggaatccttttctagtcagtcggtcatttgctgccatcatggttttgggctgaactatttttcgagttttaagattattattatatgccacaactattgagggcaattaactttctggcaaaattcttgtaagtgttatgtcacttgaacgcgcatttcacacaaagtaaagccgcttgtttgtgcccactgaatactactggacacaagccagttcttggatttgctcgatgcaattgtgtctaattgcctatacatagttttggctggcacaatgctcagggtcattatcagtaaatgtatgagcacagatatcaatcattgactagtaaacagtctggtgtgcactgtgcagttcaggacactagtcttgtctatctgcactcatgtatttgttgttagaatgcttcctgttgagcttccttagtctgttattatggagatcacatgaagcattgatagctctaggtactgtcacatgagaggttttgtcttccattgttatagaacaa

SEQ ID NO: 82936 - DNA, 14509 bp, Oryza sativa
agagctgcttttgtaaatcttccattggctccaaagatttaagttgcagtgcagtgacattcaaactacgaaaagggctgtatcatgagagatatagtgatattgtgaaggttctatgcacagtaactctttacttatttataatgtgaagctacccatcatatgtgtatcaagcctttttttatttgaatgtgaagtgttttttataatgtgaaactataaactttcctacttgctacatgcaatctgtcattttgtaatacccaattccgtgtgacaagggtatttgcgtgtattccctctcacaaatccaactaactaggtttagagctactaggcttcttaatattacttgatcatgtcatttgtagcttgaatttcttaatcttctgttcagtgttttcggaaatacttactggaatgttagttgttatgtactagaagtttcattgatgccatatatgatgcactaaatcacaaagagaaattggcatttaattctattggcatgtgtattgtggtcagggaatactagaagctttgacttttgtactgaatatatataattagcccaccaagccaattcatttgggaattaatgatcgagttattttcattcaggattgactttctctgctaatactttgtttcttggtaggattcaaagcctcatctcattgttgccccaaatgctggtatagctgcatatcctagttggattccaactattgtaagtataaatgttcttgattagcaacctcctcccattttggatatgagcatgattggctatgaatttccttgtgatactaccactcttaacttcacaaagttgacattgttccagctagtttcatgctaaagcatacatctggaacttaaagtgtattcttcacaaatcgcaaatcatccctttatctcagttgatgatattcaagtaaaaatcgatgcgtttaattggtcatcttttcttctctaacccagacaattttcaacagacatgttatctatggaagaaagtgttagcattatattgtcctcatgtgaacttaaattaaaaatacaccacactatgacagctttaactgatgattgccagtataacacagtatactctatgtcttagcttgtaacagacttccattttttgtgctcattctattcaattttcatttgaaggaaataattaggaaagttgggattcctgcaattttcacggacttctgtgaagaagctgcacatctagcttcgtcctgcattacctccataactggtcaacccctcagagtcccagtatgtgttctgtttttccatcgtttcctttctgattgtagttatggagtatcaaactaataccatcatcatctatcatctcctctctcagattcaggtaaatcctttcaggcaaccggttgcagtggataatagtgcactatgcttaccatgctactccaactgctttgtttttgggatgcagaattgcaagtttgtatcaccatgaaatgttcagagattcaactcttaacaaataatatcactaactttttcaaagaaggcaaggataccatgaaatattttcatggacgaaattgccacctgtttttattatttagtctttcagaatagatgccttggttacttgtaagaatgtaagatgcactcatcagctcatgcttgtaaatacagttgtcgtataattgtagacctgtagtaacttgtaagatactacatatataataccctaaagttgcagaaagacttgctagtaggtagtagcaatcccatgctggacatggtgaaatatggatcagttatcaacagcttttgtgccaaggtactaatgaggtagtgccgaagaagcttgttggagacaaactttctgcaatagtaccattcatatggtgagttttctgcttttcatctaattcagtacctttagttatctaaatgtccctatcactgcatttcattttaaaactgacgctttcaaatttcttgtggatgagaagtttagatctaactttgattcataaatagaatgaccagcgttaacattttttttgtctatgagaatcatttcttgctattcttgttccaaattttggaaatattcccaatataaagtaaggttcttatggttttaatgataaaacggttaagttttttggtctcatcttgcaaacttttcttctcatccacataaaatctgcatatatgatgaagcagtcataaatccaattacacacactgcctcatataaaaaaactagcattgcacacgccactgcagtgaacacactgttgcatatccaaaactaaaattccacacgccactgcagtgaagtaaggagtccaatcacagagaatcctatattacaaaaggataaactcattttctatgttagttcatcatgttcagtactgttgaggagaaagcttgctgaactcctgcttctgcattctgatgttatgccctttcctggcattcccatctgcaatgagaacatcatctatccatgagacaatattgtaggctaaactttccagcaccctcgagtagctttcaagtattgcctgcccaatgtcctgtagcaaagtaaaatggagacacgccagcattagcaatgatgaacattctttgatccaaaggagatggctcaatcagttatttcgtatatgtttgtatgtttataccatgtatgatagttctaaatattttgtattagcattcagtatacttctgtctcttaaattgtagaataaacacacagtacacttttatgtttttgcttccaacattaatcatatctggtgtaaggaaaatacagatgaactctgagataatctgaaatttgggtatttcttatgtataagcattaccttgttgtactgaatcttgcttgtgtccagggtagtctgtgacaagcctggaaacctctgcttcaagcacaacaacaaactcctagccctacttgcaaggatcagattcttgtccccatcagcattcagctcagtaacattttcccattttgacaccacatgggtcatgcttgcttttctccgccatacgtacatcgcagcctcaacacggtctgcaatctcaagtgcctcatgttctgagctcaagttgaggaagttgaggaggtggtctggtgagaactgatcccctgcagacatgtaccggtatatggcatcacccacgccaaccttcccactctgttgagtagcagaaatgcatttatcagggggaaatgataatttcagtaatcaggaccatagaaagacccagatcaagcagtttctctgtacctttggcagtgtttctatgtatgacagtggaacctgcatttcagagaggatgccgctgttgatctccatggccatcttgtggatttggcttgcttggtccctcttttgttgcagctcacggtgcatccgatcagacaggcctgactctgggacacatggttcagggagccaccacttgtcctcgctgcgctgaaacttcatgctgtcactgaaggactgctttctctgatctatgtaccagaaatctgtcttctcaaagctatccaatatttcctgcaaaaatggtgtgcaattattggtcatacattgtactacaaaagttgttcgaaaggagccttccggaattccgcaaatcgggactttaccaggagcatagtttccagtttttcaagtgctggaaggttcattagtatgtctgatcttggtgaggttgccatcacctgtagaaaacagaaatttgtgcctaagtagacatgccatgaagatgaaacttatcagagtgtgagacgtgatattcttgcaatggaattacatcatgagtgcttccatctggcatggcctggacttttggtgagaattcaacaatgtattcgcagatggagaggaggcagtccatctccctgttccacatcgccttcttctcaggaggcagtggctgcaacctgtggcaggttccaaacacagttgctgcagccaagaacaagcacagaggtcaacccactgttgcctgcatcaaagaccaacttaacagaagattcatctgcaattctcagaactaccatatagattggtgatggcattggagatggccacagccgtgcagacacccttcccactcccagacatgtcctctccaagaagcagcttggtgtacttctccttcatcagctccatctctgaacaacacccatcaatcaaccaccagaaacaccagaggacactaccagaaatcaaaacaggttggcatatctataccttcatcctccagggacttctcgttcacaacttgctgcagcttcttcatgctgagcttgctcaccgatggcgagaggcgtggtgccgtggacgtcgtgcggctcatgcttctccctcgtggcggcgatggcgtatagtgctcctgctcctcgccaccgccattgtcggagaacgacgacacacggaacagcggtcgcgcgtagtcgcgatcgtagccgtgtttgtggaagccagggaagcctgaacctccactcatggttgcagctgttcttgctgcctgcttctgaagacctgcaagaaagacgatgaatgggaatggcacaagaatggaggcatgccaagaacagagaggataggtacctggtgttattgacttgctttcccttttttggtgatcatgtcatggctgtcacttacaagtgtatggaacaataataaaggcataggggctatctttccttgacatgggctgttgcaatcaatatggtttgcaattatgcaggcatgtgagcgatttgcccccacagtgtaggacaataaggttggattggttggatgtcttgcaggtttggtgaatgtgttaactgtcaggaaggtacaaaattttggcacttggtgctgtcacattgtacccagattttgactcacattttcggtgaccatctatttcttcaatttaagtaattgcctctcaaattgtctggtggatttggaatgtatttattgcctccatttatttggaaatgcatggttgtttttcaccgaaagagagtatgcagtgtattcatgtaattacttcacaaaaagacagagtagcctatgaatggttgggacttgggagttgaaacgaatggtgaacatctttaatttctaacccatacctaagctacatttatttatttttacttcagtttccttgcataaatgacattgtcctctattccagctcatggaggctgtgtcggcatgtgaaccacgctacacatatggtaatgttttttccacatttgatctgccaatgtatcgtagagagatgttattgtcctggattcctcctggttataagcagggttcagacaagacaaccagcacaaaccgttttccaaaaaagagattataaatccaaagtacgtagtactactctatgcaaatattagatgtagaatacccataaatatcagagaaaaattcaggcatcttctaccctaaagtctctatgaaaaaaaaaactctttttgtctgaaaaaccagcggaaaatttgctctgaaccggttcttggatctgaatcagcaagttttttttttcactcctctgtttttgtaaccaaagcctataggtcatataaatatgatcctgtgggcaaacaatcttcccaaatacgttctgggaccaaagggatgatgcttctcaaacatgcaatccataaaccggtccatttgattcagaagacttctaagcaaagccacatctatctatgaaacttagtgcttgccatgatcgtctatcatgatgtattttaaatgctacctaggcaaacataatggctgtcacgtagtaggatatataagaacagctcaatctctggaccccgaatataaaatagggaaggagtggaagcccaatctgaagaaactaactaaaatcccttacaatcttggaagacacatgaaaagtaggaaaaatctctcacgaactcattagaaagaaggaaaaatctctcacaagcacatttgaattctacacgtacgagtacaatatatcaagggatgatatgatctatttgtaagagattttggctttgagagccagttattattattttttttgggttctcacaggtattacaaggtgatattgtctggtggcaataatcaagaggcatagttctatgtctgttttttaatatatggcgtcattgtttttttatcatttattttatttaaaagttgtgtgcaaatataaaaaatttaagtaatgcttaataagacgaacgaccaaacgtttatcaacgacgtcatatatattaaaaaaaatagagggagtactaagaaagatagatcgtacaggaatagcaaaattaaggagcctaaaaactgaaatcgctaattcgcgatccgtcagattattatttttttttgccagcacgaattgggccggattttctattttgcgtgtttaacgattgggttttctcttttttccccctttttaagtccatgtccattttcttttgggcttttgaccttttctcatttcaggtttctagggtaggtaggctgaattcaaatgttgggctaggcatgccggcctcacagcccacgtaccttttgtttttcttttcaaattttcttgtgaattcgtatcaaatttatacgtacgtgtacaaagtttatattttttacgtatactaaaaagtttgtaagagattttggctttggagccagtctattatttaatggttctcacagggtattaccaggtgattttgtctggtagcaataatcaagaggtataattaatatgaaggtaatgaatcgtacacgaacagaaaaattaaggagcccagaaactactactgcctccgtcccaaaatataacaacttttagtccttataatttgtcccaaaatataataacttctccactaacattctcttcccaaccaatcacaaccctccaccattcacttttcccacctacctccactactcatccaatcacaactctccaccactcacttctacctactttcttaataaccgtgtccaactctaaaacttcttatattctgggacggagggagtatctattttcgatgctgaactcgactgattatgtacatataccgtagcaatcgttcaaccatcggtcacacttgtgcaattttaccaaagggcttaggcgttcacttgtttcggacttatcgaaacatcacaatagtttgtcaaactcgattcatatgtaccgagatatttcactctaatattttgttacaaattactcttatattttgtgacaaattacatgatcatcacagcagttctcattgggattacctaatttgaattgctccaaattttgacgtactagcattacaatgtccaacagcccaacacatcccattgggtatgtgcatcctgactaacatcatactccactccatttcctccaatagctagcacatcatttgaatgcttaaaccatgcatggtatgcctcaactcagcctcagttattgcagagaggcagtgcccgcttattgcgggctaagccctggtgactatgcggtggaagggttgtaagttcgcagcgttggtggtggtggtggtggtggtcagcagcggtgccaagaggggtaggggaggtggtgctggtagagcaggtcaacgataatggcttggaggcgacggcttgctgacaagataggctatgatggtagctcaacagagtcttccagcgacgacgcctatggcggcaatgactcttcggcaagataagctatgacagtttgacagttgttgtggtttaaaatgacaacgacgtgttaatggcagtcttctggtgatataagctttagcagctcgacggagtggtgatagataaccacttttggcgagataagctttagcagcgatggaatatgtggagtagattggtcaagaggcgtgagttttttcttggcaactgcaaggtagttggcagactactattatccccttcctttgctcaatggcggatcaaaggaacttttgtagttgatgcaacgatagtgagatggtgtggcaatagtaatgcaggctagccccgcatctccttatagttctaagtgaggaagaaaagtttagggttagtcttctagtttttgtttccggttgttcgttggtttatgtttatcggttatgaaatttagaatgtcagcactcgtgtaatctttggctgttttatatccatttatggaaaatagaggccggatttctatccattatctaaaaaaactcagcctctacttcattgagagcctcacttccccagttaacctcaagcatgcagatgcaagtggtgcaacttaatccccttattttgcccatccttcatcaacaatccgcattgagaatttcgaagaactagtcctctatgaaaagggatgcaaattgtggtaccaaactcctaatctaaggacacatggttcatcaaaattataggcaacacaatttttttaattgtccatcatgacatccttcttccattattattccattatatgataataaaactttttatggtgtttggtagctacttagatattcagaaatgaaacaatgtaaaccattcattaagatatgataaggtacgaaataaagctattctagttttatctcattattcattgtcgaggtacctatttaggttacgacaaatgacatacgattagattttacacatcgaacaatagattcactctcactttgttaacgggcctccgggccggaagtttcaaaaaagaaaaaccaatcccaccaaatcaaaatttaaattttttcaattcataataatcccattaataacaagggtggtggtagataaaagatcccacccattttcattttcatgaaagaattaattcctccaattaacatccctcccaatacatacaaccactccaccagtccatcatcagtactagtactaaacttggaaaaaaaaacaagaaaaaggtgagcaaaacatttttctaaacagaaagcaaccaaccgcagtccacagcacacgtgggactctgaacaacttctcctctcttctcttctcttctcttctcttctcttctcttccatgccaaaattggattttttattttggtctgcctctttctttcccccaccttgacctgtagttgccgccggccggtcatcctccctgagctcaccttaatcttgcctgacctccaagaaaagtagctaaacgctgctagctaccgtggcctccctctctctcgcttcgcttcccctgaggcttcacctactcgtcgtcgtctccgatgccttcgtcctccccaccgctccgaggtagtcctactaacaaaggccgtacctttgccttcccctcttcagtcttctttcttccccgtggaggcttcccttgctttgtgagttcttgtttcgatctcttgccctggaagtgaagtttttgattgggtagtttgtgggtggttattgagagagagagagagagagagagagagagagaggcgtagagcagttgcggcaaaatcggtggtgttttggtagagaggttcttgattttggattatgcggttgcggcggttggaggatggatccctagcttaatcgatgaatttcttgggggccgggaattcgatcttttattatccctgaaatttctgtgtagtgtttcttgttttcagatatatttttcagtactctctttcttggtttttgaggtaggtagtccgccgtcaattcttatcatggaattcctcggtagaaacacccaaattccaatttgttttgtgatcgaatttaacagcaatctcaattaattgttagaatactgaacccggttaaactcttcttggaacctccctgaataacccaacattttgtttttttgcaggccttccactgttcagtgtctcacctctgaactctgaagctccactaatgtgatgtcaatcgcatgctgcttgccggttgtcgagtgcgtctactgcctggcgtgcgcacggtgggcgtgccagcactgcttccacaccggaggctatgacagcgagacctggggccttgcctcgccgaatgagtttgagccggtgccgcggctatgccgattgattctcacggtgtatgaggatgaccttgagcacccgcagtgggcgcctcctgggggatatggcattgagccacggtgggtggtgcaccggaagacatatgagcacactggtggacatgccccgacatacttgttgtatgttgatcaccaccattcggatgtcgtgctcgctgtccgtgggatgaacatggcgaaggagagcgactacgccgtgctgttggacaattcgctcggccagaggaggttcgacggcggctatgtgcacaatgggttgctcaaggctgctgagtggttgtttgatgctgagtgtgatgtgctaagggaccttctggagaggaatcctggttacacgctcactttcgcaggccattctcttggttctggtgtcgtggcgatgcttgcgctggtagctgtgcacaatagagaccggctgggtggtgttgagaggaagagggtacggtgctttgccatggcacctgccaggtgcatgtcactcaatttggcagtccgttatgcagatgtcattaactcagttattctccaggtgagattaattccatcattttttttagataatggaatagaatcccagcctttgctcaatgagctacagccaattattacatcaattcatagaaataaaaacgcatggcaaaaaagtcataaaaacataggcctaaaaggacaggaacacactcagtactaaaaaccaacgcaagaaaagatcacaattaattccatcattagatgttgccaacatgtgtttatatacctcttttccaattgtaaattatgtacctcatttgcatgtgattgtgcatgaaatttcataggtaaatttctttcggaagtaaaactgtaggaaacactttaccattcccacctgctttcataatttgtttgatcaacaagttcaactgaaatctgttttctgattcatattttattagaacaggatgattttctgcctcgcacagacactcctttggaggatgtattcaagtcacttgtctggtaatggaactttttcttatgtgtagtgaacacttgaactcgtatttgtagagatttatgatcttcttagtctatcttttcagggtacctgatgtagtcctttgtatacagcttgccatgccttttatgtggaaggtgccttatagacacgtgtatacctgaaagtgcgatgttgagagatccaagacgtctctatgcaccaggccgcctttatcacattgttgaaaggaaaccattcaggtacgacttccagtcagttctaaccatacaagtaattttattatctgttaacacaagaataactatgcaaatatattcagtatatgcttatattcatcttcataataacaatataatatactaactgcaatacacaactaaatgctcagggaaaatattctttcagtttttactttttctaattttgatacctcaagtttagaataaatattccattgaacgcttgctggtagctgcagatgtggaagatatccccctgttgtaagaacagctgttccggtggatggcagatttgagcacattgtgtatcttgcaacatgatttctgatcatgctattatctggatcgaaagagaagctcaaaggggactagatgtaagtctgaatttgttgttctcttcttgagtattctaccatgacaaacagataattgtttctggcgtgtagaaaaatggtaactaattctagttctcttatatccatactgcaacctatggatcgtcattatttatttcacagacgatggagcttaaaagtattagaaacaaactaggaatatagcccgcgcacatgcgcgggcatcttatgagatgttgttttaaattgtgttaagaatgttttatgtgtgggtgacttttcttaaaatttttctttgacactattgtaaacgtgtttttgtcactaatttgtttgggattgcgttgaatgttggttattattttcttatatttatccttggaagtttaaattctaaattaaaattaattggaactacgccgttttgaaactatgagaaaatatggtgtcataataatggagctggttcttataaaactatgatttgcactatgtgtatttactttttaatatttagcatatcttatcttttttatgtttctatgctttaagtaacaaaattgcttttataccatatatgtatttatgaatttttggatatattaagtgaatatattttctattaaaaaatatggttaataggaatgtttcatctaattaaaaaaacttctattaatttgcttctattctcttctcttttttttcatacgttttcttattttctttgaaaaataaaattgatttgaaagaatagcacaatcatataaatttaattagtatgtgtaaagcgtttataaatatttaagtgccatgggctaaattgcacttttgttggatcaattctttttatcaagtatgttctactgcatgcattctcatatataagtttagtatgatttcccctaataaaccaatcttagtatgaagttcccatataccatgcgtacttaatagaaagcaaagagagaaaacatgacttgtagtttgtctattattttattattatttagaggattaatatagtctctaaaatgtagaacaatggtagtggtaaatatgattgatacattaggttatcccggtatatacggatcaatagtatggaccctatatataagcatatttaaacgatgatataatctatatcattatttttttcatgatttgtcaaatctccaatgccatgcaaagtaccaagatttgtgaactgataaccgatatatagtgatataatttatattgtcatctattttccataattttcatatctgtttgcattggattacatgaaaagaataaaaatactatctaaaatataatttcctttcacaagttgaaatatagtaaatatacataataaattattaatttaatggtaaataatataattatgtaaactttgttttaaaatgcggtaaagctaatcgagttatgcttgtttgtaaagtgatttaaataatttgttaaatccgatagatgttttgtgtttttcttagactttctaggattttctctaatttattagacttttattatatgattgaggctctttggatggcacacaaaagcaaagtataggtccgcatgtctgttttcaaaatatacatggtttttcattgttgttattttggccatgcatatttataaagttctatacttaataatctacacggtaaattttgttttgtatacttttatgagtaattggatggtgtaaaaaagagcaataatctaagtcaacatgttagtctttttcacaacatatacgggtcttaaaattgttggtttaattgccaggaatacaacttttgaattagcctttttaatataataatccaatgatagggtttgtcggccgaacgtaatcttttttgacacgcaacacgtaaatacgaactacgtattagagatcggatgagtgattagccggattgatctatatacatgggaaaagaaaaaaaagaaggtaaaatacgtacgtacgttcatccttttttttttatctctacgtacgttcatactgaacggaaggaatagtgagatatgtaagggaggaggaggttggtgggtcatcggtttgttttaagagatctaatctaacggtttataatattggacccaccgatttaagtgaaaatcgatggatagatgttttgttttttcctcagtttttctatgattttctctaatttattagagcgccaagtggtggcttgagagcgttttgaggaagtttaatggacttttagtatatatttaaactaaatatatgatattttgcgggcatgcgttgtatggtaggtttgagacacttataaaagcgaaatattaaccggagaatatctgccatgatttctttataaattgttttcatcggcattaattgcttttataattttctaatctgttacctttatattatattatatttaagtaataaatgagtcagtcctgtctcgtttattcgatgataataataatactaatataaatactaatctgtgaaaacaatttggagatacaaaatcaccttacagtaaaaacaaatactaataattaaaccacaaaaaattgcaactacacatatatctgaaattccgacacaacacggctgattgatcaccctgtcactacccaaccccagaaatcaaatttggaactactaacatgaggattattgtgtaatctatttcttgaatgatcgatcactgaggtcgatttcaggaggtggcgttgaagctgaggagcttcgacgtcttggactcgatccgg

SEQ ID NO: 82937 - DNA, 6457 bp, Oryza sativa
gataaggaggcaggcagtaaaaaaaaatatctccctggatctggcccagtagagttcttttggtaaatcctagtactccgctagactttctagtttctagtttctacaggtaccacagatcgattgtttgagtcaggagattaaacaagtcttggttatctttctgaagtgttactgaggatgcccatatcaagagtcataaatcatgtggaagcatcaagcatgggagatctttactagttttaagcatactaactagaactaccatcaaactccttacggcaagaacacatgtaaagctccatagtccataaaaatcagtctgaaacataaaaaccaggctatataaccacggaagacaaaaaaaaaaaaaaaaaaaaaaaacttttgcgcgtgttcagagcctgaaacttcagaccaagcatgaacagctacggaaggaagacgagcagaagtgataccgtacctcggggaggcggccttgccggccaggacgcgggcgacgaagcttccagcgatcacccgccccttggagctagctactgctgccatgcaaaggtcgatcggacgagagaggaaggcgaaggttcagtgtttttcttgggcggcgagattgggaggagaagcggaagagtgggttttcaatcctgtggactgctcagctaccactccggctacttatagcgcccccgaggaggatgatgccggtacaccagcgtacagtcaccgtgacccggacggaaaaagagaatggtggtatattacggcgattgggaagccgcagtagtgacgaccatttggctaattgcgatggccgcagccaactaaccaacggctgaggcatgctgtccctcaacgactgcatcgatcttggccttcttggacactccgtccgcgctatgccgtccgattatatgactaagatcacgccttcttttatttcttttttgtttctttctttttcctttgatccttttcttttcttttttttccctttctttccttttctttttgacagagccacgcatttcaaacatgtgtggtgtgacttgtaggtacaaagaagttaacagctgaattccaacgcgaatttcaacactttgtactgcatggttatagtacttcggagaaaactggtccttgggaatgtttgtttgatgttttatagttatataaaacacaattaaacacctttttgttttcacaaaactgttaaaggagttttaaaaccttgatctagaatttcaaatggttggcactataaacatcaagggataagagagagagaagggttgagggggactgcatgagtaacgtactcgtttaccactccagccccttttgtgcaataaatttctcattcaaaatggcattctttttcctgcaaatgaaaaatggtggacggtcgaatctgtttttttatcactagtagtacatggaacaaggaattaaaggggatcaaagactttttgagtagcgttgattcgaatgtgctgagaaaatagcattgttgaagcattcagatatcgttaacaatcaacttgtattggtagacgtcgacatcaatgtgtttatgtagtgatacagtacagcgtatatagtagtaacattcatactaagcaactaggcgagtcttcgtctgctgatggttaatatatgcttggaaaacttcgtttccttccccgtgtaaataaaatcataaaaaaaaacccaccaactttccatcacccaaaccttacggaaacaaaaggtttcaaatttgaggagtatacatatgcacatatggtacataatactatgagctacgttaaaaaaaaaacgatctatacattctgtctagatcggtttttattttcggacggatggagtatgctgttactaatggagtaggaacgtcgatgacaacagatatactgctccatccattccaaattgatctacatatttttttttggtgaataaccaaagtggtcctcaagtttcatctgaggctcagtttagtccttgatatttcaatctatacatattagtccttcaagttttcattttagttcaaacttatccttgaaccaacaattctcttcataaatgacacttatacccctcatcatttacatatacaagagaaaaattgcatgcttgaattttttatagataatacatagtatatattatgtaaaacgaagaaaaaaaatatgtactaacaagtgtatacgatagcaattgcttaagtttcatgtgcacatgttgaaataatgggaagtacatctgtaatgttgtttattcatgttggctttctcttttctagtatatagatgtatataaattaagggcaaaaaggacattttctaatagaaatattgactagaaatagccatatggcatattaagtggacccaaggatgatttcaagccaaaacaaatatttgaaggacctacgtggacaaaatgaaatgtaaatgaccaaattgagtcttcgctgaaacttgagggactaaattagctattcacccttttttttaggttatttataaatgatctacatatttgtgtttattcgttaagtctattcgttatttgtgcattggagtaaatagacattgatgcatacatccatacacacaagtatttataatccacatgcaatatcttgatttgctattggctaagaaatagtggggatggtgtatgcatcgagtttgttgctagaataaatatagtatgagagagttattagtttttcttgatcttggtgtacttataaaatatatagatcaatttggaatggagggagtaatacttgcgaattgaccagcagtgcatgcattggagattgagggctacataattaaaaaataagcataactttgcttagggtagacccaacccaaaacactagacatggttttcataaactccacatcatcaagaaactagtattatacactactcttccaatgcaaacaccactattctatacttcaatttaatgctacttagagcacctgcaatggtaaagtaaggtgctatctataaaacatgtacatctcagcaatagactagattaatagtaaaccatctcaatagtatgtctacatgggtatctatagctctctaatacattgcctcgtttttctctatagactatctccaggttagtagatagctttgctctctctcttcatttaatctcttccaagtagaaaaatatgctgacatggatctcttatagagagcctatagataaccattgtgggtgcccttatctcacatgatgtcttggatgttgtatagaaacaatgtctcatgcaagacatggtttccttttctttcctcatttattcacttgccacatcattttttttcctaggtgacaacttatttaatgctatggacaccatcttagacattgggttggggatggacttacccagagcagaataagtacgtgcagcctgtcttaggtctcgtcttccaccggccgccgttaattagctgattagctcgtacctggtacagtttctcctatcaagtgtactgtgtagcccacatcggaatatgccatgcgagatccggattattaagcaccgactccgagtgcgtttctggtcaattagtactcgctacacgtgcctgcccttgtgtgcgtgtacggaagtcaggacgccgtgataagttgataatggagccacgaacgcatgatctgtgctggtaaattaactgtcatcgttttgacttagcgatcattgatcattcaacaggcagtactgctctgatatcgtccagatattcatggaccggagtttccagaattccagaattttcaaacatctctcaaatttgtcccctcccatgtctacgactacgaggaagaggccgaaaagagcaaaggcgttggcttgccagtgcaagtttctcccgataggtggcgtcaggctatctgccgcaaccgattggtcgttgggaattcgcactggcggagcgttactggtacctgaatacatgatggcaccccaggattaggataagcacgggacagtgggacatcgatcggcacgggcagtagctacctttgcgtgcgtgtgcgccgcgcacggttgaagccttgaagatgatgcacataggcacggcaccagacgcagacgatgatgcgtctcggcagcctaaagatagacccgattcggttgctacttacatgtgtcatagctgacgccttctccgtgccaggtttcaggtttgtccatggggagccagaaaagcgatcgatttgggcgcggttggggtcacctggtcacgaaagcgtgcgacgtgtcccacggcattggtagcgccgcgccgtgctcggttgccaccggccgccaacgcgtgcgacgcgatgtgggagccggaaccagatgcggcgtgtacgggttatggcccgccggccacacgtcgtgctcctgcgcgatttatcggtgactactcgtagctagcagtatagtaccgtagtattcccaaacggaatctcgcaaccactagagtgtacagtaatttatcccggcacagttgctgatcgcgacgctacagtagttccggtacgatggtggaagcgccactgaacaaacaaacatgccatgtgattgaagagccagcttacgacaattaatacggcatctcgccaaagcgaaaaccatagggccaacatggagtaaaaatttgttctcgttttaagttcatgcatgtgcccgtgtggcccgccacggtttccccccctcgatctctcccgacgtacgtgcgtgggtataggggtacagcacctgtcgttagctagaatcagatccccggctggaaaatggaaacacccgctcgtttcgccaatcgctgcaaaagtggaaacgcgatgagatggcgcctatctagtagctaaccccaacaacgatggctcattccggggcacaccagccgtgccgtgccgtgccgtacaacgcaccgctcggagccggaacggcgtccctttcatgagttcatcgtcgtcgatgatgcttccagcgcggtgtgttggcgtagtgcgcgagcgaacccggactgagataagatcctgactagtcacgtcgtgatcggtggagacacttttatccgcggcttgaattcgcacgaagaaaaatgaccacaccggcctaagagctttggacggtcgtactcgtctcggctgccaccgcgcttgaagtcctatcagactagcgctggccctgactaatcctgcacaaacattatccttttcaaaaggaaaagggaaaattgtcgggtttttttataactaaaattgtcggtttgctcaacgttttatttcatgatggggagtacctatacatctttcgaaagaattttatgatcgtatcacacagatttttaatttttggattaaaatctgatagatataataaaaagcaaaaagcaattaagaaacaccataatggacactaaattactatatcctcaagaaaaagaccaaatccaatacaaaatttaaaatttacatgcgaagattcaaaaattacattgtaacttacaaaagttgcagtgtaagtttcataaattacactgtaacttacaagaaaatgcactgtaaatttgagtgagaaaatcgagtgagagataagaaaaaatctttcgagtgagatatagcaaaattgttcatgatgaaacagacgtgccagatatttctgtgtttccacgacacacgattagcgtccaaaacttcggcccacatttggtaagaggtagcccaaacttccacgggtttgtggactaaacaccagaacggactctattttggataggactaaatccactaaagtcctttaatattggtccaatctgattcacatcctttaatcgtagcatccgatattttaatcccctactattaaaaatcggtggaaaaatgatttttttttatttggttttgagggtggtttttagtgacatggttcgttgacctaatccaaccagttgagttagcatatggggcctaaatgttagggattgtttgtcttatatcatatatcctctcgacctttcggtctcttgatccccatttgtctcaatgacgctgttgtcagtcttgatgacatcaggtacgatggttggatgctacatcgctgaggacagagaaatggaccgtggatcttctctttgtgttcgcccgcctcggttagcaggtcctcgatcaagaggtggcatcatagtcgtactcgagcatggcgtggaggctgacctcgatccggatagagtgcaggtcagcttcactcgaagatggtggcccgaggtggagcccatatcatcatgcacctcctcaatctctttgcgacgctgaggattccttgagcttagtgtcgatcaacctccttagctcgatgatgcagcgtcggtttccccgccaaccatgcaaggcaacatggtttgcgacgcggtaagg

SEQ ID NO: 82938 - DNA, 3504 bp, Oryza sativa
ttttacttactaaatatagttactttgggtcttgaattataaattttgtggtaaataatctaatgatgaattatgtattttctatataatatagtatgagaggatggaaggatgtatggcgtaagtacgtgtactggtgcacgtaaatgatacggatttaaagtgggtccaccgtatttaaagttgtaaatgatacggatttaaagtggctccaccgtatttaaagttttcctttttaagaattattagatattcctcaaatttattaaaatgccacatgacgacttaagagcgtttgtaggagtttcacgtggcggcttgagagcgtttgtagaaagtttaatggacttttagtatataatagatagataacgttagtattcatctctggcgccttgttttagtatcagctctcttaatcatcgacacaaaaaaatatttagtttttcgtcaactgtaggttctgtcatgagctttctttacagagcacaaatgatgtgtagactaacagtcttgtcatttcagttgatgctggagaacgagagaaccatgaagccacctgagacgcaaagaatggacgatgaaatcgccatcgagagggatcatgatgaggagcagaaggcggcattgaggcgtgccgttgctctaggggtcgcagatgttaatgtgccatcagcatatggtacattcagtgaaaatctgactcctgaggctgatgaggcctctccggtattgcccgacagtggactgcgaaggacggtctgggatgagtggattgcaaggatatttgagaaggatgaatctggcaaaatgattccacgaacatgattatggtagaacagggcattatgctatgaaattaggaaaaaaataataaataagtatgcaggcaatataatctgagccgattattattggcatcagttcatctccagcctgttcaagtctgttttcaaaaccttgaaatggtgatggaaggaaataggaattgttggcagagcaatgatgtgaaatctgatgcagtttcaacctcagaaacaaagatcctagtagatgatatggggcctgtttggatcggagggctatttatttatttatgagtattaaacgtaaattactgataaaacccattccataacccctaggctattgtgcgagatgaatctaacgagatatattaatccatgatttgctacagtgatcatccgctaatcatggattaatatacctcgttagattcgtctcgcaaaataggctaggggttatggaatgggttttgtgagtaatctacgtttaatacttctaaatagcaagattccggagggatatttaatagcttggaggagccaaacaaggccatggtcgcacggatgtaaatgactccatccatcctaaaataatagcaaactatagtttaggatgaagggggtaggaattaacaaaagggaaggaatataggtgaaaattgatataggaattagcaaaatggaaggaatataggtgaaaattgatataggattacatatatttgttatcagaaaatgtcctttatacacacaattgattaagtaattagttgtacagtaagctattaaggagagtaagatttgtatgcaaaccatgagataaaaaagaggggcatcctatcttttggtaaattttcagccagaaagtacgaactttgttattatcaagacagtggaatgctgcaaatagtcttctctcaatctttagttattaagcgtaccatttgttcttttagaactcatgaactttattgaaggaaatgcttaaaagcacagtacatgaatgatgttaacttctccacaaggagattacaaaggttgcctaaggttgggcaacttgcaaaatagcaggcaaagcatgacaagaaaactattatgacaagaaagttattaggagaagaggttcttgctttatgtcagcatgtttattggcctcccttggaatccatctgattgcgatttgtttacctgcagataaagcatgcaattcaaagagtaatgatctcaaagaccaattgtcttggttgagcaatgaaatcttgctgctgtaaggttgagactaaagttttattgtctgacaggaaaaatgtatgctgtaactgtaaagccaagcaaaattttgtaacctgaaacaaatgctgcaagatcaacaagaggagaagtaaagctcttcgaacgtgcttttattaaggttactgcgtgtgaaccaggatcatgtataaaaatgccaaaatctgatatattaattttccaagaagcatcaacataacaaagagtacagtacctgaagggataatcaagttaacataaggagatgttgttcagtttgtgttacctccgaagaatcatgttgtgtttgatgaacactattataactttgcaccatggagatggttgcattacaaacctgaaaaggctcccaattttttgctttaaaattatgatcattcatagcttttcaaatttgccaaagcataatagcaattttttgaagggcattatctgtggacatagtagctaggaggtaagaataatatcatacatagatgtcatcaagctaagagcatccgttttatgttgaaaatcaaagataaaccaaactagtctactaaagcaacagtgcaaaaagatatgagtttcgttttgttgttgaccgcatgtggaacaagtaggttcaatgtccttgattctagaatgaagagtaacagcagtaggtaaagcgtttctgaaaagtgtccaaagaagaattttaactataggagaaattgtcttatttttccaagcagatttaataagattgataactaaggaaggaataggatgatgattataatggaaagacttgaaaacttctttgtaagcacttttagtattacactcagcagaagaagtgtgaatccaacaaagcttatcttctgtatcctgatgaattactcttacatgggatatagaatttgtagcctccttagcaaagacttgagaaattttatcaaagtcataatttttgttttgaccccacaagccatcgaaggtaaatgattaggaatattagtcggatttaaggatcatgaataatttctcaaatagaacactagggttgattctaaatagaaacctaacctttagaaatttgcccaatacatgaagtgaaaaggtattttcggattttagaaatggaagaccagagagttgactgggaaacattaaaaggagctttccaaaaggaagcattgttgaaatatttggttttgagaatagaggagactaggcccccttttttttttcttaactccaaactttaactttcttgttttccattagcacaccttttaagttgttaaatggtgcattttttttaaaaaagtttctatatagaagttcttttaaaaacaaataaatctattttaaaatttataataaataatacttaatcaattatgtgctaatgaggtttctcgtttaattgcataacatgtac

SEQ ID NO: 82939 - DNA, 5215 bp, Oryza sativa
tcgcgaactaacttaaatataaccatcacttgctaatactttatccaattatctagtagttcttgcgttctctcgtgagaatctcatcgcgtgatgatttcgggcagtggaccggtgtcgcgcatgtgcgcgttaataaccatttgatagccacgaatcaattagaacatgtacaatagcaggctataaaccagctataaccacatatcgagaagaaaagagaagagagaagaaagcggactatagatttatagccggctgcaacacggactccaatacgttatgagtatataagagataggaccgaatattaatgatgtagtatatttttatagataactattatataaatgggctattagattgactataaatgatttggagcccagttggctatactattgaacttgctcttaacaagtactacaactgcagcgtttgaaccgatctcgcctcgctctaataacacttcatcttccgagttccgattgtccggggttggtgagttggtctgttggtggccggggcgcgggcgcgcttacctgttctccctcgcgtggagctctttgactacgcccgccagctgcgcgtgtgtataaccttgcttgcttgcctctcacagccgaagtcgcaggcgcagtcaggagctatcgggaaaacgggatttcccccagctttccaaggttcgcgggtcaatctcgcagtgatactccggcggcggcaatggacgccggcgaaatcatcgtggcccagccatcgccgcggctgtataaggtatgtgaaacttcatgagcgagctcgccgtcgacccaagcttagggagatatagggattgatattatcggtgcagcagtgcgtgattagttgtttagtttagcttgcttcttaatttgagggctttcatttggagtttataatctgattgtttggattgcttttgtgcagagtttgactttccggaggatcgcgacgaaggaaaggaccattccccaggatgaagagatgaaggtaagcacctcttgatcacgtttgaactcgtcctctgttgttaattagtcattaacttgcgtagttgtagtccgtagtaatagaaaaacttggcgggcggggtgcgatgtgtgatgatctgctgcaagaactgagaaatttttgcgtcaaaaaggaactgagaaatttttggataatggatcacataactcgtcttctaaactctaataaatggatgtatacgaccattttgtgcattcgttttagtaaaaaaagcagctacacattgttttcttgtttttgctagtactttaatatagtatacatgctatattgttggtttattacggattccatttttcaggtgtcctatggtaataattttcgcaagtgtttttttttgaattcatcactgcagacaacaagaaatatgatttaatggtcaaattgattaccctgcaaattgtgttgtgacaataaaatgatattctcaatttcaagaggccagcatgcaatttctactatcataaaatagtgaaattaattgaccgtatcaagaactgtacacaactgttaggtttttcaagttattgtactagaccgtatccacctgccagatttttgttctaaaagcgtaatttattttatattaagctattatcaatatctcgatgcaaatgtgtgttcttttttattaaaagattctttcactagggaaaaacgtccggccaatcaatttgtcccagcatagtcgccctatgggctatttttataggccttaggcagccgtacgccctgttgaaaaaaaaaaagactcccagctcaaacccagcccaaaacatctgttaatttggttttacatgtaaaatcattgggagcccgtagattcagaaacaaaggtctcaaattggatatttttcttaatttttatattatttcatattatttctaaaagattaaaaaataaattacagttttaaagttttgcaaaaatttactcctcccgccctaccgtagagcgatatatgtgacatggcaatccagggagggggtgccgtggcaattttgcataaatcgccctcccctaggacgatttattcttgagaaggagccatctataaaattgtcatgacgcaaaatttagtgatgcatcgggtgcgttatggcaattttacaaggctcccacccgaggagaaatcgccttcctgtaaagtgatttatctttcaagggggccacctacaaattgtcacggtatacctcccacggggtgccatgccacatagattgtcctattgtaaggtgatttataagtccacttttcgatatgtaaaattttaaaatgataatttattttttaattttttttaaaaaaataaacaaatcctcaaattgtgcaatcttttgaggccttatttcgttgcaaactttttcttcaaacttctaacttttctatcacatcaaaacttttttacacacgtaaactttcaacttttctatcacattgttttaattttaaccaaactttcaattttaacgtaaactagacacatcctgacttcgttcgcagattcgcagcccgaggttccaggacgaaagcctcactgcgccatttatactagacaagaaagcgaggagcaaagcgccaacagtggtcctaggattcgagtgcttggagagcacagcatttaacggcattgccacgaacctggtggtgtacctggagactctcctgcacggcagcaatctcgcgagcgcgtccaatgtcacgacgtggttcgggacgagctacctcaccccggtgttcggcgccatcatcgccgacacgttctggggcaactacaacaccatcctcgtctccctcgtcttctatctccttgtaagcatcaatgcattttgcaagatagtatgttgaaatccatatgtccaatgtgcttaattaactttgcaatccatcgtctgtgtgcagggtatgatgctggtcaccttctcggcgttcctgccgaccaccgcgctgtgcaccgtggtgggctcgtcgtgccagcagccacttcttggcgcgcagaccatcgccttcctcgggctctacctcgtggcgttcggaagcggcggtgtgcgcgcggcgctgctgccgttcggcgcggaccagttcgacgatgacaacacggccgaccgcgagcgcaagatgtccttcttcagctggttctacatctgcgtcgacttcgggatgatcgtgtcgggccttttcatcgtgtggatccagcagaacgttagctggggacttggcttcggcatcgccacggcctgcatcgcgctcgccttcggcggcttcgtgctcgccacgcccatgtacaagcgccgcatgcccacaggcacgccgatcaagagcctcgcgcaggtcgtggttgccgcgtgccggaaggcaagactccgtgtccccgcggacactactcttctctacgaagtccatgacaagatcaaccagtcgaagatagcgcacaccgaccagttcggctttcttgacaaggccgcggtggtcatggagtccgacttggaagaggaatcgaacgacgtcgcggcggatgcctcgtggaggatctgcacggtgacgcaggtcgaggagctcaagatcctgctgcggctattgccgatatgggcgacgagtatcgtgctttcggcggcgtacgcgcagctgaacacgacgttcgtgcagcagggcgccgcgatgaacatgcggatcatgtcgttcaccatcccgcccgcgtcgatggtgtccttcgaggtgctctgcgtcctggcatgggttctcatgtacagctccgtgatcgtgcccatgctcaacagcttatccctggccaacggcgagccgtcgcagctgcagcggatgggcgcggggcggctgctcatggcgttcgcgatggccgtcgcggcgctggtggagatgatgcggctggacgcggcggggcgcggcgagtccctgagcatcgcgtggcagatgccgcagtacttcgcgctggccggcgcggaggtgttctgctacatcgcgcagctggagttcttctacagcgaggcgccggagtccatgaagagcatgtgcacgtccctggcgctgctcaccgtggcgctgggaagctacatgagctcattcatctacgccgtcgtgaacgcgttcaccgccgtggacgggcggcccgggtggatatcggacaacctcaacgaaggacacatggactacttcttctgggtcatggcggcgctgtgcacgctcaacttcgtcgtgtacagcgcgttcgcccggacctacagggtgaagctggtcgtgtcgtgattgttcgttactcccttaccatgatcaggttacacgcaatcgtggtcgtattgtgttacagaagaatcttgtactcctagctagcaatagcgacagccgacagtatgtgtaaagttcaaggaaaaaaaacaaggtttgatgggctgacagcccagcagcttcctttatgggccgtgtgcttgccaccggggctgatcggtccaaaaggctactccaataaaaggaaaacgtccactttgattcgtaacgtttaaacccaaaatcgggtataaggactctctcaactattaaaatcgattaaaaatagcccctacaataatactattaaggatggtatttgctgatgtggcatgctaaccataatcaaaaccacgagttagtaagaaaattgggaatattacatggagtcgacatgtcattctcactattctttccctttttatttccctccctctctgctcccatatctctctctcctccctctttcccgtcggcagtagagaggacaggagcgatggcaggtgctcgaggatggtggcagtaaccaccagcattggtagccataggtgtcagagaggtggatggggaacaggcgacggctgaagaaacaggcagcccaatctcacctgatatgcccacaccgctcctggcccataatccccataatcattatggtcacaacgatagctgaaccccgtccatgagaagttcacctgcccatccatggaaagaaaggaagcaacggtggtggtcggaaggtctctttgagctcaagctcatctccttgtccccatcgtcggtgaggcccttcaagctctgggatccggcaacaaaagaaaccaagctactctggctctgaatggcactcgatggtaaagttcctgactagtcacgcatccaga

SEQ ID NO: 82940 - DNA, 4584 bp, Oryza sativa
attatacttcctgatgataacctcctgtgctcaagccctcaactgtaacatttccaagaatgaacagatgaaatattagcatctccatgttttcttttgatttctttaaacattttaccctttcgatcgcactaactataaatgcaatcttactatcaacagtttctccactggtttacgataccaccaaacctttatgggatgcgatacaagactttaaaaaccagtatcaacagtctgaatatgaaaatggatggcattttacagaagggctctgaattaggtcttctaccaatcgatcaggagatcctgaatgaaaggtctgaaatctctttggaagtgatacctgatgattacattgtgggtgacattgaaaatgaagcaaacaaattgattgatatattgacagacaggaaaagtgcgaagacacttgttgccatagttggtggtagtggaacaggcaaaactacactggcatggaagatacatgatgatcatcgcacaagaaatgcttttggtatgatcgtgtgggttagtgttttcaatgactttgatgatattggattgttgtctgcaattgtaactgctgctggcggaaatcctaaagaagcaaaaaacaggacgcagcttgagttaatgctggcttccatgcttaaaggaaagagattcttgctggtgcttgatgatgtgcggggtcatcaaattgaagaaaattccctagaagctcattggcatgtttgtggtcatggaagtagaattttgatcactactcgagatgagaatgttgcaacaaaactaaatgcttcttacatccaccaggtaaaggaattgagttttcagaactgttggtccctgctttgctgtaatgcatgccttgatgagaaccttcatggaaacactttaaggaatatagggataatgattatccaaaagtgtaagaagattccaatggctgttaagattatcggcgctgttctaagaagaaaggagcaaacccaagaatcctggcagagagtttatgagtttgaaggatggtcttttgatgaccttcggggtgatgttcaaggcttaactggggccatatatttgggctaccatgatttgccgtctcatctgaaacaatgtcttctttatttatcactctttcctgaaggctctaccatcaggcagcagtttgttactcaactgtggatttcagaaggtttgattgatcgacaagatgactgtagtgctgaaaagatcgcagaggagtattatgaggagttgatatcaagaaattttctgcagctggagactggaaatcgcgatataactaggtgcacaatgcatgatcaaattagatcctttttgcagttctttgttaaagataaaatttgctctggtgaagtgaaacctggcaccaatggaacttctagtgaaggactgagacatgtgtggattagcggcaccagtacaacaactaacctcgaagaaactgtgaccagcttgaagacagttattctctacaagaacccattgagaaatcaagggttagacaagctatttaaggggctcaaatatttgcatgtgctggaccttggtggtactgaaattaggtacatcccaaggacactggaatttcttgttcaccttaggctcctaaatctttcattaacccgaattacagaacttccagagtccattagttatctcagaaatctacaattcttgggtctccggtactgcaattggctacacacccttccgaagggaattggcaacttgcatagattacaaactctcgatcttcgagggactagtttgcatcaagtcctgccaagtttggtaaatctgaagcagctctctacgctgcacggtttcacagtaaatcgaacacccatacctgaggatgatccgagtgggtggcctcttgaaaacctaaaagatttgaatgcattgaaagcctgcagatactgaagatggaaaaagtatcagacttttcaagggtgaaagaagcaatgctagagatgaaatctcaacttaaggaccttgaaatatgttgtagcaatgatgatagactggctgaagcacgagaggatgattctaggacgctgaaacagatatttgattcactttctcctccacagtgtctgaaatctctcaaaatagtgagctattatgcaagacactttcccaattggcttccttgcctcacaaatctccagcggcttgttcttagtgattgcaaattctgtgagcatatgcctgacctgtccaagctaaatcaactgaagttccttaccataactggatgctctaagttgcttacagtggagcaagagtccacaggtgtcacacaggcatttcccaagttggagcagttgcacctcaaagatatgccaaagctagtatcatggataggatttgcatctggtgatatgccctcccttgtgaaattttgtctcgaaagttgtcccaagttgaagtgtctcccagaaggcctcaagtactccagagtcctaagaagtgtgcaaatacgacatgctgatagccttgaggtcattcaggacttacctgtgctaaaagaattgaatgtccaagcctgcaatgagctcaagatagtctcaaaccttccattactcgaagtgttaacaatccgcagatgccctagattggatgatgtcagtggtgttcactatctaagtcatgtctgcatcacagataaagaactgaggaaattaccagattggttgtcaatacatgcaccagtgcttcagacattcaatatagtcggcgtatcagaattgcttgatagattacttcccaatggtgaagactgggaaatcattcgtcaaattgacaaagtttatgctaacttacttgatgaatcaccattcttcacttacacaaagagctctggtgatttccatgtcgatcaaagaattggagaaataaacaaaccacctgttgtgttaggacatggaactgcagtcggaggcttgagcattcctgatcactctgttgagataagctctcaaattggtgtgtctagagtacctatgaaccgaatatccacactgaggtgggtcgtaaggagttaccttgttccgtaccttatcatggttatggttgttatgcaatttctttcgtattatctacacaacaggtcaactagggagatctggctggttcagacccttttcatcttcttcgcgacagtgtttttgcttctgcttgtatttctggactgatggttttctcctaccaaaattggagagatgagaccagtgaagaaacagagtttttttttctaccataattgggaaaatgagacagctggcccaagagacagatagttacaatgaacttcataatagtgggcataatcatgtatctcctacagttgggggtgtgctgcaattgattcatgcttgcttggtggaaggaaacaatgaaaacagtgcctcaacaacaaaaatcaagagaaatgttgcctcaaatattgaagttgtgatgtgagatttgttaataaaagggtgcaatatcttattgtcattcttaaatgagccaagaaaaacagattctgccagcctctcgcagttggtttgattagttgtatacttgtattgtattgttgtatgcacagtttaggttatagtgctctttcatatatagtttgtagtgtttgacttgccctttttcaaagagatcatagggggttgtgatgcctacagaaattgatttgttttgtttagggcacagaaattgatttgttgtatatttgtatacaaaaataagggtgaataaacaatttgttcctcccaagtttagctcagggatgaatttggtctcacatatttggacaaaatagagcattaagagtcaaattgactatggtgcaaaacttaggggggaataaattagccattctccctaaaaataaaacaaaaccatggagagcctggcaattaagttgtcatcttttgtcctgtgtactttctgttatatattcttcaatgttgaattcgattccgtcgataatcgtgaccaaatattgtatgacactggatattattacccgtcatcgtcacagtggttttcagattttatatgacgtccatatgcgtagttttaatagataaatcttcagtatttagcttgctgcctgtcaacagatattctctctattacctataaggctttatcatagtaagcaaaatacatgagcaaaactaaaactcttcatggagttttctgtaacattctttttcaagttgctcacacacctcaagtaaaactctgtaaattttagctcacagataactcaataatacaacaattaatgtgtcaaataggataaaggtgtagtgacaaaacataagattttacagtcatattttaaaccatttccatatggtggaattctttttcaccaatacattagcttagatttttataaaccgtgccaattcaagcaaaacattaatatttgaaagctgtaagtaaattgtgacaatcagtgcaagtttcagaagttaccatacagtagagcctgggaccatgagaacagaaacaatgaaggtacaaaacttgagctattatttt

SEQ ID NO: 82941 - DNA, 16361 bp, Oryza sativa
  unsure (1)..(16361): unsure at all n locations
taagctgagcatgtttttttgtgtggcaaacacttttccctctttcaccgtccatgccagcttcaaatgaaccagtgcaagcatcaacaacaagaatagctgcatcagcttgcgttgcgccagatatcatatttggtacaaaatctttatggcctggagagtcaagcaaaactacacggtacttcttagtctccaaataagccacggccacagtcattgtcacgcctctttctctttcttcactgctttcatccatagcccacgcataagcaaatgatccttttccctggtaaaaaataatttccataatacaaagaatatgaatggaacatcaggatcaagtagagtacaataacaacaataataaacttactttttctttagcctccttctcattcttgtgcatatcttttttcgatatccttcctaacagatgtagcagtctcccagagagtgttgacttgccagaatcaacatgacctacctaaacaaattgttcgtagacagtaacctatttagacaaagcacttttagaataacaaaattgttaaggaacatatgccatattcagaacagaagatgagtatagcatactattgcaaggtttagttggctcagcactcctgattcctcattagcgaacatccacttctcaggcttatattcttcaggtaaataaggttttgcagtatctacttcattcttttctaaacctagcttctgtatgtcagaagaaagtttctgggccacatcctcattctgcgcagaactgctagccctactactctggtcctccttcagctgaaaatgatcagaaatcaattgagctgtcctctcgacaggcacatcttcaggaagtgcaatgtgtttcacctttttcccagcgcctgatgagctaccagcagatgtgtactgcgtggaaccaactgttgaataataaaataatttaaattaaggtgacaataaaaaacacagctaacaggatttttttttcaacaggaaggcttatcaaccaacagatgatacaactggttgggaagatctgcaaatcgagtacaaataagtcacccttacaaaagtagcttggttcagtctttggagtgcatgacacgtgagctgtgggttgttgttgcccaacaggtgaaacatttttaagtggtatgcaagggaacaatctgttcagccacactaagtaacaatggtgcttgggaaagaaaaggatcaaaatctgcttcccgcacataagatgatctaatgtgcttcttttatatggtgaataatgaattatccttttcataactcaataaggtgttatagaaggagaagctagtttaaaggtagaacagagttgcatacacaaaattgtaaagcatctaccatttgcaccagcagtacctttctcatgagatatgctagcattctttatctcagggtcaccatcaaagtctgtagtacgagtattcactggcatcttggtacagtcagatttcggcatcgaaggtgtcccaaaatcacttggtatcccatggactgtaatttaatagttataagtacactatgattacattagaattccttgttggaatacaaattgtgattcaaagaaaattagaatgggtgaagcatgttaccttttattgaaccatccttggcagatttcataaaggattctcgaaaaaccccacacatctcacaatacaccatgctttcatgattatcgaacatgcacatggagcatctccaaagcacaggcaccgtacttgaggacttcttcgatgactctgcacaatagagtggtgacataatattagagatcaaggagctgtactaggcgcagttagcttgatatgctgaataaatcacaaaaaaaactcactgtacaacaacaaagtgaagcattcagtgcatggagcttatgaggaaagcaacggttaaatgtataggcatatgaattatttcaaaaggcctcaaatatatagaacaataatatgcatatgcaccaggattcagtaagcaaccagtaggtaaccctggtagttctaactggcagccagctatgtttcgattctcacccaatttgggtagatttgatttgcagtaagtttttattttgatggactaactggatgaatgatatttgactcattccaaaaaatgcatgttgaataacaatgccttcgagacaacaaatatctgaagtgcatatgatgggataaatgggcaaggaaattagagcaaggccaggtaatcggcagacataagctacacgatcactgcatttgtttgaacaagcaatgctattggaagttttagagtaattaagcataccgtgttcttatttgcatattcaggcaatagaggatgcgatagcaagtacgaatgcaggatggaaacaatgtaatgtcattaacaacatttaacaccactgagcaaattatgataaccgggtgaacgctccttgtaacctacaccgccgtaactaacctacacgagtagatatgttaagtgtgcatcatgaagcgactctaatagctatttcaccattcttacaagctgaggtgtacactgtctagtactagcttcaaaccttcgacataatacctttctcctccttcacggggtgctgaatgtcgtcactgtgcccggtctcaccgtaatcatcgtagtcctcatcatactcatcatagtcatcgtcgtactcgtcatcgtagtcaggcccagagacaaccttgcgtggcatcctgctgacacagcggcgtacctaatggggaacaaaaattagtgttattagtaaaactaaaaggttaataaaaaggcaaagagaaaacctagcttccagatctagaagagaagataaggttgaggcaaattcgagagaaaaagggtgtgggtagaacgggagggatggcaaagaaagaggatgtgcgtcggcacgggtgctcaccggaggcgggtgtaacatcccgagtatttagctatagtcttagtcatgctaatgacttggtcacactggctgagagcggtgttgattgagccacgatgctggctaggacctataaatatattgattgttgttttattctggatattaaatggtttctcgattgtttccttgtcatttatttatttagtcatatccatatgcatcattgatttattcttatttagactaaacctggtgaggagtgggataatttagttttggttaaactatagtgtagattagtcgtcacgaagcgaggtacacatatgcacagtagaaatcacagttctttatttacagtttaccactacaggtctgcatacatacatgcatataattgtacactagaaattttatacagtatgcattctatatattgtgcatatacatggtgattatagatatcatatcataaactgaaccatctcagtcaaagattcaataattatttatttttcagaaaaactcttgagttctagggcaattgcatatcagtccctaaattcgtagtagtcttaaattttactaaacttgtgggactcaagtgcaaaagcactaaacatgtcaggctttacaaaatttctattgatcgtaaatatagcttgagattatcacaccaaaccagctttgttgaggtggcagcaagcccttatccaaccggcatgcaagcaggtgagtcacaaaagaaaaaaattatcccatatatcaacccagctactagagaaccagtcttggttacatcggttggaaaccaatctcaagcagcagccatagtaaaatactcctcagtcgcaagaacaatcaaccacagaatcaagcagtagtagccagcaattcggctagagactcagctgaagacagagaaataatcataggtagcatatcaatagtaaacacctcagtcatgcaacaccacagccgtagcagcctagagtgagcagcagaggagactagggtgactcagagagagagagagatagttgctgttgtagttcattagtttagtacaaaacaatcagagcaaccatagcgaccatggccaggaaatcatatagacaaatcaaagtagatgagtaggagatgcttgagatccaggagaagcaagaatcttcaaatcaagaaagagaaaaggaaactgttgtaaattggattaggaggcaaaaccagcaaggaacaagaaaccaaataattcagtagcaggtcagggtttcaatcaagcaggaggtacctgagcttcaagaggagaggggtttcagctccaggaggaggagctgagttggtacatcaactgcaaggggagaagctagagttccaataggagaatccttgaaccggagtccagggggagtatctgtagaaaccagagaagagaaaatcatacaaccttcataattatactagagtcattaaccaggtaatctgcagattagaatagaactaaaatcatatcatggcatgattcttgtgtgatgcatatattagtatgcgtaggacttgggtgttgcatttgcatccattagaagatgaaccagagcatcttagattcagtaaaatattcatattaaatagtttgagcttcaaaacagaatgtgtaactaatatgatataaatattttcatctaaatgtcaagtagaagataaattctggctgagattaattatgtcatcatgtagctaatagaagaaatcagggttcagtacatgcatgggattattgatgctttattgatgcaagaacctggctttgatcataagaatctggatagtatagttatatatgtgtaactaaaattttactatagataaacaagtgttcaggtgataaatcaagaaacagtagaatgtatataaagatatcatcaatcttatgtctttatcaagtttactaactgcagatttttgtccatagtacaaatattgatttttttcgacatatagataaaatcagattttagatttagccatggacttggaaattagtatctgaaccctagcatagatttaagttatcatgaaggaggacaactatagcaattctgtcaattaggataattcaattgtagataaatcatttatcaattagtaagcagtaagaaatagtagcatcgcattatcagccaaattatgttaattagctgtagcaagaatcatcatgcgaatggagttcttaaaataagtaatattgaatctataggattaatatggttagcaggtgtacatgtatatttttagttttgaatgcaaatccataaaccgaaacctatgggcctctacagcaagtcacctagaagagaattatatcaaaatcagaaccgtaggagttggtaatataaccttgctatgatcaataccataaaacacaaaattacttatcagagcttttagtaatcagtatactttgtcatatagatcaatattcattgttcataggtcatttgatcacttttgtcatactaccatactgcatcatgcatgtaggaattaatattgaattcctgtattatgctctgaatagtagcataggggagctgatcctgctaacatattagcatatagcagatttcaatattttaatcaccattgaatacaagcatatataaggaccactcctgataatgtgatttctatttttaatcttatattgcaaaagcgtatgcttgtgtatgtgggtattttatccattcatagcatctaggcatcatttagccatagtaaaacaattagtcaagaagagccagcaagggcagtcatgagtatatcaccatcacgagagttatttaggaaaaattcacaaacatcacccatacaccataatccacagtatattaccacacacaccacacaggagagcacaaatatcatatcagaggagcagaagagagaggaagaatgagaggaagaattggacactggggtgttcaccaatggggatagggtgcagccaccagttgtgctgtgttttccaccggccatctccatgggggctgcagcagcaggaggcggatggctagggttagcaggagcaggctcgtgggagccaggggaaccgattcgcggcggcagcgggtactggagggttaccggagttggagtccggcgaccggagcgggggagcgcggcggcgttgatggcgcggcctgggagagagcgtgagggaggagaagagaacgaggaaaaaaaagagagagagagagagagaagaggaagaatcaagaaggtgggttaggtgggttgtgttttgttgggcttttgctaatgggctgtagatggtggaaactaagatagtgtttggcaaatgggaaagggaaatgattttccacccatctttaaatcctaaccatttattctccctctttcatttaatcctaacccttcatttatttctcaatcccaattctatcccccatttcctattatccaaacacactctaaagaaattaagaagtagagcttggataaaaaagaaattattatagaatatttaaattggtttaaactctttaaaataaattcttgaaaatcttgatatattattacagtcactggtctattcattttatcagattggtaatttaagtacatacaaatacaacttaactttgcatatcataatcctaatagaagtatctccttcaaaatatatcttatgaactactttattgatcaaagaaagtaaagatgtatatttctatataaatcaatataacttgtggctattaaatatatttttctcttgagaagcaaattttcttctaagtaaaataactaatcttccttaaaatgaaagtttaataaaagtaagtccataacctatatagatctagtatgtgcattcatgttaaatatatcatgtgcatcgcattcatataaatattcttgtatttagttgtgttttattgtttctttcagttgggcgtttatcttggatttctggaaatcttcgttggtttattcgttcttcaattttgggtatctcaggcaagtccaacacctttgatcaactcttgttatattttcgtaattgcaatctatatgtatcactttgcattaaattatattttctataattgaaataaatatgctgatggattggattgactggtggagcagtcagtcatattatagatgtattctgaacctgctatggtggtgggggttcagttgcatatatttatcatcataaggttaaataacaactgttatatggcattcaagcgccgtagcgatcgtgtcgaccatatgacctggaatgggacaggctggcttagtagttctttcttaatggctttatcctgcgggcttaaggactttcgcgaatcccatgagcgtgggctaccgatgagggttgccgttgttgcgggatccgatgattcgccgttgttccgggaatcacccgagagataattggcagatgggattgatgaaaagcttgtgaccttagccttgccgacatataccataaagtgtgcttaggcgctggcgtggtggcggtgtagcacgggtgttaaaaggtttaaggcttctatgggtacagcgacacacctctgcagagtgtatgaattgtgatatgtcactcccttttcgggtagaaactgcgaatgcggcaggaaaggaacctatcggaggttctaatacctatggtgccttatatgtagtagattttataattgcttaatatgagcttttactacactgtgtttatgaacatgcataaaacttccttgttggattatgggatttggagatatatgtattatgcaagtggattatgggcatatatttgttggattgctatagttggacttgttgagtaccaatcgttctcatcccctatatatatttgttggattgctacggctgttttgtacacctgggtgtacatactccctcctccttgttggatatccattagttggtaatgaatagttgggtttaaaaaataatgtttaattgttttcaaatttctgcatgcatgtcggttgtgttctatttgttttttcaaattttcatatgcatgcacaccggacggtgaggaatggcgacattcaaaattttatatatactttttgcttagttagtacaagtatatactcttttcactagtatatactatattttttcagtacatattttgttctgtttatagtagaatatactatttgttttcagtatatactgttctatcccagtatgtaatgcttttttaatccagtatatatatacacttaagtcgggcatatactacttttatagttagaagtagtataaacgcatatttaatttgttttaagcagtatatactttttaatgtagtagcagtatattatatatactaagacatgcccatcaggatcacatactgatactggctcactggcaaatgctcatagcgatgttatgcatagtggttcattagtctggtttcatttgtcacataccgtttcattcttccggcttcttggtttgcgtcatccggaaacatgttcatcaccagcatgtacggctgccgttgtgaattaatggagcaatcaaatatgttatctttgtgctgatagtttttaaagacggtatatactattttttatgttagtagcagtatatactgtttttaaactaaaaaaagtatgtactggccacatcagtatatactatttttttaaagtttgtaccagctagtgtatactgttttttagtttagtagctgtgcatactgtttttagtttaaaatcagtatatactatatatctagtaacagagtattaatacctaaaaatatgtactaccgagaggtgctattatcgactgagcttacagtcttacactagctagctcattgattggtaccttcactgtagaagctgtcagcaaaatagtatattgcaattttcagtgtgacgcaatgggtttgatctgccggagctctcgccggtccagaaaacaaattgcactgacgcagcggccgcgcaccactcggctgggaacgctgagggtgagggctgggaggatgagttgaatctacgacactgcatgcaacaaagaaattatatgcctaatcatacaaagggcctcgcatcaaacaaacgagaagtaatggatctaattaagcagacaaattaatcgaagtgattcagggaatcttttcggtctacaacaaaggacttgtattaccagcaccattgaagatttgatctggacgggagggactcagatcaactcagaagaagactatatatactacttgtctacctcctccatggatccgccgaggattagaaactgcagcactccattcgctgtcgacggggagaagtggagcacgtacgacctcaccagggaatctcgtcggagatgccaccacaaccgccgacgacgattggtacaggagggacgagagctagccgccgctcgtggcgacgttgaatggctgggagtagtacgctaggattagtcatttgatttaattacgtggacagtttgttgatccgaaaagaatgggataattaagaatcatgcatgttattgtttttaaaaacgaaaaatcaaagcgggtattctaggatgagacccggtagcatggatgatgcgaggggcctttgatgaacggtggatacaagcaggttggagtacagaatcattatatatatatatatatatatatatatatatatatatatatatataaaaggacactcatatagggcaccatggtgcctgggcactatggtatcaaatgcacaaaattgctaaattttttcaaattttttaaattgtgagtatatacctagttataataattcgattcatatctatacctatcaacaaaacaactcaaatttaactttatttcacaatccatgattacatacctaactaattatatatatggatgctatatacctagaattaaaatctaacaaaaacaagttcaaattcagttcaaacttgctttgaactagttagtaaagtagttaatgttaatacctaagtaattgaaaaagtttcatactcatttgaattggttatatactcaatttcaacaatggtgcccgggcaccattgntcaaattgagtatatacccaaatcaaatgagtatgaaatatttggatttttccggtcgtcacaccgatttttcgtccctccataaccccacgcgcacctcctctccaaatcccacatccaattccaatccaatccaaaaacaaaatcttaatctcaatccaaatacaaattggaatcatcacaaaatcctagagaaaacactactacaagatcacaagaacatatttcatcaacaacaacgacaacacaggaacatcacaagcacaaaaacaccgacgctggaaggggagggtgccgccgtcaccgccgtcgtcgtagggaccccgggccgctgctgcctcccctcccgctagatccggaggaggggagggcaccgtccctgcccgccaccgcaggagggggaacggctccgccgccggtgggggagggggagcctcccctcccgctggatccggcggaggggaagacgccgcacccgcccgccaccgtgggagggggagggggaacggccccgccgccagtgggggagggggagcggcgctgccgcggtggagggggagaggcgccgcctgttgggacgccgcgccaccgctgcctctcctcccactagatcctatagaggggagggcgccgcccctgcccgccgcctcccctcttgccgcttgccacagccagccaccgtgggagggggagggggagcagcgctaccgcggcggaggaggagagacgacggcgtcaccgtgggagggggaacacacatgaacctttgtcgccaccatgccatccgccgaagaaagagagagagagagagacgacgccgccgcctctcccgcccacgtcgggccgcagccgcctccatgccgccggatatggcggaggcgaggcccggcccaccgcctccacgccatccgggctgcagccgcctccatgccgccggatttggaggtggcgaggtccagtcggccgcctcccctcccgtccccaccaggccacagccgcctccacgccgccggatctggcggaggcgaggtccggccggccgcctccgtccctccttgtaacgccccgattttcgttcgggattaaaaatcaattaataatgcatttcctagaaattaaataaaaagttaatcaatttaatcaagtgaaattatagaggaaattaaaatttcctttaaaaatcattggccgggaatattttgtaatattctttgtgccctaatgtactctccggaattttccgtgaattttcggagctcgagaaatagtttcaatagcacaaagatcattgcatcaattaaaataaaaagaaaacaaataaaatcctccttcctctctttgggccatttttcggcccaaattcctccccctccttcctctcccgcggcccgcgcgcctcctccctctctcgggccggctcccttctcccttggcctgctcgcaaaagtctgttttgcgtccctccttctctcccttcgccgacaggtgggaccggcggtcccacccgtcagctcctcctcctacctctcgccggccaaccccaaccgccattgccgcccacgtcgccgcaaaatccggcgccctcccgcacccgagctcgcatccaaccacatggacacgaccccctccacgtcctccaccttttcccccactcaccccgcaagaaacggcgccggtttgacctccccacgagctccacttcacctccccacttcgccggccgattccgccgctccccggccctctcctcgccccttgagctataaaatcaatccccgtggcctcctcttcctttttcccccttttcctgagtccccacgccctctaccgagctctccacgccgatccccatcgccgccgctgctcctgccgtcgccgcgcctcaccacgtgtgccatcagcttcgccatcccgcgctgcacgccggcctccactcggtttccttcaaccgctatcggaaccacctccccaccgtgtaacctctctccgccgcttgccgccgaactccggccgcctctcctcgccacgctagccaccgccaagccgcgccaccgccacagtcggcttcgccgctccaagccgagcaccagccaccgcctcgttcctctaatccacaaccgagccgccctccccactaccaaccagagccaccgtcgccatttccgcctccggccgcgccgcaccgcctcttcagtccgccccgtgttgtgttgtcgccctccacggtaccgcagccatcatccgtggctcagcaatccctccgtgttcgccggtcgtcgccggactcatctccccgtgcctcccggtgagctccgtcgtcatttcggtcggcgtttcctgccgcaccgcaactccctaccctctcctaacctcttcatttccttccctaggtccctccgaccatcggccgccggttcctgctcacggaacgccgccgaaccgccgtcgtcgttgcctccccgaggagcgccgccgcctcttcccgccgccggcgacctcccgctctgcctcgtcggcccgcacgctcggtgagcccctcctcccgctccccttccctttcgcgtgcatcgccactgcccgtgagcgccgccgtcttccggctgctcgccgccgttcggcgccgccggctgctgcctccggaggccgcacgctgcccagcaccacggctcggccgagccggtttcatgccgtgcccgtgccccagccgcgccgcctcgtggccatccgatcggctttgggccgatccgggccgtcggttcccgtggaccggcggtggatcgcctcggtggtcccggtccacggtggaccggcgcccttgtgccgctgaccggtggggcccgcttgccggcgccgcccctcccctttgatgacgtcagcgaggtccatttcctttgtaaaaataaataataattgcgcaataattcgtgaataattatagaaattcatttaaatggctcaaaacttctaaaattcatatctaattcattcgaactccgaattgagccattcaacttgcaaaattcatctaaaaatgagctctacatgtttgtttagtttttatgtactgttttcttggtttttattagagtttttcctcgttttgcgtgccagcgtgtagttcccgtcgtttcggaagatcgcgttcgcaaggataagagttcagaagatccaagtgaagaagcaaggcaagtcacacactccccttgagcatgttgatcccaatttataaattttttaccgtttacaaataaatatgcatgttttgctaattacatgggatccgggtattacctatctgctcgcttgtgccatgtttacttgatatctgttctttgtcaaccttgggtaataaatcgcctagcttgtgttactttgatgacctagctagtactatatgcttagccatgcttaattaccactagctcagttgatggggtaattacagttttagaccttttagtatcagaatgagctgcgtgctcgagacatctggccatgcttcatggtcgtaattatccaactaaaatgcgtctgaatggtgggctgtgggtgcatggttttgctggtcgcacccatggcagttaaggaccggttcgcgggatgccctggaagaacttatcgtacttaccacaagccagcgtgggcaacggctgggcttgtagtgtagctctcctctagtcgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtcccatcttaataaattgactcaatacactgtagttcaggtgggttggttgggcctgttcaacgtggtgtagcgttgatcagtggagattcaatattactgtaattactcaacagttttactgtcttgctcaataaaatgttttacaactgcctttatgcaaatagcctcaaacccctccttgtatccccttgcacgtctgcaccgttggtgtggcttgctgagtacggtggttgtactcagccttgctatttttcccccttttcagaagtgtagtgcttctgagctgaagatggagttagaggaccaaggctcagaccccagttgagttttgcctgtggagtggagctgaagccccgctaggatagcctttttccgctgttgctgcttttgtttcggtgtgaggactaagtgcctcttccgtaagtattttacgctttatttacgtttggaactgtatattacttgtcgttttgtgtaccctggctggtcctggacagggatttaatacgtaaaatagtctgaaaatttgggttaaatttctaggccaggctcgccgttccgttggccattcgtgagctccgccgccaataccgccgtaatactgatctattcctactgctagcactggatctgaggctcatgatacagctgctcacttgatccatgagtgctaggtctagatcttgctgcttgagatggaatttgtgaaggggaaggagacaaagaaggggatcgagaggaaggaggcaggagacagaaggggatcggaagagggcggagaagacgagaaaaagagggaactttctggaccgagcctttggagagatcgacaggggaagagaaaaaataaaataactatagtgggggagagatatcaagaaaagaagcggcgaataaaagaggggaggaaaagagaaaattaaaaaatacacaaaacgagatgagacattagcgcatatttaattgagtattaactattttaaatttaaaaatgaattaatatgatttttaaatcaattttttatagaaaatctttaaaacaacataccgtttagtagtttgggaagcgtgcacgtggaaaacaagacaaacttgtccaaccactgtctaacttgctcattattttatttttaaatatcttaactacttaaaaaatacataattttccaattgttacacgaaaattttttgtccgtataatgattggcgccctccgtccctgcccatgccattgtcgcgcaaaggatgggaagaggcagccccccgccgatgaagagctggagccgcacgacggattccctgtcgcgcacgcgccacctcgccggactgccatcgccaccatcgctctactcgcttgctcggacgtgccggagagaaggggatcagggagaagagaagataatgggattagggacatgccggaacagctgcaatctaggacggccattctctctcccgcattgggtcgcctgtgctgctcgctaggacttctagcttggctgggccgccacgtcttcatgggctggcactatcggctgggccgctgtgcactagcacaagcgcttgtatgccgcacagtgccaggccggttcgagccttttaggccgaaatcagtttattttttaagcaactgatttaattaattttagaattacagaaacttatttgtcactattttaagacatttaaaattgttgggaaattatgatcaattatttggtcactcagtaaattatttttaaataaatgaaaccaatgaaaagatgatttttatttccttaagtgcatgtttctttgtcattgcggatgccttttaccttttttcctttgcagaggatggttaagtcagatctataactgcctcccctcccccgtttgtgaaaatttgtgaaagttggaatatgttttgaacgtgtagaaaatttgaaatatctcacgcatgaattataaagtttgagatacgacatgaatctgaatgtgtatacaatatgaaatatgttttgatatttccctgtataaaatttggagatatttgtgaggtatgtacaaattcaagatttttatgcagcaatcttaaccattcatatttagctgatattcacccagtgcaacgcacgggcatatttgcgcgcgcgtgtatatatatatatatatatatatatgtatatgtatatgtatatgtatatgtatatgtatatgtatatgtatatgtatatgtatatgtatatgtatatgtatatatgtatatgtatatgtatatatatatatgtatatgtatgtgtgtatatatatatatgtgcgcgc

SEQ ID NO: 82942 - DNA, 2519 bp, Oryza sativa
cttcattctctgggagaagaaggcctcttcctaacaattcatcataacatctttcagcttcttcttcaactgttgcagagtgcctctgtgttgagtttgtctgggtcacaatgaatccctccgcgatccactgctgggtgatgcactgccgctcgataacagatccctctgggtacaacgcacagtacagaaaacacctcttaaggtaatatggcagttccaggtagctcatgttaatagtgctccgtatccttgcagaaatgccacagaaatcgctcgagtagactcttccccattcatcctccttatgatccacatcccgtagatggcatccaatcctccttattgccattggaaggccattgcacttttgcacgattcgtcttcccatgtcctgcatgttgccagcaccctcatcaagaaaggcccttgtacgaagcaaccaccaaccatcatcctcattcagcatcttcacacggtgaagatggatagcccccatcctcctagcaacacgctcatcccgggttgtcacaaggactctactgccaggggcgccatgttgggcttgtatctctagccgcccatcccaaacattctctccccatacatcatcaatgaccagcaggaacctcttatcttgtaaatatgatagcaacagtgcttgttgttctgcaatttctgctttactgaacatcccatcagaccacattgttaagtgccgcaaatctttggagacgtgtacccatagcctggtctcaaacatggctgctgccttatggtatactttacgagcaagggtagtcttgcctactccaatagttcctatgatagcaaacaaaggacaagtagtattatagtctctggttagcagctgtatgagattatcggagtcattctcaacctctctgcctacgatatcaggctcaagatgtggagcaacatcaagatctaatctgatttgatcttctgccactggattcagatggagcagtgtactctctgatctaatgctctccagttcctgatttagttcatgtatatcatttgctataatgtagtcaacagcgacatctctgcagcacttaaaaagcgatgaaggattgcactcctgcacagagattgtaaatttaattcatggttgaataactagatagtgcaaaatatgaagataatatgaaaaatgtactacagaattttctccttgagactggaatcagcaagataagcacattaggctatttcctggtgaataacatataaatttatgcaatgcaaattaagataaggtactatctttactcgcggttcatatgccaattccagtgatcttggcctcttgacaggaaaaaggaaaagagcactaccagttctactgactaggactggtagatgtcatactgattaagaagtgatttcatactttcttttttatgtagtcttaatgctaatgattttatcattttaaaggaccaaaaacagtagttttatcccttaaagaaaaaacacagtagttctaccaaaaaaaaaagacgaatcaaataaaaatagcaaacctgaactaccagctaaggtctggtaatatttcaaataatctttctgtcatccaaactatcaacaacatgtggccacagaagcagatgttagcagtacacatatatgttaaggtatatttaggatatgcagcccaaattgcctttgattaaatattagttcgctaccacaggaactattggagtgttattaagtattagttgtagagaatgttggttacgatagagtgaatggttgtttttgctagacacatgtatattcagtacacagttcgtggtcttacatgtcttaataaccattcatagatttatagaaactaaaaaaaaagagtgtactgaatactgatactaatatctgttaaaatttcagcagaaataacacactagtttcctatatatctgcaataagaaactggactgagtctgaaatgtgtccaaaagtccatcatacatttgtggtgattgattggagcattcctagaaggaccgagacaagctgaataatgcccgttgcctccaaccccatctaaaagttgaggctatacacattatgttggcatatttgagtatccttagacaacagtgagccctcaaaggctcaaagctcacaatattcaaatacattgtatgcaagcatttttttttttggacaagcattggaaatggtcttcaatgaaattacaaatctaaataagctaaaaataattatcaacaaaagcagaaaggaaaataacaatttggagaaatatgttcccggggttaaaacaaaattgatgaagatttgagaaatataacctgtggttggaacatttggagcctctcttgttcaatcctgcagcggtcaattatgttttctgcctcataagctattcctctcaactgcttcaaccaatcccttgtggtttcatactgcacaactgtctgctcagcatccctgatgatagccgacatggtctcaagcttcctctt

SEQ ID NO: 82943 - DNA, 745 bp, Oryza sativa
gagcctccgcgcgagcccccgcagctcgtccgccgccgcgtgggcgtggccgccgacctccgcggcgagcgcctccgccgagcgcgcggcgggcggcagcgccgccgtggcgatcatggcggcggcggtggcgtggcttccaacgccggctagtcgatcggaggaaacgagagcttgttggcgtccacgtcgttttaatttaaagtcaaccgcagcgaagattgggtcgtggctgtcgtcagcttacgcaagcaagcagagactgtttcctgatttattttatttttttggtcggagtaaccgataaatggctgtccgtccttttggctgtttaatcgaggtcttctcactcaaacagtctgtgttggagaattgtttctaaacctaatgatttaggctccgttccacgtgtggtgttttggagattgatttttgttcatcatatgtgccccaaatctaaaattcattttccatcattttatttgtcaaatacttcatttattcaactctgttcagaatcttaataaaatcattttttatgttaatatgagtccaagtgataagtaaaaccattctaagcatggctaagcaatatagtaaactagtgacaatataactcatattccaagtagtaatagtaatagaatatgattcctaaggttaggaatgagggatatggatatatgtggggttaaggcgataatgcaaataataggagtttgtctaacaaatttaacaaaatttt

SEQ ID NO: 82944 - DNA, 2896 bp, Oryza sativa
ctcttttcttgttgggggggggggggggcggggggggggcgagttaaaaatgtgcatgcttccttattcttcaccaccacttaagttttttttttggtgaaaaaactaatcaatatgaaatgggaggaataaataatatggtcttataagtacatctattttctctatctatttaatgcttgaaattatagaaatttacccttttattcatatattaattgaaagcagcgagacattgagatgatggacataagttggaagacgaatacgtgcgtacaaattctgaattccaaccaaccaaagtaatgaaactacttattttccctccacatgtgtataagaatcgaggaaatccttttttttaaaaaaaataattttatcttcttattccttaaatataacgttctaagtgcataacattaaaaagttcaagttacacagtaaaggaaactaatgaattgattatttgtttgaaaatttggtactcaaggagcataacgtttgcatcaagcgggagcaaaagatgtcggtagcattcttttcctagaattttacctcaattttcgttagcacacttttcaaacatcggtgtgtttcatgtaataaaaaatctttgtgaaagttgctttaaaatatcaaatatatcaatttttcaagtttgtaataattaaaacttaattaattatgcgctaatagttatctcgttttgcatgtccgcatttaatctaaatcttcgtcagattcgaatacagtattctcatttactacttcattctatcctggataaaagattgcaaagaggcctggcttttttttattattgtccttcccagtccgcagtccccactctcgagtctcgactcctccgctgctctccactcatcaatttgctcctcgctcgacctcggtgtctccatcttcgccgcggtacgaccgtatcgctgctacaacggccttcagtctatggccttcttcgcatgaagctcgaaggcgcctgcgtctgcaagattgaagttgcgccggcaacatcagcaaagagaaatctgcgatgcgctccctgtcccccacctcctgcaatccctcatgcttctcgggccagcggccggatccgcagcccacgataccttcgcccgccgcatccggaagacaactcccatattcccaagccgatgtgattatcggcgcaaaaatctggtagtgagctttggtgctggacaaagcaccagtgagtgtgagttgtgcgatacagctagcgttgcttgcgtccattcacttgctctctgcctcttttgctcatttgcatcaccatccagtatcccttagtataggctcggtgattttggtactcgcctgcaggcaggcatgcatgcatcctacttgggtattttcctctctacaagttcaacgaaagatctaaagagaaccagtgatcctagggaagacactgcttgattttctttgctgaaaacatctcaacacgtgccttaatttagcaccaattgcaggtaattttaaccagttctttggtgttctaaatggaaggagtataaataaaggacacgagcgggtggttcgccgtggcgtcatcggccgtgatgcgcaggtggcggaggatccggcacggcgccaccgctcactcgcacacgccgcctcctctcctcctccgctagctagcgcccctcccttctcctgatccgggccgatggccagtgccgtccctcttctttctccccgggttcaatggatttggcaagtctgtattgggacgggcgttctcgagggtgactcctgtcggtgagatagaagcgtttaggaagggcagcagcatggcggcgggaggcacaggggagggcgaggtggccgggcgaatgtgaagaagacgagcccaacgccgttgagggagaacatgaagcgggtggtcggccgcaacgcgcgagtagcggaggagccggtggattagggtcgagcaattctgcaaataaaaaatacaataactccgtagttttacgatgaggtccaccgcaacgaactttagccgtcgatacttaatcaaacggtgcaagaggagtgccaaggagacacgtggcagatttctagagaggtgaagcttgatttctagagtgccacgtggcccaatcaagtgccaggattcgggccctgcaatcggtatataagattgggttaatgggctttgggctactcaaattaagtgggccttgagagtttcacgttgaaaaagatcacggaaggacttggaataagttcaccgaaggtccctcaacttaacaacgagatttttgaggtcccctaaccatagaaccagaaatgtgtacccctaaacttacacaaactatgcacacaagatcctatggcagtatatatgggtggtttcgctgacgtggcatcctagtcagcaaaaaaaaaatgttacgtggggcccacatgtcagctgcacatcttttttcttctcttttcttctccttctcttctcttttctctcttctctcttctcttcttcaggccagcggtgggcagagcagcgatgggaaagcgcggatgcgggcggcaggcgagcgcggtagcggagggaaacactagtgtgtactctcgttctggctcggccagtcgccccaccgccgctcgcttcctggctcaggtagggctgcaatttcgcgctccatataacgccgctgtggacgtacagcagaggccacgtgcaaaccctgcctgcgccgtgtgttgtcatacgggcgtgtggcggtgggctggcggccatgtccccgtatgaggctatgggcgtagcggcggctgggacgcagctataggcggaggaggtggcatcttggattcagtgtccatcttggaggcggtacgtggtgccccccgagtaggggtg

SEQ ID NO: 82945 - DNA, 7845 bp, Oryza sativa
tcaccaacgagaacaagtagctcaagggacaaaaaaggacaaccacaaccaacaaatcaaatcaaatcaccataccagcgccgcactcgaggagcgtcacaccggttgagcttttcgccacgggttgtgaattacttgtggagcaagagaggagaggtgcatggcgatggccggccaggttgtcaccgtcatcgtgtggtgcgattgcaatgtggatagcagcaccctggctagggacgacgtctatggcatgaacgataagcatcctgtcgggtcgacgagttcctagacccaagcttgcctgacggagcgaacgacgggacacgctccttgacaggttccatgagcgcactaatcctagtgctatgccgctacgctccgccgccactctcgtccgccatccgctccgtccacagccagccacctctcagctacctccgctccgccgccgcgctcgcccgccgtccgctctgcccgcaacccgccgccgttctgctaccgtgctcgcccaccgctgcacttgccccgccgctggcccaaagaagggaagagagaagagaagaaaaaagatgtgcggttgacatatgggccccacgtactttttttaatttttttttctaactaggatgccacgtcagcgaaaccacccatatatattgccatagaaccttgtgtgcacggtttgtgcaattctagaggtacacattttttgttttgtggttaagggatcttaaaaaaatctcgctattaagttgagggacctccggtgaacttattccgaagggctttgaattagcaacgctcctacatagtgaattttttttatttttaattttttttattaaaagttttacaaaaataattttccattttgaaaattgacggaagtagtcgcctaccgccctctgggaaggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcctgcaaatgggcggcgagggggggcatggaattttgcaggcggcccccttgccgccctccgcgagggcgattttctactgtgcggggggccgcctgcaaatgggcggcgagggggcatggaattttgcaggcggcccccttgccgccctccgcaagggcgattttgtactgtgctctatatttttgtataaatatcaatagttatcaaatctttttatattgaaaactatacaagattaaaatctccaagactggtaaaatacaattttattattttttagggcatatttggattgttaccgtacaaatattttgttaccgtacaaatattttattaatttttagggcatatttggattgttagtgccaaatttttcttcacgaccaaatatttggtaaggtaaaattgcatttgatcatatttggtttgctgccaaaatgtaaaattgtagtgaagaatgttctacataatctcaaatctagattacgtattaccaatgaataggcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtaaacaggcagcgccgaaagttgatagtgataactcgagctgccgcttttcatgtgtgctgttgtggactgtgcgcgctactggatctgacactaccgtgcagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccgtgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtacaggtatttaacagtattaataaaaagtaaagtaccgtgtgggcgagggatcgacgctccgtgagaggaagagctggcgaacgcacccgaagaggtggcgaacgcccctgcggagctcgtggaagcgccggtcgtgcctgcggccatggacggaccaattttcttgtatcgatccctaaagtacgcttgcgtgccgtgaaggatgaattcaacaatagcaaccaatggaagtacccgaactcctcgcattacccagttgtacacctctgccaaattggttgtcattatgccataccgagatccatcggtgtcgaacaatagagaccacttctccttaggctcattctcaatccactgagtgaaatttctgatggacgaccctgacctccttctcattgttggtgggtcatcatgtaatgcaccaagaggtatgggaggctcgtcaccttcaactagtggtctgcgagattgctcatctgtttgcttcgttgtcaactcatccaacttgtcccacaactcattaaatttcttctcttggttctgtgcatagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctctgcagcacactctttgttcgatcatcaaccgatgtaaatgtatgtaggtcatagtacgtattattattcctctgggcaatggtggctaacaaacgaggcaaattatcataagaagcttcaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcatatcttgcaccctcaattacctcgttctccttatactcccagggtacatgatcaccatctgatataacaagtccagagaagtcctcatttgcccaatcagtggccattacatcaccttcctcatcggatgatgcgtcgtcgtccacttcctcattatccgaatcttccctctccatttcatcaacaattataccgactctctccccctcatccgccatgcccatagcctgctcctcccttggttgattttcctcattttgcatcgatggtccaacaacatcccctgcattgataggaccctctacatcttcggtttgcattgaaacatttatatctttctcttgtaccgatacaaatataacgaggggccatgaccgttcaaaagccatttccacataccgtctccaagcatcagtgctgtccatcggcattagttcccaaaaataaccttctgttgcacgactcactacaactgacactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacattacattctccagatcaaactaaactacatcttacaattaacactactgtctatgtctcaattcatactattatattctatgctctggatcttcacatatgtgctgtgtgctacagatgtgctaaaatatatggaactaaaactaaaacgcaacatatatactcaaacataacatattagtacaaatgcaaaagatgtatgggagcatacctgtgatgaattgagcgaaccagcagggcttcgccgctccccttctgctgccctcccctctctctcttttgttttttttggatttttagtgaatataatgaaatttcacagaggagggactgggctttatagggggagaggcaaaaatcgccctcccccagggcggcaagggggccgcctgcaaaattccatgccccctcgccgcccatttgcaggcggccccccccacagtacaaaatcgccctagcggagggcggcaagggggccgcctgcaaaattccatgccccccctcgccgccaatttgcaggcggccccccgcacagtataaaatcgccctagcggagggcggcaagggggccgcctgcaaatttcgttgacggccgtcgcccgagagcgaacggccgtctgccacgtcattttcgccgccctctgagagggcgagggcggtaggcgactccttccgtcaattttcaaaatggaaaattatttttgtaaaacttttaatacaaaaaattataaataaaaaaaattccctacatagtttggttgtttggctgcgttggttttaagaatagcaaaccaaacaaaaaccaaccatggaacaaacggagaaattaaaaccgaagaaaaaaccaaacatagaaaaaactgctacttcggctcggttcggctcggtgtccggttttctatatttttttcccacccctacccccacccttaatccaagttactacctattctcagtcaacccaacacaaacactaaaataaagataaattcaatttccatttggatttaaattgaaggtccaactcaattcaatctaaacacaaatatagatatattcaaacgttggtctaggagcgatcgatctcatatagttgtgatgagtttggtgctaagacttccccctcagtggcttgtgtttgtatggtcggtgcatcattctcaactatgcgctccgatgcacggccaagcttgatggtcttttgtgtctccccccctcctcttaatactattagaatgctatgctgaaaaagaaaaaaaatagtactgctacacgtaaatactcatgtacaactaaatacatgtactcgtagatcaattaaagaagaacatctttacatacgtacgtgagttgtttagttagatcgtatgcataccattttccaaaaaaaaaattcgttgaaggccaagtccattgtgcaacgtgtgtcaaaaggtcaaaacgtttgtctgcgcctgctagtgcacttgcacttgcattgcagcaggtaggcaaaacgaagaccacccaaatcttccgttcccatttttcgtgtcccttccatcatcctttccccctctatattttcgaggcgggggctccaccgaccaaacgctgcgctcggtccaccacacacctccgcctgcacggatcacgaccgcgcggtgcacggcgtccacgccccgtggaccatgtccacggaggggaagaagaagccgacccaacctaacccaacccaacacattcttcctcctccgcgtttgctccaatctctttctctctcctcctcctccacctgaatctccctctctctcctccaagaacaggggcggcgaagcagctaagccggatttcgtggttggtggcctctccccttccaccaccaggctcgccccgccgctgccgcgaggtgcccggccgcctgtttcttctctccggtgcatttcgatctgattcccccgtccgatttcgtgtccgtcctgcttcacacccggatggttcgaatcgattcttaaggaggtgaggcgtttaatttgttgttgagctacgtgtaaatccccccctttacatatgcgtggagagattggagcgggcgtatggagcttcgctgagctcacggcttcttcgggataggcgggggaggagggggtgatggtgccatggttggcatgaagcttcgtttctcattttccatggtgttggaatgcagcttctcagcttgagcaatttgagggaaatattgtcaaacccagggagcgttttctcagagcagtgattataatttttcggtttattagcattctttttttaagtatacaacttcctattttcatgtaactatatattttcaaggattgttactgtttaatttgacatcacggctgcatggatccatttcctcctagatagttgcagcttcaactcaatctgcttacacgcctttcttgttagtgctataggtttatcgagaacctcataaatcagctgtattttgttcaggtaatgaccttcccccttatcaaatgtctcacctggaatacctaccagaacgttatggagctggataactatgatttctcaacaattggattattctaaagcgttagtggcgcctgttttcttgtaacggtgtgacctgttgcagattggttgctttagattaactttgtctgtggtgatgcaccatgcatctgattagtcaaaactagcatccagtaagcgatgccaaagtgattgaattggacatagcatggaagctttagagtgaatgtgttaattgataagtgtagtccctcctttcatttgttaaaagtctcatctgtttatttggacaaaaaaaaatctttggttgttataaaatggaatacttatgtgttgaaagatgaaagccattaagcatatgtcatgtcaagttgatctatatgtcaacaaacaatttttaatgtcaagttgagaggctctgtttttaacttgatcttaaggtgagttgtttagctacttgctgaaaacataattagtcgtgcattgtctgcccataccatatatagctgcaacaaggttatcttactgtgcaactgcacaaattacaatgactagtagttgttcattcctcagtattagtaactttatttaagtgaaagttttataatattctatcttttatttcagaaacaaatgaatcgtggcgaatgaagagtttagcgatgtgccttagttgaatggttccattgccaccctgtttggctgattttgttcagacgaactcatctt

SEQ ID NO: 82946 - DNA, 10524 bp, Oryza sativa
aaatccgcggccccgcagcgcgagaaacccttcaccgcagaaaccctagagctcaccctagggcgccgccgccgcagccatctccgccgccgctcgtcgggctctctccatctcccatccaggtaaacggcacaccccccttggatctctccctctcttaggttgccatttggtagagtttttcttgttgatggaatgatgacgggtgctggaaatgtgcttcgctaatgctagtgctgcgatctgtgatccttttgctgtgagataattggtcttgctgtcgttagtgttagcttctacgcgttggcagtaggttcttggatcgaatgcagcagcgggcgttgggtttacttgaaatgttctgtttttttaatgttacagtttcatgtgtgaatcatagaatatttgtttccgtattgatgaaatggacaaaagtatggttaggatctgaatatgtagttccacgtttacgggatgtgtacaaacttgtatatgttgcattctatctctcctgattggttgttacgctcatttacttgctttgtccttacatgctagtgttatatgttagattcattctgtcatatatatacatatatatatacatatatacatatatatatatacatatatatatatatatatatatatacatatatatatatatatatatatattattccttgtagtgttgagctaacaattaggtgaagagaagattcgacaaaattgatcaagtgttgcatttctctacatcaacttattgttgaaggtgatgaagatctagaagagcaaggtattgttagtgttactattttggtaaaaactaatttcttatggtttttatttaatgagtttcactacaattgtttctgctatgctactttagtgtgcccatttcttagtaagttggttcttactaaggaatgagccgtagaccggtattctatctcggaagtggaatacgtgggtcgctacagcgggaagggaaagcagctagagcgcacgacgacgacacccacatgctgcccgcggagtggatggagaacggcgaaggctagcaaagaagcgaggagacggaagttgaggccgacaaaaaacggggagatcgagttgggggagtcaggaggggaggagagagtatgcggcggcggcggcaaatttcgtagcggacgccggcaccacctgcgacgggagtacgagactaacactggaatcagaaaatatattattaagacattttgaaaaggagactagaaattcttaatttaatcagaagaaaattagagtttaagaaatatgatttaaaaaatttcaatacaattttcagaaattagagtttaaatacaattttcaaaggctcgagtagaaacacaatttagaaattactgaaattataaattttaaaaaataagtattgaaagaaaatccatctagaatacaacataatattaattaaatttcggatctgaaaaatatattaaaagaagagtccatctaaaacacaaacaagattaattaaatttagaaattaaaaataaaataaatcccaaaattagattccactacaatttctaaagagttcaagtagaaatacaaattataaattactgaaaaccagaataaaatatatagtatattggaataagagtccatctagaatacaaaataagattaattaaaattacaatttaaaaataacataaatccccaaagtggatttttatacgaattccaaagaattcaactaggaatacaatttagcaaactaaaatacgagaattaaaataagtaatattgaaagaatagtccatctaaaacccaacattatattaaataaattttcaaataaaataaaatgaattctaaaattggattttcaatacaaattccaaagaccccacgaagttaacccctcacttccccttttatactgagttcggttattcactttcccaactcatatctctcgtttgacgtggcacactttttaaactactaaacaatacgtcttttgtaaatattttctataaaaagttgctttaaaaatcatattaatcttttttaaataaattaactaataataaattaatcatgtgctaatatgttgctctgctttgagtgcacggagtgttagttatacaactacatattctcagaatttgggcgacaatctggactgtttggaggagatgaagatggaaaaagtatactttgactccttcaacaggtatatcgactcctccaactatcaaaaccggtgcaaacaatgtccctaggtggttttgaaggtggttttggctgacgtggcgcctacgtggtggttttgaccaattctttgtcctacgtggcgcttacatagcattagaataaaaacaaaattttgaaaatacatggaacccatatgtcattcacacaaaaaaaaaatatattgtgggacacacatatcatccttcctctccttcccttcttcctccccatctctctcctttatctctctctctccccccggcttttctcttcaccggaggagcggcggcggcggtttggcgcggcgccacggcggcggcctccaccggcgggacgcgtacaggtacggcggcttctaccaccgtggggagggattccatggcaacgagaagcagctggtggccgagatgcccgtcgagccggcaacggcgaccaccgtggtgctccccatcgcggagccagatccggactcgcgccacgatgccgccgtcgcggccgctgaggagccggtccatggcgaggccgatgaggaagacgaggatgagatggcgagtagccggacttcaccggagggatgtttgcgcagaccgttcacatgccgtccgatgtctgtctcctggaaaatcacaaagcaggaacttcaacttcatctcctctccttttgttgcaaggggaacagaacagcagtgacggtgaaagaagaacgggagtaaaaagcttttgttttcacctggagcgccttgtacgtgatgtccatgtctgccaggctctgcagcaagctcagcagctcgtcctccggctgtgaggaaagaaacgaaaaaacgtgcagctcgtgtcaaatttctgtggtttctttgaattcgtcggcgaggtggtgaaagaaaattaaaaaaaaaaacctcagttgctgcagccgccggcggcggcggcgtagagccgctccacgaaaccgtcgcgccgcgcgcgcagctcgtcggggcggtcgtgcgcggcacaggccagcgcggcatccacgagctcccacacgccgctgcctcctcctccaaatgccgccagcgcgcggggcagccactcgtcgtcccgatccatctcccccctcgcggcggcagcggcgagacccgacccatccgcgccggagtatatatcggatctttccaactcagcgccacacctcacaaaccccatcaaccaaccaagaatccgacaccaatcaagaacccaacctccccatcgccactgccgccgctcccgaccgccgccgctctggtgaagaggtcggggggagagagaggtaagggagagagaggggaggaagaagagaaggagagggaggatgatatgtgggtcccacaattttttaaattttgtttttattctaatgccatgtaagagctacgtaggcgtcacgtcagctaaaaccacctaaggatattgtttgcaccggttttgatagtttgagaagtcgatatacccggttttgtggttggaagatataaatcatactcggagatagttaagggaattaaagtatactttttccgatgaagattgatagaagctcctcaaacaggccgcgttgtagcaggctcatgcggtagttcagcccaatatggcccattaaataaaggttgcgttccacttggatcgctaacgttggcagggatatcttcctttttcgggggaagaaatggcatgtagatagacgattagaggtagagcgccaacgagctcttcacgtctcaactttccaagcccaattgggctaaaagccaatgcaatcaaatcacatgaatacaccatacaaatattacaattacaagaaatacaaattaaccgatacgcccgaactccggcggatgccggtggcccggcggcggctatcaggcaacggcagccagtgccggcggcgaagcggccctctcggcgacgacctgctcgtagaggtccctgatcttgagcccgacgatggtctggaagagccccgtgccgttgttgctcccggggaagtcggcgtgcttcagcatctgctgcgtcacctctccgtagtacttggtcgacaggttgctgaggtgactctccacgtagatcagctcgtccagcttgtcgaacttcccgtccatctccagcaccgaaacctgcagctcacaaaaccacatcaattttgcaatttctcctcacatctgctgaatcggtgatgggttgttgataattactacctcgtggccgaagtaggtgtccgggaagtacgagaatttgatgccagggtaggagcaggagagcttcctgccgcaggggatccagctgatggtcgatccttcgtcgaagaggtaggccggcgcgaagtgctcgacgccttccttcatgatcagcttcacgcgcagcaccttgccttcgtcgccgtcgtcgtccgcggcggcgatcagccgcgtcggcaggacctcgatcacggcatcggcgtactgcttctgcgggtctgcacagaagacgtacacaaaaatggatgccagtgttgaccttgttgagctcgatcttttgatttagtggtggattagtgtgtttttaccaatatacgcatcgaagtcgggcttccgggcttcaatgctggccttgatgctctccaggctgtgcccacgctctgccatgtctctctgcacaaatgggacgccgcaaaatgctagtactattcataagtaagagaactgaactctgtcactgttcccgagcaaatcgtgacacaaacagacctgaattttccatgcaaacttgatgtcgctgctgatgtccaggtagatgctgaagtccagcaggcccctgacacgctcatcatacctggagtaacgcaaacacaacacacgttaatgtgcattgcccggcatatagtatagtagaagttgtagatcaacatgagaagaaaaattgcaaaaattaatcacattgggtgcaggccctcgacgacgaggatcttggggggagtgatgagctctggcgggtcgaggaggcccgtggcgtggttgtagatgggcttcgcgacggcgcggccctccttgatggccttcagctgccggtacatgaggtcgaagtcgttggcgcgcgggtccagcgccgtcacgcccctctccttccgccccgcgcggtccagcgagtggtagtcgtcgaggcagatcaccgtggcggcgtcgccgaggagcgtgttggagcccgggttgccgccccacggaggcgccgccgccgccgcggtgccggcgccgagcacgctcgtcaggcgacgcacgaacgtggtcttcccgcacccggagtcggcagccagcccgatcaccaccgtcccgcccgccgccgccgccgccgccgcggagcacgacacgcggaacgggaacgccgccgccctcattgtcctcctccacctcccgcttctcagcaggatggtcgtcgtgctcgccgagctgaacgacctggccgccattgatcagggcgttgcgaagctaggtccaagagagtgagaccaaggagtagggagagcttgcagtgtggtgtccgttcttgcttgatgagttgcttcctctgttagctcgctgtcagctcagcctcagctcagcgacgaaatatcgatcaaatgagttgagctagatgtactgcaggatgcttagctagcttgagatgattgagactggattttcatgggctttctttgtcctgcatacctccatgccgatatctagctagagacgcgcgcagcagggccggccggccggcggaagaagagaaatcttggtggtggactggtggttttcgcggggttgcagattatggtggtcctacgtggtggcggcatgagggtggccggctgaaaacggagggcgccaacgtatgtgtttgtttggtgtatttggcgaattgcattatgattccattggtgaaaatggtgattctcttgaaacacactcggttaaccatacaaagatactgagtactactgattctactcttcctcttttaacgcaccacacgtgagttgtaggatttgccacgagcgcattgctcaattgtttatccgttgatttgagcttgctttaactgcctaaactaactgatagccgcaatcacgcgcgatgttacttgtcactgatgaccaaggctagccatcctagaacagactctgtcaaagaaggtacaaacatgggtttccaccgaggagctggctgaaatggactgcagaagcggacgcgtcgagtattggagcaacacagaagatggcccatagtttgtcaagttgctgtgaacgccaaaacgaccgcccaaactgacccacaggggtgctttggtttccattcaaagttcagggcgctggttctagagaagatccctgccacgctgcatgattgcatgcaccgccgcttctctgccttattgtcaaagagtaacagcaaccgtaccatgcgatcagcaagcataccggactgcggtagcatctttaacagcaggggaaaaaaatcaggtagatagaaattccaggtaggcatcacatacaattgtgcagataaaactggaaacttgcaacgaattgtgccagatgaatctgctttgagttagatggatagtaaaaatcgggaagcacagcatcaagccaacaatccgcaagggtgcatatatatgatccaggtctgaatgcaattttgtgtctattttcccgagcgagaatagccttagctcatttaacggtaaccaacaggcaaaccggcgatctacccaatcacatacggactacagtttgccaagaatcaaaacacctcgttccagacacaaagctatgataacgatgctaacaacctaccccataacaagcttgaaaaggtttcacaataaactgacatgaagagacattctcagggtgtactgatttgtatgcacagaagcgatgcatgaagaggtgtgctactggtgatcaccggaaactttccatcatgatgaatagcttcacttgttccctctgaagtacatgtacactctctgcatccaccgatagagaagtaataaaaaatattaaatgtacacattttgtaccctttaaaaaacaaacaaatcaagtaatgatcataaccatggacaagctgggtattcgatgacttgcaggaaccaaaaaaaaaagcaatcttcaattaacattgagtataaacttggacactaactaataggtaatgaaaattgggcagtacaatggaattgtagtaccaagaaattaggaaaattacttccccttgacatttattttagtgaactatgaattgtattcacgaggtttactagctctgaaattaaactaagaaagggtgcagagcaatgtgaaagcagaagtacttaacttttagtttacatagcgaattactacaatagtttccatttttttgaaactgtggctctaatctcaatgcataataatctacagaaggaatacggaccacttcctcatgcattcagtatcctgacaacaaattactactttattagttactactatgcagatatctataatatggaaagagaagtaacaagtttaatgctttaagcagaccagaggttaagaaatatgtggtgcatttaatacatgcatagagcattcataagttaatatctgccttacattcatttcatgtgtgcaccctgatttaccctaaaataacgtaggcttctcttgtgctaagctaactagtgctaaaacacatatatataaggacagagaaggcgacagatccctcgaagagttatggatagaattgatagctcatttgacagaggggatatcagtttatgagaacacgattttgttccagacctgaagaactccaatgctcagcagtgtctccaagcaaaacagcgcgaaccccacaaagtaaaagatctgcaagaaaagaaaaacatcagtacttaatttcctactagttggcaccttaaggttaattcaaagtgctggacacacaacatattgcagaaaagctatccagcttgcttatttatcaggaggatttgaaatggaatgaggcaattcaactcaccccaattatcacatgctcagaaaaggtgtctatggcagccagtatgcccctgataagcaaaagagaaataaacatgtaatattaatatctcagaaacaagaacatgcaaaaaatactaccaagaatgagctctagaatttcataattcatcagtcaatatttaaataccaaataactgcatattaataagcaaacacttgatataacttacgttaatgattttccatgaaacacaattggcggggcaatggcagcaataatgcaaaagccaatgtggatctgtgccaaatatcaatgaaaagaagatgatatgatccatttgataagcagtagttgtaatgtcaagaaaacataaaaaaacagttttcagctataacttaccaagtaacagagaaagaaccatccaaaactgaacgcactgttagtcctgtttaacaagtaaaagaaagtgtcagatacaataataaagccatggttccagaactatacagcacaaaccatagttcaggtccactgaaatgttttatactagctccacaaaggagcagtgcaggtctgcataaacttttgtgcaaaagagatgcattctctgtaaaatgcactgatggaaataagcaagataactgaaatgcgctaactaaaatataacacctgtagcaagatgcgctaacaaaaataatactctttgaaagacacattaacagaaagagtggtaaagcagaaaaatatacctcatagcacggtagagaggcctataccatatcaagtacgagaggggaattccaagcaaggcatagatagtggcaaggaaaaacagcttcgaatctacaagcataagacaacaaccattaagcatgagccaatgtacaaaaacactttggcatttatagaaacccatgcaacccacctccctccttgatccaacagactatgacagcgatgaagttccatgagaggcaaagcacgatacctgtagattaaaataacacagacaggacatactgagaaaaatcaaagctgcctttgaagcgcaccgtagctaccaccacaattgattaatccagagactcagctagataagcaaacaatgtagtactaccaaacaattgatgtagcaaattgcaataacaatgtccaatctacacctaccaagccagcttgcgaacgcgagatactgcaatttctgcaaattagccggtatctcattggcaatgtcatggtgaatgatcgggaagaatggtggccagttcttatcctccattggcactccagctgcatcaaaaaggaaaaaaaataatgcgaaaatgagcgcactcctcttaacacaactggcaattgaattatcactgagtccaccatcagtcaaacaagagcataccattcctcagcgcttcctccctccttttgatatcctgcagccacaacaaaaccacaatgatacactaccgaatcaaccagcatttcaaaagtttacaagtggaatggagagcaaaaacccaccgcctcccgccgcttcagatctgtttcccacgatgagagctcccttgccttgctcttggagtcctgtgcagcgtacacgcccccaaaaccctcagattcgcgtacgagaacaacaggagaaaggaggggggaaaaaagagggagcactatcacgtaaagcatcttacgcccatggtgtcgagcgggacatcgacggtggcgtcccccctgccggcgccgaagccggcgggctccgtggggcggaacccgtactgctgcctgctgccgccgccgccaccaccacctcccccattctgcagcgccacagccacacctcatcagaaaaacagcacgcgaaaaaaatcccagatctaccaccactccacgatccacgaacacacagtaaccagacaaaaaatcaccccaaaaaaaaacgaagcgtgcgaggagaggagtgtcggctcacggagaaggggttgtcgtcggcgttgccctcgtcgaacgggttggggtcgtgatgcatgccgccgccgccgccggtgacgcgccgctccttcctagggcttggctccgcctcgccgccgcgcgtggaggaggaggaggaggagaacggcgggtaaagcggcgagtggtgcagcgcgtggcttggcttggactcgagtcgcttccggttcaagcggttcactcgcttttgcgccgctttttctcacgtgacgtgactgaattgggggggggggggggggggggg

SEQ ID NO: 82947 - DNA, 604 bp, Oryza sativa
caaaatcccttccaaaccgtatatctcatccaaccaaccaaacaaaatctcatactagccaggatgaactaatgcaaccaaccaaacagttgcatgtgtatcatcctagccaggctaaactcagcctggatatgagagatggaccaggctaaggcaatgcaagcaaccaaacacacccttaaggaatcgtacgtgaaaataccatccctcattttccctctcaatacttcaaaaatttcatccttatccgctctccaactatctcacctcctcatccttatcctcaccctcatatgtctctcactttctctcctctcctctcacgcactcatgcgtcacggcagcaggcaggtcggtagtaggcaacggtgggcggctcggcagcaggcgacggcgggaggagtagggccctgagcggactcagccggaactacgtcacccctaccgctgacgatgacaacgagatggccgggagtggcaccgttggccctgcgaatccacgccgcccccgttgacgaggaggaggaggaggtggtggctaggagcggaggcggacactaacttaatctgctcccctggcggccgtccccatgctccctccatg

SEQ ID NO: 82948 - DNA, 7234 bp, Oryza sativa
catgctcccactacttcagctactcctaccaccagagtgactcgtgcttccacctcagctgctccttcttcctctgctgcacctcagcgttctgagtcttcttctcccataaagaaggctcttagggctatcttttgcatgtgtgccaagacagctaagaaggtaaagaagatagagaggcgtcaaaaggaagattggattgcagcaggcaaggatgtctctgacatttctgatgatgaggagtttgttgatccttttgctgcttatgagactgctcgagacattgctagtggtgagggtccctctggcacttctcgtttcttcaatgaggagtcctctcactccgaggagagcagtgatgatgaggagtcaaatgcccctaccgagaatgttcttacagatcccgatgaggcagtggacgccgccgggcaagacatcgactctcctcactccggcgacaccgagatcattccttctgatggcgatgatgatgaggcttgatcctcttcttcccttgtgattttgtctctttttggtgccttgatgccaaagggggagaaaattgcaaacgaaggggggtcaaaattttgtttttgatgcttactgcctgctatctgtataatccggaagttccggatcctcttatctggaagttccggacctgacagctccctctccttattgtcatgtcagcttatccggaagttcctggtattttatccggaagttccggacctggcaatcctttgacccctattcttaagaactcatggacatgttctaattctctatttgtgtgaatgtaatgtctattagatgctcttagccgccctttatttatactgctcttcatttatgctatgagtgtcttatttgttgtttgtgttatgatgttgattttatcctcttgagtgctcaccatgtcgtatcttttgcatataatatctattcttactgctttttgcatcccatgaatgagtagggatgaaggaaactctcctcggttgctcccttatatatatgcatatgagcttctctcatatcttccatatgcatacattaagggggagtttcatttacctttaaccattcaaaacaaaatttaattcaatcttttgtaagctttaaccatgttgtcatcaatcaccaaaacgggggagattgaaagtgcattaatccccctagtgggttttggtgattaatgacaaatgtggttaagggactaatgagttcattgagtgactttcaggtgcattagtccaaggtgtggaagatggatgcttggagacccccaaaaaagtacaaaatcaaagcggaccggaactcgagaagggcataggatagtttatcttttgaaatcgagtttttaggaaaaaccgtactattaagaggggttccaggtgatgctctgagatatatcaagtgctcttagtgtgaaccaagtgtcaagtttccctaggagtcatttttgcaaatactccatctgtccaaaaatgcaagtccggaacttcctgtcttccaggtccggaagttccggtcttgtgaaaaagattttcctaagtgtagtccggaagttccggtcttctaggtgacgtaacggctagatgacgtcacctagccgtcatacatatacagcttgattccagctcgttccttagccattccactttcatttttcaaacctagagcaattgctagcctctcccaagtgtttcttgtcttctccactcaatctagagcctaattcttgtgagaaagagagattgagagggagagaagaagatttggagatgtgtgaagactaggatcttgggtgagcacttggaatatctcgtgggctgtcatctcggtgcttattactcttcgagatgatctcctagatggttaggtgtcgcccgcgagaatccgttgcatattgtggatgtcccgggtaagtttgtgaaggatttcctctcctccgaaagggaacgaggtaagttggtgaagttcttgtgctgagattctagaggctttccaagtagagcaacccacacttgtggtggatttctagaagtaggttgagttggatcttggtggtcactcaattctagaaatttgcctaggggtgtttggggttgaaggctgtggatttcctcaggggtttttgcacaagtgaggcaaggggttaattgagacccagctctttggagctcctcaacggagagtaggatcgcaagattcgaacttcgggaaaaaatcgctcttgtctctttctgtgatgtttctgtgaatgattctgtgatatatcctctgcttagaatacctgtgcaccatcttgtgaagattggcttagtctcctgtttcaaaatttgaatttcatctctgttttgttacccggaagttcctgtcttagaacaccggaagttccgggcctagcaggccggaagttccggagttccttaccaggaagttccgggtctgtttgaattttaccgctgcgatttgtttttaagatttcagggacagcctattcacccccctctagacttcatcagcgcgttcagcaggtgaagggacgcgacggcgaagcagcgctccagcgagcaggccacctcgacaccaccgccgccgactccccacggcgcagcctcgccccgtcggccggcggcgccgacctgccaaagccgcaaagagaagattgagagagagagagagaggaggaagggagagaagaagggaaagggagaggagggtgaggtgtacacgctgacatgtgggcccacgtgggtcccacgctgacttagccgccaatggccgtggtcaaagtgccacgtaggacaaaaccgggatcaaaaccgccgagggacctcgggtgatcggttttgcatagttaatggacctcatatatctggttttgtggtttgaggacgtttttgtaactcgatgacaaattgagggaccttcggtgtactttttccatattttgggctagcgagatcgcttatggctccttttgtagcccaatccccgggaggaaggccagcgggagaaaattcaacgggccaaatcttcttgtccatttggaagcctacaaggtgggaattttatggcccaatccgcacagaatcgtgaggtcaagaaaatttcctctagctcgatacattgcgccaccgcttctccatctcgcgattgcgagcagacgatgccaccgagcctcctccagcgagatgctctcaccggtcctccttattcggtctacccctaccgctctatccctctctccttagatcttgggtatgcccttcttctttcccctcttctcctagagtttccgggtttcctatttgacaaagttggtgatgagccgctctgtcctaaagtgaacaagagttatgttatggttggcatgtctctatcttaagaggatttttccattggaatgggttagtttatctcttagatttagggtattttatataaatagatggccatattgaaagggtcttgagaatcgttaattttgcctagaggaggggtgaacgggtgctttgtgatatttcaaaacttgcagcgagattagaactaactagacaaaccgacacaacttccggtagtccaactatagatgagttggatagttcgactgctgtaggacaatccgattagtgcaacgataggaaaaatgataagtgacccgattgtccaattgctccaggacaatctggttaacacaaggatagaaacttaagtgatatagtaagaaacaaactagaaggtccacttaagcatgctttctacaagggcaagtgttgacggtcattatcgatcagttgcgaccgtcaatattaccaaaatagaggagaactagttatgcttgcaatacatatacaagttagaataataatattccactagtattgggtgtactaaccttttgcagagaataaccataaagtggaggagaatcgacatcagcacatacgataaatcaatcggacgatgtcgagaatcaaacttatgcatgaatgggccaagaactcagaattgacataatgaattgggccaaaattcacaagtctaagaagtgaagtaatggaggaggccacctaccgaattcggccgaaccccctagcaccgttggatgcagggtttcttctggatggcgtggatcactccccaatgacggttggagagcaattctgaccattccaactgccaccgaccatccccaaggagttcactctcttcacttcaacacacacctcaagcaagagctctctcatattctctcaagttagtttagtattcttaagctagtggaataggaatatagtagaaattaggtatggctctagtggctttcctttcctctttggtaagctttgtactttatttagaatacttttctatatacatttatggtattgaaatactttccgagtatatgaataccttctttacattatgttcatgttatactgaatatactgctagcttatctgggagatactttggtgcgggtataatgtttgcttatgcaattacactatgtcatgacgatgatattagagtagtatctggtagtttagacgaggtgtctagattacgggatatcattatttggggttatatgctgcggatgagaggtgggctgctgatggtgacagctcagtacaagtattcctccacgcatgtatatagtcctaagttaatttcatgggtagggtactcctccgtatttagccccggttgtatggccatgacgagctgtcgtaaggaactcaacagtcaggggtggcttctcgaagtacgaggagggcatcggatagagggtattagctagcatatcagatgactcgaatgtatgtatattatgtatactagaagtataggaatatattatctttctcttttctttccacttagcttagataatttagtatgagaatgaggagcttaatgcttgtgtgtcactctacccttgaattattttaacccctgtttagactatgattattacaagtaatatataaattattagtcaagttctctctaccatgatcttcctacgggataaaataaatacgatacccttggaatactctcgggtgaaatggtacaatggtatatccgtgcgcttgcggatgaactctgtaaccataatataccaggagtatttatgcgccattgctgggaattatatttctagtaatgtcgttaagaaataccaacagcaagctaatgataaatagaactaaacaagcaagtaaaggtcactaatagaacaatatagaaagtggtaaatacaaggtaaaagagaggaaaggatacactgatttatttactgatgtttggatccaacctatcctactctccgttgaggggttccgaaaagtcgggtctcgattaacccttttcctctccaagcaacctccgatggtgtcttggtttcttcaagcaaccgccaaggaaaagttcgtgcttcaagagacccactcggtctcaagctcggatagcatgcaactaccctccggtgaagctcgctctggcaagcaactacctagatgaagctcggcttccactcagtgacttcttccctttcaaaggcgaaatagagccttcacaagggttcctaagcaaaccacacgcgttggcggctctgagattacaaatcttttcttccacacactctcaactcaacccactattagctcacaaactcaagatcatagaaatggagagagttgggagagaatttagcgaacactctaagacaaatgatcttcaataagcacacaattctcttgaacacttcgatggattcatcatgtgaaatggggtttaatgtcttgaattgagtccatagcaccccaatttatagccctaactcctccaactagttgtttcttcccggtgaaaaagtctgctagaatttgtatagggccggattatctagtcctttatgcttttccaacagtcactgaaccacttgttgccccataaaggaacaaactatccgatagctatagaactatttagcagtgcctcctagatagtccggtaccaataggattgtccggtccttttcttctccaattgtccatctaagcattggtagcctccaaagggtgtcggacagtacggtaccgtgtcagatttgatcttttatcttccaaactttggctaatcatttccacttcaactcttttgcttttagggctgtctttactcactttagggcctaatgcctgatcattactcaataaatgaattagtcattgcttgtcatcaattagccaaaatgcactttcaatctccctctttttggtaattaatgacaacctgattaaagttcaacaaagattgaataatatttggttttgaatgcaaatggctagtttgagctccccataaatgtatgtatacaaatatgtgaagtgaaactcatatacacatatttttgagaatgctagagctccccgatgtcttttgcatttgtggggtgcaacgtgtgttaagataccaattgaaaccaactttaaaatttgaaataaatgacatcaattgaaatcttgagatcaatacttgaattttttttctcctctctccatatgcacatttaatcttttttaaccctcttcctttgatattcctctccccctttagcatcaaagcaccaaaaagagcataataagggatatgtgagccatgagtatcattgaatgatatataaaagaatgagtagattgcatttgtgatacataaacttgttaggtgggtttaatttagtacataaacttataaattgctcattttggtgcacaaacttgtctaattcgtgcaaaccaggaccacaatggcttgaaaaggttaattctagcaagctaatgttgattagaatgtgacgtccatacgtatagtgagtacgcataagatgtgctatatttataaatgaggaatttcatatatttcttaccctttctaacccttgtatcattgctcgggttttcatatatgtcggctatcactatttctcattttatcttttcattgaacaggtgtatgtccaaatataaatcttctcaggtatgtgtttatcctaactaatacctaaatcaacaggattagccatatagtgtacttttggccttggtccaaacgcactggacaagttcatgcaccaaaacaaacattttacaacttcgtgcactagattacacccacaagttcatgtactgctgatacaatttactct

SEQ ID NO: 82949 - DNA, 4292 bp, Oryza sativa
ctagagaaccattagccaaattaagctcattagctagttgttcatttttagcacattctttagctaggctctccactaaggcaaggtttctttccttctcaagaataagtaattcttcttgcctttcgagagattgttctttactatccaaagctctcattaacttagccaaatgttgcatagcgggtttgctaaaactcttaagcacatcatctaattcattatcactttcctcatcactagaatcaacatcaagagaggtatgagagggcttttgagtcatcaccttgtggccttgggccatgaaacaagagtagtggtaggagtcgtcgtcgtcatcactcaagttgttgaagagacgctccttgcttgaagaggatgacttgaaggcgacagtagcaacaccaccttctccttcaaccttgtcttttggcttgggcttgggcttgacctcgagatcttcttcatctccggagtaccacacctctgccatgtgtgcctccgccacatgagcacgctccggcttcttcttgcctcccttagccttcgcttcatttgacttgagacaatcggcaatgaagtggccatattcgccacaattgaagcaagctctctttgattgcctctttcccttgtcatcatccttcctccctttgccatagccactcttgcgaagaaagtgcttgaatctcttgacaataaaagtcatttcttcatcttcactttcttcacaacttgactcttcttctagttttgccttcaaagctacttcttgatttttgatcatggtgggattcttcaccatttgcctcacttcacgagctgtctcttcttgcatctcataagacacaattcttccaagaatgtcacttggggtgagcctcttgaaagctttcctttcccatatcattgatacaagagtgggatttcttggaccaaaagcatggagaagtcttttgaccacaaagtgatttgtcatgtcctcactcccaagtcctttaatcttgttgacaaggatcatcatcctatcatacatctcttgtggtgtctccttgtcatccatcacaaatcttccaagcctttcttccaataattcaatcttggcctcacgaacggcgggtgatccctcatgagccaattgcaaagtatcccatatctccttggcctcctcaagcccatcaaccttgttgaactcctccggactcaaggcggagagaattggattggaagcttaagcattgcggtggatgagttgctcttgctccgaagtgagctccatgtcatcatggggtacatcaatacctatacaaacaactttccaaatacttggatgcaaaaagattagatgcaacttcatcttgtgcttccaagcggcgtaatgtgtcccatcaaattgaggagcacgcctagaaggcacggagacaaagttgtgagggggaatggtaagtttgctgtaatcaaaaggtatagtagctcccttgggtgatggagtttccttgctgctcgttccatcttcatttccattttccccgttctttccccctaaatccgacatcgtggatcactcaaagcagtgaagcttgaatcaagagcaccttgctctgataccaattgaacgcgctgatgaagtctagagggggggtgaataggctgtcccctgaaatcttaaaaacaaatcgcagcggtaaaatttcaaacagacctggaacttcctagtaaggaactccggaacttccggcctgccaggcccggaacttccggtgtgctaagacaggaacttccgggtaacaaaacagagatgaaattcaaattttgaaacaggagactaagccaatcttcacaagatggtgcacaggtattctaagcagaggatatatcacagaatcattcacagaaacatcacagaaagagacaagagcgattttttcccgaagttcgaatcttgcgatcctactctccgttgaggagctccaaagagctgggtctcaattaaccccttgcctcacttgtgcaaaaacccctgaggaaatccacagccttcaaccccaaacacccctaggcaaatttctagaattgagtgaccaccaagatcaaactcaacctacttctagaaatccaccacaagtgtgggttgctctacttggaaagcctctaaaatctcagcacaagaacttcaccaacttacctcgttccctttcggaggagaggaaatccttcacaaacttacccgggacatccacaatatgcaacggattctcgcgggcgacacctaaccatctaggagatcatctccaagagtaataagcaccgagatgacagcccacgagatattccaagtgctcacccaagatcctagtcttcacacatctccaaatcttcttctctccctctcaatctctctttctcacaagaattaggctctagattgagtggagaagacaagaaacacttgggagaggctagcaatagctctaggtttgaaaaatgaaagtggaatggccaaggaacgagctggaatcgagctgtatatgtatgacggctaggtaacgtcatctagccgttactcacaaatttgaactggaaactagacaggaagttccggacctgaaagaccggaacttccggactacacttaggaaaatctttttcacaagaccggaacttccggacctggaagacaggaagttccggacttgcatttttggacagatggagtatttgcaaaaatgactcctagggaaacttgacacttggttcacactaagagcacttgatatatctcagagcatcacctggaacccctcttaatagtatagtttttcctaaaaactcgatttcaaaagataaactatcctatgcccttctcgagttccggtccgctttgattttgtacttttttgggggtctccaagcatccatcttccacaccttagactaatgcacctgaaagtcactcaatgaactcattagtcccttaaccacatttgtcattaatcaccaaaacccactagggggattaatgcactttcacctacatcccgaagaagctcctcctggcccgcgtggcgtccatctcgatccactccccctctccccacgtaggacatgggcttgataggcggcggcgttgggcgggagccagagccggtgttagaggagaagcggaggagcgagaggagacgatgcggctgggggtggtggcggctagagtgggagaggaggaggcggaggtgagccatgcgatggcggggcgtggcggcggctggctttgggcaggccggcgccgccagccgacggggcgaggccgagcggcggggagttggcggcagcagtgtcgacgtggcctgctcgccggagcgctgcttcgccctcgcgtccctccgcgtcggcgtgcaacgagctgcacgaggatgcgaggaggtcggcgatggcgaactccctgggcgcatcgcggcggtggagggcggcgaccacatctgtcgcgccgtggcggcgctcatccgaccgtcctcccaccaccagcgccgccgcgctgccttccgccctcacccaagccacctctccgccatgtccgtcgccgccgctgcctcatcgagggaggggtgcgccgccgccgacaaggccgagcgccgtcactctccatccgcggcggcggcccgtgggaggaggacatggtggcgcggcgatgcgggagcaggaggcggcatctcccctgccggccgagcgctgccacttcccatgcactctcccctgccggtcgcgcgcctcccactctccctcggccgtcgtcgttcttctccccagcctgcttccgcctggccgctgttcttctcccctgccggtcgccggtcgccggtcgccggccgccggccgccggacctcttctcctctcctacctcaccatcctcgtcggcgccgcaccaagtcgtcgcctcatcgcccgtcatcgctccactagacaaggagcaaagtgaaagaaagagaggaaaggagagaagaggggaaagagagatgatgtggcatcctgacatgtgggacccacgtgggtcccacgctgactcagccgccacgtaggacaaatccggcgtcaaaaccactgagggacctcgggtgaccggttttgtatagttaagggaccccgcaatctagttttgtggttcgaggacgcttttttatctcgctgacaagttaagggaccttcagtgtacttttttccccaaaatttgactaaaattttctctttttttagttattactactccctctgttttaggttacaagatgttttgact

SEQ ID NO: 82950 - DNA, 17782 bp, Oryza sativa
acccccctggtttttatataatgtctgaaccatagtgtatttgcatctatgaaatccttatcgcaacaagcaagccacctgattcttttttttttaatgtagcctagtggaagccagtttgtcgttgttatttcatggaaggtagaaaatcatgtctaaatatttagaggtcaactatgaaactaatctactgtgggcgtgttgactgatgataaatctaatgcaatggtgctgataacatattgtcaagttaatgtggtttgttaatttaaggttaacttgttggttcagaaagtacaggataatctgttcaaacaaagcttgttattccaaagtttacttttgcttgagtctagttctgtccaaattaatacagtgaagtactgcatatatatgcttgttgtaatagcttgtaatttctagtcttgttaacttaacatgtttcattttctaggtgctggagaagataaacaacccgcattatctctaccgcatgaccatcctgcaagctatttcattgctggcccctgtcatgggtgccgaaatcacttgtcaacagctgctccctgttgtgattaattcctcaaaggacaggtgaaaaatttgtaatttgtaaatgtatagtttacccatctgatcaaggccttattaacaaatatttttctaaatttcagagtgccaaacatcaaattcaatgttgcgaaggttctgcaggcacttataccgatccttgatcaatctgtgagttgcagtattttttttgccttgattcctttcttcgtaatgctataggacatttacaggttattggggtatattatgaatacttactttgtaggttgtggagaagaacgtgaaaccatgcctcgttgaactcagtgaggaccctgatgtggatgtaagatactatgcaaaccaggcccttcaggcatgcgatcaaatcatgatgtcaagctaactgtcttcctgtccagtatttagaacttgattctcttagtccaaattttggaatatttgtaatttgcactttagtttgaagagttcctttctagccccagtaacagaccaaacacttcccaagatgataatgtatggctccgacccctcgttctctgtgtttgatgttgatgatgttgtaattgagcaagatcggacacattattatgtttgtttacatggtagttttgggccttggtttctgtgattttaatggatgccaacactgcaatgtgatttttgactgtagctattggtaacggtgtagtacttgcatcgtacgagttggctcttgatgtggacaccgatatgttgatatctagaagatcaaattggctttattaaatttaacattaaatatattttgataccatgttttctactccttctgttttataatgtaagactttctagcattgtctacattcatatagatattaaagaatctagacacaaaatgaagggagtatgaactttatcaaagttaaaatttgacttagaaaaaaaaggtaaaacgtctttgatatgaatgaagttctaatataaaatggagggggtactgcctggttcgttcttcattccaactctgtggagtccttgcgtgaatggcctgttcttaatagtctgatggtcttttgtcgtgcacctgtcgtctatggattcaagtgtcggcttatagttactcgttgaatcaagctagtagtactccagctgaatggtctgcatcaaagggtacccatacgggggcaaacatgacaaaattggaggcggggcagatgtatccaagtcataactgaatacaagtatatgggggcatattaatttcttttctatacagaaagaaaacaaaatgtggaatcaaaatagtgtaagtacgtgtgctaccttatagatgatcataaatatgtgaagaacactacaatattgggtcatcatttttgcaggtagatcagttgcgcataggatttctcttgaaaaacatctagctaaaataaattctgatgactaatgcaacatgtctaaccattttttagctttctggctaaagagtgtaaatttgaataggccactaagccagctagtggcgccgttgaatccggacgacggtaacgttttctgatgattaactaatttttataggtattgatggctatctgtagtgaagacaatagcagcagagattggggatcgggcggcgtggccgatcacattatatatgcttaagcaagcattggaaccgacaaagtggcaaagagtgacaaactcaatagttttttttttttttgcctagtattgatatataatttcttaaccaaggatagcatttaatctttttaccaacataaaatgcatttttattcatacaatttgattatataatatttatactatataattattaatttcctagtattttcacttatagttttggacatcaataacgcacacgattttgccaatttttatttctaatttcccaaaaaaatggttactcttggattcaaatttattctgcaaagattatcatgccatatttaaatttctccccattctatcctcatacatcctcccctcaaccatttctcacattctaccatcaacaatcatttcctctcaaccaggagtaataaatcatttaatgcattgcatgtttttttccttgaacattaatccttgcttctaagagaaacctagaataacaatctcttaagaaaggtgatagtagcaataaaattattgaaaatataatgttaattgtcaaaaacttcattttgctattacaaacgaagggactaccttaccttaggctgcgttcggctccttggcacggaaaacggagcaacgattagcacgtgattaattaagtatttgttattttttatttaaaaatggattaatattttttaaagcaactttcgtaaagatttttttttcaaaaaacgcaccgtttagcagtttgaaaagcgtgcgcgcgaaaaacgggtgagggaaggtgggaacctttggtattgaacacagccttaatcagttcccaacatgattatattttgagacttcaaaatcttgtttgagatgcttctaactagcttctatctagacgatatcatgcaacttgaaggtatttaaatatgatttttgatacacgtagcaatttaattatggtcattatgatgaattttgctacaggacatccaaaaaacatgtaattagccgggggacactgtaataacacgtttatgctacagggcactgtaaaaaggtggtaattagttgttggacattcacgatattattttattatacttggaggaattaaagagagaaacagatatgaaaatacagttttacccttcgaacccaataaagtctcactcccactctaggacctacatgtcaaggaatatttcttttcttttatttttctttttctctctccttctctaccccttcccttcttcctgctttcttcttccggttttcgaaagttagcattatattttcaataattttattgctactatcacctttcttaagagattgttattctaggtttctcttaaaagcaaagattaaggttcatgaaaaaaatgcaatgcgttaaatgatttactcctggttgagaggaaatgattgttgatagtagaatgtgagaaatggttgagaggggaggatgtttgagggtagaacggaaagaaatttaaatatggcatgataatctttgtggaataaatttgaatccaagagtaaccatttttttaggatattagaaataaaaaaaatggtaaaatcgtgtgaattatcgatgtccaaaactataagtggaaaaactggaacattaataattatatggtataaatgttatataatcaaattgtatgaataaaaatgccttttatgttggtaatccaaaagattaaatgctatccttggttaagaaattatagtcaataaatacagcaaaagaaatagaaattatcgagtctgtcactctttgtcagttctaaagcctgcttagagcatgtataatagcagactataaacaagctataaacacatattaagaagttagaagaagagagagatgagcagcgggctatagctacagcatgagcatggattttaagacatattgtgtgtatgataggtgagaccagatattaatagtgtagtatatatttatcggtaactattatataaattgactattaaattgattacagatgatttggaatagttagctgtaatcttaaacttgctcttaagcatatgtaaagtgatcggccacgcccgcagatcccaatctcgctgggcttttcgcccctcccaatctcccatagtagccacctcgacgcaaaccctaatcccatcgtctccgcctctccctctccctcctccccgcctccatggatcgcgaccgctcctcccgccgcccccgcgacgacgacgaccgccaccaccgctcccgcgacgaccaccaccgccgccgccacgacgccgacgacgaccaccgccgccacaagcgcggcggcggcggcgacgacgacgacgactgcgaccgctgccgccaccaccgtgacgacgaggaggagagccgctcccgccgccacggccaccatcgcgacggcgggcggcggtccctctccccgtcggagtcccccccgccgcccgccgcgaagcgggagcggtcgtcgagccgcgctcccagggactccgtggagcgccgggactcggccgaccgagaggcaccgccgccttcttcgcggaagcggaagggccacgagggtggtggcaacgagtccgacccggaaggggggaagcgggcgagggcttccgtggagccgcctccgccgaaggaggagaggccgaggcgggagcgacggaggtttgaggacgccgatgcgaatgggaagcatggcgatgagaggggtaagggtgataaggataactcaaaccatggcgctgtaaatggagattcccggagtggtctggtgcccaatgtaagtgttgctactgtctccatatttttcttttctagtgatgaagtcaagaattatctaagaaatgattgctttattttgttttggataacttattaactggatagattacatcttagtcacatttctgtagtttatatggtattatgttggtgaataatctgccaattctttagtaaatatatgggagtgaagggtttttatcaggagtccaggagggttagttctgttcttacgaaatgtttctgttgatagattgatcgttagtgcttttgtccaatttgttcaagttgcacaatactttcaagggataagcttgtattgttggttgacatgagcgatactactggttactaggtggatttttagccttgattaagagagtaatgcagctatggcaatactgcctcctgctttattaggaaaacttgatccaacattaggagccaactagccattagatcttttccttgcattgatgatgaactttggaagtacctgttcagtgtctctgctgatttactgataagaacatgctcaattgtttcagtattgtttgagatgtataagaagttaatatccttcctgtatattctcattggatgcaccttctgtgtttttcaggctggtgctcagcaaccgctcaatgctgcacctgttgtggtgccatcatctgttcctatgccttcaaaggtatcttcgattactaccaccaatgaaaatgagggagttagtattagatctgatgaggttactggaaaatctagtacagatggaagtacaagttcagccgctggcaaaagtagtaatctatctcttgatgctttagccaaagctaaaaaagcattgcaactgaagaaggaactatcagaaaaactcaagaagctacctgtggtaagaaatcacagttgttggtagtcccttgcttctatatttctattttacctttctaacttattgtgttttttggcacagcttaataataaacttggtgttactagtactgatacacaaattcctaagaaagaaacacagcctgtttctagctctggtgcatctgaaatggctgtgggtgcagctcttactgagaagatggcagctacagcaggtgcagttggtattccaggccttgctaacattcccaatttggatgctgtgaagcgagcacaggaacttgctgctaagatgggattcagacaggatccacaatttgcgcctctcatcaatttgtttcctggtacatcctctgaactaactgtgcctcaaaaacctgcgaaggcacctgttctccgtcttgatgctcagggtagggaaattgatgaacatgggaatgttatcaacatgaccaagccaaccaatttgagcactctaaaagtaaatctcttattttactagcatgaatactatgaaatgttatcagtaactcttctgtgcaatgactgtcacttttggttataccttgtaggttaacataaataagcaaaagaaggaagctttccaaataatcaaaccagacttggattcccttgcaaaatcaagtgcacactttgatgaaaggatgggcatcaaccaaaacaagctcctccgccctagaaggcctggatttcagtttattgaggagggaaaactttcaaggcaagctgagctgcagagaattaaggtctgtaaggatcaacttttaagattagttttcaaaatgtatttacttatcatatttccttttacttaccctaataatttgaccttctagaatcaatttggtgaagcacaagctaaagaacttaaagtaaaacaagctcaacttgcaaaggcaaaggcagaagtagtcatgaacccgaacttgattgaagttgctcctgggaggcctccaaagcaaaagcagaaggaagagattcctgaaattgagccatggtttgctgctacaccctttatctaattttatattccatcattaaaatataactactaatgtatgctctttacagggatgcaaaaattttaccttctacaacatacgacgatttctccatggagaaggttaatatggaaaaaatcactatatatgtagagcatccagagccactggagccaccagctgagcctgcaccaccaccgcctcagccacttaagctgactaagaaggagcagaagaaactcagaacacaaaggcgccttgctaaagagaaagacaggcaagaaatgatcaggcaaggcctcttggagccaccaaagcccaaggtcaagatgagcaatcttatgaaagtactaggagctgaagctacacaggatccaacacgtatggagttggaaatacggactgctgctgcagagcgtgagcaggctcatgtagatcgcaacattgctcgcaagctcactccatcagagcgccgtgaaaagaaagagaggaagctttttgaagatcctaacacattggagactatagtttgtgtgtacagaatcagagacctgtcacatccgcagacacgttttaaggtggatgtaaatgcacaagagaaccgtcttactggtgctgcagtcattgcggatgggatcagtgttgttgtcgttgaaggagggaagaagtcaatcaaaaggtacaataagctgatgctgaaccgtattgactgggctgctgcggttgatgatgatgatgatgctgatgaggaatcagacaagcctgtgaatagctgtgcattggtctggcaggggagtgtggcaaaaccctgctttaccaggttcagtgtacacaattgccgtagtgaggctgctgccaagaaggtgtttgcagatgcttcagttccacactactgggacctggctgtcaatttctcagaagattcatcttgagctgagcttctgttcagaacatggaggcgcctgctgttgaaacccctgcctagggattacgatgttcaattctcatgcagtaagtgatgagtagtagctaatttctcaccgtgggtaagtgtcctcttcaagttacgtacaagccttattacttgctctggaagcatttgtggactgagtaatacttcgtactgtcatgaacatacccttgtaagggactgctgatcttttcgttgcgggatttactcatgtgagctagaaactgaatgcatggaggaactgttgaaatttttgcagtataagcttccaactatatctggactgctcaggccttgaatattgttatgggaattgtgttaatgaaagtatgtatgcattttcgtagggttgcagtgctcttgagacggatttcatattttcatttcaatccaacaatatttgaccgattttttccatgattggaaatgttagtagttgcacgtttcagtttgcaactgctgctccggatgtttatccatactcgattcggcatctaatttagaattaaaacaacatattctgaatttattttaccaatgaggcggccagaattttgaagtttgacatatccaaagtagtgtaaaaccaaacttgtggcatttctgttttgtgaattatataagaagaaagattctcgaggtttttacctgtgtgccattaaaaaagatgacccctgtctctgtgccactaaaaagttcgagcctccctctatgccatcgtcgaactttatcgtgtctgtcctccacaccattccgtccgtttttgatcctaacggtgagtaacggcgcagccaaatgacgctcttgcccttagccatgtttcatctagccaaatggcgctgcggcatcatcatcagcatccgccgccgccgcctgagctgcagctcctcccggcatccaccacggcgccgttggccgccgcgtttttgtccaactccaccggttcctcctcccacgagcaacacgtgacgacgctgcgacgacgacggggcggcgccgcgacgacgacgacggggcggcgctgcgcgacgacgacgacggggtggtgctgcgcgacgacgacaacagcggcggcgctgcgacgatggcggcgacggcggcgttgcgatgacgacgatgatgggagcagcgctgcgacgacgatgacgaggcgttcctccgcatgccccctcctcctcctctccgcctagacctcgccgctgtccttccgccgcgggcccagctccgcgtctctcagcgccgcgagcgccgccgccgcctcgtcgaatgcctccttccctccgcctacgccgccggccatcacggccgtcgcctcctcgggcgccgccgccacgggggtcgacttggccatggggttagctgctggtggtggtcgcggtcggccgtcgtgaggatcgaagggcatggacggagagaggggaatcgagggaggagagagagagagagagagcgactgaaagtgaaagggcaatagtgacatttttcctacttgggcccacatgtcagagctgccaaatggttaaacccaaacagaatagcgacggaatggtgtggaggacgcgataaagttcgacaatagcatagagagagactcaaactttttagtggcatagaggcaagggtcatcttttttaatagcacacaggtaaaaaccttaagattctctagcctcaacatgaatgtatctaagggtgtaaatggctaacccatgaaatccacttgtaggttaaaataagttaaaataaacggacttgtaggttaaaataagttaaaataaacgggtttgcggctgatccacttatacccctaaatgcatctagccagtggcaatttcgtttgcttcacaatttttgattttgttccaagcaagagtatgatcggaatgaagtgtcaacattttgtgtattcaaactgaatttatcaaggacgaaaaatgagccgcaaaaaattcatactaaaattacaccgcaaaagttaccaagtaatcagagtccaattccaatctgctgagtgctgaacgcaattcatttgaaaccgcatctaattctccaaaacccaaaatttttcagtagttgacacttgaacagtttgcacaatccatatccaagcctgcatcacgtgatcaccatttttctccatctcatacggtatggtgtggctcaggaagagatatggccaatacctctttcaaatttcgtcagagtgaacttcaccaaacatgaaggtgcaacacggcccttcattttcgatgctatatacatacccttgaccttaatacagaagatttctaggtgacaacattacttggctccattactgttctcatgatctgcccgacttttgtcaaataaactctttccaaaccaaagattggtgagccaagcagataatacctactcagaatgatttggatgcttcctcattaacagaaatctaaaatctaaatgtctcaagcagagtacatttgatggaatcctgatggttagcacaacatgacagcgataatgatacgattcaaagcgaagctagtaaccaaaacatggaaacagctgatgtagctatgaacgaccatgtgatgaatgccaagataactgaaagctcgtaacgaccacacgaaagctgcgggtacatcctacagaagtgcacgtctctctcaaaaagaatagtgacaccagcagaagcagaagctgctgcaaacgaaagaatcgctgtaacctgcaatacatccaaatataatgttctttaatgtccctcttgctaaattatgttagcacttcaagaaagaagggtcaaacaagtgatcaaacagggaaatgaaaaccttggcatactaccccatctagctacaagtgccacatggatattgacatggcaccggaaatgcagctgattactaatttacggtaatatttcaagaatgaaagggaacaccgaagttataatataatgaaagaagttatcgacagaaacctacacatatgttttgtgtatccattctaaaaaatgtattttactgcacaattctagaccattagttattttttactgaaagggtataaaattgatcgcaaactgacagaaaacaacccatattgccagtgtttcatctctgattccctaaaagatctaatacaatcgcaatttttttcatgtcatactctcatttatgtctgattccctatgtctgattccctatgtctggattggacatgattcatgtagttttcatgtcatattctcgtctagattgcacttcttttctctcatttagattgaattatgactggattggacatttaacaatatgaaaagttcaaactgttcccctaagcatgaaatttaagaattcttgaacaaaaacatatgtactactcccctgttatttttcctttttgatgacttcatttccaaattgaaaaggaaattcatgttgctttttacaaattgaaaagcaattactagagtaatatatgagaaatgaatcacttacccaatcaccaacaacaaacaggcttacaagcactgggttatgaagatctcttttagtttgtaatgaatagatatccagacaagcaagtccaaaactccaaagaagctgtagacccatggaagcaatcaagtagctgaaaatagggagatcacaatatcgtcaattatgtatatagattatatcacgtatgcactgttgagctcctgctcaagcaattctgaatagtagtaaacaattttcatactttgcccaacttggtctcaaaacattaagttaaaaatggcacccatacaataatcaaaggatgtaacatgttgaatgttgacacattcatacacaacatctaatggaaaaattctcataagatgttaagttaaactttaatagtcacaaagaagagaacagataagcacaccaaatcattgggcagtcctgcctttttggtttaagacagataaataaattgtttttggtcccttcctggcatggaactgaattatatcaggaaaaaggccagtaaagaaactgtgagaaaagatcaaaacatcataacatgatacccagaaagctacatgagccaataactggaataaatctactacttgtttctttttagatggaaagaatgcaaaaacactgccacatatcatgcccctcgattcaaatggaatattccagaatgaatgcatttattactcgtgaggaggtaatggtgctcaggaagagaggagagagacttaggacctttttattttttaattttattaagagacctttccaaaaagtatttctgaaaactgaaccttttagcgttgtcttgccacaccagccacggtggcgtggcagaacagcactgccacgccagcctcgcgtggcgtgacaaagttatttggccatgccaggcgggctggcgtggccaaaaggttcagatttggaaatacttttgggaaggtctatcaataaaattaaaaaataaaaaggtctaaaaaataaaaaaaaatccagagggtggggaaggttgatgataaccagtgggaagcttggaaatgtggaggcaagggaaggataggtgtgctagtgcaagttcagtgtggtggatatctgggcagttttcttgtgtcagacaagcattattgaatagtttgattgcagaataaatttatctactcaaacggaaacataccaagaaaacatacacgacaagacagtacagtttagctgaacaactatcgaagagcaacttaggcaagaacactcaccatgctgagtttgtataccagcaggcacacaccagctcatggggaatgcaactactgtacctctatccattgatatttcctgctcatttcagttactacatgcaaactaatccaaacttgtaccatttatgtacaccctatttgcagcaataaccaaaactaaggaagctgagtgagaccatgtactataaggccacttataaaggaagaagagcagaagcaggtttttattttggaagaatagaagcaattaacaaatttaacacagaagcctaccgagtgaaagtcctaaactagaatgtttgctgcaaattagcttcagcaatcggctcatacagagacgtaggtgtccaatgttatttcaagcattccaaaatagcgacttgagcttgaagcatttgcccaagaacccttgaaattgcacatttacgcaataggcgcgcgctggttgaaactcgaccaatccccatgaatttgcaacaaaatacaagaaacatttgacatcaagaaggctaagcctgacacattgcactacaatgaaagttagaactgacatttcagtagacaagaagcgaattagtaaagggggaaagaggaggctagagagagagacgtggaaaggcggtagtagtagggtaccagaaggcggtgtagttggagaagccgtaggcggaggccatggcgacgacggaggcgccggcgaagacgcattgcgacacccgcagcgacatcccgctccatgtccccgggctccccaccacatccttcatcccctcctcctccaactcttccgactgctggatgcgcgcgcggtgcggagggcggcgtgggggtgcagggcggcgccgccgcaccgtagccccttgcccgcggatctgcgcggcggcagcggcggaggaggaggaggtggagtggagtggtggttggagatgggaaaggcgacggagcagcagccagcaagcgaggaatgagttgttgttgctagggaagagagagacgatggcttctacacgttttttttcctttcttgtgttgaataaatgaaattaatcttaactttttagctattaccagtttaatcttagaaaagtactcgcatgagactacatatacatttgtcgacaaatttttccccaaaaatttaacagatataattatagtacaattatagtgtaattacactgtaacttatatgtaattacactgtaacttgcatgtaactacacataattttgaatcgttagatctattacaagatttgttttggtgaggaagaaaataaatcatagcacacacatatgtgaaataatttgttcccacgacctccattttaccgaaataacatgttacggagagatttttgaaagttacatacaagttatactatagttacagtataattacatgcaagttacagtgtaattacactacgattatactgtaattacatctgtcaaatttttggggaaaaatttgtcgacaaatatatagcaaaatcgataggtaaagggttttcttcctgtaatattgggatccctacatacattataattgaaaaagttaatcaaaattcatccttggttttgggccgaaagctcattctttttactttttagccctagcccagtccactgcctcctaccttcctccacttggccaaaatattgtgatatgacatgattaaaataatatacataattttttttgagaaataaaatacataattgtgcacgtaaataaaattctattcccatagtacgataagacaatacgaaataaaatatcaaaacatgaactaacagttaacgcgcataatttcataacgttataattttatcacaccatggggcaagaaataaagctaagtatcaaaatgtcatcgaaatcatataatcataaaattctacctcataatactgttgaaccaaaataaagcaaaattaacattagtatcaataaattaaatttctagctgaatttcttgttagttccatttagctacacatgatcttcattgcataagaaagtttataatgcaactttatggcatcaaataatggcttaaacggattaaaatgcatttatgtaaaggaaaaatcactaattcggcccgataataagggaaaagtaatttggcccgaagaccagtcacgacccagaggccagagctagcctgtgattgggcggcccttgaggcaagcatagcccattaaccaatcatggcccgtcagtgtagccgtccgattctgatggacggccacgatctctgatgggtggctgatgcggcgtatgagagtcatggtgttatggttacggataaggcggttgtagataaggcatacctcttatatttggggtcgcgaagtgtatgaatacggtatatcctcaagtatatgggaatgttacgttagttttaaggaattcggccaatgcgtaaggaaactaacccccaaataaagggtgttagagtcctattcagagaggatgcaaattatgtgatctcgcgggtagaagattctccccgagttctacttggaagccaaggcaattcggcatataaatacatggtgtccatgggatatgggatcatcgaatcatagaatagccaccaaccatagcagaggcaatccggaggactcgaagccaattcgccggttcgatcttgttgagacgttctcgacaggggtcaggtcggtaactcttcagtttatattgttctctattgtaatctctgtggtttccgtataattcatataaactggattagcactgttaccttgcgaggggcctgaactagtataatccttatctttgtgtgcttgatgtcgtttcgtgttgactcttgttacaatgtaccccaataccctcaaaacatggtctatgattataacccatcgacagtggcacgctaggtagggggacttggtgctcaaggtctcgctgagatggcttcaagctcaagaccttctaacaatgatagctaaaattgtcttggcctgggagatcctacccagccggcgtttgcatggactcaagtcgaatccttctgctttcccatcttcgccgcaactccaatcttgccttccctaataccagtcgggatcgagatcgccgccacgaggatgacggaaaataaccctcaaccgtctcctcctcctgtccaattagaaaagaaggcgctgatgacttcagcttctcggggaactcctaaggtggccaaacccccgaacatctgttaaggatcacgtgccaacaaggaaatcttcgcccaatcaccacacctggtgcttgatccgcaaggcgtctcaacactctctggtcgagtgtggggtgatacttaatgtgaaggctgaacttgatgcttgtaaagatcgagctatccagcacacatctccatacaaggcatggtgcccgatccacaaatcgaaaagttacccccttaccggtagggatggcagtcgggcacgacgggcacgagtagtgactacccatacccgtgcccgcgaggtaattcatgcccgcgggcatacccattattacatgacgggcaaggaacactacccatgcccgttgcccgcgggcgccatgtgcctgcgggcatgcccgtttactcgtcacaaactcacagttgaacatttcaaccacaaatctccacaagcagagagacattatcacaatttaaagaaatggtacagttgtaccaagttcaacaatacaagcattacatgttcatcaatactagatggtggtatttatactaatttgactgagggaccacatgtcagttggtttttgcgggtaaacgaacgaagcgggcatgggtagtgactacccatgtctgtgcctatatgcccgttgggtataggttttgatgcaataaaaaacccatgggtactaaatggggaacaaacccaactctattagggtttttacccacgggtaaacagacaaacgggttaaattgccatccctacttaccggctgtaagatcttctagagattactggatccatgatccatgtcccttgctatccgatccaccaacgccgagagcaaccttgagatgcatccgtggaagatatgcgaaatgggaactgcagatcgcctggtcggattcatcgacatcgatccttccgtccttcacaacttagatgaccaggaatcttcaggatccaactccccatgcgaagtgaatgtgatcgaaagagtcgtcgaggacatacacgaagagggcgagattcgttttggagatgaaccgcgagctcctgttccaccacgtgaaccagtcgagccggttcgaactcctgccaaacacttcaccgtgcgtggtcaactctctactgaggtaaactccgttcgacccagtaaccttcccggaggcggacaactaggtcagacatatatagtcgacaatagccaacctcaactctgcttttttgaccgcagccgaaccaaccccgcaaggtcctgctcgagatccccgacaacataccgatgacagagtaacggagaacgaagttgccgaggacgcccacggtccccaccctagtcgagacctggaccgtactcctcaaaatgcatcatcaagaaggcccatcaacctcatccccgtctagatgaccgcgatcgtcacaaccacttgaacgggaggaggcaggagctcgaggaggaggtctggcgaggagcagtggtaggctctcgctcatgtagtatttttgcagtatgaacacaactcagttggatagagtcatggtatgttaggattaggataaggagttctccatctatataaggagagatcctatcctagatcagttagcattagatcaagatttatcttagtgcccatcaaccctaccttgttggtgtgagggagagcatcgtgctatttaggttcagggccattctctattacttcttctattatgatccaatctattcctcttcacctcttttatcccatataatcctagcacgtgacactttactcttttcggtttcctagtcttctcagagatttgggtatgtctttagtactttactctctttgtaaggctatgagcttagtaataaagttatcttgtttatttaattgtgttcgcagttcatatattgctttgttaagtgtatgctctatgagtagtgggctgcagg

SEQ ID NO: 82951 - DNA, 45111 bp, Oryza sativa
ttgtgaaacggagggagtagtaaagaaaacttggatacatatacacatctcttacaaaaacttagataatgccatcaccatatctctttactatccgatagcacaacacagttgggcttccccatgatcaggggaaaaaaaacaagtgtgtagattttcactatttccagtgaatgccaaaatgccatacccctcaataaaaatgccatcttcttttcaaattccacagccaagtacaaacctctgcttgatgaaattttctaattgaacaaaatcatgcaaacagaaaaaacaaaaccttcactgctgaaatttactccaatcatgaacgacctgaaaccaactttccaatcatgaacgacctgaaaccagtccccaacttttttagtatggctgacaaaactaattttcctttagtatgggatactacagaaatcaagtacgaattacattgtattggagcatgcagattagttatatttcctggtatttgctagcagaacaaacatgtacttagatcagtacatggacatttcagagtagtgatgtaaaatacacaaaactatgaaaatacttacaaaataaacaagtcatacaaaattctggtgtgaaatttagcttctctaccttccgctgagccttagccctttctaatcttgtttaactttatttcaaatttgcaaacaaaactatagaattaaaacaaaaaacatatttcataactagtagataaaaaactgcccatgtttagtagctgataaacctacagaattctggagtgatgcatgctaaacgctgacaaaactacatgtatgaattcagacaaaactaattgcagacaaaatttttaaaaaacaggtattaaatgataataaaactaatgatctacttacaaaactaaactgtatgaattcaggcaatattaactggtgacaaaactaacaaaaccaggtactaaaaatagctgacagaactagaaaaattcacattgttagaagacaaaatagtaagtagctgacaaaaacaaaacaaaactgacagaacccatgtcagtccttcatctgttgctacagaactaatctgcaaaaaagaagagattaataccgtgtaaaatagaagtttaaaaagatatttaaaataggatgttaattaaaaatatataatatatgaacatagataactgtactttaaaaaaaatcaaaaaataagaaaaatccaaaccaggacaacttcttccaggccatattcagaaaaaaaaaaactcaaggctgtaaataaagtagttataggtggcattcctcttcacaacgtcaggcatgttcttcagcaaacaaaatcaaggatcaatactattttcatctggcagcgagccatgcatcagatgtgatttaccagtttgtacatacttatttttgaccatatgtatgcaaacaattctaaattcacaaaactgaaacaatacagcaagaaagtcctcactcctcagcacaatgggatgcgggaagaggatgaaaatcatgaacaaatgcattcaggttgagcagaaaagaaaatatgtagttcttaattttattgctaagtgagacagacaaacagcgagacatgtgcatgctccacaaatccagagaggaagagtaagagagagaaagaagagaagctagtgcccaacacaacttcctctcttggcagtggttgataatatcaattaaaacagaacatgctcagtacatgagaactagtttctgttagttccctttaaccccctttgattcaaaggaaatttataggaattttagaggattttattcctatagaaatttttcctacaaagccctttaaatcaaagtaatgaaccctatggaatcatatgaaattcctatggaatgtctcttcccatataagttttggagaaattttaacaagaggtagaacctcatggaaaaaatcctttgagtctttatctctcctcaaattcctgtgtttttcttatggtccaatcaaacggtcattccaatgtttttcctgtgttttgcaatcctctgttttacacttacattcctgtcagaatcctatgtttttcctattcctccgttttttcattcctgttattcaaaagggcccttaagattataatgataaagtattctctgaatttttgtatacacaagtaaccaagttggtgcaatattacaactaattagatgcttgcttatgaaactagggcctgttcactttgatgaaaaaaaaactgtcggagatatgggcccgggggtatgcgaagtaaagggaagttatcttcccctccagccacgtggctctgcaagctggccccactctcacacctcgcgagttgcgaaagcgacggggggcctcggggtggagcgtcaccccctcgggctctccccctgcttcgctccgaggccctcgcccaactgccatgtggcggggggagagagagaaaaggggacccaggccgaacagccataaatacgcggcgccccaactgtccctcaccgcatttaatttaatgcggtgagggtagacgtgcggtgccacctaactgacccctgtcaatcggatgtgatcggcctgttgccggtcatgtccgattgaacgggcggccgtgcccccacgtcgcctctgtatccggtggagtaggggtaggtatgacccgtcccatcggagcgtcactcgaaggagggctaccacaagtctccactcatttatgaaggaatgatagggctgtccctcgtgtcaggcaggggcagcgctgggtcccactcaagggcgggcttctacttagcttccgggcgaaggcacggattgtggcccggtcaaagtaaagtggggtccccctcctatggaggggtaggtagaggcggcacatgtggtatctccttgagatataaaaagaggacattgcacaccaatacaaggggacgactctcagaaaacctgaactctaggaggagaaaggcgagagcactctccggagtaaaggaacccttgtaatactcatccataatcccaaacacaggaatagggtgttacgctccatagcggcccgaacctgtataatccgattgtgtgtaagctagccagcaatcttagaggcggatacgtgatttctaagaggcgagcctctgcccccggccgaactcacgaaaggggggtctcacgactccccactattgaggtcctttcctcgacgaaaaccttaccaaattttggcattaccaaaattttaacatggttgccaaaattttggcaacttgccaaaattttggtaggatttcttatatagttgccaaattttagcagcaaactaaatgtagccactttttttttcaactttaccaaaatttggtaaggttgaaaatggcatcaaagtgaatatgaatatgcccctaataaaattatttccattcatgcaactcccccttaatgtaactctaatctacatttcttggaaaagaatttctgcttatgaagattcctgatcttcacaacaaatctacacgcagataaagaaaaaaaatgtaaatgctctaaacacatgtcctctagtactgttgctcacaaaacctccccctcaccccactggaaatttcaggactgaaaaaactgcacttatacaatcaacagccacagatcaaagcatttatacagtcaacaaaataacagaccgagaacagcgttaatacattaaacagaaacagatcgggaggggtggtggggaggggcaatacgattgtgattgcatccaactaatatatgtgaaatcgaatcagcaaagcagcagcaacacaaaaaaaaaatttgctcaccatgagccgagttatacagatctcaacgcctgatatatttggattcaaatcagcagcaacagcagccgttttgcgattcgcatccccttgcctgatgaatgccaaaccgccatggatacctcaccgggcgcagccgagtaaggcatggagtcatggacgcctcgccccgaaccttggcgaacccgagcctgcctccgcagtggcaacggagggtgctgcactgcgctcgttggctgagccttgctgcggcaaaggcatcctgctcatggccttgctgcacgagcggcctcctcccgccggtgaggccgccgccggaatcgcctcctcccctcgacgacattgcctttgagcagtggagctggaggaggcaacactgtttcaaaaaaaaaaaaaacgtgttgtgtgagaaatatccagaagccctattcgatcgggcaccaatcttgatgtccatccgacagttaggaatttgagtgcgatttggagacaaaacacgctggtgatgtatagcaaaaaccataaatagaggggtttaataaaatttaaaagaaataaaactgagataaaagaagggttttataaaattaaaaagagatttaaaagagagctcttaactttgcaaacaaaatttaggtccaaagtaaaagagattaaaagaaaacaaggctgctccaatggaaaatcgagaagagtgcaactaaaaacttttcgcaaaaaatttttcttgaaaaattgagtatgttacaatatgtttgggagaggaaagaaatactcagttgcagtaacatagcaaatgcaagttcatatcactacttctgcgctaccagaggtataaagatgaaatcattgatctttacaaattagagcacatagcacaggatgtccatgaacctgcaaatgcgatcatcaaaatgctgccatctactttgtaaagtttaaaaggaacactaatcaaaagctgagtcctgtcaaatttacaacactgaaatttacattgttatcgtcctcgacatgctgtttgctctggttgtgttgctaaatttgcttcttattcagtgcttgagtaaatttatcacaaacaatattctgtatcgttctataattctattggttttcatttctaacaacagaatctcatttcatgataagtgttgaagctcatgtgttttcccctgtctaggattgacttatttgtgctcattgttcgttaaaaataccatttacactggtgagttaacaaatttttatcctatgtatatcactcgcagtggagctttgattttttctattataaacagtgtatggcttcttctttttttctgttgatgtacttttagctttagtaaaatttccatctattgactcatgataatttgatatatgcgataactgcatcttactgttccaaaaaattgtaccaaactcgaaggactatagctttctcttggcccctgtttgcctctttttgctgaggctatgtggcagcaattatatgaactagatactggggcgcgcctattgcacgcctcctgtacgtttttgttttgagtgtgtttatacctttgtgtttagttcacttatgtaatatcacaatgctttggtcagtttagggccatctgttgtgctgacccttgtgaacgttgagtggagcaacgaatcgtggattagtctgttctaccctgctataaaattagtgaacctaaaattgcaaggttgataagcaaaccaacagacagttaaggtagcatgtacattattgcaaccatttcagcagtaagctcacaagcttgtggaataatgatcgacgaaaaggtacaacgcatgtagaaaataataaaatgtgtggtacctggtttcacggttgtacagttgtattactacaacattgaattgtatgatacatttgaattttatctaacttgctatgcaaattcaatagcatagagttggcttagattaaatagaaatgaatatactctatattagactgaagagagaagattaagctaattagaatttgaagatcccttagttgtactaacagggaatagtactgaattcaacaactaaattttctgaagtatcatagaagaatgaaggcatttatacatgctgatctatccagcttatgtttaaaaggggatagtaaactgctgctcagacacaagtgaataacacttcaataacagaagttagactcataggtcatgtatatgtatgaataaactaacgccaaccagtttacaaaacaaatttcagaccacactgtacagatgccacatagatcaatgaaagtggcattgcacaagtatcccaccttccaagcacaacccatgggaatgataatgcacagtgtgcttacggttgggatcatcaggcatgcactggcctcatctactaaacatgggcaaggcaaagagagacattacgagcttagcaatttgcgatgccaacacgttgtagcaggttgttcaagatagtaaaaattatacctccctttaaactcaaaaacagaaactttagtatatactccctccttcccaaattgatcatcatataatggaattcaaaatttatcaaattaatcatcacataaccgcatagacacggatttcatcggaatacaattaatgcagtatggaagaatatgtgcatgctaaggtgtaattagcacggtgttttaattgatgcatgcattgtaggagaatgtgtgcatggtgatatgatttaaattattgatgcataaacatatatgatgatcaatttaggaaggagggagtacaaagttaaccccacataacagcttacaaatatgagccgtaatatttggtttttgttttgcaaaatcacatgaatttataaataattagttggaactatagaccctgatgaacctatgcttccagctaaaggtttgatactatgttcaggattaattttcaatttctggtagaattgaatttgatgaataattagtttctcatgatcgctaataactttgagttaaacatacataatacagtgatagaataatttacagccaaatactaagttcagtaaccatatagaaagtttgaacatgcagacttagtaagtcaaatagctgcttaagatcttagattcctgagttgtttttatcatgtactcacatgtgctcacagaacaacttgatgcttggttgatcacagtagtatagcctcccatctgctgaccatggaaaaacaaatcaagttagacggaggttgatagtttatttgttgaagaagagtcaattcttcaggattgatcatctcgagtcctctgttgaggatggagatttcataataaataagtcttaaccaaacttgtttattccttttttcgaactatatttcgttcatatgatagaatatgtgtttaaataagttggatctttatggagtctttcccaataaatacttaaattcttttattcatatttctcggaagttcgaacagatccagcagtcaggaccccagaacggagcatggcagcagggaaatcctaattcattaggatagcgttggtcacaaacgaaaatattaatatcaaccaaacaaataaggggggagggttagggagggaaaataacattaaacaaacggaaaacaaaataaagacctcaacgtccaaacaacgaagcaatcagcaaatggattgagtgaaaaactgcaagaaatagcagcagacatatatttagtacaagtatactacttcacttgagagggaaaaaaatacgtgtgcggcaaggacaaccgatcccagagaagccgaacgatgaggagtaacatcgagctagcatcttatttctaggaccaaagaatgaaagagagggatatgaaacaagtaagccacaacagtgcacatagaagaagcaacataatagagacgtagcagctgtctccgattgtgtctaataattggcgccaccgaggtgaccgctaattaatatgcgtccatggtcagttgaaaataattagcatccatctagcacgatattgttttagatatcatagtatgtaaatgtatttgcaagaccggagccggccggaccagaaccaattcacacagcaagcaaacggacactaaacatgcaccaaaacaacaagaaggaagtaataaatgttgttggccaccggatggtgccaatgactgcatcagcccaagaatgcatccgcaaacaagcatcaattgggcaacatctttgtgacacacaaacataaaataaacaacactagcaaatcgacacgccattaaatcaagaggagataattttttttttgaaaaaacagagaaaaatgaacccaccgatcttagggaattttatgatttagaacaaggatattactccactcgagagggtaaaaaaataagcatagagcaaggacaactaatcacagtggagccgactgatgaggagtatgctgaagctagcatcttatttataggagccaagaatgagagaaagggcaagaactgaattgaatcctcgtgaatgaaacaagcaaccaacaattgagcacacataggaagcaacctaactgacgcgtgacttaggtcctgtttgtttcagtttaagattattgtaatctagattattaaatcagattactttaagctagattataataagctgacagagaataaactgtgagttgtttgtttctctggattattagaggtatctaagggtagtgggtctttagccactcaataatatggaaaaagctcatctagaagagattattgggttatactagtctagcttatagattataataatctacttgtttgttccagtttactcataataatctatattataataattctaagctgaatcaaacatagccttaataaggagccatctagacgacacgacacgtagcaaaacacagggggaatgaaacatgcacacccatatataacaactcttacagaaccaattttatttttaaaaagataatcaccgagttcatcattggtttataatcattttttttcatgtctatctttctactatttatttttttttggcagagaacacatttgatcctttcaacaattttaataactaatccaatttaaatctagtttccaaccacaaaccacttttgtttttgcataattcagactacccctgatttttttattttagcctactttttcgtatctcctctgttttcccagacagggctacgaatttcaaaccaacttgaaaccgtgtcgaccatccatatcataaaataaacaaatctatccactaacaatttgacatgatattaaatcaaaaggagagaaaacaactcgaaaaaacagggaataaggaaccccaccgatattagggaattttatgatttgcattggtgctgaggtcaaacccatacaacctttgtggttgcatctgacaggccgaatcctctccggatcccggtccatctccaccgtccattctctcccatcgctccacgctccctgcgcggctgcgcctcctctcctttcctctcctcgccgccaccgccggggcgccgccgccggcctagactcccccccccctctctctctccctctccctctctctcccatctcctctccggtcgagcgcgcgtgcggcctcccaatcccgacgccgccaccagcccaaacgcacacgcagacacctcgtccggctcggagactcagccccggctctcgcatcaggcggaggcgggtgttgcggagcttgatccgttgcttttggctattccgctcctcacccggtgccgggaaatcggcgagttgtcccccccttgttcttcttgctatccgggtccgtgtgatgaacggcggcaagaagttcggcggcggccgcccgccgacggggactccgtcgctggcctggtcttccgtcgtcgtggtcgtctccctgcttgctggagcgtccatcgtgcacaacatctacaagcccaacatggtatgccttttgtctacacctcctggccatgcgcgcaacctgtttgacgtaatgcctgctctgttctgctaccggcgtgctcattgtttctgctcttgtagaccattccaccggtggagagcacggatgggggcaagcagagctagacaagttcaaaggttcgtgctcagagtgttagaggtttcgtttctttctcggtatatgcatcctcttgtgagatgaggccgacggtagtcttattctgtcagaattttgagagccaaattaagcctgcagtattgctcgctaagtatttttttaacagactgctgcactgcattttatttattctagtacttggttaattggtgattgtctcccaaaacattatgatcccagtcttgaaggaatgcaactagagaaaggggatgaggcaattttatccattgctttatggaggagaatgcagttgtttgcttttcttttcaacgtgctcattaattcaatgtggaataagtccatttgactctagttggaaatataggacaaaaagttgaactgacaatcaacttggccaggctactggttcggtgatttaggcatttagctgcccgaccggcagttcatcggttcaaccagtggtttttatagatcaatattttatttgtttatattttatgttaaaaatacaagtaaatgttgctgaatattataattaatatatatctctataattctagagggaaaaaaagatgaatttctgataaaataatgaggcataaataaatatatattttttgccgggagagtatttaaatccagatctgataataaaagagaaaccaaacaaattgtttcaatgtaggcaatctcacagatgtacagatgaagcagctcctctgggcataggctcaagtacagccagtgtgcagccctaaccactgggagctttggacctaagcaaaccagtagtcatttcgacatatcggtagaagctgcggcacctcaccttggctgaaattaattttgacaaattgaccctttagaaaaaatatatgaaaaatggacctaggccagaacttattttaaaaatgatacatgaaactctgcctagcttggtgctgacctcccaatctcagcaccaggctcgttggagttgaactaggggacttaacgtcgagttcatttttaaaataggttttctgaaagagtcaaatttgtcaaaatttcggtcaccttggactgagaggtcacaaatgagtgaacggtgggagaggaaccgatgaggtccggaacctcgctggtcgtgctagctgcctcgctgtgacggccatcgcttgggacggtgatctaggccctgtttgggggagcttaagattatgagaatctgctagttggtatccagcttccgagaatctggagaagttaggtttttcagtttttgggttctagttcattttctggagaagctcggcatgtagcttgtcgtggcctcgccaagaagcctgtcaggtgtcagcaatcagcatcttaccagacaagcccatctccactctctacactatgacactctagagcagtgttttggggctctaaaggcaaaaggaaactctaggcaattggcacttatagccctaataactcaaactagatgttacacaaacgcagtcaaaatttacatgggggtaaacggtccgaacctttgtaccttttcaatattatccactgtgcaattagccaattctctggtaatgcatgtgtacattaaaaaacatgtttattcttgaaaaagatcggatggctatttactctgttggcagaactgagaggcatcaagcatgttgcttgctattttcatgaccagaacagggtctaaacatacctgagtaacctcgtttttttttatttcaagtacataaacaatatcgtttatttgcagaactggtaccttttcttccataagacaatggttattgtactcaaaaggttaattttgtagtttgaaatatcactttattaccttgtgaaactacgagaggtagaaccaatgcattattcaagatggcgacatggcgtacctctattaagctaaactgaatggaagttaacatctagagcaaccaaaaataataattatgcactgcaaaaactgttaaatggttcggtatgcagtatcaacagtaacaaggcaactgaatcgaaggactaaataatattgtacattgcatggattgttgggatggtgttacgaaccgactaccgagagagtagtttgggatttgtgggcagaacgagccaaggagaaggaagaacagaggaagaactcgagagagatagttcgggagaggagatagatttcagagatagttgttgtgattacaaattcaatgattctctcttctccccttcgatgcttatatatttgcatcgggtacagctggaactcccacccattcagagccagctaagcgaacatttgcctttgtcacgcgcgtggaacgcagcctctctctgacgggattatccgttgccggatggtgtacagtagccgtaacactcccccgttctttagagccggcttgtccccaagccggggcactgcgtcttcctaagtagcttcagctaggattgtcctgtccacctgaccaagagttgtttaaccgtgccagcgcctttcttggaaactcgccgcgccaaaacttgaactggaccaattgttcctgattggctagaggtacgaacaggatttgatggagttggaggcaatgccttgcggagctgtgacacatgtacaacaggatagatagcacaaccagtaggcaactccaattgatacgccacagtaccgactttgctcacaacctgaaaggggccaaagtaatgaaaagctaacttatgattagctcatgatgccaaggaagtttgcgcataaggttgagccttcaaaaacacccaatctccaacactgaaaccctgtcagagcgatgtatgtcatcttgccatttcatacgttgttgtgctcgcagcaaatgctaacgaagaaggcctgtaatcattcccttctcctgccgccattcctctagatctgaaactgcacaagtagctccatccaacgcaccgaaatgtcgtggaggatgaccatacaatacctcaaacggagatgtccccaaagctgagtgatgtgtagtgttgtaccagaattctgccaaagctagcctccgtgaccatttggaaggacaagcatggacaaagcatcgcaaaaaggtctcaaggcactggttgatatgctcagtttgcccatccgtatgtgggtgataagccgaactcattttcaactgagtatcagcaagccgaaatagttcagtccataatgtgctggtaaagatgcgatcacgatctgaaattattgcttggggcaatccatgaagcttgtagatattgttgagatataccagcgccacatccaaagctgtaaatggatgagctaaagccacaaaatgagcataacgactgaatttatccaccacaaccaaaattcagtcaaatgtagaagatttcggcaaaccttcaataaaatctgagagagaccgtttgccaagcatgatcaggcaccggtaatggttgtaattaacctggatacttcactcgttctgcctttgcttgagaacaaacagcacattcagtcacaaacgtatgcaccgctttcttcaatcccggccaagcaaacaaacgcttgattctgctgtatgtgacctgaattcctgaatggcctccaataacgctagaatgcaaagccatcagaattttatgctgcaattcagagtgaacacctatccaaattcgacccttgtaacgcaaaataccattcaccagagtataattgggatatttgtcaggtgccaacagtatctgcgcaagcaattgttgagtagcaacatccttttttttttgaaaggaacgacgacagaagacctgccggaatttaattaaggaaaaaaaggaaaagtttacaatcccagaaatgggatgtcaagtccaaagacagaagagaacaataagggggcctaaaggccgatcttctaaggtctagatcttccatgacaagatgggctacctgatttactgtacaggaatgattattgaaaattctcctatttctttctagccaaatattccactaagtagttaacagtgctcctctaacgtcctgcttttgatttgtcgatccatcttgatttacttggtcccaccaaatagagatgttcgccggctatagggtagggactaatagatttcgccaggaatgaacgagagtccaaacttcactgacaaacacagtcacagaaaagatgatttgtatcctcgaatgcagacgtgcaaagacaacaaatccagttgcacggccagtgacgccttagcaggttttgggctgttagggttttgtgatggaggatcaaccacccgaaggatcacatttttggctcagctggtgacttccatagggcatcgaaatccaatcgtgcaaaagatcctgcaaattgataggagtaagcttctttactagagtaaaccccagaaggattccagttccatgtaatttcatccggttgctgggagaagtttgatatcttgggtcattccccccaattgcactaggtcgtgcagctcttctactgtcgtgaattgtcgaaaagaaacaatccaattgtttgacgagatttcaacttggacacatcgttgctttagtttgtctaagcgaaaacagagaggggcaacatcctttggacataatccgttaagccagtgatcgttccggaaacttgttcttgccccatctcctaacgtgatcttagttgctgcttggaatagtctcttgtcagaatcgtcgcacggcagagtcattccggcccaaggtttatcagattatttccagttgaaccacaacaagcggaggcaaagggtcctcgagaatttctcgagatcggggatgccaagtcccccaagtgattttggtctgcacactgattgctaattaaccaagcagcttcctgggttggtgtggtcaggatcctctcccttccaaagaaaagatctcctaaaatgatcaatcctcttgaatacccattttggcgtttgtagaactgagagatgatgaattggcatcgaactgagaactgtcttaactaaagtttctcggcctgccgaagtgaaaaaatgtcctttccaggtggggagccttgcaccaattttttcaatcaagggaagaaaatcaatttttctcagtttacggaaatgaaggggtagaccgagataccgacaggggaaggactttgatcgtgccaggaaacatttgtagtagaggagcgaaatcaaagttgtcacacttgattgggtaaatttctgttttactgatgtttgtgtgcaaacctgatacttcagcggagaattttagtaaaagatttaaggcagtgaagctccgaagggtcgggtttggcaaaaaccgctacatcatcagcatataacgaacaacagaacctgttgcgattcccatccattggtggaagaatagatgcattttcggctgctttgatgatgtgatgaaaaggttccatagcaaggatgaacaacatcggagatagcgggtctccctaacgaaggcctctagcgtgaaagatttcttgaccaggcgagccgttaaggagaacccgagagaggatgttgcaaaaagattcgaaatccaatttagccaacgattaccgaaaccgaaatgccgaaggacatcaattaggtgcggccaacataccgtgtcaaaagctttggcaatatccactttgatgaacaaactttccttttttgttctgtgcagcatttgaaccatgttttggacgaaaaggaaattatcatggatcgctcttttacgaataaaagcactttgattatgtgaaaccatctcatttagcctcggggcaagacgatttgccaagaccttagtgattatctttgtgaagctgtgcacaaggcttatagggtgaaaatgttctgcgcctgaggcatcatctttcttcggtatcaggcaaacaaacgcagaattcaagtcctccagttgcaaaatattcatgttgaaaaaatatgatactgctgaaaggagatcctccttgataattccccaggccgccttgaagaaagccccaatgaaaccatccggacctggagccttttcggatggcatggcaaatattgtgtttttgagttcctcttctgagatatcttcttcaagctctgacaagtcgaaaatcgggaattgaaggtttgtccagtttataaccgaagatcttgggaagaaggttcccagcttctcatggaagaaacgaaacaaatcattttctttatcttgagccgagacagcaattcccgtaggggtttgaagagagtgaataaagttctttcttttccttgaattggcttttaagtggaaaaattttgaattgacatcaccttctttaatccatgttagtcttgatcactgtctgatcttgattttattgagaactgacaaacctaacacacgagatttcagattggaaagaagctgccgttcttcatcagataagattcttgattcctgagcaacatcaagctggaagattacttcagtggcgacagcaaattgtagcttaatatcacccacttgagagcggctccatctctttagatcacgagccaatatgcagagtttaagtctgaaaatggcaagtgggttggaggctaggatttgtctttgccaagagtcctgcacaacatctaggaaacctaggatttgtagccagaaagcttcaaaacagaattgcgggggttttgctcgactttcatttccaactagaaaaagaggcgcatggttagaacatgctgaggataaagggtacagatttgagccactaaacaaaacatcccagtcagttgagacaaaggctcgatctattttcgtttgcgtcagggcttcaccatcatcagtccaagtgaaacgtcgtcctgacaaatgaagttccttcacttggatcttatctaacagaccaccaaaacgttgcatcattcttctgtttaggcggtcgttgtttttgtccgaagatttatagatgagattgaaatccctaataatcatccaagccggcttcatagacggtctgagagcttcaatttcagcaagaaaatcaattttgtctccctcaagctgtggaccatacacaacagtaatggaccactgcaggttctcttcacgcatggtgatggtcgctgagacagaatactggccgagagagatgtcagagagagagaagaaattttcatcacaggctaacagtactccaccccttgtagagtaaccattctgaacttcttccacccaagaatgaatacaaacagataatgccgacaattgtagttccccaacatgattacagcaagataaagcatcagccgctttattctccaatccttttctatagaccaagcgataattcaatcccaatagttttgtcatcgcttgttgctgccactgagtagccaatcgctgatcaccaataattttgtcatcgctcgttgctaccactgtgtagccaaacgttgatcaccaagattaattaaactcctttgatccgtctgataacaaattccccaaactgcaaataagaacgccattgatcgactgctaaaagaattgccaagcactccttctcgtatgtggataacctgcgattacgaggccccagtgctttacttaaaaatgccaagggatgtccagcctgcaagagaactgcgccagtctcgatctcgaatgtcttagaaaaatccggtaatgcaagcaccggagctgaggtcagagctgctttgagtgcctcaaaggctgcctgatggtctgacgtccacacaaacactgaatgtttcttaagtaaaccagtcagtggacgcactgattgtaccaaaatgacgcacaaatttgcgataatatcacgctaatcccagaaaaccatgcacttccttgacattggttggtactgcccatcgctgcactgctaaaatattcttgggatcagtcgaaactctagcctcactaatgacatgccccaaataagttgagctggactgagaaaacaagcacttggtttaaccttcaactgatgactatccaatagctgaaacacatgtcgaagcaaagaaacatgctctgccagagtactgctgtagatcaaaatatcatcgatgaacacaagcacaccgtgacgaagtaaaggagccaaaatcatattcatcaatccttggaatatggccggtgctcctgttaacccataggacattacacgaaactcatagtggccattgtgagttttaaacgctgtgttttttgttcatcctctggcctcatttgaatatgatgatacctagcacacaaatcaaaacaggtgaaaataatggtgccggcaagcttgtccagtaattcatcaattattggcaaaggataacgacttttcacagtaatggcattaagatggcgataatcgatgcaaaagcgccatgtcagatccttcttaagaacaagcagcacttgagaagagaacgggctagagttgtgctgaataataccttgctgttgcatttcaaccacttgtcgttcaatttcacccttctgagcaggattatatctatagggtcgaaggttcacaggttttgccccaggtaataatggtatcgagtgctcaaactgttgagcaggaggcaatcctttaggctcatcaaagactgaacagaattcttgcagaagttcagagataggtgctggcaattctgtctgttctacagactcttctagtaaacacaactcaattacttgcatcattgaatcacgatgaaccattcctttaacttgacttgctgacactccagggcactgagaagtatcaccagtttaaacacaccagttgattctgatactgaaactgcaatgttttaccttgccaatccacttgcataggactgaatctttccagccaatccataccaataattacatcataagtacccagagataaaatctttagattagactgaaaagacacaccctgaacccatcatagacaatccacaaattcctgatcacactgcaagattccaccatcagctactttaaccttaactgtcggcattgtctgatagactccggttaactgattagctaaagtggcagagacaaaactatgggtgctccctgagtccaccaacatcagcacttcatgattctgaatcaatccctgaagtctcagagtatgaggagaatcaatgctgcctaacactgcctcccgagaaataacacaaagctcactgtcatgttcagaaacttcagctgactgctcaatctcaggttcagaagacccttcctccagtaaatcccagagctcctcaattacatgcaactgaactgtgggaccacatttatgttctcgattccatcgttcaccacaagtatgacataatcccttagctcgacgataggctcgaagtgccacaagttttgtcctccacaggtgcagctcgagggtcatcagggtgtcctgatgcaccaccgccttgccgagctattatttaccgcttaaaaaatatggtttaggatatggtatgacgactatccatctgaatccgctccgttttcacccctaattactggtatgccagctcgtatgccaccgcgagcaccaccagcaaatgccccacgacgcacttctcgttgattagtctccaaaacttcttcctgcaagcaagcaagcaagctaagtccagggcagtatccaaatcgggatgacaatgtaaaatcactacagatcttatttttgccttcaacccatctacgaactgagtaacaaagaacaccgaattccatgacgggtgatgtgcaccatcgatttaggtatttttttcaccatctcaattaccaactagaaaatttctacatggtaaaatttgtttgacctttaattactagaatgacaaaaaaaatatgcttgtacaaatctacataagtatattatcaactgagtacggaaaaactgagtacatatagccaaaaatactcaaaataattaagtttttacaccacttctcacgttattgtaccaaaatcatacccacctttcaagtagttgtaccattaagctgatttattaagtttttgttctaggttgcgcccacttggcaagttgttgtcctagcatgctcatttctcaagttcctacgctaaattgcaccaacttgctaagttctaagttgatgtaccatgaatgcaatttactcttatttaagaaaaggaaacatcgactttatagcaggtaaccttcatattcctctcagaaatagagagcaacattataagaaacatgttccatgctatcctttatagcaacactgacactgctgcaacctgcaagcacatgcgtcggttgtagcttttcaccttggaaaatactcaaaggttcatattgctacccttagaatatacttgtaggtgaaaagctacgaccgacatgtcttcagattagctccccgtctttaactattccatgtctcaagagagaggccatgatgcaaactctttataatcacactgttggtgtaaatattatgccttcaaactttgcattaaattgcttacagggacaaaccgttggcaccaataaggcaccaataaacaaaaccctccagagcccatctggtcctatcattgaaggttatgggattcttcacagagagctgatccaactcaatggtgtcgaggctatcctggacttccatgttttcgaagtctctgactttgatcttctcataggccatcccatagagaaacttctccttgatgcgccgcatatcggagtcctagacatcaaactcaggaaaatgacgtttttcgtcctgatattgcaataaaaaaaattctttgatggaacccattcccaattccgagccaattaaaaaagtgttggctatctctccttttgagtcccacgaatccctcttcgaagatgatgccagtgcattaggaggaggacgatcttggagaggtgatcgagttacacaaaactgatccaccttcatgacctccaattgagctcaaacctcttccttcaagcctttgctatgccttcttgcacggtgatacagagtcgcccgtcatcataagcgacaagcttttcgatgacaagaccttcaaactcacagctgtgttagaaaagcatcactatgttctaggctagtctcttcaagaccttaagtggatttgtttggccttttgtactcatcatgttcctttagatccttcttgtgcaccctctcgagagctgccatgaagactaaataatgtcatgagggaggtcgtgaaaaaagtggtcttgaaacttctacatgttgggataatttatcccctcctatatagtgagtgggtccaaaggggtgagacaagaagtccctttatctccattactttttaatttagcagtggaagccttaacaaccatgatccaaaggctgagagagagcagttaatacaagggttgggagctaatgctgatagtaacattgtaattcttcaatatgctgatgacacaattttcctgattcaggagaatctagattatgcaagaaatttaaaaaagtgctctgcatttttgagcagttatcaggtcttaaaattaatttcaacaaaagtgaggttttcttcatgggagaagcagcctgaaaacaaaacctatatagttagatctttacctgcaacattggggattttcccatgaggtatttgggctttccaattgaccagaagagactgttgaataaagattggaaacaggcagaagaaaaaattgaaaaaaataggatgctggcaaggaaaccttcagtcaattggggggagggtgactctaatcaatgcatgtcttagtaacaccccctatacatgttatccttctttagagtgcctattggggttagagagaaaatgaatttgtttagaagaagatttctgtggcaggaagatcaggggatcagaaaataccatttggttaattggaacagtttgttcccctagagaaacagggggcttgagcatcctagatttagaattcatgaatattgctttgttggggaagtggatttggaatcttgaaaatactgatggcttgtggcaacagatgatcagacaaaaatatttatccaaaaacatcttggctgccacagaattaagatcaggagcctctcacttctggcaagggataatggaagacctggaggataggatgaatgggaccttctttcttatcctgtgccgatgatagatgtttcttgcttggctcaatgtaatagatgttgggggacaattagaaaaaactagcttgtgcatcaggcatcctgtcattttgttttctgtttcttggtgagcaccagggggggtatcctcttaggttcaagactctgtttttgtaagaatctatacatttctttaatggaaattgagggctttgccctttgctcaaaaaaaatagtgagtgggtcaacctagtccagtttgtgcctaaaaagggagatatgacagtcgttgaaaacacgaaaaacgagttaaccccacaacgtactgtcacgagtaagagaatgtgcatagactacaaaaagctcaacaaggctactagaaaggaccacttcctgctgcccttcattgatgaaatgcttgagcggctggcaaatcactcattttttctatttccttgatggctattctggctatcatcaaattcccatccatcccgacggtcaaagcaagataacgttcacgtgtccttacggaatgtatgcttatcgacggatgtcattcgggctgtataacacacccacgtcattccaactgtgcatgatgtctattttttctgacatgttcgaggaaatcatgttagttttcatggacgacttttccgtcattggaaaaacctttgatcattgtctagaaaactcagtgtttgcctagaccatagtctggacggtctagaccgcatctagatgctagacgatgagttatcatctagtttaggacctaaaccgtgaattagaccgtttgaccgcctagacggtcaaagatggttctagactgtctagaccacacaattaaacaatgagacaagtgtagaccataaaactgttgtttagactattgtctaagtaatggaccaatgcatttttttgtggtaggaactaaaacttcatgtcccaaccaaggtccaattgtcttagggttttgacaccattccaaacccttctcctctgctctaaacttcacactgccatgaagtcgcgtcacctcttctctgctagttgccgctatggaccttgcttcctcctctctctggtccgcgaccctatgtgagtagttgcacctatcccagtgccaacagttctccaatattatatgaaatatgttaagtgtatttacatgtgtgccaaatatgatcatcatggctaaatatgtttacaatggacagtccttcatggaaaagtttcttttaggggcttggaatatttggaaataaaggaattgtttcattttttagaataggttacctttgttttcttcctggaagcaagtccttaaaggagacttccttcttatgttgtttcggctgaatgtgcatgatcaaagtcagggattggattcttttgctgtaattttctctttttttactttctttccttttattaataaagttttttttatagcggggccttcctgttgtgtacctttcttatgtgtgccaaagctaacatgcatgctgtgtatctttcttatgtgtgccaaagctaacatgcatgctgcaagcaagtagcaagttgctaactctaatcaacaaaacccaattgttcttagcagcggctaaaagtaaaagaagagggggagaacgaccataggaatgtgagggtcgtgctctaaccctaggacacgtccctaatggacccaacttgatacacagccgattgggtccaaataaggtgacgcaataccgtggacagaatagatatggacataaggacggatggatttgaaagtagacttgataagctttccataaagtacttgcatgcccaaatcggagttcacatgaagtcgtggcggtcgtcacaagttgacgctgttctgtagtccgaatccagcttccgcgaatcctctcccattttgatcctctctatcattcctaagtaaaacaagagtacatacgtctccagggtataaataatatgaacatgaactcaaaaatgaactcacctgatagttaactcaaaaatatgcaggcaggtcaatcttatatgcattttcattaatctttgccaacaatttaaatggtccatcagctctaggcatcattttagattttctcaagtcaggaaatctatcctttcttaaatgcaaccaaacaaaatctccatgttcaaaacttagctcccttctacctttgtcaccagcaagcttatatttagcattcatgcgctctatgttttctttagttgtttcatgtagttttcacatcaattcagcacgttgtttagcatcaaaatttagtttttcaaaagatggcaaaggcattaaatcataggagcatggggcaataacccataaacaatctcaaaagggcacatctttatagtagaatccagctaatgattataaacaaattcaatatgagacaaacattctttccatatcttaatatttttctttaaaacaacccttaacatagtatacaaggttcgattcacaacttcagtttgaccatcaatttggggataggtaataaaaaataaaagcttagtcctcaatttagcccactacgttctccaaaatggctaagatatttagtgtcacgatcagaaacaattatgtttggtacaccatgcaaacgaacaatttctcgaaagaacaaaacaacaatatgtgaagcatcattagctttatgaaatggtaagaaatgtgtcatttttgaaaatctatccacaataaaaacaaatgctatcacggcccctcttggtccgagacaatcccaaaaccaaatctattgaaatatcttcccaaggaacactaggaacaactagaggcatatacaaaccatgtggatttaagtgggacttagccttttgacatgtagtacagcgaccaataaatctctccacatctctcctcatctttggccaaaagaaatgaccaacaagtatgtcctccgtctttttgatccaaaatgccccaatcaactcacctccgagcgctttcaacgataacaacaaaggaacagagctggctagaatgcatagcttgttagctctaaaaacaaacccatcgttgaagacaaatttgttccatgtatttccatccttacaatgcagcaatacatctttaaaattatcatcatacatatattggtctttaattgtttctaagctagagattttgtagtcaagttgtgttaacaaagtatatctcctagacaatgcatcaacaatggtattatccttccctttcttttgtttgataacataaggaaaagattcaatgaattcaacccatttagtatgtctgcagttcagtttgccttgactacgaatatgcttcaaagattcatggtcagaatgtatgacaaattccttgggccacaaataatgttgccatgtttataaagttcgcacaagagcatacaattctttatcataagtagaataattcagaacagactcactcaatttttcactgaaatatgcaacaggttttccctcttgaaacaaaacatcacccaatccaatcccactagcatcacattcaagttcaaaagtcttataaaaatctggaagttggaggagaggtgcatgtgtcaacttatctttcaacatgttgaaggtgttctcttgtgtggtgccccaagtgaaaagcacaccgttcttagtaaactcattcaatggagcaacaatggtgctgaaatccttcacaaagcggcggtaaaatctagcaaggcctaaaaacttcacacttgtgtgatagtcttcgggacatgccatccttgtatagcttctaccttaacttgatcaacctcaattccctacggagtgactttatagccaagaaaataagctctatctgtgcaaaaggttcacttctcaaggttaccaaataaacgtgcatcacgaagagcattaaaaacaacacggaaatgatcaagatgttcacccatagacttgctgtaaatcaatatatcatcaaagtatatcaccataaatttaccaatgaaagcacacaaaacctcattcatcaatctcatgaaagtatcaggtgcattatttaatccaaagggcatgactaaccactcatataacccaaacttagttttgaaagcagttttccattcatcccctagtttcatgcgaatgtggtggtatccactacgcaaatcaactttcgaaaacacaacaacagcactcaactcatcaagcataccatccagacgtggaatagggtgacaatatcgaatggtgatatcgttaatagctccacaatcaacacacatacgccatgatccatatttcttaggcactagaattaccggaagagcacaaggactaagagactcacgtacataacctttatagagtagtttttgcacttcgcattaaatctccttagtttcttccggattcgtcttatatggcgcacggttgggcaatgaagcaccagggatgaggtcaatctggtgctcaatccctcaaagtggtggcagccccggtggtaacgcacttggaaaaatattagagttctcctagcagcaggaggaggcaaataatattgcatatcgtgaagtaaaatcagagcatccttgcataccaaagcataagcaacaaaggtgatgcaatcaattcattaatatcagatatagtagcaagtaagcattttcctttcaaaatgatctcatttttcttatcagcaacagattgggcatttttattattctcacttttggatttggcagctttagcaacatcaacatagaccgacagattgccaaggtctatgttgatatttcttaacgacataactagtaatataattcctagcaatggcgcctgaaacattattcggtatttcttatggttacagatgtaaatccgcaagcgcacagatatacgttgtagcatttcacctgggagtattccaaggtatcgtatttctttaatcccaagggaagatatggtaagagaatactttgttattaatacgcatcacacttatgtagatcaaagtctataaggtaaatggtaggttgacacacagaaggaacaatataagaatactctcactaaataataaatctaggctacatggagaggagtaaagaaaagcctcatttccatacttctagtatataatcattttagtatacacttgctagtgtacaactatatggctataactccctaactatgccctcttagtatatcgagaaaccacccttgattgtcgagttctttacgacaatccggcatgaccatccaaccagttatagataaggagtacctgcaccaggaaccttacttagccctatatacgcacgtggaggaatacccatactgggctgtcaccaccagcggcctatctttacagtttcgtggcatatagtaccacttcatgatattcaataatctaagcaccgcgcttacattactaaatattactctatatctctgcagatgacataaagcaatcatacgaatgaacactaagccaataccactacatatctccagtaagctagccatataactaatactaagcaagtataaaccaaaggtggtactcgaataatggtgcaaataaagtaaaggaccaaaactatataaagaagaatatttcattatagaataaagtcttacaagagggatagaagctactagaaccatatctgaattctccggaagacttgaagaactcaagagctattctatttctaactccactagcacttgaacaaaatataaaccactaaggagatcttcttctttttattccttcttggtgtgttgtgaatgaaggagaagaggagtatttatagggcgaggttgcttggaaggatagagatgctccatggaatccaaagggcatatttcttcccctcttgtcaaatgtcctcctaatgatggttggagcgcaggaaatggtaacaaccatcattggaggtcggtaattaccaacctggagaatttctgggccaactgggctgggcctcggtcggccgagtttcattgggtttgtgtgcccttccgtacatttattcgccacttgttaacctctggctgattgaacgggtgttttccaccatttctcctccatttatatggtgatctcctgtaagcaaatataatgccaagtataagtggtcagctgcaagcaaagcaagtgtatcttcatcgaaatcactagccgacgaatactcgccatctttttttaccaccaaaacatgcttgctagggcagtcacatatgcttgttgcttgtgaacacatatctataggaacacatgttatctaaataattgataaatgagagattacctggtaaaacaaacctttgctcttctctgttgagtccttgggaaattttatgaaagaaaatgtggtgtaactttacatactccgaatcgatgctatattcctaccaaaactatatgtcgatcatattgataaaccttatacatatgatgcttgttattactttgagtttggtcaaattgttgtgacccttgttagattcttttcatacattcatgatcaagatctcacacacacaaacacaggattttgctcaccctctacaccaaaccagaggttagtaaaaatatttcttctaccaattatgctatacttctcactggaagccagtatacatcatccacccattaaataagggttaattggatccatgccattataacttttgcggttttgaaatatgccattgatatttgtctatttgaaaccatgccaatataatttcacacctatctattatatgccattgcttacccattcagcacattttctaaacttataggaccaaattgtccctgccttcttcctcatcctcttcctctctatcctgttcatcttccatctccttctcttgctaaggtcgaggtgtggggaagtgagaaagggaggaagacgagagaacctgacatgtgggcccatagatgttttaaataaaagttggttgactggactgtcacgtgtatgccacgtaggaccaaaattgcactggattaagttagggaggtaattatttcggcataaaaagtttagggtgtaaaatatctgattttgtagttttaggggataaatcggaccgacacaatagttcaggggtaattcagactttttcctaaaaataagtaacaatatgttcacaaattattgttattagagatcatgataccttcaggcacctcactcattgcttgcacacatagcatgtatttgttttgggggaccaagtgggaaggattagacttatctatatttttagtacgagatggtcgcatccatatgggatggatgcatccgtttggtatgagggatgtaatggtcttaaaaactttttaagaaatggcccacacatcattgagaaagaaaagtaggtgggatttgtccgccagtttttgagggtacaaggttaaagtgaatcttagaaaagtattcttttttaggaacatctcatcccactgtctcaaaccaaacaccttaaaaaataggttcaacctaatccgaatccatccaatcccttgaacacatatagtggattctccgtgcacaagttaggaacatctacatctatataggatacttcatgagatttcctcacatggcaccttttccacatgatccaagagtcctgcagtacctctgctgcctgctggtgggcagtcaacatcaacattgctgaattatgacttgactgcaggtcatttgccaaggccatgggtgggtgagaatgtaaacacaccataagagtggtttggaatataggaatgactagtattttaacacaatttgtaacactagaactataataaataacttataaaataaagggagtactgttcggccggcttaaaataatatataagagtgtcgtttgcaatgccatcgatcaaggagagattttagtgctttccagcctgcctaatctacagctttgagatgtggaaaagcacaaccaggaatcatgttccgaaggctgatttgtgagcatgatcactcagggctcaatcgtgagatcagatcagatcagaagcatataatgtcgatcgtctgatctgggtgctgctttgcacaaccaagtccaaccaccgagctagcaagcatggggctggtgacaggggcgatggggagcctgctcccaaagatggggaagcatataatgtcgatcgtctgatctgggtgctgctttgcacaaccaagtccaaccgccgagctagcaagcatggggctggtaacaggggcgatggggagcctgctcccaaagatggttcagctgctcaaggaggagtacaacctgcagataggtgtgaggaagaagatcgagtctctcttgcgggagctcgacagtgtatacgcggtccttcgagttgttggcgaggtgccaccagagtagctcgatgtgctagtcaagctctgggcgcgcgatctcagagaggcatcctatgaaatggaggacatcgtcgacatctttcttgtacatgttgagtccatggaacctgccagcccacacatgctccggcgcctcagaaagaagattggcaaattgttcaagaaagtcaaggttcgccgcaagatcgctggagccatccaagacatcgataagaagctcaaggaggtggctgcaaggtgtggacggtatacggtagatgacattgtcgtcgcaaaacctgagtaccaagcaaccatcgatcctcgactcctgaatctattcagaatggccacagagcttgttggaattgatgggccaatggatgagctcattgagatgttggcccttggggatgatattcatccatctatgaacaaaccaaaggttgtttctatctttggatttggaggtctagggaagacaacccttgccaaagcagtctacaacaagtttaaaccggggtttgattctggagcttttgtgccgattggtcagcatcctgacatgaagaaagtccttagggatattctcattgatcttgacaagcaaaggtacatgcattcgattatgatgttgctggatgaaaggcagctcatgaatgaactccaggaattcatccagaagaagaggtatgtctttcgtcttggcagctgtaccacatatattttttgaagtgctttaatttacggtggactctattagtagtatcaccagtacaaattaaacgatgttagccgttaatttttatattctactaccagtatttgagatgcaagtataaatagatacaaaccgctagattagaaagaaaaatactttacataccaccaatagagaccccataaatagcatatactttttatataccactttatgcagctatgcgcacttcgaccggcgattgtaccacatatattgctcttagtgttaaagctaatattaaccattaatatgatatcaaatccaaaattccggtggcaaaaccattagcaaaaatatcatgtaaaccattttatagtgcttcaggtataagatgccctagggcgtctttgtaaaaggaaaaaaaaactaaagctgttgatcaaagtattctcaaccattatacatataaaactcaactccttgttcttctctgattcagtagctcacctttgcatgtgttaaattcagaaatatacgcaaaccttgtgagagtgtagtcggcaacggaagtcaagtatgatattgagctccccgcctatacattggcaatttcttgaatggtcccatacatgatagtgagcagtactccagctctccaaatctatacttaggatataggactagcaaaaattcaaatcacaagtttaagtactgccaagtggtctattattcttatgatcctgccatcccttgtatgctttgtctcctcttgagtccatgtagagttgattccatctccaatagtagtagttaattttaattcctataacccccaggtgtgaagtgacgctaggcctaacacaactcgtggataggccacaccaacaaccttttgcttccatcgtcgttttgtggaaaaagtttgaaccggagttattaaacattaggaatctcccggcgaaaaaaacattagaaatcaaatcagtccaactctcatatatacaactgttagtgtggtactaaacttgggatgctatatggttccatttgcaatataaatcagtaaatcacatgtgtatatttggttgcccttaaaactctaggctggactatatgatcgaaccatccaggatgactactttggtcttgctgagtggatatagtggacttgtttggtaggtcgcattgtttggatatgtatataaaacagttgagagcagcagcagcagcagcagcagcagcaccaataataataataggctataagcaatgtggagaagatagaaaaaaaagaggagtgttgcctcttgtgcaagagctagatttacacgtgcttgaaatgcattaaataatataagtgagagaaagagacctaaacaaaaaaaaatgaaggcagccttatagctaatgcttcaatatggccatataggcatagctagtaattagctctgtgattaaacttggagatggtatttggttagttgcatggtcagtaggatcatttgtctggctgagttatcatgatggtcctttcgctttatcatagtttttcatcaataatcacatttaatcttttaggataaagagatagcttaatttattaatgacgaaaatactgattacttttctagttattagataagtccacaattcttacataagcacacaacatccactccacacaaggccttacactcatggtccattgggcaaagagtacttgctaacaacagaaagtcctttacagtctgtgataataattcataaaatatttgtggatgaaagtggggagcgagatttagagagcccactgaagtgcgcagtgaaaatagggagtcggtttggaaaggtggctccctattcccattggagatactctatccttgaatttaacaacaaatgaagcaaggtgattaaaagctacagtggtaaaacatggtcatctttgattgcaatttaagttaacccagtggttatatattggtgctatcaaactaaaagtgtgatctttcggtgctacataactagttttgctaattaaatataccatatctgtttgatacatgtttctgattcctagcacgactgttcttcatccttccatgttatgtgtaaatataagaataaacactaatgttttttttttttttgctgtttgacagtttttcatattgatgtgcttctttcttttgtatgttcgtcaattaattttagtcactaacttgttttcactgtcgtgtgggtatatatacaggtgttttatcattattgatgacatatgggataaaaaatcatgggagttaatcagatgtgttctgcaaaatagtaattgcggaagtagagtagtcgcaactactcacatttttgaagttgcagcatatgtcagtgacgtttacaaaatgaaagtgacgtttacaaaatgaagccactttcacatgaagactccaaaaagttattgtatacgagaatagttggtggtgaagataagtgtttggatagtgatccatcagttgatgcatgtgagaaaattttgaagaaatgttgcggtgttccattagctatcattacaatggctagtttgttagccaataaaccaatggaggactggcccgtagtatacaaatctattgtctggggcatggaggcaatgacaatgtagataatactagaaatatattatctttgagctattatgatctacctttgcatctgaaaccttgcttattgtatctaagtatatttccagaggattactatattgagaaaaatatgttaatatggaaatggataaccgagggtttcgtacacgaagagaaagcagctgggatagggttatttgaactcggcgagggatacttcaacgagttgattaacagaagcttgatcctgccagctgaggctgaagacaaagggtacatagatggttgccatgttcatgatatggtgcttgatctagtccgtttgttgtcagctgaagaaaactttgtcactgtattggatggcaatgaggaactggtacttctatcgagaaattcccgcagactagctctgcagtgtaagagttctgagccaaacgttgaatgtcccctgttagctaataagggtgtggagcaactgaggtcctttgttgtgactgagtgctgtgatataagcatggcatccacaggctctcatgttatacgtgtattggctctacaaaattgccttattctggaccattgcagtaaacacagtctgcagcatgtttggagtttacttcacctgaggtaccttggactacagtacattgattctattgagatccctgaggatgtaggacatctgaagtttctacaagtacttgatctgttgggaactcaaataaaagagctgccagagtcaatgggcctgctgacaaagctggtgtgtctacgtgccaataggatttacaaggtatcagctggtttgattggagagctgacctctcttgaagagatatggatagaggctgaaaatgatgacagaatacagtttatgaaggcactaggcaagctgagtaaactaagggtgctgtggattaggctttctacttacgaaccagatgagaggccgaacagagatttgttggattgcctacacaatctgcacagcatccagactgtggatatttatgcctcatccggaaagaagagcgtaatgtgggaagaagggcacgcttcccctcaatgcctccggcacttgtgcttgcaaaccttgaaattctgcaggtttccgatgtggttgaactcatcatttcttccaaacctctgttatctagaattgcaggtgatggctttgaaggaacaggacatagaaacacttggaaggttaccagagctcaactacctcaaactggattccaattacactgcgacaataagcatgggggggacatctggtgatgtttactttcagaaattgagaatttttaaggcaccccgttcactcgtgtggtttgatctacataacatcatttgcaacgagaaggctattatgccaagcctcgaatcccttaagttcactgtccatgtacggttcctaaaagataccaacctactttgtttcgagaaccaacttggtttcaggaaccttggaagaacatcgcttcaaagagttgaagctgacatctattgtgctggtgctcataccaaagaggtggaggaagcggaggcggcactggcgcaagctgccgccgtccatcccaaccatcctacacttaaaatagtaagaatatctgaggataggttgctctcaccttacaaagaggtatgtgcacacaaacttctcctcctccactaatctagctaagctagaacgagcttgttttagtccaatccaatgtgttttaatatgtttgaggacattctcaccccaattcttttaagatccactcctcctccactaatctaactagaacgggcttgtttctcttggctttaataagggtccaatgataataatagccacctcaaacacctataactcatgacgatgatgtgacacatgtttcaagcactaaatattccaattttatacttcatcaagaaaacataaacatcattgcatgtcaggggtggagctagagtattgaggggggtgcccagtaacccgatcaaaaaaaatttgtagctatacctgacctcttttcaccatgtgtgtaccccccccccctcaatacaaatttagacaccctagcttaaacttgatataaagcaaagtaaattaaataagtggcacccccctacatctcgctctaactccgcccctttgcatcaggacgcactaatgttcataagcttaaacaaagtgctgcaaccattgcagttgtcggttgctaataagctcctcttaatctcatataactctagccggccacgattgatagtgaggaataatagctcttctgttgtggatagagatcaccggccacgatatgaatgagtaaagcataatacagttgacaccttttacaatgatgtgtaaaatgtgtggcattaagtgaaaagtggtaatagcattgctttattgtgcaactttagtctatatagattatacatagttcaaaatgatatctaatctttatttaatgccatttctagttcgaaggcctcattataggtttaacattggggcctttaatttgtagatatagttttatgttaaggcttctttatcaaattaagctagtgtattgtgtatgttaacttttatttgatagctagtagaagatgttgataagattgaatgtagcaatcacctctctattaaagagttaaatgggtcgttggtatcacaacttgcaagacgtgtgcaatttagtcatttatcttataaattgctcaaattgatcactcaatttgtttgggagtgcaaatctagtcaaaacagcagccactcatattgtttatgccgagttggacgctgcgttggcaaacatggcaatgagttagcgaaagcaatatatattttgtagaaaaaccgttctactcttcattctcttcgctaatttagttagtatatttagatcgatttgttatgctcatgtgctatgccacgatcttaagtttgatggcatgtctgaccgaacggtgctggatctagcgagtcacaatcatcaacgcttgccacaaccgcaagggctctgtttgttgtcatctttgttgctttcatagtctaggaagctaacgtggcattcaccttgacataaataatacgcatggcatatttttttatagatttgtatcctaaataaattgagtaatcaatttgatcgatatataagatgactgactaaatttcatctagctcacaagttgtgatacctacggcatattttactcattattaaatctactgttgatacttaccagttcattcgttcgtaatttctcatttcgcagcccgatagaaacatcacttataaaactgctttcaaaaatgtcaaagcgcgggtggtgaaggatgatgttggttactttgacttccactggctgctgcataatccaaacatcagaaaattcgaggtctacatcgactgtgaggatgctacgcttgaggaagtggaggaagcagaggcagctgcgtggtgtgcagccaatgaccatcccaacagacccgcccttgaaatcataagacgtgatgaagataagatgatgctgtttgacatacatcaagaggtatatctcttctctgcgaagtctgataacaaagccattcggtgaatttaagcctcttcttagcgcaagtttaataatatagtcaaccactaacgtcaaatcacttgtaatcaatttaagttttaatagcatagccgactactagctttaaatcatctatattcaatctaatagccaatcttggaatctgcgttaccattgactatatggatctatagcccacttcttctctctctaggcactagccggacggttacccccggtctagagtctagccagtctatacgatacgccatacttatactaccggcatattttttttacatatatgtaaatacacttagcaagtcaaaagttctagagaatatttgagagcaacaaaagatggtatttaatgtttaccttattttgcaagaatgaatcttcaattagcttcaaattcaaaccttgcacatcctcaaactcatcctaacattttaaattgtgttcccgaaacaagaaaatgtcacatgttactaactttgtattgcgggtggtgtggttgtggcggttgttggtggaatgggggaaaaatgagatttactccatccaaaccctaacctaaaccatctgagccttggcgggccagaaaatttgagctcctgcacgtcaaatgttttgggtccatcgcctagaccatggtctacacgtcatttttttggtctagactcagctaggcgtggtctaattacttggtctagacgatcttcgaccgtttttgactgtctagacaagaaaatggtctagagcacagtttaggccctaaacgagacgaaaacctgtagtagtctcgcgtctagacgtggtctagacggtctagaccatggtctaggctttatttgaccaatgggagaaagagaaagatcgttcctacagcttttggttgagaagaaccaactgagaaatgccccgaaatctagcctcccacacacgaaatcacccccatgtggatcgatattaaccgtgctttgaggtctctacccgctacacgagagctcatcctcaacaggtcaattcttaacacgtgtttttatgagggaccagtgaccgactatttttaaccaagcctcaattcacctacatgaggagtcgaaccagaacctaaaggcacaacttaagcttgaaatatcagacaaaagttgaagaaattatggtaatttttcgctaaattcaagaaaaaatgagcattttgaccagaagaaactcctacatgtccaccggtaagcccgatatcagaaattccaaaccaaaattgtaaaccttgtatacacatcgcatataggtatttaaacatatattgatgttcaagtttttaagtttgacttgaaacttatcccaaatggcatgttctcatgatcgggtggaatagtttacgtacaagataacacacgtacgcaattctagctttattcttcttttcatctatatattcatggtgtttcttcgtgtaaatcttatattgattttctcattctcagcctgaagttgttcatcgtgatgtcaatgtgcgcaagacaaaggattctcttggctgtattggaatctatatattcagaagttcagcgtctcgatcaactatgagaatgctagtcttgaagaggtggaggaggcagaggcagctgcaagatatgcagtcgacgtccatcttaaccgtccaacactagaactaaagagatacggtgaaaaaaagatggcgttatctgaccaagaccaaacagagcagaagccttgtaccactctgtaatatctacacggttaaggacagtctatagattttaactggatattggcaaggggtatttaaattagaattggccattaacttttaatatcatgttgaatcactagttttattaaaaaaatagagtaagtatgaaaaatataagttagacttaaagttttcttaaatgataaaacaaatcataataaaataaataatactatattataccatctattaaaatatggtggaagtaaaggatgcgagtccctaacaaacgagattcacactcataagacaacacgttaaagcctcgtcggaagagacattatacttgaacccagggtgctcctgccaccacgcttcgtctaagtacactgaaatattttcatgggccaatttaccattccaggtgaaaatcgtctcacttgatatctggggtgacactttttagtacataccaaaacatacaaattcttaattggatgtgcatattaataaaatgcatttcttttgtgtgctaatttattatgtgtgtttctggatttttcttgtatggcatatttgtgttatggcaacaagcaacgttgcataacaatgatcacatgttatatcaattcatccatttaatttaattccaacttcatattcaacaaacgaagggtcggcagaatagagctcagcagatacggatcaattctcgactggagtcaatcggaaaatatcatacctttgattcaaaggatgaacaaacatgatgctttgtatcaagtgcgtagttaataggctgttgtattagtgggagcgtgttttcccatgttcaaaagcaagaacatgaaagctaaggaacgacaaattgttgtttactacacatcttatcatgaccgatttcatcggtagaatgtcatcttacagagactacatatacaaactctggtgtcaagcagaataatggaagaaaaggtgcactgaggttatatctttgatgttgcgtctttgatctcctccaaggttatagcctgcaatatgcatagagtatatataaggaaaaataaaattactttgaggaatttgtagaaatgacgttcatgcaatgacaacggagagctagatggtatctgtgaagaaaacattgtgaaaaaggagcatgcctggtcttgtccagcaaagtcattgtcgggggtaagaaaaagcatgcaatggcattccttcctgcaaaagttgatcaaccaattgaaaacagatgggtccaacagctcatcatattcattatttcatttatatctatgtccattataacaaaaaaataagggccagaagagactatgttcctaagtcatcggtatatatgtaggacacatggtttcaaaagtcatgatgatattactgaggaacgtctttatcaaaacatctatgcttctcactttgggcaatcagcaataatctacagcagattcgtttgtgctctcttagaaatgcatatgcctccacaaatactatgaaatcggaacaaagaaacagtgaaacctcaccatgttccgcgcctataactaaaccacaaatagcatcacaacattatttatgcactatcatagttgttaaaacaagagttataaagaactggacctctcacgcatgggaacacaagggcagttccaaaatccttgtgctacctcagcagctttgtcatcataatgcctgatttaaatttacaccgtgaaaagcaggaacagtaagtaactgtcgtaatcaacccgaagaagaattagagagtggacacagcacgtaagataaattacctacaagggcatagaggagctccaagttgatccttgtgatcagcaagtccctgcaaaaatatttttagttgctattcagaatcaagaagacacagaaggcaatccttaattttatactttttaccaagaaagggctggaacaatgacaacagtccacagtttatattaaaataaaaacaagatgacttctctcctgtgattaaaccagagtagaggagctgattgtcaagctgatggagttttatcagttggtatcaaggaatggccccagtggttccaagagttagctaaagggattgtgaatagtggtagattgtgattcccttttattatcatttgcgctcatttaccatgtcctttatacattggcttgctggtttacaacattgatggatcatttgttcccctcaattgacactatggccacaatgcaagagcttaatcatgccctctaagcattcaccagtttactaaccccttggagtgtcactgacaagaaaatcctacataacactcataacttttttgaccttctcgcccatacccaaacactgtctgatgatcggctgtgtctttgaccaagttacaggtatgatttccatggtcaacacacaactacttagtcttgttagtgactcagtgtccgcaatgtaccaaatcagtcactgcaatgaaagcgaaaagaaattatgtgccaacggataacaacagttcaagaatatcaaggtctcagtccacagagaggcacatgaggcaataaatcaatgtaatattgttttctcgatgctagctgtatgagattagaagaaaagctctaatgtgagaacaaatttcctttttggttaaccttgatacatcttagcaaaatatgacttaaatactccattgagattgtaggcaaatcaaaagtaacaggtacatgaggactcctagtctagacaaaaactacatggtcataaaactcattctagtaatactcataggatcccaccagaacagatcccaggtatgaccttaatcatccaatagcccaaatactatgcagaaaagttaaaacacgatttttgagttacatatgatcctacaatacgaactgtcaactcaaaaggcataaagagatccactatgcaaccaacaaaaagattatccatgatttaaaatgcatgtatacccacctccaacaactcaaccaaccatatcatctattcgtatatagaccttgtatcatagcaatcgccttgatctgttttctactcacggatttgtcaccatctgaggtaattattcctcgctgcttgagatccacgatttcggactatcaattggagtactcttttcttactcatgtttgggcaattgttgatttcttctcctttggcagttatcagaggaaataccatttgctattatttatgtctctattctagcaatgtaatttaacagggagatgctgtcaaactttacctgggaatggtaaactattttgagatttgggcacttagacaatgcagtaatatgattgattatctagaggatggggctcaaatatatgccttttattatgttggacttgggttttctattttttttcatgaagagattgctgtgaatacactcttcatatacattttagttcagtaatcagcattcagctggcatgcttcactgtttctgctctagttgtttcatatcccaaacagcactgggaaagaaatacatgttgcattcaaagttccttttgtgctctgaaaatctcaggcagtacgcagcactcaccttctacatcaatgcaacctaggatacttaaaactgtgtgttaacttagcgtgttgaaccaatgaggtgtatggaaggccttgctaaccaatggaaaatcaggggcatactggcaggttctcttctacctaagattgaagcctactgcatcaactttcaacagcagcaatagggcgtaataatcttcttatcaagctgcaggtacagaacacatgaaatagcagcatagaagaatttgtttgtggctaagatgatttttgctagtatttgatttgtatgtgcacgcagtgagatttttttaaaagtaaagtttaacgaggattcaagagagaagtagaaaatagatttggttccattaccttgataacaacggcggtgacggacttctcggaacagaagaaggtgttggagcggcgggcgtactgctcagagaatttgcgcataatctcgagcgacttatcagatgcatccgctccggcagctccagctgtgtacccccaaattaagcaaaagaaatcagaaatcgatcagattacagagtactgcatagattgagtagacggataccttgaactcgaactgtgcatttgcgtcctctgggcatgggtgaagggcaaaaggggctggcggtggtggaggccatcgacatcattgctggacagcagcccaccgatctgcgagatgacaaaggtgtatgttgtaaaaaactaatgttgctcattgatcactcttaagaaacatcttgtagttgcaaaaattatgtgggttatacataccctttctaatactactgggttgcgatgtaattatactaatggtatgtttagatgtaatgatcctcaacacctcttcaaaagggaacctaaattaaaaacttggggaggcgcagcgctgacgatgaccaacacgataacatcacctcacctcccaacacgatagcaactagcaagcaggtacgatggagcgccatccctaactaaatcaaaccccccgacagaaatagatcgagaaaaaaacatagggaggaagaggagagcacatgtgcatacataccctgcttctcggattgggaggggctgaaagggagtgaggagaactcctcgtcggcacgcgcgcgcggcggacgaggggggcgggcggtggcggcggcggcggcggcggcacgcgcgggagggagggagcgagagagagagagacagaggaggatggggaatgaaaggaggaggggcgtgagaggagaggagagccggtaaactgggagtggtggagactggagacgtggtggagtgtttgcctttttcgcgagaacgacctcgttctctcacgtttttagatcatagtcttgcgaaacttgatttgtccttatattttcggaaagtataggggtgttttgaataaacttctctgatgatgaagggtttttttttttttttgcaaaagttgaacatcggtttaggcatgttcactttgatgccaaaaaaatattaaattttggtaacttgccaaaattttagcaggatttcttatatagttatcaaaatttggcagcaaactaaatgtaaccactttttttttggtaactttactaaaacttggtaaggttaaaaatgacatcaaagtgaacaggcccttagttggggaaaatttttgggtttggttgtcacataagatatacagacacacatttaaagtattaaacgtaatctaataataaaacaaattaaagatttcatcaggaaactgcgagacgaatttattaagcctaattaatccgtcattagcaaatgttactgtagcaccacattgtcaaatcatgccgcaattagatttaaaagattcgtctcgcaatttatatgcaattctgtgtaattaggttttttttcctacatttaatactccatgcatgtgttcaaacattcaatgtgacagctgtttacacccaaatttagcacctatgtaacgccccgatttttgttcgggattaaaaatcattaaataatgtattttctagaaattaaataaaatttaaagcaatttaatcaagtgaattattgagggaattaaaaatttcctttaaaaattattggccgagaatattttgtaatattctttgtgccttaaaatactctctgaaatttcccgcgaattttcggagctcgagaaataatttgaatagtacaaagttcatttaaccaattaaataaaatgaaaaacaaattaaaaacctcctctctcccttttgggccactcccggcccaatccccctttctctcccggggcccgcgcgcctttctcccttcctccccggcctcccctctcctctcttgggccgtcggcccgtttccccttcccctcgcgcaaagt

SEQ ID NO: 82952 - DNA, 1839 bp, Oryza sativa
aaaaaaaaaggagcctccacgttcgctctcatgacctagaaattctcacattaatcagagaaaaagaaaaggcagagtccatatagtaatacaatttagaaatagctgaaattcataattaaaaaataaggaatattaaaagaggagactagagtctatatagaaatacaatttaaaaatagttgaaattcggaattaaaaaataaggaatattagaagaggagactagagtccatatagaaatacaatttagaaatagttgaaattaggaattaagaaataaggaatattagaagaggagactagagtccatatagaaatacaattaggaaataactaaaattcggaattaaaaataagaaatattagaagtagagtatagagtccatatagaaatacaattaggaaataaccgaaattcgaaattaaaaataagaaatattagaagtagagtatagagtccatatagaaatacaattaagaaaaaaaaagaaatttggaattaaaaataaggaatattagaagtagagtataaagtttatattggaatttaaaaccaactaaaattcagaataaaaaggagcctccacgttcgctctcatggcctagaaattctcacattaatcagagaaaaaaaagcatagtccatatagaaatacaatttagaaatagctgaaattcagaattaaaaaataagaaatattagaagaggagactagagtagttattacacattagtagttttgaaaagttattgcaaaatttaaaattatgttgttattgtaatatattttaataatataatgagaaaaatatatgctattatatgagagaaaatataatgatgctagccgcgcaatctgcgcgggccaccatgctagtttatcatataatgctgagtactaagacggctctataatgcagcgtaaggaagcaaaaagggtggccttgggcaggttggacgagaatgtttgttgattcaacacaactggacagcatcctgcaacaagccaaccaccaccctggaagatagaaagtgtgatcaacgtctttgttgcaagaacatatcatggggtttgcgttgctgtttgttttgtgaggttggtgatagtttggtgtgggttttggtcacgcaatggccacgtaaatcgacgagatgcgtgtgttgtgaaaccatggtttctgcaacctccgctcgaataatttatttatgtttcttcttctatttatgtacgattcgactgtattttaaagtctgatcgtagtaagctcatcacttcatcagctgcgtgtgtgcctgtttgtaagtgtgtattttcaaagttatttgcagttgctcaatctgttagatttctaatggcaaactagttgagactagtgtcctttcaaacatatatactcactgtccaagagtgtactagtactctgaaatatagccggcaaatttgagagtaatcggaacatcaatctgatgaacgtcacactaccttgtgctcttcagctcttgggcatccaaaacttgtgtcaaaatgtccggatcatttgctattgtcctttgctcctgatcagccaccctattcagcaagatggtattcagctcttatcaataccgtgtgccctcacgtgacactgattgcaaaccaaaccatccaacgacggggacacagctagaatatttatgcaccatcacgctcagaaaagattcaccggtaaccaaatacttatagtacggattaggacagaagtacattacagccacaagcaacatgagcacacgtcttttgcttgttcttattttaggcatcagcatcgcctcactgtaactaccgatgcacgcca

SEQ ID NO: 82953 - DNA, 2500 bp, Oryza sativa
tgtttctgctttgcaagcctcctcttcttcactatccagtaagtccaaaagccaagaacaatgagaacagccatcaaaccaaggcttccacctgaaatgggtatttgaatcttgaagttactactacttcatgtagtaatcaattgtttgttctggttgataaaatttcgaaaaagagagaataatattaaagattgcaagagacttgcctacagtagacaacattgttgtatctcttttacacccaatgccttgcttcttgccatctcctgtcatgcccattgggcatgtacaattgtaaccaccagctatgttgatgcacttgtgggtgcatggatagttattcccgtcgttgcattcgtcgatatcttgtagtcaaaagtaggaaacaaagcaaaaaaggatattagaataaggcatgctagccagtaatactatattggcaaccaaacacatgaattgaggatttctcaccaacacatccaatgtacgggttgccagtgtaacctccagagcaattgcagcgatatccagctccatcttccacctcatagcaataactgttctccttgcacatgtaggtttgacgactgcggcttgcctccttgcagttgccaccctgtatataccagtcgagcaccatcggcagattccccaagtccttgtataggtcatgcctagagaacacatacgagtcctgctccgcgatgaacgccttgctgcaccgtgtgctgccgctaccgacggcactcgtgggtggcatcagctggtcccgtatgctggtgaactccaagtccagcttgttgagccccttgggcactgacgactggcagcagcccacaccggagcattcgccgctgatgatgcttccatttgatgcgcagaacgacacgcaccccccgctgtatctgctcatcaccgtgctgttggtgttaccgacaacatcgctgctgtttcttatcattgccatggcatcacagccaacggcggtgaacttgttttgcgtgtgggagaacatgtagtttgtggcagtgaggtcgatgattccctggctattgttatggcactgggaggagtatacggtctggccagtcacacgtacgtatccctcgagcagggagatgctgaggacgctgtagttaccaccgagcaaaatcattgggcctgtttgacgacatgatatcgcaaagcctggagttgacgttaagcttgagttggtggcaattttgaaaggaaatgggatatcaacggagctattggggcacttgagtgggctgatctgggaagaactgctcgaggaaagcgataacaagcagaggagaagcaactgtgcaaggaccatggaggaaaccatgtgtgcttgtttatcagaacgaggaactaaacctgctgcaaagttacaaggatcaagtcatgcgactgagcgtcttcatatacccctatcggaggagcacagcgcgattttcttcctttagtcaacaccattttgtcgtatgttatacggaataaacgtggactgatttgttcctaatgggagggcgtgatataacttgtggttgagtcgaattgttattcaaaggaaacatatgagagagtgattagttattttagaaacttttccctggcagtagcaagctggtatctactcccgctttgatttttttttaaaattctctatgttcgatcaaatgtaacattgaatttattttgataatatatttattttgtattaaaaatattgctatatttttctttataaaaatcttaaaaaaatcaaaacgacttattaatatgcaacggatgaagtatatgatattgcgatatccatgcctataacttgtaagcaccgtcgtcgtcgtggagtaaaaccgattgcaggccgcaagccacacttgacccgattcatttccccgtcaaccaacgatcttgtgcatctcacacacggtttacattctgtggaagagaggcaccgacgcaccgtccacggcggcctctgccgacagtaactcgtggccgtaacagcgcatggttttcgcgctcttccgtatccgtcaacccagcagcggtggcctctgctcgcggcccgcgcgggcgcacggcgccgcacggttaaaatccacaccgaacagggcaacaggccgaggcccgaaccgatcgactcgtgaggtgcgcgcgagccgagatgtacgtacgacgtgtccgtcgcaacactcgttgtcatgcgctcggtgctgacggtcgcgtgtgatcagatcacgtcacacgggtgttgaaccatagatgcgcctgcgcgcgcgcgatgtcctaactaacagacccacccacgcgcccacgacgaaatcaagcctttcttccgagcaaaaagccctgaagagcacatgcgtagcagaggatgcagctgcgtgctggtcgcagccagctcgccgtgcgcaagctgtaatgcgcccatcgatcaaatgacgagaaagcataggtgtgcagaaagaagtccaggggccgg

SEQ ID NO: 82954 - DNA, 5630 bp, Oryza sativa
tcaatacaatttcggcgcatcgccacctttttgctttagttttatttcgacgagttcttgctttcgggttgagctgcatcggtttcgatcttcaacaagaggtaaaacttgttatgacggcttgtgttctcgggattagtgcttccatctttatgatactctaatcttgtttatgtaattcgtcgagttatcatatatcttacataatctctagcaatatcgctatctaatctacaatcggctaacatctgttaatggaggacagccgatcaaattagattttgacgttgatttagattatgtaagatatctaccactctatgaaacttccagtggcttgattgtctagatattgttcttcttttcatacttagtcctgcatcagttgagtttgatctattaagttgtgcttagaatatcaatctctagcctgccttctggttgccgattagtagtatcggagtttcagccgatcttatctgatttaactatattcgctctatatgcttcattgacatgttaaatccgccctttatgtcaagatcttattgcacttaagtatattaggcttttgtttgatatattatacttgttttgatatcttgatatagagtagtatcggagtattagccgatacatgctagatctatctgatcggttattctataaacatatatagtcctgttattaatatatatttcgatctaagtaatttatactgtctcggcatgtcgaccgatctatcccaatcacttgatttaagtatatatcgatataagaattatatattgttaatatctacagccgatcgaatagatttagttcttcattgtctatttacgaccgccgatcgattcacatatgacatcggctcaaagataaatgatatgtcatcggcacttagccgatcagctatcatttatagatttaactgcggtctctttgtccccatttcttgttgattgcaggatcaaattaactggcacgctaacacacccgaaggtgagctttggacctgcactagatttaagcagatctctcaggcctcgtgtttttcatcaacaaatagatgagcaaattttttattgcttatagctggtcgcctggtccttagatgtaatggtagctcattcaagtggctcctattaaaagtattcccacaatgtatgtgaactccttacgggacttaagactctctgtatttctacatcgctgatgcccttatcatttcaaagactagcaagtgagttggacggagagcagattggacagggatgaggcggacggcttggtcgcttggataccgtggcgacgggataccggtgtttactaatttcgtagatacatgccaataggatgcaactgctcaagcctcgcaacttttacgagaggatcacaacgaccggaaattgaaagaagggggaatcatagcttccgaaaggaccgtgcaatatcttcttcacatgttgggagtcccgtcaagcagaccttctccgaacggcagctgtcgtatcgagggcatacgtatcaacgatttccgtggcgatttcaaccgcagtgagcctatcaacgacatcgaatgttccaatggcaagtgccatcttttagtggtttgcataataagtccagctggggttatcatcgacttcgaccagcaattgaccagcacctatcttcatcttactttttttcgagttgagggccttatcttcatgaccgatttgtgatatactttatggtatttcgtacgttccttccgagtgccaaataaactgccaatgatgctagtaccttttatgttccgttaaagttgcaaaattgcacgaagtcacgaacgtgcttgtaagttgtaattcaacgcgcacactgacccatatttatatgtgtataataataataataataataataataataataataataatgataataataataataataataataataataataataataataataattattattattattattattattattattattattattattaacggtgcatagcctacttctattaattagcaccttcaaaaaaactaggacgatgtattttgagattgacgaaatcaccatacgcgtctagatgttgatcggtgtctactaataaaaaatagccataaatacaagtatcattgttaagtctaagtcttaatttcggttggtaggttcctttaaaaagaaccgtcacaaggaattcatatcaggactatctacgcatttcttgtcaaattttaacacaaaaatttaacaaatataattatagaacaaccataatgtaaggggaaaatatatgaaaacaattgttggatccaaaaataaacgtatgagatttgtccacgccaataagagtaaaaaaaatttactcacaaattcaatcataagtaaaaattttactattgatgaaatggacaagtcttagacgtctatttttatccaatggtaattttcagatttccactacatatgcggttttcactacatattttccatgatgtaattacattacaacctatttgcatgtaaatacaacataacttaactcaaaaaatccctcaataaaatggtatttccgtgaaacggaggtcgtaggactgaatctactcacatgggcacacattatgattcttttcttcctcgcttgcacgaattttcaagaaaatttgactgttcaaaattgtgtgaaagttatattgtagttacatgcaagttacaatataattacattataattatattaaatttacatctgttaaatttttataagaaaatttgttgataaatacagtatatagcaaaatcgttaatatcataatacgtatatatgagaccttgtataactttgaactcggctagacaaagaaaaaaatgtacgcagaagaaaaaaatcagtgccattaaaaatagatagcccctaactactttgaacttcagctcaatggctaggcttgtgagattgttttaggcttgagcttgtctagagctctttgtaattaaggccgatcgagctaaagcaactcataagcgtcaagtttttttcccctacctttcttgttagaggctcgtaaggcccaagtctttttacataaaaattccaggttattaatctccaaaacaatctacaagaaaattagcacgactcctatgataaagacgacccattgacccactccaccccggtcctctcgggccctatcacctctcgctcccgtgcatgcaccacagagaagtacagttgagcataggcgacatggtgtgcaggcgagcaagcattccagccgccacagaggcggctgctgtggcttcatggcctctcggcccactggcgctcgcgctcgcgctcgccatcctctcggcgatgccccacgtcgcgctctcccagaacctgacgtgcaaggatgtcccctttcccttccgcgaggaaaggagcggagcaacctctgtccccgggttcatggtaacatgcgggcgaaacaacgaggccatgctccggatcggcgagcatatctacaaaatcgacaaggtgtcggtgccggaacacttcatcaccatacgtgcagggcccatccaacaggtgtgctacgaccgcagcaggaggccgaagcagatcaagccgatcaccagagtcgatccggctccggctccgacgagcttgcaggccacgcccttcaccttctccaggcgcaataaactcgtcgccaccggctgcaactacaggttcttcgctaacttcacgagctcgtcgggtggtggggacgggacacccacgagctgcgacacctggtgcaacgacggaagctccgacaccatcttcaacggctcatgcgccgataaggcctgctgcacgaccgagatgcagatggatggcgcgcaggaattcaacctgacgttaaagccgtcggggaatgtcgaggccagcacctgcagtgccgtcttcttcctcgacaaagacgagcaagtcttcactagcgccggtgatggccggaatatggcactgaaagaagcgctggtgccgctcggttaccgcaagatgttcttggattgggcgattccgggcaactgcgagcagaactccgcgtcacagtacccgtgtggcagcatgagcacgtgcaacgacgtgtacaacggaacgagctacatctgcagatgcaatgaagggtacgaggggaacccgtacgagcaaaacgggtgctcaggtaagtactttcatcgacaacagacaggctagtacagtacgttttaaagacagatatgattagggagctcgctgttgttcattttcacttcaagaacttgtgatttagcctgtgaaaaaacagataatttgggagctcgctcgattacctgctggctatgaatagaactatgtttttttctgctttctgaatgaagcttcgcactatttatgaagatatcaacgaatgccgggatatgaataacaacaactgcagcagagatgcaacctgtacaaacactgatggaggctttacttgctcttgccccaagaacacggttggcgatggttacagggctgggacaggctgcagtattgactcccttccgccatctggtaacatgtcacgtatttttggaccgaacaaaatcctattaatcaccgttgcatcacccatcacaattctcattcgcatatatataggtactactccctccgcttttttttagtttgatataccaacatttttaacacaaaacaaacatagtactatcaaaagtgcattcaatgttagatttattaaaactaatttggtgtcgtgaatgttgctaattattttataaatttgattaaacttaagaaaaattgatcaagaaaaaaaagccagatcatcttgtaacataaaaaaaaagagtcaaggatgaaaacggaggaaataattgattcagtccccttgtgccagaagttaaaggtattaggagtatataagattagttttgaaaactgttcggttcttttgctccccttttacctaaaaatgtcaatataaaaggatatatttctttctcttgacacgctacaaagacattgtgtgcatcttctatggctggaatatagtaagttcttagctgtactatttaagtacttcaatatggctgtacgtaatatttaggacggagggagtatgttctactcctaggccttgtttggatcctccgaactattaaatagtcctctggaatcttactatttagaattattaaacgtagattaccgataaaaccgattccataacccttagatgaatctaatgatgtatattaatctatgattaacagctgattactgtagcatcattataacaaatcatggattaatatatctcgttagattcgtctcgcaaaatagtctagggttatgaaatggtttttgtcagtaatctatgtttaatactcttaaataacgagattctggagggccaaataggaccctagtaatgcgaagaatctgaccaataacagtagagcattctccctcaaaccaaccgcaaggtacgataaagcagagtgcagtttcttcacagcacagaagagtaatttaagtgcagtctttctaataaggaaagaacaaagtttccactgttcaaatttctgtt

SEQ ID NO: 82955 - DNA, 30718 bp, Oryza sativa
aatacagttgagttccaaacttccagtagagctacatcacaaaaaagtcagcttgcttaaggatttcacaaatgcaaatactgactagggttcaaatattttataaataacctgagggattatatgctgcatcgcccattctggaccaaactcctcagctaggcgcttcaagttgtttgcagcagcatctctgattgagaagacctaaaattaaagatccagttaaaaacatcttaaatagcaggttataaataccacttgtccattctgcattaaaaaaaaactatataatcactgaacacaaaagcatgatatagtttctatgaactaaatgaacaataacaaaacttgtctttcagaacaatgacaaacctattttagtaagtcataaatgtcggagatattcaaatgtgtgcctactgacgtttgcaactaccataattgtcacagcatttttcgttagtagcgaaaaatatcggtgtgcccaaattttctgttaatagtttgagaaaaaatattggacatgtctgaatgttagtctttcaggctgtattgtgctggactgctggtgccacaatagaagtgaattcaggtcatttgcttgcaaaaaacagttgctacactcacgtatgttgataatattagagtgcctttgtgcacaatatatagatgatcgagagacttagaatgacagcctggtaaataccttatcttccaaccattgcatgcaaagtgcccccagcttgtcatcgaaaaatccaacgcctaattgactagccaataaaggaatgtactcaattattgcaagccgaaccctccagtgcctatcctctgcaagttctacgatcgccggtaacagtgattgtgacagcaaatcaattccaataacctgaaagatcaaaaggactcagtaatgaattttctatgaccaaggaatttatcagtcattagggaagcaaaattgaaatgttatattgagctgtgggactgatgttttctaaacactgcaggtagtcaatacctcaaggttaggctggtagagagtgagaatcctttaaaaaaataaccaggtttgcccttgaggggtattctagccagttttgatagtcgaagtgtgtataaaatgtctggtgtcatagttgagggttgatttctagactaaaataattgttgaggtggagtaaattagacttcacgctaataaaaacagcatgaacatcacaaaagataagataaattcatttcaataagaaaaaaacatgaacatcacctgattaacttgatcgagcttgctgattatattgagccgaacatcaggaaattcatccttgagcaaagaaaggaaaataggaagaagttgttcgattgtagcctcctacagaatgccagaaacaaagcaagtcaggtttccaacaatcgtgaagcaatggtagtaaacaactgaacagtaaagctgttgcaaacaaataatttgaattatttcaagtaaaattttatgaagatattttgcttgtgacctttcccaagaccggggccattcccataataactgaagccaaagctgaacgaacatgctgagatgaatctgatgacaattcctgcagatgcagttggcaagttagtttgctgggaataaacagcagcagaaaaccagttaataatatttggttaagcgttggcccaccttgacacaaggaagaatatgctgaattgcaagctgaggacttaaaatcctacagaacttagtaactttccctgcagccgctatccgcacttccgcctcattgtcacgaaggagacgaacatatgccggcaccaactgctccctattaccaaacacatgaacataccatagatgaatattggaatcagattacaaaattatgtatttagataagaaataaataataacttgcaccatttaaggaccaaagtatttatgattggttttgacagaaaagatttaggacataaggcgcataatacctagaatgttcaggaccaactgcctcgcagagctcatacaattgattggcaaccatataacgaactcgccatgatttgtcctatttaatgagttacagagagtaaaagatgtcataattatggtaacacatacaacagaagcaactcggagcatcaggaacctctagcaactaatgaatgtctgcaaataaatattatatgtgatatcaagtagatgacactgaggtaccaagtaggggtgtaatttacctgggagaaattgacaataactggaaggatatgtgctacacaatcttgtggttccaacaatttcccaagagcagcacagccttcaactgccaacaagcgtacggaatcttgatctggtaataaaaggccagcaatattgttagatgcattatttaggctgcagaacatgtatagtaaatgtcccaactggctcaatcatgcactatttgctccatgacagaattgtcccaactggctcaatcatgcactatttgctccatgacagaattccattgaaaggctagtactatgatttctgagagtttgtgttgatatttgttatcttcaggcactaatggactaacattggactagcataaacagttgtacaaattgaataatggatgcatacaaatagctctttatgctagttcttggtacaaaactgaagcagcaaatgaactgggagtggtaaattcaacagaattagaatcagcaatgcagtaaatgggtacagttttttattagttactaataggattattaaagactattatgtcatgaatgtaaagaagtatgaaatagcacaaaatattatgtgagaggtgcatggtaccatcttgggttagatcatcaaatatcgacatgacttctgtctttagatagttctgttcaactgtggctgcaaactttccaagatttgatgcagctgcccttcggaccataggcatgtcatcttggcatagctgaccataaatggtcctcaattctgccttcaattgatcaggagcacttggatatgctatatggaaaagtccacaagacgatactcgagctgtaaaccactcaccagctgctagcctctgaaaagagtaatgcatggttagctgaatacaacacgatgtagtgtaaaatagtctgtccataaagtattcattagtggtgctagatggaatggactaaggaaaaggaaaatgaaagcatgataactaatgccattgtggcactgtttccagtcaacaattgcaatgtgttaaaatagcttctatggagaacaatcaacaatatataacaaaattgcaattgacaggcaagaaacaaacacaaatatcacacaattgtatgccaaagtaacaagaaacctacatagtgaagttggcagcgaactgataaatctggcaactctacagaaaaaaaacaattaaatattaataaacttcttacctttactactggaacgaaccagtctacaatgtcactttccttcatctgtgctccaatacggcacagagattcaactgccttgtctcggacacaggtttcctccactgtacacaatgtctccaatggtggtagcaaaacatgagcatgttctacacccccaacgtaaggaatgaacacgcccaattcttcagccatagcaagaagcacctcatcttcatcgtcattattttcactgagaaaaggaattaactccttccgggttctttcttctccaagtgctcgtgcaattgtggagagcctcctaatggagttcagacgcaattgaatatcttcgtttttgagctcatctatcagtatagcgatgggataaagaggctcatccatcgaagccatcagccttatcaaggattcctacaactgtaaagaaagaagattagtgctctatggtcattggaatctagcaaaacctataatcatatatttctcatcttaggcacggttccattagagaaacaaatccatgtaaatctaaaaggtcaagagtgaaccacgcatataactcacaaaatcaagcctaaactatatcactaattaatatatggttcaatcaaaccaagcatacaatatacgacttgcccaaatacaatatttgttgactctcattagatgtaaaacagagatgtcgtctattatctacacatggtttccggagaaaagtcagaaaacaatctcatctaaacattctcagacatatcaagcacaatggaagaaaagagatccttgtgtcgtcaacagatctaaaaacaagatacctaaaacagaagaatttcagctggtgaatgaagctcagacaacttaattcgaattagatcaaggaccaccctctcagctttttatggtatatcgttaacataatttttcacctttccaggcacattttcaaaaccacaaattgcaacctttccaggcacaaattgaaccacaaaatagcaacgcagaagaataaatttgatgtgcggcgagtgattcatcacatcagggtaacagaagaaccaaatcgaaccacaagagaccaataccaccaccaccaacgcacaaacgtaacatcccactagaagcacccacacatacggcaaataataagccctcccaatccgcccccaaaatcacagccccgaaggagaacacgcaggattcgtaccaaccgcgtcaaaaccaacgtttccccccaaccaaaatggcgcagatctaaagcagatgaaccacacggcaacataaattaacccaaaaaaaaaagcagccgcgaaccgcgcaccgcacggcggccaccggaaacctaacccccgcgcctcatcctcgacggtgggggtgccgatcgggggcgccgcgggccagtcgaggtggggtcggcggcgcagatctaacgcgcggggagcgaaggggaaggcgagcgacgggcggatcctcacctcgcggggccggatcggcggccggcggagaggggggcaccgaggggacgcggcggcggcggcggaggaggatgaggaggagcggctcgcgaggggtgtcgccgctgaagtttaggaggaaagggaggggggagagatggatggggatgggtgatgtagtggtgggggtgatggatgcggaaggaaggggatcggagagagataattgagctcaacgggagcgggtggaacggaagatagcaatgggccgggccgggccgtgccggaccttgtccagagtgattttgttttttactgtgcccgtgcgttgcaacgggtaaaggtaattttaatcatttatacagatgggaaaaaaatataaaggaataataataataataataataataataataataataataataataataataataataatgaaataaaattgcagtaacctttgataaaaaagataaaaaatatataattaattttccattaattccattagctaaaaataatataatacgaagtaggaaaagttattctcaaatttttagcaatttttaaaaagcttaaatagagcaaactaattatataaatgaaaacaaatttaatcacctaaataaaacaattagacctataattgaaaatatgttgccagttcatttaaacatgagcctgcgggtgtgtgtggtatatatctctcacttgtatgtcgtggtcttttttttgacatagaaaaaatgcccatgcgttgcgacggctaattaaaattataacaaatataaaaattttataagattaaggtttagttttatatgatatgagctctttaagaaaatatatttataatgaaataaaaaaagttcagctgaagtgacctaaagtgaacttgttccatacggagcgcgtacacgtggtccatgaggcggcccaatagtgtgggcggcctgggaatagaatcggggaggaacaacttaagcgacctaaagtgaacttattccgtgtgggcggcttgggaatggcgttcgacctgacgcgggagaagccaaagccgtccgatctgatagacggtcatcccgacctatataaaagttcaacagcccaaaccctaaccctaaaatcatttcccctccccctctctctctcaaaacaacgtggcggcggcccggcataccgacatccctgcgacggcggtggtggttcggcagcgacgacgacaccctccccttctggcgtcggcattttcttagtgttcttgaatctgatcttgtatttttgtagtagtgttttctttaggatttaggtccaaatttgatgcggtctctcatttattttctttcttttctttttttattttttgccatcggagagggattgaagcgggatcgattgcacgtgcgatggaaaattttttttatggacaaaaactataacccataagccatacaaatttttttaattaggtatatatagatattgaatcggactttccttttttttcattttttttcgcccttttttcgttactacggatgtcagaaacgtctttatttatttttaccgcgtcacatataatcggattcgatttttttcgcccgatttctttttcacgctttttttcacagatggacgatggaaacactttttaatttttaagtagtagagataaagatagagatacagattgagatagagaaagagaaacggaaaacttttttcgcaaccttttttttggaatcggacagaaaaaaattttacgcttgttttttaccgcgttgatggaatcagattcgatttgtttttttaccacgctgtgtcacatataataggattcgattttctttggaatcggacagatacttttttttattttttttcgccattttctttaccgcgtcgacagagttggattcgtttagacttttttccttttttcgcccttttttaccgtgtagacggagtcagaatcttctatttttttcctttttttcgcccctactttttctggatcggacatattttttttcttttttttggccggttttttcccttctttcgcctttttggatcggacaggtttggttttttttttcgctcgcagatttttttcgtttgtttcgtctgtttttttatcggacagagtctttttttttctttttttgcccggtttttttcacacggttttttttcccacggtttttttgacggacgatagaagcacctcttattttttaagtagtagagatttaatgttctataatataacgcgtttattatgtatatatagaattaactagtagcaccttcatgtttaattcattttttaattctctaccctaaaaatatttaatcttattgagtgcatgcattttactctatcatttattatgtaagtcatcttgactttttaaaatcaaacttctttagatttaactaagtttatagaaaaagatagtaatatctacaacatcaaattagtttcattaaatataacattgaatatattttgatactatgtttgttttatgttgaaaatgttcctatattttttataaacttttccaaacataaaacaaaattggctaagaaagaagtcaaagcgacttatggataatttattagagccaaaaaatgagaaggttataatattttttttcattgcgttactagttgttgtgccttatatttttggttgaagagaatattattgtatttttcttctaaaaatatattgctttactactaatctacaagctacatataatatccatccaatacaaaaggttaaaaaaaatccaccttggccatctccctgaaataagcacgatctgttgagcatatgtttgaaaacaatttttgcttgtttaacttattcaatctaaaatgtgacattccattgtaatatatgatttgtgaaacaaaagctcgacaaattgtgcatgcctatcttagaatcgtttactgatcatctttccttgtccctactttatatgagtaagaagcaagattcttttgttttccctaaaaaaaagaaatacatttgttattgtcatgtattatttgaatacaagcatcatgtgaatatttccttttaggaaaaaaatggttatacaacattaagagctcccatttctaattttgtagcaccaaaagttatctccactctttaatttagcattccatccaaacctctatttgttttcttttctttttattatcttcctgacaaaatatgatataaacactaccgctaccttcttttttcttcctttagtcctttatctctaagggcaagagcaatgcttaccccctccgtccaaaaaaaaaaatcaaacccagggacatactagtatgtctttggtggaaataaggtgggtcccaccacaccctctgactatggtcacaatgcttaagacataaagtgatggtaagttggtcccacaactatgtaaaaaagtcctacataaaaataggttccaccatgtcatagagtcattctcaccctttctagtgtgcatgtgtgttttatctcattattttatttcttaaggttgagccataagcttatggccatttttagcatttaatgctttatggctaatatccacaatgtatatgacttgttataaggtcttatgtcacatcgtggatgccctaaatcaccattcctaaacttagcctgaacttgtataacctccattctcaaacttcccctggaccggcacttagccatacctctgtttctgaactcgtcatggaccaagggcttttaactatttgccactcttacgagtggtacttaatgatttgccactagatgtcatgagggtcacatgtcatatacagtgagtggcaaataattaattgccatatcccaagagtggcagtagttaaatttccccatggtgcattgctcatcctatacagttataaacacttctcattggaaagctcaaactcaaccaaaacttgtctattatcattgttgtgctcaagctttccctaacactacgcttcttgggcattcaccatcactcccctgattccttctttctatagagctaatgctcactaaacacataaaactcaacatgtaaacatagtatttattaacactcctaaaacctacatgtaagcatgccacatcaacacattaagcacacaaagctcaacatgcaagtatatagtaattatatctacaatttatttcattctaaaactaaacatacacatgctaaatcatcatattttcaaatcattttcataatatttcaatccaaattattttatcatttctccaatatctaacatatatcccgcagcaaagcgcgggacatcatctagtatagaaatatgtccattaccactgttgtgctcaagcttgctctaacaccacacttcttgagcttgttcaccatcgctctcattatcgcccttaggtggatttcattgtccttgagctctccttaaattgaataacaccctacagcacgctagttgagctctcctcaaatccattgtcacctaggctcccgactactatctcaagaatcatgcatgtctggttgttattatgctgccctccatctcacgagatgtgccgccatcgagcttgtatgcacgctacctccaacctagcccccgatgcagtgcatttgaactcatccgctggttcgtatttatcgtgatgcgcacaagctccccaagaggcctgctatggtgagttcgtggcatatggaagatggtaaatgaaggaagaaggcaaaatgtatggtagagaaagataacaatagttttgtggtgggagaggtttttcgttttggttttgatggaatgttaaaaggagtaaaagatataactttggtcttactaaaataatatacgaatttgatgttatatgactaaaacatgaattaacgatgctgtagaaccaattttatctttcttctatgccatcacaatggttcatgtgccaacatctttttttttctaccgctagagctcgtatgtgttatgatagtgagtggcaaagtaatcaaagtaaaaaaaaaaatctatttctcaatgattttttttaaccatcagttaacctaatgttgattataagttgaaaggcttataagaaaaaaattatgggaggacttttatatacatggttgtttacattgtagccaaaataaaccttaccaaaatttggtaagttggcaatattgctaagttttagtatgattccttatgtatttactaaaatttgattaaaaaaaactaaatgtatgcacatctttagcaactttttttttaaaaaagtatgatttgaaatgacatcaatctgaacaacccctatgttcttagtgattcagaagttaatgttaaaaaaaagttgatgttaaataaaagagttaattacacaatgggccgcttatgtttaccaaggttgcatcttggactaggggagaaaaaaagattttcactttggactagataagtttgcaaaataattcactttgtaccacttccctctactgctctctcatcactttcttctctgccatctaggaaacttggtgagctcatgaaggcagcagcatgcggcccctcaaatcctcaatgcatcagatcagcatgagcaggagtcaactactaccaatcaaggatctgctatagctaggtgctcgcttcttgcgttgattttgggaactgggagcctaggagatcctcgagcttcacgtcaggtagagggcacggcccggaggagatgctccttggcgatgagcaataggcgctcgccgtagcctccacaaattgggacaatattccccgatgcagttcaccaaggcatcaactatgcttgctccaatgcttcacgatatgcagggcatggcagaatgtgtaggtcgagtagagcgcgtacggcaccaacggaaatcaagctcgagtggcaatacgtagacggcaatacatagaatgtggaggcctgcgttcttgaacttttttttgtgcgtatgtccttctcatctccttcatccgttgagtccgctctcatctctgcttcctagtcgaccgcaagtagctggccgtgattacggaggagagggcagtagggcacgacgggcatgggtagtgctacctgccgcaggcattcccattactacatgacgggcaaggagcactgcccatgcccatcgcctgtgggcgccatgtgcctgcaggcctgcctgtttacccatcacaattctccacagaccacaagtaggacgccgatggttggaggggagcacggcgcagtggaggtaagaggcggcggcgaccggaggtgggaggcagccaggcggatgaaggaggagcgactagaggaaggtgtcacggccgacggctggaggacgtcgatggccggaggtgggagctcggcgcagacgggataggaggcggcggtggtcgcagcttcgtcggttgcccctcccgtggcggctgtgaaagtcgtcggctggagggtggggccagcggctgtgaccagaggtgggaggtggtggcgattcacgcgcccctcctgtcccatgtcggcctggagtggcgactgtggaggaggaaactggagtggggctatgaaggaaaggggaagagaaggaagaaaaccccatagtcttagatgtggtttttatattaagttgaccgagggcccacatgtcaattggttctcgcgagtaaacaagcgaagtttttgcgcccgtttgcctgttgagtacaggttttgacccaataaaaaacccaagggtaataaatggagaataaatccaactctattagggtttttacccacggataaacgggcaaacgggtcaaattgccatccctagaggagaggaagaacactatttgatgctgacgtgtgggccaccggttaaaaaagcaaagtttggtaataaaacttggtcaaaagtgtaaagatgtgctgataactggtccaatttgcaacttaggtaataaaatctgccctaaagtacaattcactccaaaaataaagtgcgatgaaaaaaaaaactcgaaatcaacttcacaagtaaattttataatttaaattttggcagcagcttaccagctagaatatgtaaaatggtaagagcagaatcatgacatagattaaggccctatttagttcccaaaacaaaaatttttatgctgttgttggcaactttttgtgacaagttgacaacaacgattgcagcaccttatgtcttgcggtgatcttagagtcgccaaccacctccatctagcaaagagctaaacctagatgggttttgacaaataaaccggctagcggagccaatttaagataactacccgtctcgtgggcaaaacggaaggttttcaggacaaacctacaaagagatgtcgcactctcgcagcggcggcggacggtttacggcgcaaaccgacaaagatggacaaactaagagaaaactaaaagcaatatgaaaaaacgattcaattgattgattgtagattggatttttacaataatccagccatgtcccttatataggggttggtcttgccctctacaggccctcctccacgtccaactcggggtagaaactaaaggaaacccgaaacatgccttcacgagcaaggaaacctcgaaacccgacgaaacacagtcagacttggacctgccggttagaccggccacacaccgcaggtctgaccggccctcaatcggcggtctgaccgcccaacacacggcggtcagactggcccactcaaagaaaaccggtagacttccaaattttggcaacctttcctattttaatcctaggtgccaaatttgggtgtaaacacatgccccctgcctttttgatgaacaacgtgaatctaaaagcatagaacatgttttggtcttagggcgataatctaattaccggccatagtacctcctaagcgtcttgccacacactcgggaagtatttcttcaagtatttcccattgattgctcgctgaaaacgctcccttgaagtgtctccaagaaatatgcgtttcgtcgaacaatgccgcatactcgggaccctcccaactaggggaccacttaccgaactccctggatcgagtacccaaaggcaaaattgtcttccaaaccaagtctccaacttgaaacaactttgctttcaccctcttgttgtacgccttggccaccctcttcttttctttctctatctcttccaaagccttcaggcgcttgtcgatgacttcatcaaggttgtctcccatcaacgtcttgtaatctttacttgacaaatcatcttgcctgatgtaacgaagataaccaagatttacctcaaccggtaaaatgacttcttgaccataaaccaactcaaaaggagtgactttagtggcaccatgtttagatatcctatgcgcccacaatgcttcgaaaagcacttcatgccacctctttgggtgttcctcaatcttctttttcactaatttcaacaatgtcttattactcgactcggcttgtccattagcctgagcgtagtaaagagaagaactcaacaatttaataccataagattcggcaaaattcttcacttccttagatataaaagaagcaccttgatccgtagttaatgtttgtggaataccaaatctatagataatatgcttcaaaataaagtcaattacctccgtatgagtcatattcttcaacggcacatcttcggcccacttggtgaagtaatccgtagcaactagcacgaacctatgcccctttgatgacgaaggataaatttgaccaatgaaatctaaagcccaacctcggaatggccatggtttgattataggattcaacacggcggcgggcgccaattgaacattgccgaaccgttgacaagtttcacatcctctataatatttgaagcaatcatcaatcatcctcggccaatagaaccccgctctcctaagcaaccaattcatcttgtgggccgattgatgagtcccacaaattccttcatgtacctctcccatagccactttagattgatcttcatctaagcacttcaacaagacaccatctatatttcggcgatataaatcttcatcaagcaatgtgtacttgaatgcttgccgtcgaattttccgatcaaccttaagcgtgggatctttcaaatatcgaatcaaaggaatcctccaatcttcttctgtttcttgggcacaaatgtccgaattcacaattaattcggccttaaaattgattgaaacgtgccctccagcgctctgcctagaaccggtcagaccggccataccaggtgtcacaccctgaagttctcctcctaagcctaaaattgaatttataaaccagcctaagaaaatgccggtgcaaatcaagacaaaaccttaataaactaatgcaaataataatcggaattggcatgtggaatttttcttgagttctacatgtcgaaatacgctaacaagatttttagtggaattttcagagctctcgaaataattttaaccaattaaaattgagcacatgcaattttaatcccaggaaaaatcatttttccttctttttcctttttctttcttttcttttctcttttttcctttgaatgggccgccggcccattccttctttttctccccctcctcccgctgggccggccgaaggccaaggcccagctaggccgcgtgagccggctgcccgcctcctctcacccgggtcgccgacaggtggggcccacctgtcggacccgtctcccacctcgcgccgcgccgccgcgcccgcaaccgccgccgcgcccacgcctccgcctcctccgggccacgtcggccacgcccgcgcatgcgccgcacctcccgcgcctactcccctctctcccgcctgcgcccgcgcccgagatggccgggattcgattttcgaatcccgcctctctctcctctcccactccccgcgttggccggcggaatctcgtccctaccggccacgtccgggactcccctcccctatttaagcttccccgccgccccctctcgctttttccccatctcgccgaactccctcgtgctccccatcgctcccgcgccgtgcaaccacccgccgccgccgcttccgttactccggtcgccgctagccgccgctagggtcgccgccgcaccgcgccgtcgccgccgtcgggttcacgaggccaaactccacctcgtttgccccttccccgtcgggattcgtcgccggaattcgcatcccctcgcgctccggtaagttctacctctaccgccgccttcggccatggatgccggcagccgtggttcatctccctctctctaatttctctctcctccttccttagggcaccccgaagcccgtccgccggttgccgtcgtcctcccgtggctcgccgtcgccgttcgccgtggtcttcctccgcgccggccaccctcggtgaggcgtcttctcccctctactcccctccctttccctcctagtgccgcgccgccgcttcaagtcatgcgccgtcgcctttggccgccgccaccgcctcccgtgccgccggtcgccatcgccgtcggccgcgtgccgtcgccgctagccctggccggccggccggctttgatgccgagccgagcccggcggctgcctctatcgccaccgcccgatcggctaaggggccgatctgggccgtcggtcccgtggaccggcggtggaccacccgcgtggtcccggtccacggtgcaccggcccccctttgagccgctgaccagtgggaccctcctgtcggcgccaccccccttgatgacgtcagccctgggagttattgtgcaataaattatttaaggactttttgttatagtaataaacacagtgaatcttctaaaattcataactaattcatccgagctccgtttaagcccattcaagtctcagtaaatcaagaaaaatgtgtagaatccattaaaaatggttttgttctctgtttcagtagtcttgtagcctgtttgcaatgtttgccttgtatgtcgctagattccggttcttccatcgctccagtgtacttcgaaatagtcgccgaggttcctctagcagcagagcaaggcaagtcatgcttgtcacttgatcatgttgatcctatattgcaaatgttctaatgttttctttcaaatactgcatttgttttgcaatatcactatgggatgtttacctattgttacagccatgctattttggtaccctgctcctttgttagctcgggttatgacatgaatagacgttgccctaggagttggttagccatgcttagttcaactagtacacaatgggggagaatcctattaatgtttagactgttggttctaatggtaatgttggtttagaaccaccgctttggtgttggttaattaaaatgaatcacatggtgggctgtgggtgcatggttttgctgatcgcacccttggcagttaaggaccggttcgcgggatgccctggaagaacttatcgtacttaccacaagccagcctgggcaacggctgggcttgtagtgtagctttcctctagctgacgcatccaggcaagggtgggcgtgatggagcggggcgggccctgcgacggcctctgtcgcttccggattcacctaggcacgagaggggactgcccgctaccttgcgaggactgggggtgaaacctgaggtgtggtgtgcttggttatagggggttatgcgaagggtcctgtcacggcctctttccggtatgtcgtggtggcatgtcggcacacggaaatgtgtcgtggggctatgtcttgtgggtacagttgtacacctctaatcagagtaaaactattcgaatagccatgcccgcggttatgggcggtcaaccagattcaccgtgattagtctcaccctagtttagtctattgaaattggatagtataggtggatggttgggcctgtcgcaacgtggtatagcgttggacagtggatgattaatattgattaattattacgactgttttcttctttaaacttctgtttataaatgctcgctttatgcaaatgaaccactctagctctcctttgataattccctgcatcatacccctattccggtatgacttgctaagtacagtgggtagtactcagtcttgctctatttttcccaaccccagagtacgagtatgtgtcagatggaggtttctccgaggagtaggcttcgtccgtgccgtcgaggatgcctgtggagtggtgttcccgctgcagttctagtcaaggcttagctcctgttgtctttcgtttttccgctgcatttatgtaagacttttatgatgtttgtaagacgtggatctgaatgtcaatattgtcgtttgtgtaccccggccggtcctggacggggattttaatgcacattctgcttggaattctattcgggaatttctgggcgtgacaccaggccggttagaccgctcggggtcgctggtctgaccgacggcatgtggccggtcagaccgcccctggtcaccggtcagaccggccgtgtaatgccggtcagaccgctcctggtcttcagttttgccaatatcgcacaaagatttaaaatcaagcaccgactcttctaatatcagaaataatcatttcttcacattataaccagatgcttgttgtgccaagtcatttgctctagaattatcatgcctagcaatatgtctaatagcaaaattatcaaaattggcaataatatccaaacatgaatcgaggtacctatttagtgatccgtccaagcatttgtaaactccggcgacttgttgcagcaccaattccgaatcaccaaaagcttccacgtacttagctccaaccatctccatgacttgtaagccgaataacaaagcattgtattcggcttgattatttgtacaataatattctaaacgaaccgatgcttcataacacatgccattaggtgaaaacaaaactacccctatgccttgaccttctttgcaagaagaaccatcaaaataaatcctccaaggtataacttcaactaggcaaatctcttcctcataagcaatatctacatgatggtccactataaaatcacatacaatttggcctttcatagatttcaatggttcataagccaaatcatattctatcaaagcatatgcccacttgccaattctcccacttagaattggcctttgcaacatgtgtttaataacatcggcttgacaagcaactatgcatgtactagataacaaataatgcctcaatttggtacaagcatagtataagcataaacaaagcctctctataaagacatacctcgtctccgtatccaaaagacggcggctcaaatatgtaataatatattccttgccatcttcctcttgcgtcaaaacgacaccaatgactttgtcttcggaggcaatatataaccgaaaaggttttccggctttaggcgctcgcacaacgggtggagtagacaaatacctcttcaactcctcaaacacctcttattgttttgctccccaagtaaaatcggcttcttttttatgcgaagtataggaacaaaagcatcgattttacccgctaggttagaaataaaccttttcaaataattcaccttacctagcaacttttggacctccttcttgcatgtcggcgctttgaaattacgaattttttctatcttcttaggatcaatctaaacccctctctcatgcaccatgaatcctaagaatttccccgccgacacaccaaaagcacacttaagtgggttcatcttcaaaccataccggcgcatcctctcaaaagctaacctcaaatcggctatgcgtccttccatactatctgatttgacaataatatcatcaatgtagatctctaagataatacctagcaaatcatgaaagatcaaattcattgccctttgatatgtagcaccggcattcttcagcccaaaagtcatgacaacccactcaaacaaaccaacaaatcccgggcacctaaaagccgttttgtacatatcttcctccgccataaagatttgattgtagccggcattaccatctaaaaagctaatcaccttatgacccgaagcatcattgatcatcatgtcggctataggcataggatattcatctttgggagtggctttatttaaatctctaaaatctatgcaaactctaatcttaccacttccctttttctccaccgggactatgctaaaacccactccgcataacgacatggcctaataaaccccgccttcaacaaccgatcaatctcctctttgactcggtcatatagcaaaggattaaaacgacgaggtgattgcttataaggcctaaaacctggtttaattggaagccgatgctcaagaagctcacggctaagacccggcatctcatgatactcccatgcaaagcaatcaacatactctttaagtagctcgattatcttaaccttataatcgactctcatatttttgtttacaaaagtcggccttggtttggttccatcacctatgtctactgcctccaacggatcggccgatgtaaacccttgtccaagcttctccacttcatcaaaatcttcaatagtttcaccaatatcgttctttgtagaccgatatttttgcaccctcttttgtaaccactctaaattagcctctttactcattatacaaatttatatggcttagccgtgctacactagccagctttacagagataggtacaaattttccatcggagatactaataaaatcatagctagaaagattcctccccgataagcattgaatattcccatgacgccactcaaaagtagcatcggccattgcaacctcggctgatgtatccgcttgaacaatttcaacatcatcgccgtcccattgaattaaacattgatgcaaggtagaaggcacacaacaattggcatggatccaacaacgacccaaaataacattgtagttaccttgcacatcgacgatgaagaaagcggttggtaacgtcttgttccccacggtaagctccgctgaaaagatacccttcgcctccgttggttcaccattgaagccattgagaatcatgttagtcttcttcaactcatcatctccatgcctcaacttcttgaacaatgagtatggcatcaaattcacagcggcacctccatccacaagcatcctagagaccagttttccatcaatatgacctttgagatagagatgcttcatgtgacggtttgattcatcgggcttctcaaaaaccgcatctttagggcctagtgaaaattgagcaacctcggcttcatccatagcacaaaactccataggcaacatacataccatgttgatatccatgtcttcttttggagatgactcatctttagcaaccgattgttcttccctctcctctacaacaaccggttcttccttctctatggttttacgcctccataccggtggtggtcgcaactcattgaaccttttatccctttactctttggcctttttctctcttatttcttgggcccgaagacgttgcaaccttctcctttgagtagccgtcaaatccttaggtatccacctaggtttcggctctgttccaggaggtaaataatgccccctattaggtttagttgatgacgatgaagccctcacatcgccctttgcaaacctcctatcaaaccggtgctggagcccggtcagaccagacgtagactaccgatcagaccagccagatgcgcaggtcagaccgacattcggtgggcggtcagaccggcctgaggcgtcggtcggaccattgtcagttcggcggtcaaaccagcctgatggcccagtcagaccgaccgtatggctgcggtcagaccggccgtatggctgcggtcaaccggccagaagacctggtcagactggccaactgcgatgagctggtaccagcttcggattttttgcttgaggactctccaacttcatctccagaaggtattggcacatcatgagaccctactttgatggtaatcacttccgaagtccttgcctccaccttaatgcgctttccttccctcctttcttcattggcccggttcctaccataaaactggccattgtttggtgaagaaaaacgctcatgaattggccttcttggtcctccccacccttggttgaattgcattggaggcatatggttgaacattggcgatgttgccccccatggcatataataaggataagtataactcggcggcggcattgaataagaaccccatgacatgtcttgtggatgatgatatggaggtgaatgcgaccgtcttagcgagtgaacaaatcgctcccaaagaggtgatcttggtcttttccccttgttgtgagctctctcaccaccctgcttttcatatttctccaaaagcatatcaagggtcactttagtcttcctaggagctttagaagttgaagcttcacttttattctctttccaaacaccaacctccggcttctttggtactatcatctttggccttggttcaccaatgattactccttttcctttagtagattcggcttgctccggccaaatcaacaccttcttgtcattgaaattaattgtattcaccggaaaaggatcatgatcaagcttcatcttggagccatcggtgaacttcaatcgtccttcatctatggccgattgaacctgtcgttgaaacacattgcaattattagtggaatgagaatgagaatcatgccatttacaataagctcgacgtttcaattcttcttgagatggtacgatatggcctttaggtaatctaattttttttcttgtaaaagataatcaaatatcttatcacacttggccacatcaaaactatatttaacctcactttgccgatctttgcgaggagtcggcattaagttagaacaaacaaaaggcttttttttgttagtccatgaccattcagcagcatacatatcatgatcaccctcatcttcactatcactagcctcagggtaatcaatcacattaacattaggctttttctcatatggtctaacaatttttttattatccttaacccggctttcttgagccagagccctttgcataagttgactaacatcaagaaattgttggccatctagtctttctctaagaggagcaattaaaccattaaaagcaagaccaaccaaatctctatcagttatatttaagctataacatcggtttccaacatccctaaatctcttaatataatcaacgacaggctcattatatttttgcttaaccgatgttaaatcacataacctaagatcggtttctccagtataaaaataatcatgaaatctctcctctaattgagcccaagtatgaatagaatttgccagtaaagaagtaaaccatgtaaaagcggtaccggacaaagataaagaaaacaagcgcaatttaaaagtatcactattagcctcaccacattgcgctaaaaattgacctacatgctcccatgtggtcctaccatcttcaccactaaacttggtaaattcgggaactctataattactgccatagcctgaatttccgtttcaggatttataaattatttaataaattattaatagaatttatattaaaagttcattaatttacaagtgaagttaaatgtgggaaataaaatttcctaaatataaagcatggttggatttaatttttattaaattctccatgattaactatactctttggaattttctcggatttttcagagctcaattcttaattttaataatacaaagaacagtttagcaattatttaaataataaattaatcattaaatgatctggatattattatattaaatactttgagtgtccaagtatgttcaagatttttcttggaattatttgagcattggaagtatttttaataattgaaagatcatctcattggttaatttatttggaaaagtaataaaagtcctcctcatcagttgggccgaattcagcccattccctcccttcctctcagcccgcaaaaaagtctgtttgaccttcctggcgctacagtactccatcttcctcctccagccgactgtctcccgtgccgtgcacagtgtcgccgatccccttccgaaatccggccacctcgttgctcctttttccaaattagttgcgggaatggaatcctctcaatctcctcttccttttccccaagaaatccccaaaagtttctatggaaatcctttccaatttcgtggttcaatctttcctttttccggcgaaatcctaaactttcccgagtttttcccgtcgtcgtgggctcgatccctgggctcccatggctatatatagagccccctccttctcctctttcggccgccacctctccctctctccgccgttgccggaagcactctccccgcgagctccctctctctccacctccggccgccgctccagccgccgtgcgccgtcgccccggccgtcgtcggtcagcgccgccacttccctcggctccgcaaagtcgagctctaccctggcctttggttccttcgtgccaaatccagccggaagccgcttgccgacgcgaaccagaaggtttcggcctttgcggcgcctccagccgcagctagcagccgccttagccgccgctttccgtcgccatcgactccattgggttcgcaggagcaagatgaagcccggcagccggttccccgaagccgaaatccaccggagctccatcgtcgccgtcaagccgaagttcgccatcgcgttttgatctccggtgaggccttgctgctcctcccgtcatcgccaagcttcgccgcagcctccctcggcatcgcagctgcgaagtgaaccccgtccacccctctgttgccgtcgttcgtcgccggaaaatcgtcgccgccgtggacagtaccttgccgcccttcgaagctcgtcaccggccatcttccgtcgccgtctgtcgtcgcgtaagtgttggtaagaatcgccgtcgccttctctacctcccggtgcccccgtttgcattattgtgccatggttcaccggcaaccgccgctcccatgccgttcaccggtgtagattttttcctagggtcttaatccaatctaatctaatccgttgtttgtctagcgtcgtcgtcgtctccgtgtgttgccgccggatcgtaaacgtcgaccctccctctccgatcgctttggttcggtgagacttctatccgtgtcccctcgggttaggtttcaatccctcggtcgtgtcgtcgccgttgttgctctaaccttagcgcagccgctgccgtgtcgcttgctggctgccctgtgcaccgccactaccgccggctccttgttgccgccgcgtcgctgtttagccgctgtacgtcgccgtcgcgctgctgctgcatgtgtgccaccgcaaccgcggttgtgccgttgccgtgcgcaacgcctatcgtatcgctgtgccgctagctgctgccttagcgtcaccgctgcactagctgcctagccgccgccatgccgctccctgccacagccgtgctgctgctgctgtgcattgccgcttctgctgtgcattgccgcttgccgctagctgtcgttgggccgctacttgtgcatgccaagtggccgccgtcccgctaccgcagctaccgagccacttgctgtcgtgccgtgccgtcgctgttgtgtcgtgtcgcagctgtgtgccgtttaaacctagccaccgctttagctcgttgctcggtagtcgagttgtctagccgtaggtacatccctaggttcctaccggcctatcgtttgccgtaccggggctttaccgtgaatcgtttctagtccaccggtttagccacagccgttgttgagttgttcgctcgttcgttcgaacgaggtgttccccgtgtttcgttcattcatccgtgtggagtcgtcctttagtttagagccgtcagagctgccggctccgttcgccggtttcggctaatcatttaggcgatcccgtgtcatgtagaattgactcgttgagtcggtatctcgtgaggctcgcttgccagatcaatccaagccatctgatcttggtcaactctcggtcaagattaatctcagtcgtccaaaatcgatataaatcctctcctcttttcaatggcatattattcctttttaatatatgtcatctaccaaatatgatctaatcttttctggaggttgctttaatcttttgtctcagttataaatcatttgtaaatggtttaattaatttggaatagtcttttctttaataggtttaattggaattaaatcttgtaaaatttgtaattaattcatatgaaatcggaatgagaccgttcaagtctctaaatttatgtaaaatcatgatctacatgtttgtttacttttatgtactgtttatttggtttttattagtctttctcctcgtttttgcgtgttagcttgtcgtttccgtcgtttcgaaggttcgaaagtgcgtcggaagtgttccagaagacttattgaagaccgaatattgcaaggcaagtcacacagatcccaaacacaattcctttgagcatgttaatcctatatttaaattctctatttatttcaactgtgcatttatgttcgaatgtcaccgggtggtgagcctttcccatttaattatggccgaagatgactttatttttttatgggttataatttgattagctagaaccttatatattagtttggttcagctagatacttataatagatgcttagccatgcttagaaacaatagctcactaatgggataaatcatgcttcactatcacttatggatatttaatggaagctcacgatggtcaatcgtgattggttaattaattaatgtgccaactaaaacttgataatggtgggttgtgaacacatagttttgatggtcgtgcgcatgacaattaaggaccggttcacgagtttcggttgtgaaacattaaccgtgccaaccacaagccagcatgggcaacggctttaccttttgtatagcatggttcattgcggagcactagactaagaagtggcggagataagctcacgggggtcgctggggagtccatgccttgttttataagggggtgattatgatccaggaacggtacactgctttgagttgtgttgtgcgaggggtactgtcacagctcctttctgaggtactgtggtagtatcgaggcacatggtgacatgttgtggggctgtgttttgtgggtacagtggtacacctctggctagagtaaaactattcgaatagccgtgcccgcggttatgggcgggtcgaacaatgtcttttgtgattagtctcacacttcacaccataataaatgatgctataactggtaataatttgattagctcctggtttggaatggtacattcctggtttggagataggtctgtgcagcatgggtgtgctattcagcgttgattaatattaatgattaattactctactgttttacaattcctaaatgtttgctaaatgctgctttcgcaaatgaaccctatattatgccattctttggtattcctgtgcacttgcatatttgctgtgtggcttactgagtatgtcatatactcaccttgcaataatcaatcaaacctcagttgaagacaagttgcgaaggagaagacgtttggcttataccccagttgagctgcctgtgggagtggagtcggagcttcgctagaccgtaattccgctgctgtttttcttttcttttgtaagtatgtaacgttattattatgatggatttgtatattaaattgtcagtttgtgtacctcggctgattcctggacaaggattttatgcacaaataagttcagaaattactagtgaatttccgggcgtgacaattacggggaaacgacacattatcataatagtcaggatacggctttttgtaaaccctaccacgattcctagtttcaatctctaatttatccctaatagtcttatttcctccatattatcaggcctatgttgatttagcggtggatttggtggcctaataggttgtgtttgtggcgcaatatgattatattggccttgtctagtatcgggaggataccccctagcaacatcattataagcattaggaacatgtgggggaacttggggattatttacagcagtagatacaggaggatcaaatgttttaggatgatacaaataactagcattagtcattggatctatcccctatatcggtataattgcgccggtctgaccggtccagggcccggtctaaccgacatccagaggcgcggttagaccggcttgagtcccggtctgaccaccgggataatacccggtcggactggccgtttggccggttggaccgacggcgaagttgcggtctgaccggccgtcaagcccggtcggaccggccgtcaagcccggtcggaccggccgtcaagcccggtcggaccggccgtatgcgccgctccattggttccgctactcgtttgatctataggagcttggttagcagtggtagaggctttatcttttgacatgtaatcggccataagagggccgaatttaaaccttaaaaactcatcaaatttaccctcaaaagttgcatctaacttatctttaaaaacagtcatagatgaatctattgtagatgctacttgttgttggatagattgtgttacctcttcattgcttaccaaatcagaagcgagcttagtacgtggcctgggcttgatgatcacgccttgatgagtcctagtgcatgctctcatcagcgcctcctgtgtgatctccttgatgtactcctccatggacttgcggtcttctcctttgaaatcatccaatgtgataggtatcacattagatggctctacctccgtcttggatggcggcttcgtcatggcgaagtcgaagttgagttgacgctgaacggatttccccagctgagtcgccaaaatcatgttggcaactttttgtgacaagttgacaacaacgattgcagcaccttctgtcttgcagtgatcttagagtcgccaaccatctcgatctagcaaagagctaaacctagatgggttttgacaaataaaccggctagcggagccgatttaagataactacccgtctcgtgggcaaaacggaaggttttcaggacaaacctacaaagagatgtcacactctcgcagcggcggcagacggtttacgacgcaaaccgacaaagatggacaaactaagagaaaactaaaagcaatatgaaaaaacgattcaattgattgattgtagattggatttttacgatgaaccggccatgtcccttatataggggttggtcttgccctctacaggccctcctccacgtccaactcggggtagaaactaaaggaaacccgaaacatgccttcccgagcaaggaaacctcgaaacccaatgaaacacagtcggactcggacctgccagtcagaccggccacacacaccgccggtctgatcggcactcaatcggtgatctgaccgcccaacacacgacggtctgaccggcccactcaaaggaaaccggtagacttccaaattttggcaacctttcctattttaatcctaggttgtcacgcccagaaatttagcccaaatttccagactattttgtgtattaaatccgtgtccaggaccagccagggtacacaaaacgacaagtaatatacagttccaaacgtaaataaagcgtaaaatacttacagaagaggcacttagtcctcacaccgaaacgaaagcagcagcagcggaaacaggcgatcctagcgaggcttcagctccactccacaggcaaaactcaactggggtctgagccttggtcttctaacttcgccttcagctcagaagcactacacttctgaaaaggggaaataatagcaaggctgagtacaaccaccgtactcagcaacacacaccaacgatgctaacgtgcaaggggaacacaaggacggtttgtggctatttgcattaaggcggttgtaaaacattttattgagcaaacagtaaaacagttgagtaattaaagtaacattaaatctccactgatcaacgctacaccacgttgaacaggcccaaccaacccacctaaactacaatgcattgggtcgatttattaaggtgggactaatcacggtgaatctggtcgaccgcccataaccgcgggcacggctattcgaatagttttactctggccagaggtgtacaactgtacccacaagacatagccccacgacatgtttccgtgcgccgaaatgccaccacgacataccggaaagaggccgtgacaggacccttcgcataaccccctctaaccaagcacaccacaccttaggtttcaccctcaatcctcgcaaggcagcgggcagtcccctctcgtgcctaggtgaatccgaaagccgcataggccatcgcagggcccatccaaactccatcacgcccacccttgtctagatgcgtcagctagaggaaagctacactacaagcccagccgttgcccacgctggcttgtggaaagtacgaggaattcttccagggtttcccgcgaaccggtccttaactgccatgggtgcgactagcaaaaccatgcacccacagtccaccattcagtcgcattttagttggataattacgaccattaagtatggccagatgtctcgagcacgcagctcattctaatactaaaaaggtctaatactgtaattatcccgtcaactaagctagtagtaattaagcatggctaagaatatagttctagctaggtcacataagtaacatgagctagtttatttattacccagggttgacaaaggacagatattaagtaaacatggcacaaacgagcagataggtaatacccagatcccatgtaattagcaaaacatgcatatttatttgcaaacggtaaaacagttataaattaggatcaacatgctcaaggggaatgtgtgacttgccttgcttcttcaaacaatcttccgaactcttatccttgcgaacgcgaacttccgaaacgacggattctacatgctagcatgcaaaacgaggaaaaactctaataaaaacaagggaaacaatacataaaaagtaaacaaacatgtagagctcaattttagatgaattttgcaagttgaatggctcaattctgagttcgaatgaattagatatgaattttagaagttttgagccatttaaatgaatttctagaattattaacgaattattgcgcaattaaactcgatttatgatgtcaccgagagggaaggggtggcgccgacaaacgggacccacccgtcggtgactcaagggctttggcctaccgtggaccaagtccacggagacacgggctagcgcaccacgtggcgccgacggagcaccgacgtggcggccacgtgtgcggacacacgggcggcccgggtggagactgaggccgatccgacggcccagatcgactgcggctgggaccaaagggaggcggcagccggcagtggtgcgggcgcggagcgcagcggcgacgaaccggccggacggccaccggcagcggcagcgcacggccatcggccactgacggcgagcggcggcgcggtgagcggcggcacggcaagcggcggaagggagcagggaggagaggagggatgctcaccaaggcggcgacggcgagacgacaacggggaagccagcgggacgggctcctcggggaggcaacggtgacggcggtccggcgacgggctcctcggggaggcaacggtgacggcggtccggcggcgttccgcgagcaggaaccggcggacggcggctgcgagaacaggggaa

SEQ ID NO: 82956 - DNA, 6293 bp, Oryza sativa
catcggaaacttattttgacgaaattatagtcgtggccttgcatgcatgattagctgatccttgtcttcattatttcaagtgtttgtgaaaccaatcgaccattaaatcaagagcttgctcagcttttttgacctcgaatgggttgctggcgttatatctgcaagcaaatccatggttcactccttggaagaccttggcaaagtaatcaatctgcaacaattaatgaacaaaaggttatttctaatgttcatttttgctaatgaataatatatttctttgcaaagatttattattgaaatatttgatgaatgtttcaaagaaaaatatattcttcttgcaaaaaaggagagaaaggaataggtataggatcaaagccacagtgccccaaatgatggcctagcttttgtggattagattttgggtgagttattttcctcgtttctcttatgcaactcacttgtttactgcgactatattttttaaaaccacaaaacagtgtcttttaaagaaaactttatatatataagtttctttaaaatttaaataaatatgttttaattttttaatagttaatatttaattaatcatgtaataatggtatttctcggttctcgtttacaatgtgctagtaatctttcagtttttatgctattgtataatctgcttctgctctaacttttgccagatgttgaccagccattagagccagcattccctcaaaaatatagccagcatgcatgatcctttatcatctcatcatccgtggaaaattctcttgtgtgtctacagtttcatttcctttcagaaaatagacctagtgtttcagtttaagtgttctgtctcttccggtctattgaattcctgtgcttcatgtatatgtgcaaattatcttatctgaaaaaaaacaaaaagaataacaattgcaaggcaaatggacctatatatgctgatgcatttgctatatatatcaactgtaaacgaaactggtaataggggaactcacccgatcagttctatgtcgcaaggcctgaacatactggtacactagttttggtggtgtcagtgtgtcgttctgagctccaatgatctcgatggggcatttgacctctgcgtgaaatgtcacggcgaactttggaataagaaaacaatggctagctatatattcctgtgcaacctagctagatcagatgatacatgcatatttcagcaaaagcaacaaagaaaatatatatatatatatatatatatatatatatatatatatatatatatatcacctttaatgtcatcgacagtcaccaatccaggatgggtggtgacaatcgcttcaacctcgttggtttttgctacctccacggcaaacttccctgccagttaaaacttgcctttgagagactttaatatgaatcagatctctgcttgttcaatgtggagaggagatcacgaaggttcagagtgtatccttacaatgcgaatctggacagactcatgtccagattcgttgaactagaaaacatctcatcaatattagattgggatttttttgggatggagggagtatgttgttactcgtgactgcaaacattttttggtcgagccctaggcactagatagtaatagcagatcaactgcctagcaacctcaggcggctgcccaggctcattgctgaatccattgaaattctatattagacagattgaaacagagtttttatagcaaataagtttacttgggctctttttatttttaagatacaccactgatagatgtagtagtataattataaatgcacaaattaatgtgcttcttctttatgttgattaatatcactcaccaccccaacagtaacctccaactccaataacagatatccctttctttcttagatcagaaaagattgctttagcatcttcagctgcttttacctgcaggatcaattcatatatactggtcaaaaatcaacttattgagtccttgattagcatctagctagtataggttaagtactttggatatagttttgcttaatttgcggcttaatttgtgcatcctgataggtgcaggagagaattttcatctgaacgatcacgattactaggtaattaatgttctagggaatataaaatcaaattgcataagacggtgaaacgaattaccggagaatgtttgctgaaccattccgtaaggttcaggtctagtgtgtaaggatctccgtggaagaaatcaggtacagcgacataatatcctgcttgaccaactttgtcagcaattttcctgtaattttcagcatcattatcacacatatgcttttaaggtgttttcggatctactactggatcacaattcacgatatattcagtttaactcaatacaacaaaacaacacaattatatcgtcctatgggtactaatcgaacaaaacacatcactgataagggttttcccaccatacacacccacgccctccacacaacaagaagcggcactgataacaacacattagtgccggctacgacaataaccgacgatgattagtgggcagacaattagtaccagcctgtacaattagccagcactaataacaccctaatcagtgccggttggtgtactaaaacggcactaacatcacaatcagtgctgatatgtgctaaaccggcactgataaagatggcctcaaaacagttcaccaaacccccttagagcacccgcaatggtaaagtaaggtgctatctataaaacatgtacacctcaacaatagactagattaatagtaaaccacttcaatggtatgtctacatgggtatctatagctctctaatccattgcctcgtttttctctatagactatctccatgttagtagatagctttgctctctctcttcatttaatctcttccaagtaggaaaatatgctgacatggatctcttatagagagcttatagataaccattgtgggtgcccttataattatgtacaagcttgagtagaagtgtagagcatgcagggaaccctgttgctagacgggttgagattgcagttttttttagaagaaatgggaattttcaaagctcttcttcgctctatatttattttgtatgtctcgcacacaattaattattcacatagagctttattatgtgaaaagcattgcattttttgtcctctctctgcaagatagataaaattacgatgttttgcacataatttctccttcaggaacaagtacttatatctcatgggttgaagaggtatatatctccttgcgacgcatatatattacaaatgggttgaaggaaatgcttatagtgaaatatattagtttgattttttttatgacatgctaaatggttcgaacaaaaaaaattgggcacgcgtaaattaatacaagagcgtacaataatctggaacttcaagacaactttgccggcttcgtcgttagggacatttctcaaaagacatgttcattgatcgagggatcgcctcgtactatactacaaagtaaacagaagggcaatcatttctacaagacatagatttgtcaagttgttcaacaaaaaaaatagctgttggtttcttgtaacgacaaaaaaacacgacttgtaatgacgtatatgtgatgtaatgtttaatgatttataattaatgattatacatgacgtattattgttgtaattaattgaatgttattaaaatttatgctggcaaaagtaaaatatggataggcacaatattctttttttttaaaaaaaattcagaatgaggtgctcctggaaccatctgtgtcggttcgggaatccaatccgatattttttagataatggaatagaatcccgacctttcctcaacgagagaaacccaaactggtatatgtttggatatatatgaggctgatcaatcggcacggataacaatttaaaatggacggagggtacacaatattgttgatattatgttgattttatcccaagtaacaaactcactatagaaaaacgaagagagttgacagttgacgaaagatcatatccttttttaaaaagtaagaacatagaagatcaccagttctccacgctattgatttgtaaaattcagtctctttccaaggtagttgttcgtttgtcgatttcctttcgatattgttgtcgggaaaaaaattatggaggaaacgagaacaactatgaaagatgatcgtgacaacgatgtcgaccggcaatggaagaacaagacaaagagataaagaaaataaggacgaagtgtaccttagcaaaggcgcttcaaatcctgaagaaaccaactcgatcaacaacgatgcgtgcaggagcaaatattataaacggttaatcaaatagagataaatggcagtgactgatcagtaggctactcatgaattacggctagggatgaaaatggtacggaaaccacctttaacgttttcgttccattttttttcaaaattagaaacggaatcagaaactccggatacgaaaacggaatcaaatacgaaaatgaagcaaatacaaatcggagcaaatatggtatagatatttattggaatttaaaaagctcttaaactgaacttctcaaatcgacgaagagatgtagctaaatatttttttttctaaaacaacaaatcgatatttctatttttttatcaatagtaataatacaactagttgtacactttacttttttaagaaaagaaactatattcatctataactataagtagtatgacatggactaataaaaactaaaaaaaatcattaggcaaaagaaatctaaactactagacaacaaaaaatatttctatttaattaagcacctataaatctaaatatcaagagaagatagctaaagctaattagttgtacataagaaatactctgttcccgattccgagagaaaatttgaattcaatttcagaaagtttccgatgatagcagccttatcatattcgtttctgtttaaaaaaaaagaatctgaattcgttcccgtttctgaaagttccaaaaaaaattccgaacggcactttctgtttccaaaaacatatacagaatcctgcaactttccgaatcattttcatccctaatcatgatagggtttgaatggaacaaaattatttgaaatttaaacattttcttgaccgaatttgaataaactttactaaattcatacaaacaaaaaatatttgaaatttttgggcgaaataatttagtctttttactttcttggggggttccgaaattttgaaaatttaaaacctaggctgtgtttagttcgtgtgccaaaactttttaagtatacgaacatacatttgaagtattaaacatagactaataacaaaacaaattacagattccgcctgtaaattgcgagacgaatctattaagcataattaatccgccattagcaaatgtttactgtagcatcacattgtcaaatcatagcgtaattaggctcaaaagattcgtctcacgatttacatgcaaactgtgtaattggttttttttgtccacatttaatgctccatgtatgtatccaaacatttgatgtgacggaaaagttgaaagttcgaagaaaaaagtttgaatctaaacacggccctaaattttaaaccctgaatcgtaatcctagacatgcactcaccgaaaacgtcggaggcaaggaggacaaccttggtggaatggacggcaccagtgacataggcctcgaagcctgccaggtcatggacgaccacgccggcctcacctccgccggctgtcaagtccggcaggttgtcgaggcactgggagtgcggtggagcagcagccaccgctgcggcggcggcggcgaggcagagcaacaacgcccatgccatggttttcatgctctaccgagagaccttgggcttttttttttccttacgtggctttaatcgatcggtagtaatactaagagagtagctcgttgcctaactatatataggcaaacgggatggacttgtggtcttgtggaatcgtgagcttaactcgatcgcttggtcataagagctatacggctccatcgtttcacttattcgggaaataagcgaaatggcgtatttgcaaacgaaaaataatttgtaaataaaacttttatatatatgtgttcttagcgatctagaagtaaaggctgaaaaataaacttcaatgaaaaaaccctaaaaccaactccaaatttaaagttgaaaatttaaatttttgctaatatataagcataagcatagtttatatttttttcaatttgacaatgtagacgtgcttttctattaagctga

SEQ ID NO: 82957 - DNA, 5150 bp, Oryza sativa
tttttacggaagatggaaaccttttctttgcacgttttttcctttttccagtatggacgacggaactttttttcccactaacattgttttttttttttggacaacggtttatacagatgattttttttaatcgggcagaaacttttttcacactttttttttttgcttcttttacatgcggaaacctttttttcgcgtggtttttatcggtacggacaacggaaatgtcttctactttttaagtagtagagattagctgtaggaggatagaatatgaaacaattccaatatatatatgtcgctatgctgctgattatctccatgtggggataacatattgaaaaccctaagaaattactctcaaaactagcacagtggcctgcacagattgcgcggctagtatcattatattttctctcatataatagcatacatgtttcctcattatattattcaaatatattaaaatgacaacataattttaaattttgcaataactttacaaaactactaatgggtaatatttatattatattttatatacgtgttagttattaattatttttaatatcaaactttagttatttgtaaattatatatattcctatatggactctagacttatcttttaatattttctttttttttaattccgaattttctgtaaattgtatttctatatagactctatgctcttcttccaatattatttatttttatttttaaatttttattatttctaattgtatttatatgtggactctaaactcatcttttagtattctttaatttttaatttcgaattttagttacttctaaattgtactcctatattgattttaaactcttcttcccatgtttttcttaatttggaattttagttatttgtaaattgtatctttatacgaactctaaactctacttttaattttattatgtttattccaaattttagttagttttaaattcctatatggactctatactctacttctaatattccttattttttaattccaaatttctatttttttcttaattgtatttctatatggactctatactctacttctaatattccttatttttaattctgaatttcagttatttcctaattgtatttctatatggactctatactctacttctaatattccttatttttaattctgaatttcagttatttcctaattgtatttctatatggactctatactctacttctaatattccttattttaattccgaatttcagttatttcctaattgtatttctatatggactatatactctacttctaatattccttatttttaattcagaatttcagttatttcctaattgtatttctatatggactctagtctactcttctaatattccttattttttaattccgaaattcaactatttctaaattgtatttctatatggactctagtctcctcttctatattccttattttttaattccgaatttcagctatttctaaattgtatttttatatggattctactttttctttttctccgattaatgtgagaatttctaggccatgagagccaacgtagaggctcctttttctattcatttaataatataatagatagatgtgtattatataggaataataggacgttagagtatcttggcatatatatcgatatttactactctctttgtttcatatttttagttgttttactcttttcttactcaaagttctttagttttgaccaaatttatagaaaaagttagcaacacctacaatactaaattagtttcattaaatttaacattaaatatattttggtaatatgttaatttgttttgtattaaaaatattagtatattcttctataaatttgattaaacttaaaatagtttcactgagaaaaatatcaaatgacttataatatggaacagagggagtagtacataatgattctcgatacaggagtggcctgtcgccatccaagtcttatactgataaatcatgcagatatataatcagtaatattgaatattatgtgtgacttaatttctcgcaagtcacaaataactggagatcactataaaaaagacagagagagttgaccaaaaaccatatccgatcccttcaaaataaccatagtcacctttctattgttgtaacttgcatgacaattgaatgctaatgttcatgcaagtgtacgatgcatgactggatcgtaccaaaatcataacaagtttatcgtacatacagcaatttccctattatacaaacgaagaagaagattgtacctcagcaatggcgcttcgaatcctgaagtagagacccacaattaacaaccacgcaaccactcacatgcaacagcaagaattcaagattaattaatggttagtaataaatgaatccacaatatatcatcaaagaatatttcaaagacagataagctggcagctcaggcaggcatgcactaaccgaagatgtcggtggccaagaggatggtccgcctggaatggacggcgccggtgacgtaggcctcgaatcctccaagatcgtggacgaccacgccggcctcgccgccgccaccggccgtcgtcaggtccggcgggttgtcgagacactgcgagtgcggcggagcggcggcgccgacggcggccgctgcgaggaagaggatggtcgggtagagcaacgctggtgccatggttttccaactatcgagttttgacgatacatatgaggcatcgaatcgatagttgctggggcatttgtagtttgtttatggcctttagccttaggttaggtagcacattgccctcagtttcttgtttaatgtcacacccagttcccgctgcctgttgacattttgaattgaatttaaggtgagaaaaatttttttgtgtgcctttcgttatattgatcagtttttaattaatcaatcccatgttcaatgttttttttcactgttaattaaattaaatattcctaaattttcattttgtttcctttaaaaaattttagcaacattaactttgtatcatagaaattagattaaatttcacaaaactgtatgtattttgatcaaactatcacaaaactacagattgattgtattatatcagaaactacagatttaacatagatttatcacaaaactacaacttttgtaacctcaattgttctacgctataaactctaaaatttgtagttctttgataatttcatcactaaatatgtagttttttaatgaagttttaaatctgtagttttgtaatatccttggtgttaaatctgtagttttgtgatacctatatttaaatatgtagttttgtgatagtttgatcaaattatttgtagttttgtaaaacttactctaaaatttataccatgaaagaataagtattggtcaaagtttgtcccaacaaaataaagtgtacccttatttttttcaaacagaggtagcatttctctctctcaaaatgattattatctctacgtttgtaatttgtttcttataaaaaagatcatctctgcctcctaacacaaagttaaaaatctcactagggatatttttttcttcttgattttaattgtcaaagggtgtgaaaatgttcaagtgattgaaatttttaaacatgataataattgaaattaaattttaatgtttagtaggaataatttcaaccatattttaagttcattagaaaaattgaaattttagtttaaaaaatcttgtaaaaatataaaaagaaatggtgaatgggcaaattcacctccctcataaatttgttctaatttaatcaagtactttcagaaaaaatatatttcagtttcaattctgaaggcaaaatcacacgaagattagataatttgggtacttttgacctttttattctattttgaaagaagctcatcaaaaagaatatatatgatcttctcaaaatgaatagtgcaattatgaaaaaataaaacttgttcatcaagtagttcgacctcccgcattcgttcatactcttttcataaccgaataatttgaggcaatgtgagcaaaacgtggaggcctgagaaagattaagtgaaaacttagggacaatcaaacaaggaccatctctttgaaatttggagattttaaatttcaacttgagaatacgtgcccttttctatgaggctgaattccttccacgcatataggtttacatcagtctatgacagtccacaagcccagcggttatgagttcaacatcatgtttaatttatagtagttgaccttgttgattctataaatcggtagtaagaaggggtatcacgagatctaaaatgagtaagtaaagggacacaaatttagaaaggttgaggcattctcgatgagaagtattaccctattcatatttagatattgtatccgtctggtgttgtattgatatgacgatcgagttttggccatgttatttaagggctccatgtccatcttatataggtacggaggcaggattacaaagagaaatggttattgggtcatttcttccctcataaaatttgtgaattttactacctacgcaatcatcaattattgtgcaaagtcaaagcgaagaacttggaagctgcaggcctatggccaaattgctggactttttggtagtgcatccggttcgccaaaagttaatgcttggtttatcgtcgatgtatccatcaatataacagtgcacgcatgcgcacatgggagttcgatcagtaagcatatgtgcccggattgttgacacttaaccaaacacgccctaattattctcaagaaacattgcactggtgtttcatgggagacagagagaggaggcattgatgatctatagccaatttgatggccaggagcatggatgcaaatattttaaataattgtcacttgtggtgcatgataaaacccactagtaatttagtttttatcatgataaaaaccaattggtggtgatgttcttttatgccagttttatacaaactgacactgataataaggggttaagatatcttgttctgaaatagtggaggacacacctgtgttgcttcatttatttgtgggaaccatggattgctcctgttgctagctccagggttcaaaatttcgtaacaaaatttccgaaatttcggtcctattggaacccccatacgat

SEQ ID NO: 82958 - DNA, 3501 bp, Oryza sativa
tcgaaagagttttgggcttcatagtcacgtactaaaagcttattgctccaaataggcttattaatgggcctttcaagtgttttcacgaaggcccaacccaatcagaaagtaagcacaactaggccgctatataaatgcgagtaacccgttcgagtcgaaaccctactgcgcctccactcccacccgtagcgcctccccgcgaacccactcccagccgccgccgccgccacctgcaaccgagggctcgccatgccgccgaagctcgacccgacgcaggtggtggatgtgttcgtccgcgtgaccggaggcgaggtgggcgcggcgtcgtcccttgcccccaagatcggccctctcggtctctcccccaagaagatcggtgaggacatcgccaaggagacggccaaggactggaagggcctccgcgtcaccgtcaagctcaccgtccagaaccgtcaggcgaaggtgtccgtcgtcccctccgccgcggcgctcgtcatcaaggccctcaaggagcccgagcgggacaggaagaaggtcaagaacatcaagcacagtggtaacatcagcctcgacgacgtcatcgagatcgccaggatcatgaggaacaggtccatggccaaggagatggccgggaccgtcaaggagatccttgggacctgcgtcagcgttgggtgcaccgtcgacggcaaggaccccaaggatctgcagcaggagatctccgatggcgaggtcgagatcccttcggcttaaaaggtatacaaatgcgtctttcttgttacccttttttgtagctaacttgcaatgcaattgttaaattcataaaattttcatgacacaagtctgttagtgccgtactgttctgctgtaatgtttatttttccatatgtaggtttatatgtaccaacatggtattggttgaaaatgaaatgcatttggcctcattgcttttatagctgtgtaaccctataattcttagtatgaaagcatatataactttttttaaccaagtccacgcactgtactctttgtttgcaacgttgaataatatgaatggaattacttgttttgtaactttaacaagagttgatcatcacttgtcatgcgttatactcgtgatattaagtgaccgtttctgtttacacttaccatcctgtttttcacttgttctgccgaaccgtgcaatttattgtgtaactttgctgttttggttgtctaggttattttcagtgtactactcgcattgtttctctatgcaacatactgcatttatgttaagctttagttaaccttcctgatgtttattggcaaggtactttgcccgatattttttgagacttttgattcctgtatggcgacggaaaatcatagggtgagataggagttattaggatgggattgccatttgattgaatcggtttatgattatatagtaagctcaaatagcttagtgcggagtatgtctgtaattgaatttatatctgattaaatgttttaatgggtatctaaatgtaattgatgaaaataaactattcactgtagcctgtcctgaaatcatgtatgtataaccatctttatgttttattaccttttcaggcttgatatttgaggacattaccatctcgtgctactgaagtgatcatttgttccaaaatgctgcttatgtaccttacgagacgatgtgattcgacctatttttgtcatgctttagtagtgatcttgttgagacctcaatgttactattgcaacttggtaccatttggtcctctggaatggagtttcaagtacttgcataatttaatctatagtcctgtctgatgagatgtctgattcagttttattttctgtgtgcttgatctgatcaaaatgcctactagtaatattttcaggaatctgtcactcttgcttgcacccgtttctgcaaatgggacattatgaacctgtatgattttctcagttcttttaccatgataaaagcacatctagccaattctgattactcacgaacttgctatttagcaatgggattttttctctattgacagtcgccaattctgcccatactattgtttcagtggatttcttttagagataggagtaggtgctgctgtttaccagcattaaatcaatcagtgggattttttatgaggaggtagtagttgtttagcatggaattaaacgatatgtggccatgagggttgttctatttggccatttacccgtcgagtcctcttcaaatttaaccccaatatctatttggccatgaggatatgtcacgattatcacatattcgagctgcttgaaccaaggatgtcataacatttcgtcagacgatgcaaaattcacgacatttaggatttagcatttcataaatagagctgcttgaaccaaggatgtcataacatttcgtcagacgatgcaaaattcacgacatttaggatttagcatttcataaataaaggaaacgaatttaacatggtaacagctaaacaaatgggccatccagatcgcaaacatgggtacacgacgagttcctacacgacgacgcatcctcgatcggcccatcgaatagcttagaacgacctaactgccttacaacgaaaacacggcccaacaccacaggaaactcccacgcgccgtggcggcgcgggaacagcagcagagtctccggcgagcttagaacaagggcggcgggagcgcggcggcggcggcggcgtggctgctccgcgcctggtggcagagctggcggagtctggtgggcacgtaccagatggcgaggcgcgggtgcgcggcgaagacggcgtcgatgtcgaatccgtggcgcgcggagatgtcgacgagcggcgcgtagcaggcctgcctccacgcccccacgttctcgccgcgggccttgtaggcgcgccgcagcgcgtccgacgcctcctcgtccaggcagtgcagcgcgtagcagtgcacgtagtgccgcatcttgggcttgttgatgtagctcgccccgaccttcttcgcgtaccggaacacctggttcgtcacctgcatccacccatacatgcatgatgcatgaaggccatttcattgcgtttcaccaccgagacgttcgcgtgtgcgtgcagctagctcgtgcacatgactcatgcgtcgcacagtgagatcacggatctgatcggctgcttgggggcgcaggagcgcatcgatgcagcagccggtccgtccgggctgtgagtggacgggatgcaaagccatccaatcaccctggaaccccgaccaggccgtgcgtgcattcatttcattgcaccgtctccgagctgagcgccctgatccacggcggcaggtgagctcacatggccgtacgtgcgagggattgccgccacggaatccgaggaagtggccgtcctcctccccctacctccatatggctccatggctgtggggtgtggctccattgccatgcatgcctacgctgatggctagggcccgacaagacaacacatggaacgcaggctttgc

SEQ ID NO: 82959 - DNA, 4688 bp, Oryza sativa
tcctgcagcccacacatggaacgcaggctttgccagcctacctgcaactgacacgtcggcactctttttcaggttggtacttggtactactgcgcatcggcgtacgcgctcgtgtccagctcttcctgaattcttctactacccgcgtacgtgaagcatccactacgtaatcactgtttgcttgtaacaaagcgaacggacggctatgcatgggactaatgaaacagggagagcacgagtgcatggcagaaataccggtatgacagaaacagggagcatcctgttaccatgtgatgtgtgttcctcgtctgtgagcatgaattggtagaatagattaacaccctagcaagtcttacagaaggaaagtgagcattcctgctgttttacgaatgtttttcaaaaggttttgcccgttgtacagttgattttctagaaattttaaacactgtcgcccttttaagtcaaagagccaatgctaaaagttttgaataggcggaaaacttaagcattgaaaatactcaagttatttactagatgctttagtaatcaactgtttgttaccatgcaatgataatgaatctttcgcacctttttaactcaagactggccaacagaatactcctactccatatctgacggcagcacgatgtatttgctcctactagtagtacttataggagtaactgtgaatgagtaataaacaataaacaagtcgagccgttgggatgacagtagtcttagggtgtgtttgaggagaaggggattggggagattggggagattgggaagatacgcaaaacgaggtgagccattagcacatgattaattgagtattaactattttaaacttcaaaaatggattaatatgattttttaaagcaactttcctatagaaattttttgtaaaaaacgcaccgtttagcagtttgggaagcgtgcgcacggaaaacgagatgcttttgtctctcaatcccccagattgcccaggaacgaacgttcccttattcagatcgtcttacgtctgcatgcttatgcaagaacgcgagcatagtagggtaggagtacgtaagatatagagtacgtaagatacgtaatgctcgtaaatcacgcgtaccttggttggggacttgtgtccatgcagcttagccatggattgcacctgcagcaggaagaggcggcactgctcgtacagatggaacaggtagtccagcccgttcttcttggccctcgccacctcgccgggctccgtcaccacgaaaggatgctccctctgccgctccccgccgccgccgccggccgacgactccgtcgactccgacccgccgccgccgtcctcgtcgcagcagtccatctcgtcctcctgcatgtccagccttaggtcgtccaccttcttcctcctcgccttcttgcccttcctcgccgcggatcccttcttcgcctgcttcttgccggtcaccatcctcctgccgttgtcgtcgtcgcccatgccgccgctccccgccatgtcatgctcgtcggacaacactgttcgcgtgcatgcatgcatcacagcatcgtgtacagaacaagcacaggaacatggttaagaatttaaccgatcagcttttgcatgcatgcatgatgacatcgtcgcaattcacacgcaagaacacacagtacgcacttaatacgcacgagcgtgttcggtaatcacatgaaacaagaggagaaagatagtggtatgatcgatgcgtaagataccttcctgggaggcgccgtccacggtgctcccggactggtgcccatggtggcggccgccgagcgacatcaggcggccgcgctcggctcgcagcgcggcgcggaggccgaaccgctcgccgaggagcaggtcccagcggaacagcccggcgagcgcggccatcatgtcgtcgagctcgcgctccgtcatggccaggagcgtgctcgccgtgaacccgagctccgagatccgcgccaccgtcgacatccgcacgccgtaccctgccaccagctcctccagctccctgggcacgttagccggcggcggcggcggcggtggtggcggcggtggtggcacgggcgccggcgccggcgggccgaggtcccaccggaacgggtgcgcggccgagaaggcatcgttgggatccatgcgaggatggctactagcttgctgtccttgcggtcggccgggctcggtttctccggttgtttcttgtgtttcgcccacacacctctgtgcgtcgcgttgggctcgttatatagcggccactgtagtgttgggctatagttgctgcacgcggttgacttgacaaatctccatagctcgttgcattggtccggatcgatgtatctgcattcacgctagcttttggtttttgtccaatacttggaggaagggagcgagctaccgatcgatactacgtgaaaacgacctgtcctgtagaaagctgcatgcgtcgctagagcacacacgatttgatagtctagattctagtaagccctattacgtgccggtacataaaaagtaggcacagtaagccttataggagtaatacacccacacattgtgttgtcctgtcacggcgtacgtgcatttgtaatgtggcgcacgtctcaagtgtccttcgatcttttcgtcccgtctctccttggaggtagcaacggcgtcactgttcctcttccgaagaaaaaagatactcctgcatgcgtactgttgttgcgtacacggtgaacacgggtgaggccgtagccttgtgcccttaattatcgtacgtggcggttgtccatgtaatcgtgtgagcggtgggggcagaagattagcgtgtcattctgcagattttccccacgctagggcaactcaaaaatgtttttgattccgagggcgaaaatatactttttaagaattattttaccattctggataattaatgtatcgagagacaccgtatttttttaatataaaacttaatacttttagatactgtgtattttgagataaacaaaagagtaaattgcatcagcggtacacgaacttgtcaggttggtgcaatctagtacatgaacttctaaaacgctcgtttctgtgcacgagcttgtttgatgcgtgcgaataatgtcaaaatcgcactgcaaggttaatcttgttgattctgtggttgatttaaactctatgtaaacattagtctaagaaggataaacatataataaggcataatgattgtataaaaaaataaaaatttgagtaatgatgcaagggacagaaacaaagaaagataaagtggaatctaagaaaaatcggtcttgtcgcaccattttagtcttagtttgcacataccagacaaattcatgcaccaaaacgagacgagcattttataagttcatacactaaattgcacgcacctgacaaatttatgtaccgctaatataatttactctaaaaaatgtagtgtaaaatttctcttcttttaaagtctcactatggtgcattcattggtcttatttgattggaggatttagatcttttttacaattatttcaattaacggtagtagaaatatggagtgatatttattgtaaaaaagaataatgtgcatggtgtataattgtcatttagcaatgattaaatatttgtttctctttctggattttttatggaatatcatcgatgccggtgcaacggatgaccacagatcaatctagccggggaaaaacataaatgacaaagttactcctaatcaccatattaatgacgggggatttcttggttttactccctccatccaaaaagtccaagacctattttctttttgaccaaggccagtgagtaattaattaattcattatgtgacaaaatcaatgaacatgtaaccaataagtactgaagtataatgatttcttaggctccgctcaaaaatttaatataacacatagtaatgactatatggataggacttaaacttttagaaaaccaaaaaataaaatatatcttaaaacttttggatggagggagtagtcagttaccgatgtttctcctattgtgtcaaaggttggtttgcttagtcattaattagctcgatagaacactaggaatagttcacggtcgagtccgaaagcattaattaatgaaatgagcctagtgcatcgagtgttttttacatttgaatttaaaagctaccataggcaaggaactctacctattggtagtatattttgggggtaaacgacattcaaccactctgcctaacggtacaacgctcgtattgctctctcataacttcgtgtttacgatttagactactccaatttcgcttgttgcttctataattcaatcgagattttctagttaagagagaattagttatctattagctcaaagagacgcttatctttagcctctaccttatagttgacggtaaaaaggagaaatgaaggtagcaggggactttaatatatagcaaaattaccacgttttttaatcatgagacagttgtatgagagcaaggataatagtacagctcacttcctactattagcacattttaaagccaacagatataatagattagctataaggttggctataattttcttctcttctctgtctctcacttatacatttaatgtatttgtcttggagtttgtaataatctagctcttgtatgagagccaacacccttgatttttcactatct

SEQ ID NO: 82960 - DNA, 2437 bp, Oryza sativa
aattcctgcagcccgtcgtcgtatggagctctagtggaaaacgacccgcgtatactgaagagagcgacctcaaattgtttccaactttaagtgccatattgtttatcagtttttgcctgttagtctgggtagtggtgttctcgtgcattcatccttgcgcattgagcaattgatctgtagctttatctagattcttcacaccctcctattattgagtgggatggttgtgattggttgatagaaagatgtaagtgaagaaatagcttcattttaaaacaaagtaccatgctaaaataattatattttgagacagagatatactacttatttctcgaaatgtagcaacttttagctatatatttatgtcagaagttattatggctttggaaccgatgtaggccccattttatttagatcaagacaccaattttaccttgattttttatatcatgtttttaaactgctaaatgatgtattttgcacgaaaactttcttttagataaattcatttttaagtttcaaataattaaaactcaattaattactccctccatcctacgaagactcattttttagtttttgatataacatttgactcatcgtcttatttaaaaattttctatgattagtgtttttctcgttactagataaaacatgaatactccctcatttttagattttgacacagtcttcaagatgctacttgatcaataatatctataaaagtaaaatgttttaaataaaaagaattgcacatgatagttgtttaatgataattctagtaacaatcaattttacatgatcgatctttttttctactaatagtcaaaattaaaaatgtttgacttgacactattctaaaaattattatattttttgtacggaggatctagtactttatgtgtggttaattttttttaaaaaaattttcataaatttttcagataagacggatggatatactagcttcattattttcaatataaatgaacaccactgtagtatatgctctctccatttcaaaatagaaggcaactgaggctcttataaccactgggttacagtccctttcgcattatcatcttattgttagaatcatcctaataaatacaatgcatgtgtccaatagaattagaaattctaagagtgaagaatttaaataataataaggaataagtctacataaccccaccaactatcacagcgtgactacttaaccccctcaactatcaaaccatgtatcagacccctcatctttctaataccgtttaattaaccccctgaggtagttttgccaggtggtgtgctgagttggacaagcttcttgtgttatagcaggctgacatgtgggcatgcatgattttgtgacactcaaatgacctgaaacacttatgcttaaattctgaatgttatggcgttatttccgctagcacctgttgcttaaattctgaatgttatggcgcgctagcacctgttgctttgaattgtacactgaaatagcttttcatgatgtagcagccaattatgtttgtttcggtggaaatgaatagttcaaattatgatctaatttgtgtttgcattatgattatgtgcatgctgtcatatacttttagtgttgattttttttaagccgattcaatgtccagagtttaatcctctcacttacaagccggtctacatgtcagcctgctctaacacaggaagcttgtccagtttaacacgccaccgtggcaaaaccaccctccaaaaccaccttagggggttaattaaacaatatttaaaagatgagggggtctaatacatggtttaatagttgagggggttaagtagttatccggtgataagtaattttaaggatgctagttaattgcatatatgtcttgtattatagaacatctgaaaaaaattggggggagtaaaagttttttcagtctcatgagaatacatagaagttccaggttaatctgagaaacaattaaaaatttaaaaccaacatgtagccagtagccacaagagaattagcacgctttcggcgacaatgaccccttcacagttcacactcccaacatagcttctctcggcgctcgtctatgctgtatgcaccaccgagaaggagaacagcaagcaaaggcgcgacgacatgccgtgcagaagagcaagcacaccggccgctgcagctgcagctgatcctgctgtggctgcatggcctctcaccccactggtgctggcgctcgccgtcttctcggcgatgcctcacgtcacgctctcccggggacgggagaatcagtggccgcctctagagggaaactcgcagctgacgacgacgaagaacctgtcgtgcgacgaagtcccttatcccttcggcttaaaaggcaaatctgcccctggcttcagggtaacatgccggaaaaacgacagtgctgccatgctccgcatt

SEQ ID NO: 82961 - DNA, 751 bp, Oryza sativa
cggaagatccgctctttgtggaagtagaagccgacgtttgggaaagcgagcaaggcaagtcacatcatccttgagcatattgaatcccagtttacaaaattatttttaatttaaattaatgcattatcgctttatttaaattcccgcgttatcactgttttatttagccatgcctatttacctttgttatgaccttattattaattatttccttgttcaccctagagtaaacaaaaccccaactagtggacactctactcatggcaccactagtttaattttaggtagatgcttcgcaatttaattaggtaacattaggtggttttacaactctagactttgggaacattcatatcacctggacactatggaatggtttggttattgtggaattggcttcacaccgctccttctattcaaaatccccaaattggttttaggctgggctcgaggtgcgtggttgggttttgctagtcgtacctcgggtactataaggattaagctcgggcctctgttgcaaagcactactgtactttcacatgtctagtgggtaaggcttagtttgtggctcagtctggttataaacaaaagtacacggattggagatggatgaagtcgggggtcgatggacattcttcaaggcaaatgaaggctacacgagctgcggcccggtagtcgagatgtcatggcagagggttggtgccctgctgctaggggctcaatcttgcctgcctgtcccgggggttcccgg

SEQ ID NO: 82962 - DNA, 834 bp, Oryza sativa
atttcataatgtccgcagccaatgttatagtttgaacctaagtgatgagcaactagcagatcttgcattccaaggattgtcagcaccaatcagagatagattcttttgccacgggtttgacagtctagctcatctaatgcaaacagtatcagctcacgaaagccgattgcaagacgcaaatgaagatcagttttggagttatcaagaccagacagaagataattttgaagcatgagtactcatactctaaactggggggcatgtgttaacgacgaaatttggtaagcccaaagtcatcatcggctgaaagtcaatatcggttttagagttctagaaacagccgatgggagtcgtcaagtcgccatgctatcgtgttcttggtggagtcggatcaatcgaaggaagcttatttagaagagtccaagttcaaggaggatgccgtatgacagtttatctattaattaggaatagtttgttagtttccttttatctttaggaaagtatgtttagtgtccgataaggacttgtatcaactcatgggtataaatatgtacacccggggtctatgtaatatatcaatctatcgatcaatacaactactctcggtgcatcgccaccctctttaccgaggtttttacttgtcttccggcggaaattggcacctgacacggggctgcatcggctttcgatctccggcgaaggggtaagtcctacattccattgggccctggtgaatctgtcatctacgtcggcgtcgttcacggctgcatcgctacgacttcttggatctctctggtttggttgattgatttgcctacctgatatctcaattct

SEQ ID NO: 82963 - DNA, 1265 bp, Oryza sativa
gcggtaagatttgatgtcttaggtcctcccggggtggtcctttttataccgcaggtcagttggtctcaagtagaactcggagacatcggaccccacacgatacagtaacgacccagttctgtctgagtaggactccttctatctgtggattccgcatctatctcgtgacgaatttccttaacgtacataggaaatatccgtataggcgcgggtataccgtatcagtatagaacgtgtatccaagggtagagggtatatcttatccataaccctgacacttttcatgataatcactactaaacgatagattttcatggacgttacccccttttatttccatgcagttcttaagtggaactgcacggaaaaataggggaaccggggctgggctgttgcccgtatgggaaaatcgattttctcgtgcggtcctcctaaacggaccgcacgggaaaatgagccgattttcccgtgcgtatctattaagagagccgcacgcgaaaatagtattccctattttccctcccacccatttcaaaatttttcctcatttatctcttttaatttctcctcacatccctcccctcttatctctcttctctctcctcctctctctttcacgcctctcctctcgtctccttttggcgcgcgggcgatggcaacgacaacggcggtcggcgtcggcctcagctccacacgacggcggtgcaggcgcgggatccggcgggcggcggtcatccccgcacagatccggtgagcggccggccttccccacgcgggatccgctcccctcccctccccttccttccctccctagatctggcggaggggaggggcttctgtggcggtgcagccggacgggagggtggatccggcgggcagcggcatggaggggagcgcggatccgacgggcggcggcgcggaggcctccgccgatgaggaggaggaggaggaagcggcgccgctgccatgcgccgacgtggaggcgcccgtcgcggctgctggtggaggcggcgcggcggccgccgctggcgttgaagaggaggaggcggcagccgggagcggcgccgctctccccacctcatgcggccgccgacgacgacgaggagaaggcggccaggagcggcaccgccctccccacgccaggatccgtcatccggctgtggcggctgcactccgcacggatctcgcggcgacacagtcccccgcctggagccggccagcggtgacggcggggagtggcggatctagggttagggttcggtaat

SEQ ID NO: 82964 - DNA, 1426 bp, Oryza sativa
cacagatgtcaaatgccccattgaaatccttggagctgagaatgacgctgtaacaccaccaagattagtgtaccagtttgttaatgccttgcgccaaagacctgaggtaagttcctgttgattttcattggcacttgatgccaaatgcatcagcatagtcccacggtagacacacacgagaaaaatctcccactgatgatgagaaattgaaagatcatgctggctctatttttctttttgaggcaatattggatctagctaattagtaacattaatgaaaagtccaaacactagcacattgtcaataaacaagtttacaattgtttcttaaacacaaccactcaatgatctttaagaaaagaaacaagttatgaagagcctcttatggattgcatctttgttgcaggttgattactttgccaggatctttccaggagtggctcatggctttgcttgcagatataacgccagcaacccgtttgctgtcagaactgctgaacaatctcttgccttaatgcttgactggtttgagaaacacttgaaatgacaatagctaatcatgcatgtaatgcaaggccagtgcaattgtttatttccatcaaaatacattgctagtgtccatgtatatcctggtgttaagtgaaacttatataaataagcactagtgtaaagtgaaagtatgtgttgaatatggtgcgaagtgaaacaaagtgtactttatgaagtgcaaaatgcaaactctttttgttccgaagcgaccattagcatggcatattaaaacatctgtttgtaggagaacaaaaataatgtgtgcctcagttgccattttaactagtcgatatgttcaatcaaatgttgtatgctactcatcttaagcacagcatatattgggtacctcttgactgtttcttatggccacaaattagacagatgaaagtcgtgcttccaagaaattgctggcccttaaataggatggggacttctcctgaagctgtagaggaaacaaggaattctgattccaaccaaaatggatgggtgatgaaccatttgcgtgcaaaacacagaaaacattcccagtatttcatctcctattgtcctaagtcaacaggcaaaagatgacaaatcatccagccaggttgaacagttaaaaaaactttttttgtttgaaaaaaagctaagatttaatgtcctccagggagttaggcatacctggtctcaccggaagccagtggcgaggttgctgtagatctagccagagctgtgtatcctgcctccgccggatcgtggggatggcatcttcagatgagcatatctccacctcatcctatatatgtgcgctgccacatccagtgccaccccttgggttccatcgaggaggtcaagggagattcatgtgccttaagcttttgacaagggtgaggggcag

SEQ ID NO: 82965 - DNA, 10189 bp, Oryza sativa
ttttagagttttgttttgtaatgttcaaatatcatttttgagattttgcttgtgtactttaacttttgctattgcatatgttcaccttttccattaatatacatccttgaaaatcctggattcaccatcacaccacaaaaatgtaaggccaaaaacaatctacaaatggagggaataaaacaacaaattcctcaattttctacatgtaaatatcaatagatttgcttcaagatccccaaacttttcctcggaataaagagttctactccgaccattttcaaattgttgtcattctgattttattctaagtcaaatatttctacctttgaccagcaatccataaaaaaaaaatatagttgaacaacatccgaattatatatcatgaaagtaattctcacggtgaatttagaaaaataaatcttatgaccgttaaactatatgattttctataaactgatggccaaatatatatttgacatatgacaaaactagaacgacaagtaacttaaaattgagggagtaaaagcgaggcattttctgatatagttttcttcttccaagaaaatagatatatagtttttttttccttccaagaaaatagatttagtcctggcaattaacacgcaccactcctagctgttgttgctttcgattccaaaagtctccacagcaagtagtggtggtgtgagttgtgacgagataagagaagtaacctaagctctctttacatctaccgatgttttacatctaccgatgttttttaggtgtcacatcggatgtttgactggatgtcgaaaggggttttcagacacgaatgaaaaaactaatttcataacttggctggaaaccgcgagacgaatcctttgagcctaattaatccgttattagcacatatgggttactgtagcacttatggctaatcatggactaattaggctcaaaagattcgtctcgcgatttccccctaactgtgcaggtagtttttcttttaatctatatttcatgctatatgtatgtgtctaaagattcgatacgatgtttttggaaaaaaaactctttaaactcttttggggaactaaaccaggcctgaatatattggtcttgtggtcctgtgttctagtgtgtgtggctccccagcacaagccttggatcctactcttctcgacctcagtgtcaggtctcattcatttgtgatgaaacaccatcccttctggactctactgtcagtgccgccgtccttccatctattctgattcgatggccgtggataagcttgatttctctgtccttttttttccttgtttatttatctatctgtcaactctcatccccctttcggaaagatgattttcacatgaacacgagtttgtgtgttcaacgctatagatggataatatatataccattgtggttttattcgtggtcgtgtgtgttttatcgtgtactgatcgaagcacggtaatatagcgtacgtgtaaagtgtaatgtaaagtgtaatgtgtgtgttagctttcgctttactgtatgaagaagtattctatgccattgatgtttttttcacacgcagaaatattttcttccaagtggaggggttctttcagtttttattatttatttttgtgaatgaaaattttgactccaacaaaatccttttatttatataaatctggggcgaagttgactcctgtttattcagagagagagatagaacggatcaaaaggttagtctggaatcatgtttctgtcattactaattcttaattcctcattaattcctagaaggacacatttgcaacatcatactacttaattcagttttatgcattcctagaaacttctttaccatctatattacaccctttgtcccaaattataatgcttatatttttttcacagtcttcagtgatatattttgactattattttattttatgttacgttcccaatgagtatgaaattagcatcatatgaaaataatttgaaatgaatataaaactaatgatataacatgtataatacttaacatatatatagttagtatggttattagttaaaagttatcaaattagatttttcagaagatcacgccctgtaatttagaacggagggagtaatagtcgaaaatgcgcatcaacaacttatatgattggtgtgagtccaaaagtaggccaagacatattggggtatttttaccattgcctttctgttatttctgttaggttagcatgtccatgatgcaatccatgggattggcattgcttgcaagttaactaggaacccataatttgttcacaaagttggggatgaatcggtggcaccgaaccatcaccaatgcctacaacgaatttcccggtaaatcctagctagctagataggaacagagtgattactagagtagactgtcaacctctctagtctctaccaaataataaagaaaaaaaaatgaggagatagtgatggtgtagtgggtatataattcgactcaccaagtttcaattcccgatgttgtgtgcaaatagaggtgggaaggtaatacttccgttatataaaagtaataaggcatggtcattaaaagaacataataacactacactggacaaggtcacctgtgacgggcccaaaccctcacctttgacggctttgagcttggtcagtgatcagtggtcactggtgagtccaatcacctttgacgggtgaaggaccgtgactgatgacagtcacctctgacgggctagaactcttccgcccgtcagaggtaagtgtctgcgctaacccatgccattttgtaacccgtcactggtatggttacctgtgacggctttttcaatatgaaccgtcagtgatgaggtacatccagacaaaaaaaatttctaaatattggctagcaaatcgctagccaatatttagaaattatatttcagcagcagtaaacagaagcatcacaaaatatatccatcacaaattagccaaaatataacctaaatttctcatcaacaatatatccatcacccataacagtaagggacaaatccatcacacacatgcacaaatccatcacacacattcacaaatccatcacacattcacaaaatccgtgccactgccgctccaagaatcaccgaatctagaaattagagaagggggaggaggatggggatggatgcggcgccgctgccactcacctcctcctcgccaccgcacgtcgtcgagccctcctcaccgctgcgtcgagccgctgcaccgccgcgcgccgttgagccctcctcgccgctgccgctgcaagaacaaccggcggcggcgggcgggcggattcgtgtcccccaacctcgtggaggctagatccgacacccagcagtcgggggacggcggccgtggcgcccggcggtcggggaggggggcgaaggaggcggcgacctggatctggcgtggtggaggcaggaaggaggaggctacccggatctggcgtggtgcaggcgggaaggaggcggcgacccggaggcggtgggcgaaggagctgacgacggggcggcggagagacggcggcggcgaccatgaggctgagggcgaaggaggcggcgaccttcggaggtgggcgaaggaggccgccgcctccgcctctggtccccgccgatggacgatggacggcgccgcgccgctgctccccgagacaagccccaagagccggagagggcgaagaggcggacgtcggtcaccacgacgcggcccccgcacccgccggcgccggtgccgtctccgcctccgacacaggtcgatgaagagagaaagggttgagagggagagagagatggggggagtggttgagatggataaggatgagccggtagtagaggataaggatgagccgggatgagaggggagggttatgagaaagatttttttttatcatctttgacgggcacataaaatttgacccgtcacaggtgactttatctcacctttgacgagttttgtttttggaccgtcacaggtgactagttacctgtgacgggctaaatatttttggcccgtcacatgtaattttacctcacctttgacgggtttcatttttgaaccgtcacctcctgatggctcaccgatgacggcatcctgtaggacccgtcaaaggtgaccctcatcactgaccagcacttatgcccgtcacagatatgccgtcacaggtgcaaggatctggcgtagtgtaagaaaataaacctcgttgataacttcatttgggtggaccgggtcaatatctcaaattgaaaatatgcaaaaattcagcagcgccatatcgtcactagtcttgagcccgtacatctgcgttgaaactgaactatttcacgtggaattttctgctttgtaaattaagaatgggtctcaatttttgaacttcttatgtcaggattatgactatctttataaagaaaaccaagagccgtgaattgcagcacaaccaaatcattgcaaagcatgcgctatttctagcatcagggctgctatctagtcaacaagccagccaattaacctgtagaatatccaaccaaagataggcgcctaccatttcttgcgaagttcagaagatacttcataaagtatattacaacaccgactttccaatatgaaaataaacacaattatcctcgtacattcaggcgtctactcagcgctatcagcttttgacgtgagcctaccaatgcagtcatgtctccttgtgctgcctttttcaattcaacgtggcctaattttatgggcctacaagctcacaagcaacgttcctttgtatgaagtatgcatcattgatcattggaaagggagaaaatttgttttatattatctatcttattattcattttctttattttctttttacatggaatgcgtgcactgttggaaatttggtcataattcggcatattttaatccaaaataacaagataataaacatgatatttacaataggatttgatccagtgatagtggtgaatgtaatcaacatgagcatgcttaacgttgaataagaatcaacaatcacataatgacacaatgttgacattgcgattaacattaacagtaaaacttctaattgaaataatgtaataaggttataccccaagaatggtcctccgctggagtttgaggcagtattgcctccgttggtgttgacgggagtctccttctccttgtctccagtgttcgacatgttggtgaagatgaagtagatgttgacgaacagtgagtagtcgcgccttgcgctccccaaaaacctgatcgcccgcccgtctgtgcaaacgtcgcagcaacgcgtggtttcggaggcctactctcccaacgcgtgtgcacacactcgtcgggatgggattaccgtagcaacaacagctttggaaaatggatgaaagtgtgtcttcttcttctcgcgggagatcaaatccattctcattttataagaggaatggaagatgaagagtaagagtcatgaaataggaagaggaatggagcaactaattgtcatcaactagccatgaaccatcctccactacacaaccatcaaccaacaatcaattaagagtaattgatgtaagttaccaatggaataggaagaggaatagagcaactaattgtcatcaactagccatgaaccatcctccactacacaaccatcaaccatccatcaattaggactaattgatataagttaccaattccttaatcaaatggattaattctcaaaactcttcatcccattgatatcccatagaagaatgaattcacatgaattcctagcataatgagccttggaatttatttgatttaattgatttaaatggattaattacccaattaaatctaacaatccccaccaaatttcaaggctcatgagaatgctctctattccatagcagcttttatataccagtgtttcggtgaagactgttaagttgaactttcacctagaaaaggagctacacctgaccacaactgaacaatgtactatgccttgaattgtcagtcttgtgcagttaggtttcactcaattccataactgatactaggcaaccattagtattccctcgggttggagcttataagtcatactccaggcctttcatgagtatctagagatcacccaaatctcatagactgtgactagcagtcgaactcatataggtttgttccttctaagatgttctgcaggtcaacatctctgcttggaaaagccactcggatcacattaagacataagccatcctaccatgcaggaaagaagagaagcacatcatgaaaatgagcccttttcaagggtctcttctctcagtcacacaatagtttgtttcaccatccaaattcacgggatctccgatcataatggacaggtttccactattatgcaaccttaggtgggtatcaagcccatttccctcgatgcactgtctatcacattacgtggtagccccttggtaaactgatctgccagatttctagccgtttggacatagtccaatgctatcactccggagtttttctgctttctgacagatttcagtcttctcttgatgtgtctagatgacttcatgttgtcctttgaactgttcactttaataatcactgtttgattatcgcagttcattaggatagctggcactggtttttcaaccaccggcaaatccatcaggagttcacgaagccactcggcctcaactgtcgcagtatctagtgctgtaagttctgcttccattgttgacctcgttaagatggtctgcttgcaagacttccaggaaacagtgccacctccaagtgtgaacacatatccacttgtggcttttatctcatcagcatcagatatccagtttgagtcactatacccttcttgtacttttggatacccggtatagtgaattccatagctcatagtaccctttagatagcgcattactctttccagagcctgccaatgatcatctcccggatttgagacaaaccggctcagcttgcttacagcaaatgagatgtcaggcctcgttgcgctagccaagtacatcaatgaaccaatgatttgagagtatctcagctgatcccttgctattcttcggtttttccttaatagcacgctgggatcataaggagtaggagctggcttgcagtcactatatccaaagcgactcaaaaccttgtccacatagtgggattgcacaagtgtaatcccaccctcatctcctctttgtagtttgatgttaagaataacatcagcctctcccaaatctttcatttcaaaactcttggacagatagtctttgacctcctcaatcacattaaggctggtcccaaagatcagtatgtcatcgacatataagcacaagatcaccccttctcccccaccatagcgatagtatacacatttgtcagcttcgttcacaacaaagcctgcagatgtaagcgtggtgtcaaacttctcatgccattgcttaggtgcttgcttgaggccatacaaggatttcaatagtttacacaccattccctcctgaccttctagtacatacccgtctggttgatccatatagatctcctcctccagctctccgttcaggaaagctgtcttaacgtccatctgatggacgagaagaccatgagaggctgccagagcaagtagtactcgaatcgtagtcaagcaagcaactggtgagtatgtgtcgaagaagtcctcgccttcctttcgggtataacccttggccacaagccttgccttgtacttttcgattgtaccatcaagcctaagctttttcttgaaaacccatttgcatcctacgggcttgcacccatatggacgctcaacgacttcccaagtaccattagacataatcgagtccatttcactgcgtactgcttccttccagtagtcagcgtcaggagatgaatatgcctcttctatggttcttggggtgtcatccacgaggtatacaatgtagtcatctccaaaggattttgcaaccctttgtctcttactcttgcgagtatctacaatgttgtcctcctcaggattttcctcaggcgtttgatcattgtgttctatcggtgcaaagtgctcatggggcatgacagtttctttactagaagtgctaggtgtatatttcataggaaattcattctcaaagaatgtagcatctctggactcaagaattgtaccaacatgcatgtcgggtactccagagtttactattaagaatctataacccacactgtggatagcataaccaagaaacacacaatcaacagtttttggtccaagtttccgctttttggctataggtacatttaccttggccaaacagccccatgttcgtaggtatgagagatttaatttcttcctttcccattcctcgaatggtgttatttccttatgcttcattggaattttattcaggacatgacacgcagtcaaaactgcctcaccccaccattccttggaaagccccgcagtgtctaacatggcattcaccatctcagttagagtacggttctttctttcggccaccccatttgattggggtgaatagggaggcgtcatctcatgaataattccaaactcttcgcaaaaggatgcaaactcattggaaaaatactccccacctctatcagacctcaaccgtttgattttcctttcaagttggttttctacctcagctttatagattttaaagaaatgcaatgcctcatcctttgttttcaataaatacacatagcaaaatctagtgcaatcatctatcagtgtcatgaaatatttctttccccctttagtcaacacgccgttcatttcacacaaatcggaatgaacaagttctagaggtgccaaattcctcgcctcagatgccttgtgaggcttgcgaggttgtttcgattgaacacaagtatggcacttggaaccttttaccaaagtgaattttagaattaaactcatgttagctaagcgcgtcatacaactgaaattcacatgacagagtcgcgaatgccacacattagactcatcattctcgctaatatggttcacagcattatgattattacacatgtcattcaaagaaaagcggaacaagcctccgctgtcataaccttttccaacaaaagtcccatatttagatacgacacatttattggactcaaacacaagtctaaaaccttctctacacaatagagagccgctaactagattcttctttattgaagggacatgctgcacgttcttcagctgcacggtctttcccgaagtaaacttcagatcgaccgtaccaacaccatgaacagccgcaagcgacccgtttcccatcaacaaggaggaacctctcccgacctgataagaagaaaatagagaaatgtcagcacatacatgaatattagcaccagtgtccacccaccaatcaggtgaatgaaaaacagagagaactgtaggtaatattttactgtaccccgatgttcctccgccctcgctaatgatcatgttggcagacttcctgtctttgcgctcaggacagtccttggcccaatgcccagacttgccacacacaaagcagtctccctttgcctttcccttgcttttcttcttaaaattggttgcagccttgggtttgacatcaggcttgactttcttgtagttgtgggatgcatgagggttcttcttctgtaccatattggcactagaacctccctcaacctttttgccccggacgtcctttgccctcgccttctcctcaacacccaaagagccaatgagatcaggaacactgaactcttgtctcttgtgctttagagaagtggcaaagtccgaccaagaaggcggtagtttggcaataatgccacctgccacaaacttgtccggcaactcacagttgttgttctcaagttccttagccggcatctgaatctcatgagcttgttcaactacagaacggtcatcgaccatcttgtagtcatagaactgctccataccatacagctcactgccggcgtcagaaactccgaacttggcctcaagtgcatcccacatttccttcccaaaaggcatgtgcatgtacacgtccactatgttgtcagcgagtacactgatcaatgctccacggaacaggcaatccgaagcctcgaagttagcctcttcctcaggagaaagaggtggttcacttcgtttgccccgtgaaacatagaagca

SEQ ID NO: 82966 - DNA, 11120 bp, Oryza sativa
acaacattcactccctctcactaaactgtggcatgttctctagccgcttgtgatactcgcaatcctaaaccacgagagaaaacattgcccctatagcagaagggtagatcgatggaggcagccatcggcgcagcgagctggctcgtcgacaaggtggtgacacagctgtccgacgagctggtggcggcttacatagccagcaccgagctcggcctcaacatggagcagatcaagagggacctcatgtttatgcaagggctgctccatcatgcccgggagaggagggacaagagcaaccctggcctgcaagggcttctagaggaactcagaaagaaggctgatgaggctgaggacgtgctggacgagctccagtacttcatcatccaggaccagatcgacggcacccatgaggccacccccgtggtagacgatggcatccgtggccaagtcctccatggccgccatgctcttcgtcacaccatcggtaactgcctttcatgcttttcttcttcttcttcttcttctgtaccagaggatgccaattatccacatcacacagccaagtcccgtagtgatgaatctgactatgttggcaagttgacattcaatcgagtagacatgtccaaaaaaatcaagtcggtaatcgagggcatatatgacttatgtagccatgtatccaatttgctcaaaattacccaacctgaagaaagaagggttctatcactgaagcgacctcccaccagctcaacaattacacagaataaattatatgggcgggaagacatctttaaccagactcttgatgacatgtgcaccatacgtagtgaaacactatcagttcttcccatagttggccctggtggaatcggaaagacaacctttgcccaacacctgtacaatcacaaaagaacagaggcacacttctctggcaacaagacctgggtttgtgtatctactaattttgatgtggttaggctcacccaagaaatcttgatgtgcatatgtcaaaatagaaatgaggaaagtagcggagcacatgaaacatccaacttggatcagctccaaaaatccattgcagaaaaattggattctaaaagatttttacttgtcttggatgatatgtggagatgcagcagtgagggtgaatgggaaagcctactagctccattgaaaacaggagaagccaaaggaagtatggttattgtcaccactcgttttccatctatagcacaaatggtaaaaacaaccaagccaatagaactgcaaggtctagaggatgatgaattcttcacattctttgaagaatgtatatttggtcaggaaaaacctgcgtgttatgaagatgaattgattgatattgcaagaaaaatttccaagaaatttaagggtttcccactagcagccaaaaccgttggtcgattattgaagaataacctttcccaggaaagttggatggaagttcatgaaagaaatgagtggaaaaatcagcaagatggtgatggcataatgccagcactacaaataagctatgactacctacctttccatctgaaaaagtgtttttcttattgttccctttaccctgaggactaccggtttggtaatttagagattacttatttttgggaagcattaggcatcatagcttatggagatcaaaataataaagctgaccatgtaggattaaagtatttgaacgaactagtaggtaatggttttctcatgaaggaaggtgatgatagtaggccatattatgtaatgcacgacttattacatgatctagcacgaaatatttcgtcacaagagtgcattgacataagttcatataactttaggtctgatagcatcccacaatctattcgacatgtatctatcaccttacaatatgatgagtatgaccaaagttttgagagagaattagaaaaattcaagacaaaaatagacatagtaaatttgcggactttgatgctttttggaaaaggcaatgcaaacatgacctttttcaaagatttgttaaaagaaacaagaagtcttcgtgttctatttatgcatgcaaactcgcccgaatctttcccacatgactttttcaaactaatccaccttcggtatctaaagttgaaaataccttatggcgtagaactatctctaccaaatgcaataagtagatttcatcacttaaattttttggatctagggaatagtatatgtattttgccaaaagacatgaatcgtctattcaatttacacctctttcttgctagaaaagaactttgttccaatattcctgggattggtaaaatgaagtatttacagaggttggaagagtaccatgttaagaaagaagacattgggtttgatctgagtgagctaggggatttgacagagcttggaggtgaactgacaatatttaatcttgagaatgtggcaagaacggaagaaggtaatcaagccaaattgcagttgaaaagaaatttgagaagattgacgctaatttggggtgcggtgcaacagacgacaggatctgatgttcttgatggcctgcaaccacattataatcttagagcacttggcataataaaccatggtggtcccactggtcctggttggttgtgttccgatatctatctatctattatatactaaaagtccattaaactttctataaacgctctcaagccgccacgtggctttctacaaacgctcctaggtcaccacgtggcattctataatctcaccgtcgattttcttttaaatcggtggacccactaattttaactattagatcttcattgaaaaaataaatctggtgtccccactattttttaaaaaaattgccgtgtttgccatcgggcaaggaacgtaagttcttttttttttcccggcggcatacgatacgtactccacgttccacgttagtattatttttttccttttttttattttgcaaacagttctggtgtccccactatttttaaaaaaaattgccgtgtttgccatcgggcaaggaacgtaagttcttttttttcccggcggcatacgatacgtactccacgttccacgttagtattatttttttccttttttttattttgcaaacagtactttttctttacaccttctgaaaacagtactactactacgcacatcgtacatacactaggggagtttaggagaaagtgttaatagatatgtaaaatcacatcttatcgatttaagtaaaaatccatagttaaatattttttctttttcttataatttttaataattcttttaatttagagatatgacatgtggtaacctaccagcttttatatgagtgtcacgtggtagcttaatagcgtttctaaaaagtttaatggacttatatatagtaaaagttaatttaacttcctataaatactctcaagccgccacatggccttctacaaacgttcctaaatcaccacgtggcattttttaatcacaccgtcaattttacgaaggtaaaaaaaaaaaaacgcagtacgtactccttccaccctccgaatctcccatcctctcctattttctagctaacttatcatattttctcattaacactcaatatatcaaaaaataattcggacatctaattgatcgcgactctcaaattataattttatactcaggtttttttcaattgttatgttatttataattaaatataaaattcaaaatccatatcactcatattttgttatctaaaaattagatcatgctgccgttctaactacaaatgtcagggcctaatggtacgcccataaacacttctaagtcgatctcgccttgtaacactataataaattaaaataaatctataagtatgacaaatgaaaataaaacatctaaccattgctctccacttaaatcgatggatccactatcttatatggttagatctatctttaaaaaaaaatcccaaaactccctcacattcctccattcctctgattcctctctccctaccattccttctctgttctttttatctccatagtaactaaaaccaacattatctttaggataaaaaaactccaaaaatggactccacctaacaagtctagctagctttccctctataatgtgcttttcttatctttctcctcaagctagcacttacagaaacaatataaactagactttaaaacactcataaaattttaaatcgtatattcatttatgatatttctacactattttaatttttaattaaataaataatttaatatctgtattgacttacattgtggaccacatctatccacctttaagcctccaataaataaaatagaacactaaaatttctcattaaaaattaaaatatctcaccttatgtttttaataaatggtcaacccattatttataccatgctagacatctaatctccttcttccaactccttatgtttcagattataagtcattttaaattttgtcaatgtcaaattacttgaattagtttataaaaaacatagtaatattttctacacaaacaatcatattataaacatattcaattttcttcacaaaaaaatcatattataaaacatattcaattttgaattcaataaaaataatttgggttgttgtaaatattgatatatttttcctcaacagtggaaatagttaatttctcttaacatgcatatatgggctatttacttatatttgaacttaattagatgcacttttatgaataaatgatctttttagggataaataaacgttcctaagatgatcataatatctaaattatacatatgatatctgatgtcactaatagattagagaaaaagcttataattatatcattttttcgtgtcataacgtgtaccccgtctaggatctatttgtcatacacagcacattgaaaatatttaagggatacctttatcccatgccaagttgtatggccattccaaattgcagagatcaaaacatttaagagacgctcgatggaatggaaatctataaaaaaataacatgataaaaataattgaagactgaactttttttttctaaatttaacatttttttaaaaaaattgaaacccattctaaatagcaatgttttaatattttaggagtactgaaataatgaaaataactaaatatttaaataaaatataatagaaaatttgacccttttcagcattatgttggaaacaaaatctaatataactaaactacaacttgggagcgataaaagtctcattttctaatatattttctggttgagaaaaacatttactgctaaactgtagtttcatactgcaatactatatacatacaattaaatcaatatttcaacaaattcagctaatttaattagatgtagtcgtattaggcatatttttaatagaaaatatcttcaattaatatatcctaaaattcataaagacatatatattataaaaagaaaaattggtactcagagtttagaaagtacaaaattatgttatgctaaatattttaaaaaaagaaacgcattatgtacaaatgatatatagtttcatgtatattttttttataaaacctaaactgcattgttttaagtaattttagtttacaatttatacggtggcgatggttactagcattaagagaaacaccacacaaattattgaaaaattaaagatgtttacgatagactaatcataaatatttctaatcaaatttttaacacacttaaatatgatgcccgcgcatttgcgcgggctaccttcctagttcgtataaatggcctgaaatgtctacatttagagggcatatcttggagaacactcccacctttggggcaactaatgcatttggaggaacttactttgatcaatattgctgggatgcgtcaatttggacctgattttggtggtgttacgaagaagagtttcttacacttgaagaaaattgaacttgttggtttaccggaacttgtggagtgggttgggggagatcattgccatatgttttcaaagcttttaagcatcagatgtgaagattgtcctaatctcaccgtgctcctgctgccatcgtttgagtgctctatctctgacacaaaagacataaacaccatatggtttcccaacttgtgttctcttaagattcgaaattgccccaggttgtcactgcctcccctgcctcacacttccatgctaacctgtgttactgtgaaagaagatgatacagatttgatgtattttgatggaaaaagtctgaggttaaatcgctacggtagtgctttggccttccataacctgaacaaagtagaagatatggaaattgtagacatgccgctcgtttcatggactggtctccaaaagctgaactcccccagaagcatgcaatcgatgggtctgctctcaaacctctcatctctcactcatctagaactagtaaattgtgataacttaagagtcgatggttttgatcctctcaccacatgcaacctcaaggaaatggcagtttacaatagtaaaaaccatcacccctccatagcagcggatttgttctcagtggtggcaatgatggaagtaatacctgcaggttccttccagcagctggaacaactctcggtggacagcatctcagcagtgcttgttgcccccatttgcaacctcctggctagcaccctctgtaagatggaattcccgtatgacatgtggatggaaagcttcaccgaaacgcaggaggaggcgcttcagctcctcacctccctccaatgcctaggattctatgtgtgtccccgtctgcagtccctcccagaagggttacatcgcctttcttcacttcgtgaactaattatccataaatgtcctgaaatcagagcgcttcccaaggaagggttccccgcatcactgagatatgtatttgcatacgagggcatcagtgttgatctaaaggatcaactcaagaaactaaaagcatcaacgccaggtttacgtggtaaagcatgtcctctcctaattcctgtatttgtcccttattaaatctgtaaattttcatatttaactaatttttgcctgttttgctattaatgatttacctcatgtggagtagtggtttcatcgctaaccaacttagtaaattaatgcgagctacacaagattacatgaaggccagcaatctagaggtcagttcatggaaaaccaaggcagtccttcattttgtggtttctttctaagttcaggcagctgcttttagtttagtccatatggttgagctgttttctttatctgctatctgaatcaatgctatattagttagcttacattctatatatccttacatatttttttcatctcaaacagcatcacaacagtttgcacgcatgcagctgcgtaataaatctgaaacccgcccgccctgctatggtctgatgtcatcagatccaacagcatcaattaagccatggtggtcagtagcatcacttctgctcatatcgtttgtttttttttcttttctgtagtttctcctgaaactagtactccatccattctaaaatggcaaaatatatcaatatcaacgtagtactacgaatgtagacagccttcatcgtattaggtggtgtctaatctattattaggacactatattttgaaacggaggggatagcttttgtaatttctctcgatgtcctgaaatcagatcgctgctcaaggagcattcctctcttcattgagatatccaagggcaagaccgcaagaggatgcagcatcgtctacaggatcaactcaagaaaatagctaggagaattagacccacatttggtaaaagtgccagggtgatccaaagtgaaatttaggtaataaaaagtgacctaaagtgcaattcactcaataactttacaacgcactgcagaagctgatatgttctctgttatctttggtagcggtggaggcagcctaggaaaatctggctatactgagatgtttgtcatttaaaaagagaagtctatcttcaattaaaataacaccaaaatgcctttatgcattcatcaacgagccagggaagcatttcaaggtactagattcaacaattcctgtaggacaaatggtcattccactgttcatgggtattgagagtatagatagccatgtgggccgcccggcacagcccggcccaggcccggccgtgcctaggccgaggcttgtcaggccggcacggcccgaccgactcaccgggccagcccacgtgccgcactcacggcctaggcacggcccaacacgcctcgggctgtgccgggctggcccgaaggcacgatgggccatcgtacgtttcctcagaataagtctaactttcctccctcctattgggctgtgacatatatatagctaaaaaagtctattttacctccctcttatttgggctgtggtatataaatagctaaaacaaactcaacgcacccattggtgcgcggactaatgtatggcccgtcaccatcgtgagcttctctatatctcaatattttttttcatatttatttgaaattgcctgcgttagttcgtttgggttgggaacccatcttctccacatagaaaacataacggtccattagcacgtgattaattaagtattagcaaaaaaaaactttcaaaaatggatcaatatgattttttaagtaactttcgtatagaaactttttgcaaaaaacgcaccgtttagtagattgaaaagcgtgcacgcggaacacgagggagagaggttgggaacacagagtaaagaagtgcgttttttgcaaaaactttctatacaaaagttgctttaaaaatcaaattaatccattttaaaaaaattttctgctaatacttaattaatcacgcgctaatggaccgctccgtttcctgtgtggaggagatggttcccaactcgaaggagcgaacagagggttgggaaccactcccctttgcacgcaaaacggagtgatggattaacgcatgattaattaagtattagctataaaaaacttgaaaaatggattaatatgatttttgaaagcaacttttctatagaaacttttttccaaaaacacgcgccgtttagtagtttgaaaagcgtgcgcgcgaaaaacgagggtgatgcgttgggacataggggaaagaactaagacagggggtgtttagataattagatctaagggtgtaaagttttggcgtgtcacatcgggtattatacagggtgtcgcatggggtgtttgggcactaataaaaactaattacaaaatccgccagtaaaccgcgagacgaatttattaagcctaattaatccgtcattatcaaatgtttactgtagcaccacattgttaaatcatggagaaattaggcttaaaagattcgtctcacaaatttatcgcaatatgtgcaattagttatctttttagcctatatttaatacttcatgcagatatttaaatgttcgagttcgacttgacagggtgtaaaattttggggtgggatctaaacagggccttagttttatgccagtaaaatttgtaacaaaaaattcacacatttgaaatgatcccttcaatacttccctcatcacttacaattttaataatttttttaaagttatgctgaatacctaaaatagatattattgtatattggcttacaaatttatatctaaaggaaaaaatgtagcaagtgaagaaattcaaccacctttttcagtcctttgtcagttcaaaattaccttcagaacccaaccaggacgtacctatgtatttgactccaacctgtctgataactaaaaaaaaaatgtcctagactccatgatgtaaaatttgctaggttaaattagaccagattttattttaagaattgcatgtaacattttctttttttaaattattcttaccttaatttttcctatctaatatttaatctgcattaattttgcttgtaaaattttcttgatggctaacattagttttttgttcttttgcctgtcattctcctcttacatgcagcgcaggacttgcccgtccagtagggcacccaagacccagcacgcgcgcccaacgtcattcgtccggtcgtcgcacgtcctttgcagccgctaattttcctccctcctattgggctgtgacatatatatatatctaaaagtctattttacctccctcttcttgggctgtggtatataaatagctaaaataagtctatttaaggtccctattctttggacaattacatttatatgtctattttagtccctatactttatgtgccgggcctagcctgccggcccatcgtgccgggccggccggtcgggccagcgtgccggtggggaggcccagacacggcccggcagtcgggccatgccgtgccgtgcttgggccgggccaaaaagccgtgccatgggccgggccttcgggcctcgggccttatggccatctataattgagagcgattttttttttctgtggaaatctaccaatccagaagcttatccacaaatcatcaatttaacatgcatcatatatggttcggcaccattcagattcgccagtggaaactgattctatgtacgcctactaacttcaaaatcttcttattttcataggcaacctgtccagctgttttcgataacagaggtacatggcgatgtggttatgtttgtagctttcttgggagttctgaacaaaccatttgtaacacattagcaggtgattacatggcttgttttcccacagaaattacagttttgttgttaaggggcaatacccgaattcttggaggatcattgtttccatttcatttcgttcaaaagaaatttgtttccatttcatcatctggtagactggtatgttcatagtgttagttagcatgaaaggttcggatcatgtgatcacgacctgacagcttgcatgcatgtagttgttgaggttagtttggattaggttagtctatccatgcggatcaggttagcctttcctccacatgcgataacagatgtttgttagagtttgttttctgttttctgttactgcatgcagtcgtttcatcaatctcggcttcggttgttctcagctgcgccgaactctgtatcgccacgatgggggctgttcccatcacatatatattaacacgaaggcgacgcaca

SEQ ID NO: 82967 - DNA, 6737 bp, Oryza sativa
gtatggggagagaggaaggggaagcagcacagagcactggagcagcaacatcagctctgcagttgctgtgtgtctctgagatagttgaacgagtgttggtcattcttcagagttcaggctagcgtgcaagatggaggtagatgtgtgtcgttaatggcttacggcatttgaactacgatgtattaaatactgtttcaattggaaggaatcgctctgcctccacgcgtgctcgtccgtcgacaatcggttcgccgccacgcacaatgtattccgaagaagcgctgctgctctagcagaacgtactacgagatccagaactaataccaactaaacaacccgtccgagattaactccgggtgcaaataaatctcaaattcaaattactaaacagccctttctatatttttcacaaataccaaacttacctttctatatactgcaagtatatacttacagtagaatgtaccgtaaaagttctctaaatataagtccacaaagttttagatctgataacatcccacaatctattcgacatatatctatcactgtacatcataaatatggccaaagttttgagagagaaatggaaaatttgaagagaaaaatagacatagaaaatttacggactttgatgttttttggacgatacaatgacaatatggctatatttttcaaaaatatattcaaaaaaaacaaaatgccttcgtgttctatttatgtttgtaaactctatcaaatctttccctttcaacttttcaaaactgattcaccttcgatacctaaagcttgaagtacctcataacttagaaatgtctttgccagccacaatatgtagattttatcacatgaagtttttggacctaggccatggtaattatattttgcctgacgacattaatcgtctagccaatttacattatttccttgccaaaaaagaactttgttccaatattcgtgggattggaaagatgaagtatttacggaggctgcaagaattccatgttaagaaagagcgcactgggtttgaacttagagaattggggtatttgaaagagcttggaggagcactacaaataaataatcttgaaaatatagcaacaacggaagaagcaaatggtgctgaattgatgttgaaaaggaatctaaagacactagaactagtttggggtgcagagcagcagaatagtggatctgagattattgaaggtcttcagccaccttctaatcttagagcatttggaataagaaatcatggtggttccactggtcctagttggttatgtgatgatatttgtgtgaaaggattgagatctctccatctagagggcatctcttggggcactcttccacctttcgggcaattcatatatctagaggaacttactttgatcaatattgctggcattcgtcagttcggaccagattttggtggtgttacacagaggagtttcttacacctgaagaaagttagatttgttgccatgccagaacttgtggagtgggttgggggagctcattgccatttgttttcaaagcttgcaagcattgagtgtgaagagtgtcccaatctctctatgctactaccaccatcctctgagcgctgtatctctcatgcacaagatataaatatcacttgttttcccaacctatgttctcttaatatccgaaattgccccaagttatcactgccccccatgcctcatacttccactctaacgcatattattgtggaaggagattatcaagaagtgttgcatttggaagaaaagatactgagtgtaaatggttatggtggtagtttggccttccataacctacagaaagtagaaaacatgaaaattgaaaagatgtcacacatttcatggaccgatctccagaagctgaactccctatcaagccttaccatcataggatgcaaaagcttgttgtgcagtgaagtagacgaaggtgttatcttccattcagttgagcagctcaatctctataagtgtcatcttgccggaatatccttggcaaagctattaaactgtttcccagctcttacaaagttcgagttgaacaggtccggtgaagctcaagaggttgaggaagcagaactgcgtttcccgtcccccagactgttgcgctatgtcaagatctttggctacgagaacctggttctacctatggaggttggagggagtttccaggatttctcctcactccaagaactcgaattttggcgttgcggcaagattttcgcttcgtggttcatggtagaggcaggaactcatcacactagcaagcccttcctggctccccttaaggaactcactatttacagcgagtcaagcgtgcagtcgatggctgtgctctcaagcctcacatctctcactcgtctgcgactagtagactgtgataacttaacagtggttgggttcgatcctgtcatgacaggcagcctcagtgaattggtgatttataataagccagatatagacgataataatcatcgctgctccgtagcagcacatttgttcgcagcggtgtcaacgacgaaggcaatacctgttggttcattccaacagcttaagaagcttgaggtggacagcatctcagcggtgtttgttgcccccatttgcagcctcctcgcttccaccctctacaggttgaggttcacttatgatttgtggatgaaaaatttcacaaaagagcaggagcaggcacttcagctcctcacctccctccgaaatctagaattctatgagtgccaccgtctgcagtcccttcccgaagggttgcatctcctttcttctatctgcacattaggcatcgtcggatgtcctgaaatcagatcgttgcccgaggagggcatcccagcttcactgaaaaaactactagcaatgcgttgcagcgtcgacctgaaggatcaactcaagagattagaagaatcaaaccaagatttacaagtattctacatctgatcacccaaggtaagacgtgatgtcccaactcctttgttttttactctttcatctgcagttgttcatatttaaactcttttttacctgttcgttgttactgttgatcatctagcgagccaccactactctcttttgaacaatgaagtgcagatacacattctaaagtcatttgaacaatgataaaaaatcaaatccgatgggaaaaaacaagaaattgctagaacatgttggacaatcgccatcttttcttactgtgcgcaacaagcctaaccttggcattatggaaactttgcagtaactttgcagtaattagatcgtggatgttctgtacgttgctttattgggagtgatgaccaaaccatttgccacacatagcttgtttttttcaagagaattacagttttgattaaggagcaacacccaaatgattgtggagctaacctcgtttgtctctatttcatcatatgttatgttacagttttgattaagcagtattagatttagatgagagcaactgtaattgtttatggttctggtaacacagtttcatggtcattagtaggagaattctttgaccttattaacttgttccctttcagcaaagcattgtggaatggtgttttttttagcctattcagaaccagttttttacataatggaagctttattaatctcagtaaatttcatcaagtgatacaattattctgagagcacattcggcttctgcaccaaagagtacacacagccaacaagaaagaaacaaaagataaactcatcatccaaaatagcagaaacaaaaagaactttaggagcccgctaaccgtagcctagaacgtcacccatgtgctggggtagaaaactactatatggccactaactctaattgttgacaaaccgcaatgatagtaccctgcaaattgaccttctgaaggatagcctatgagcggagccaatgtgtaatcaaaaagataacctgcaaaggagaagatatgttttttcctttcaaaaaccacattatttctgaaaagccaaatagaccaaatagtggtagttgcacctaataagaccaaagatctcaaattgcgtgattgtcttcttatccaatgcccaaacatatgagttgtactattagataaaactaatattcgaagcaaactgaattaaagaccaaaccgcgcgggcaaaataacaatcaaagaacaaatgattaatagtttcatctttgtggcagaaagaactagacttgtttcctctccaattccttttaatcagattatcttttgttaagattactccatggcgtaagttgtcacgcccgaaaattcactagtaatttccgaacttatttgtgcataaaatcctcgtccaggaatcagccgaggtacacaaactaacaatttaatatacagattcatcaaaatatctaaaacgataaatacttactaaagaggcacttagtcctcaccatgaagaaaactgcagcggaaaaaaaaaaatctagcgaagctccggctccactcccacaggcagctcaactggggtataagccaaacgtcttctccttctggatcctttttcttcaactgaggttgattgattattgcaaggtgagcatatgacatactcagcaagccacacagcaaatatgcaagtgcgcaaagataccaaaggttggcataatataggctcatttgcaaaagcagcatttagcaaaacatttaagagaagtaaaacagtggagtaattaatcagaaattttaatcaacactgaacaacacgcccatgctgctcaggcctaaccattctgaaacaaccatacccggctgtacagatctaatctccaatccaggagctaagcaaattattaccagatataacatccataattattgtgagaagtgtgggactaatcacgaaaaacattgctcaacccgcccataaccgtgggcacggctattcgaatagttttactctggccagaggtgtaccactgtacccacaagacacagccccacatcatgtcaccatgtgcctcagtaccaccacggtacctcggaaaggggctgtgacattaccccttgcataacacaatccaccgcagtgcaccattcctggatcataatcacccccttataaataaggcatggactccccagcgacccccgtgggcttatctccgccacttctcagtctggtgccccgcaatgaaccatgctatacgaaaggtaaagccgttgcccacgctggcttgtggttggcacgattaatgtttcacaatagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaataatgagtcataagttatcccaatagtgtgctaatgtttctaagcatggctaagcaatcatatctaatatctagctgaaccaatatataaagctcaacttgtcaagttataataatccaaggtatcaaggaataaagtaatcaatgcaaacaggccataacaaaggaataggttcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaacacttccggcgcactcacgaaccttcgcaacgacggaaacgacaagctaacacgcaaaacgaagaaaaagactaataaaaaccaaataaacagtacatataaagtaaacaaacatgtagatcataattttagatgaattatgagacttgaacggcctcattctgacttcataagaatttattatgaattttacaagattaaatctaattaaagcccatttaaaaagaattaaataaatttaattctatttatggacaattttaatatgtagatctttattttatataatttttgcaacttgaaccacattaaactgagttcaaatgaattagttatgaatttttaaagattaaatcggattaaaacacttatatggattttaattgaattatgacgcaataatgaattatttttgaaaaggaaaaggaggattattgcgtcagcagctagggtttcgcggtggaccgggtgcacggcaacggttcatgggaacgaacggccgagatcaaccctatccaaaacggacggccgagatcgatcggtccacgaccggctcacggcggacggtcccgatgacgtcagcgacaacgtcagcgatgacgtcagcaccggcggcgactcgggcggctcgggcgcgtatgctcgccggcgaacggcggctctacggcacaaacggagggcaccaagacgtagatcacggcgcggcgaactcaccgatgaccaaaacgtcggcggaagaccaacggacggcggcggcgtcgaggaaaaggtggcggagaagatcgggtcgacggcggcgacggtgctccgacggtcttcggcggcggtgaagcggtggacgaggacggcgacgcgacggcgaccacgatggcgatcttcccgagcgacggcgacgtctggaacggcggcggcgcacggctggagcgacggcggcgacggcggcgctagggcacacggagctagggcgctacggacgacgagaggcaaaggcgagggtggcggcgggtagaggagacaccggggatcctta

SEQ ID NO: 82968 - DNA, 7024 bp, Oryza sativa
tgtatcgtacaatctcatacatacggacagtagcagctagcgtttgtatgttataaacatgtggaagttattatttttttaataatagatctaatctaatggtgtaaaataacgggtccacaaatttaagtgaaaatcaacggtaagattagatagtgccatgcggcgacttaggaatatttgtaggagtgccacgtggcggctttagagcgtttgtaggaagtttaatggacttttagtatataatagataatagatagatagaagatagatagatagaagatagatagatacaccatccattgaatacatagtgtctacatatagtgtctatatgacatgacaagtatggaaactaatagtttattggttggggatggcctaattagtcgcttgactgcacgctcgcccgaggcagcggggcccaccagcgcgtctgcatcgccatccactcggcccgcgtccgccggtatcaccaccagcgcgttcgctccgcttgtgttccccgttgttgccgtcacgctcatctgccgtcgtcgcgctccaccgggccgccgcctcatcgaccatggccagcgtctccgtcgccctcatctgccgtcgtcgcgctccaccgggccgccacctcgtgcaccatggccggcgtctccatcgccctcgtctaccgttgtcgccaccctcgtccgccatggccgtcgtctccatcgcctctgctcgccttggcagtggcccttgcccaccgcgaccgcctcggctgcggacctcgtccacggcggcggtggccgtcgccgttgtggttctcgtccagcccggccgcctgaataagcaacccggtgcttcaattggtggccggggggccggccgtgttcttatcttaacgggttgccgtggtcaccggtgtcaatcttgtcattttggcccacatccacggcgccgggccgctgtcctggtcttcgtccatcccgctgtcctcgcccacatccgttgcgccgcgcaatcttcgtcttcatccatcttgtcgtcctcacacacacccgtcctaccaccatcgtccgcctttgcagcggccgccatccccgtccaccacagtcgtcgtctcctagtacaccagcgccagacgtgcacgcgggccggaccggatgaacccggcggccatgatgtactgatgttcgtccttggacttgagcacgtgaaggataaaacattcccacgcatctcctcctccggcaagaaagagagtagagggatggtgggcctataaaaacaaaaagaatatttgtgttacagtaagtatatgatatatctattgtatcacttagctataatgctttctccagggattcagctcatctgacttcacccctcatgacggcggagagcagtcgaggtcatccaactgtccacgttcgattgaaccgtccgcccagaaatacaggtcagccgcgtcgtgagtctgggccaaggctggcccaacaagcctcgtcccagcgccatcgctcctatcttttttaccgcgaacaaacgcgttttggcggtcgcgctcgcctttttggcgccaaacgaggccatggccccaggcgatcatctgacaacatgctgggacagcgaaccacggattcaaccattgatcaagcacaggtgaagttctggcctcttctcttccttttttttagcaaattatttgattgtcttccacctcctccattagactgttggaattcatcaaagaagcctccagcaaaatctacatatttgagatggaagaaaacaggtctgtaagctatggttgttacttttttcaccatgatcgggtagattttacttgttcgatgaccaccaaatcattttttttgttcctgtagagtgggtgtgctacctagtttgttacctgaagttggcatggaattcaatactgttgatgaggcttggatgttttgggttagctatggtggtcagaaaggtttcgaggttagagaaaggtactcaaacaaaaggaaatcagatggaaaggttgggtcatgcatatatgtttgtgcattttggaaaaaaaaaaccgttggttctcttgaacaagccatatgcccagaattggaacataatttcattgcagtgataagttacaaatggccatttcatcattctgttggacaagtcattctcattgcaaacaatttatagagtttttctgctttctatacaaattacagaacacatgcaaccccatttttcagaacaagtggtctgcttctgctgcccgtgtaaagaacaatctatcattcttataactgaacattcagtatcttcagaatgccattcggtttggtcagacaagcaacaaagcaacactcctagacgcagcatcaaggagctgaagaggaggccgctgtgttcctccactcgctcactgctgagagatggcgatgaggagttcctcctctccctgcctgccgaggcccgacgcaggtaattcagatcaacgagcagctcaggcaccacagcttcggtcttcctctgatcggcgaaatggagccacgcggcgcgcgcactcccctcctccattcgccgcgcgctgcctgtcgcggcgcatggcctgctcgagctccgcgcgcgcacatcgagctcgtggcaccgatgcgccgtggccgtgaccgggcgctgcatcttgcgcgccttccggtccccatcttctcagccgagtaccgcagcctgacggcgagagcgagggcggtgaggaggacgagcacgacggtgagagcgagggcggcgaggaggacaagaatgacggcgatggcggtggccagacgaggagtacgagcacggctgggggacgaggcttgttgggccggccttggcccagactcacgatgcggctgacctgtatttgatgcgcttcctgggcagacggttcgatcgaacatggacagctggatgacctctactgctctttgccatcgtgagggttgaagtcagataagctgaatccaactccagatgatgtgcccatctattgcagccgatagttggctatgttattgacctcattctaagctcgtaaaatctaaacggagaggcctctccatttagcgctatcgtgcgacgcgcgtggcagccgtggtgacgtggcgtccatcacggcgcgcgccgcgcgtcccgaccggccgaccgagcgagctcacgcgtcgccttttccgaccgaacgagcgaagggtactgttcaaattttttgggtggcgctcgacgagagagagagagagagaggcggagagtgagagaggcggaggtggcgtgaatctctggcgaaatccgtggcggaggcggcgtgaatctccgacgaaatccgtggcggaggcggcgtgaatctccggcgaaatctgtggcggaggcggcgtgaatctccggcgaaatccgtggcgaaggggggggtgcggggagttgctgttgtttcctcccatcgcgccggcgtcggcagagtcggcggagccgacggtttcctctcatcgcgccggcagttgcggtgggaagcgtaggctgcggcggaggtagttttctctcctccaaatccggcggccatttttttcggtaagttgtggcggtttcattgcggtttttttgagccaaagaggtggagtgatggggctgtttttccctgcgttttttgtgccggggaggtggagaggtttgggcagtttttcactgcgcaaattgcttctcaaacctcccggtttgttctcccctattccctcatttcccctctctctctccctcattcatcaggtgctagttcatcctctcggcgagcgcaaggttgcggtggaattcgccccctcaagcgtcggcttgtggatctcgggttccatttgaaggtatttaaatttctctctctctggcttatgttgatttttccggttgcaagttgattactagtgattactatcatccaaaatgaatttctaaaattattactaacattattagttgcaagttgattattagttgatcgatggttagttgcaagttgattactaacatccaaaatgaatttccaaaattattactaacattgttagttgcaagttgattattagttgatcgatggttagttgcaagttgattactaacatccaaaatgaatttccaaaatgattactaacattgttagttgcaagttgattattagttgatcgatggttagttgcaagttgattactaacatccaaaatgtatttccaggaatgggaaaaagaaaaaccattgtacagaaaggcatgttaggcaaaccagagccaagtgaaaaaacaagggggggttcgcaacgtgctaagaaaagaagtattggagatgatcatgcagatgacatagaggaacctcctccaaaaaggagcagatcaaaggtattaagcatccacctttttttatgcattttttgccctcaagcagtgtttcgctttttccaatgcactatattttcttatgatgcattaagttacttctcactgtgaattaagttacttctcactatgcattaagttacttattttaaaattcctatgagatttccaacaccagtactcatggctatgtaactagggaatgcaaattcaagtttatttttggaagtaacttgcatgtttctaggaagtaactttttgagttttataacgagtaactttctgttcaaattgctctgagaggcaactagatggaatgtatcatgctgtgtaactagggaatgtaaattcaagtttatctggaagtaagttgcatgttcctaggaagtaacttactgttttgttagaagtaacttcctgtcaaaattactttgagattttctgttaacaagtaagaagttacttctcgatgtgcctgaagttacttctctctttgcattaagttacttctctatgtgcattaagttacttctcaccgtgcctaaaatatttttgatgctgctgcttgagggcaagttattttctagaactaacttaatggcaagttacttcttggttcagttacccttttttcaactgttttatatatgttttttaaaaaataaacaaatgctgatgtttttttatttttctttttgttgttttatacatttgcagcaagaaagtagcagggcttcacctatgaaacttataaagttgtatccccatatgagtggcgaacaaaagcgactaatagagggggctggcttccatggcctcgtagatctcaagtgctcgaagctcagacctgatttgtgcagctggttgatggagcatttcaatccagcaaccaatcagcttgtattccctggacgtggagccatagatgtgaacgaggagtcagtgaagtctgtacttggtatcccaatgggcgacaaggatgtctcatatgagatggaatctgaagctacagaatttgtgctgaatttgcttggaatcaatgatggtatctcaccatcactgacttctcttgggattcaattggagaagttgaagttagcagatgacaagtacctgcgcatgtggatcatctacgccatttcttctgttttagcaccaacgacggcaacaacagtcagcccaagatgctatccttctgttgttgatgctggaaatgtcaagaatcttaattggtgcaagtttatcatatctattttgcaaaaagctgctaaagctgggaagaataccaactcagcatgtctcctgtatatgatggtaaaacccccccaaaaaaaaaattttggggggttttttcaatgctcgcctttttttatttgatcactgtcccaatgtaacttttatgttttttagaagtaagttaagctgtccaggaagtaactaacatgttcctaggaagtaacttctttctgttaaattgttataaataattttctgtcaagtaaattctctctgtgcattaagttacttctcactgtgcattaagctacttcttattgtgcattaagccacttctcactgtgcattaagttacttcttcatatatgccctgccacatctttttttccaatttgtttttaaatttaaattacatctggaagttaacatattttgtaggttttaaatcaaacaagttatgtactttttttaattaatctaaatgctctaatttcttttgtagattctttatttggactcgctttcgtttaaaaatctcaatgttccagtggagggttatcgagctactgtttggacgaatgaaatgataaatcaagcaatattagctgacacatcagcagacggctcctttggagctttaccagtgagttttttttatagttggcatacttgcatcatttttagttttttgtttgttcgtaacttacggattttataattgaaaatatagcttaggagcagttttcagcatgaagggaccaatttgtttgggaacaatgtagatttttcaacccttcataaattcaaatgtgcccaatactatgcagcagcaggtttatattttttccccacttctctgtttaactttttgtacccttggtaaatgtaacatcaacaaactgcaaaagtaactttgtgaaatctgcatatgtaacttctctgttttttctttttatacaggaaaaggacagaattgtgatcgctgtgcaaaatttgtgtgaagggttttcaggtttggtcacgaaatttgtgagacagatttccggccttgattttgtggatcctaggggtagccaaccaaggaaaatgcgaatgaaccggaagaaacttgcacaatggacaaaaagagttcagcaagatgaagatctaggtttggttttttcactatgtttctattaattattgtacagaataattaatttagccatgctctaccactctgcacaatttgaatctcattagtatcattgttctaccacactgttttttttacaatgatttcaactgaatttttagtttttttacatttgtccaaacaacttcctacaatacactaagttactttttgttcttttttggtagatgtaacttcaagtgatgatgaagattttgttgctgat

SEQ ID NO: 82969 - DNA, 4589 bp, Oryza sativa
ggaaagagaccgatccgattcgaactcgaatcaaacacattccaaaccgatttagccgatgtttccaaaggggaaaaggtggaggagatcccggagatcgtttcccctcaatcaatttcaccagaaacggaaaggaacggccggatttggaaggagacggcggcgcttgcgctagggtttcgggcggcggcggcggcgcgaggaggaagacaggcctgacagacgggccccacctgtcagcggctgagagagaagagtggcggctcggcggactgggccggactgggccgaggagggagagagatagagagagggagggttttgggccggctttcggcccaaagccaaaaaaaaaaaacctttttcaatttaaattattcatgaaatgcaattccatttattaaaaacacttccttagctcaaataaatcccagaaaaatctaggaattatagaattaagcaaagtatttaacaaaattttatctagcccaattttatattgagatttaacaaattaaaattagatcttctcttttaggcttttaaaatcatttctaataattccttttaaacaacaatttataatttaaggattttaaacaagaaaagcacttaacaattataattagatcattattgtcacgaccggaaataacccaacgggcgttccttacgtgcgtgtattattccttgtcctaggaggcaaggtacaccaaaagttgatacaattcagagtttaacaagcgaaagcgtaaatagttatttattacatgggcagcgacggcccagcacactcaaagacaacgaaaaacagcggaagactaaggcgacgaccacaggcgcttgacggcaggcacgagctagacaccaaagccttcatcctccaggggctcctcttctgggtttgggaaaaattgagcaagactgagtacaaccaccgtactcaacaagacacacccacaagtgcagcataattgcaaaggagtacaatggagttataatataggggttaggttttgcaataaacagcatttaaaagactcttagttgctcaaagctaaatttaaaacacgatcctagaactatttaatattattaaacaaggccgtgaacccacacgaacctgccttaacccaaggcctacgatgattcagaccgaactggcaacccgaccctgggtcccagctcgtcccaggccaacccaggccaaccattccacattttagttgttaagcaggttttaagaattaaaacactaacttgggtacattgctcggcttgcccataaccgagggcgcggctattcgaatagattatactctgatcagaggtgtacatctttacccataagacacatcttcctcacgtgtaatcacgtgccacataccaccacggtatacaggcggaagacgtgacatagttcccaacccatcctagccatagacaagagtaccgacccaatcccacctacggccggaacccccgggacaggcaggcaggactgagccccctagcagcaggacaccggccctgtgtcatgacatctcgactaccgggccgcagctcgtgtagccttcatttgccctggagatgtccatcgaacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggcggtatgaatccaattccacaacaatccaacaaatccaatgtgtccaagtgatatgaatattaccacaatctagagttttaaaaccacctaatgttacctaattaatcagcgaagcatctacctaaaatcatactagtgataccacgagtagagtgtccactagttgggggttttgtttatcctagggtgaacaaggtaataataacaataacaataataataaggtcataacaaaggtaaataggcatggctaaataaaacagtgataacgcgggaatttaaataaagcgatgatgcaataatttaaatcaaaataatttcataaattgggattcaatatgttcaaggatgatgtgtcttgccttgctcgctttcccaaatgccggcttcaacttccacgaagagcggatcctccgaagctgcagcgtctacacgaccaacggaaaagaaaaggcttttactctaacaaactccatataaaaagcattaacaaagcacaaaaatgggttcttgacttcttaaggaaaaattagagacttgaacggtccaattccgagttcaaatggccaagttatagccatttgaagtttatatgctctttaaatgaatatttgcgaatttcttcatttaaattttaatttaaaattggatttattgcgtcagccgaggggaggggcacgcggaccgggtccacgggagtggggcccacgcggcagcctcacggtccacggtggaccgggtgcacgcggcttactccgaccggcgccgcgggccccacgcgtcagccgcacccgagggcgcgggcggctgacggccgggccccacgcggcagccgctcggtgcgcccgaaggcagccacggcggcgcggccggcgggaggcagcgccctcgccccgatggtcgccgccggcgaccaccggcacggcggagcagcggccgagagaggggagggaaagggggaaacgaaacggcggtccacggctcaccccgagtcgacggcgacgacgaaaacggcggccggagcggaggaaggcggcggcgcggctcgggtcgacggggtcgacggcgttccggcggtcggcgagcgaagcggaggggtggacgaggtcggcgaggatgcggcgaagccgaaggaggcggcgccggggcgggagatggtccggggcgacgacggcggcggaccggagctcggcggcgacggcggagagagagtgcgacggcgcgggctcgattctgacggggaggaagggcggtgtcgcgaccgggaaaattgccttttcccgaacgctagtgtattaatccccgtcccaggaaaagccggggtacaccacacaaacatgatataagagacacttctttattatatcgataatatttacattattacaaaggcacttaaggcctgacaatcaaaaataaacagcagcggactagcgggcctacggctccatcttcacaggcgctcaactggggtataagccaggactccacctaagacatcttctccaaagcttctcttactgaaggggggagaaagatagagcaagaatgagtacaaccacagtactcagcaagccacaccggagatgcataattaatgcaagggagtacaaggggataataagataggggttaagttttgcagtaaacagcatttaaaagtcacttagttgcccaaagccattttataaagacgatcctagagctacacagttttattaatcaaggccgtgaacccacacgaacctgccttaacccaaggcctacgatgattcagaccgaactggcaacccgaccctgggtcccagctcgtcccaagccaacccaggccaaccattccacattttagttgttgagcaaattttaagaattagaacactgacttgggtacattgctcggcttgcccataaccgagggcgcggctattcgaatagattatactctgatcagaggtgttcctcacgtgtaaccacgtgccacataccaccacggtatacggacggaagacgtgacatagtttccaacccatcctagccatagacaagagtaccgacccaatcctgcctacggccggaacccccgggacaggcaggcaggactgagccccaagcagcagcgcaccaaccctctgccacgacatctcgactaccgggccgcagctcgtgtagccttcatttgccctggagaatgtccatcgacccccgacttcatccatctccaatccgtgtacttttgtttaaaaccagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaaggggaagagaggtgtatgtccaattccaccataaaccaacaattccatagtgtccaaatgatatgagaattcccaaagtctaaagttataaaatcacctaatgttgcctaattaaccagcgaagcatctacctaagttcatactagtggaaccataaatagagtacccactagttggggttttattttcctagggtgaacaaggtaataataacaaatagcaaattaattaatggttctttaaaaaccaaaaaaccgggaaatttaaaaaaaattaaagggggccaattgggcgcttaaaaatttaaaaaaaaaaaacccaaggtgataacgcgggaatttaaataaagcggtaatgcaataatttaaat

SEQ ID NO: 82970 - DNA, 656 bp, Oryza sativa
gattaagcaatctagtaccaaactttgtttgacatgtgtggatattatgggtaccccatacccatacggcatggttatccgactagtcataggggataacttatatctatgtaatatgtaacagatcatgacttgggtgttacgtttccttgtatattacggaacggcctaaagtcctgatttaggaaaccgataccgtattggttaaggtttctatcttgtaatcctgccccccatcctatataaggtgggcaggaggccctctagggggcagagatatatgatgagacaacctgatcgtcagatcaatacacactcggcggattcaaatccccaaacaggagtagggtattacctctcattgagagggcctgaacctgtctaaatcctttgtctccacatccatccacttttaggtctcgtgcgctaccccgttttattattgccgaaatcatgtttcgacaacatgtgttgctaatgagatgaaactaaaatatgctttgggtcgtgttaagcacatggaggaaattgttaacaagatgaagtgatgtcttgctcaacgtgtagaaaataaaagagtgttttggatgcttgcaaaaattgtgctactctttctcaagaggttttttacttaaaaaagttctttgcaaagattt

SEQ ID NO: 82971 - DNA, 2299 bp, Oryza sativa
ctctagaggatcccctgcttttatcttcacaactgcgcgtcttcaccaccggtttgcttctgttaccgccgacttgtgttcacttcattacagcaatacaactttgtcatcatggtggagcgacttcatctttattatcttcggcaccggcaaactctattgttgctacttcgcaagttttactacttcaccaaccacgacgtctttgtgaacctcgacatctcggcatgcgatgccatgttattttactacaacaagaggctctccaacattcatgatttctacttggacatcttcaacacatatcttcaatcaagcaataactattcgacgacaagaggctacagttctcgactctatgttcagttgtttcccaactaatcaaagagtcgggggctacacaaatacaaggctcaaaatttgacaaattttatgtcaagctgaagaaatcaattaatcagccaacgagtcaactccaggagtcattatcttcatctttgcttcggagcagacattctacttcaacaacttcaaatatttcggtttagacgagttgggcaacaacatcaactctcctccaattgacctactatgcaaatgctgatgagcgtctttgtcattatcattggttgctacactgctattggctggatcaccgacatcgtcatcttcatcatgtcggttgcgtttgtcgtcgtcaactattttcttcatcttcatgattggtggatttcgccatcactgttgatgcgcgtctacatcttcatcgtcggtttgcttttgtcatcaccgactgtttcttcgcctccatggttatgcaacttcattacctttgattggtgtcactgttttttactaccactgacatcttccgttacttctgatgagcaatttcgtcttcatgttagtcatttcatctccatgccgactgcgtcagctattgccaatagacaattttgactatgacagaaggacaagctatatgctcaggggctcatcaactcaagcgtgaggattatatctccaattcggacttgttccggatacattccacatggattcatagtcatgagtctattttctatgctcaaagactggaccaattattattccccgtaaaggctatcaaccgaatacttgcgccagtcgggattcaattattatatttattttggagtatcccataagggataatcattcagatcagaagctattcatatgagctacacttggtctatattacccagaagatttgttactcgggagcatgtcacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaatacccttaaaatccttttataccgcagttacttaacttttttaggagtggaacaatgcatcttaaaaggtgtcaaacagtaaagctttatatagctgccccgctgacttttttatatataagtcaagagctgttttgggtttttaagcaattgatttgatacaatatcattgcttttcgccacgtaagtgtgcatttttattgaccaatattatggcttaggctgattatatattgtggtcattttctaggcggttggtaaatcctttatgagtttatttactcggattttacaccacatatgccatatatttccaggtgtggtgaaaccatgtgtcttctagggacttaagcacatctgttaaagcagtgtgcgcatggcgtatgcccaatactttggaaatttctttattcacaatatacaagcttctttatagctattttgctatatcactcatcatattttacaaagtagttggtatatcacttggatcatattattcagggattcacacatcatatgctattatcgaaaccactcggttggttagattatttattccttgactatatgtttggtttgttcaattaaccacatagtcgggggctacacctattaggtgcatctagtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggatattatgggtaccccatacccatacggcatggttatccgactagtcataggggataacttatatctatgtaatatgtaacaga

SEQ ID NO: 82972 - DNA, 2622 bp, Oryza sativa
ctatggaagacaacaagagtatgcttatgatgatatgatgttaattatgatgaacttacaaatttgttttgttaattgaatcattaactcctttgcaaaagatttgtgaaccaagtcggtgtgcttgtggttgggtagtcaagcttctgctgttctctgttatctatctatatttggccggtcggcatatgtaactataaagtagttgtaaatttgaatcgctttcatcttatttgtatttgctatgcataacaatgcttaagatgaaaatgtgaatctagtgcacatcttgggaactagattcacatgaatatgagttaaggatatttgatatatcatagatctttagccattttgtcaagtcacctgaatatgtaacacatctggtcgctgccttcgtgtggtttgacgggcacatctcaggctgaagttgactggcaggctaaaggcccggcaatgtctctagtatccttctctcgaggcgtcggatgtttcattatgtttgtttgatgacttgaattattcacttcatacctcaaatataatgagaggggtcctctagagtcgacctgcaggcatgcctatcgtcatcatcatcatcctcatcagcatcggtttcggccgcgtcctacgcagcacgacgagttcgcacctggccgctcttcgcgacggctcgcttgtgcttcctcgacatcccaacgtcgtcgtcgccagccttggaagggatcgatcggttggccaattcgccgccatgaacccggttcacctgaccgtcagcctggcgctgaagcaggcgggcgaattctgcagtagtacgaactaaaaaaaacaacgaattaggccgaagcgcatctccgtaaaggaaatagatgtcaaaaagcgaaagcaaaactcacgttcggtcccggcggggagaacaaggcgaggaagcccaagcaccacctcgcccttgttgatggaaaccccccagtcgcaagcaaggggggaaatccgaagaaggcaaaactcctcgcaaaggttgtgggtacttaatcgccgcagaaccttgcgaaggaggatgagccgggactcgagggtgccatcgatctccactttcggcttcacgacaatggagaccgcaagacgccaaaaacggagccagttcgccttgtcatcctcggcggggtaaggattgttgatgtaaaaccacttctgcatccagttccactcccacttcaccatagacgcaggcaccggccaggcgtccgaacgctccggccgaagcatgaagttgacgcagccgaaaactgtcttcctcggcccggctggcatgttcacgtctttggttgtggcgcacgccgtaaacaagatggcgaacaattcggtggtaggatcgaaaccacacgttcggcacatccatgcgaagacggccaacttcgggaatgctgacgggctaagctcaggaagcctgacctcatatatcgccagcacagacatctagaaattgtcgcatgggaggcgaagtccagcaacaaggaaggcagcaaaaatgactgttcgcctgtcgcctggcgaagggacggtggcttcgcccgcacagttcacttggccctctgcaagagcaccggagaggacgaactcagccaagtcaggctccttgacaagggacttgccaaggtagcacgaccacccttcgccagggttttcgccggttgacccggctgtcacgccatgataaattcatcccgaaataaaaatcattctctaaaaggaataatagaattaattaaaattcgaaaagaaattggcaaaccttaaaatgcgtacaagaaaaattcgaatgtggcctagagaatttttgttaaattccccttgctctaaaaggagccctcaaattttactataaattttagaacaccagaaataattattaagcaacaacaacctttagcaaagtttattaaaaaaaaacttaaaaataatcctccttcttcctttgggccaagtcttgcccaaagcctccctctctctccctcggcccgcggccgaagtccttctatgctccctctctttttccttccctctctccctcgggccgcccctcctatccctccttccctctcggcccagccgctcggcccaagccgagctgcagccctcccacgcgctcacatgtgctgactgcgccagaccacgtgggtcccaccctcggtcatcgtcctcctcccgcacggcctcctctctctctcccgtgaaccctagctcctttcctcccttaaatccatacgaatcaattcccttcatttcaaattgaggctttgttcgctagctgtgggaattaatccgggtaaagcctcccacgtggggtttgggttgtccccacaccccacacccaatccctacctggcttcctgcgaatcccccacctctcatccctctcacgttagactgttcggacagaggtgggattagaagggatcactaccattcactacactttaaaatcagaaaatgagtaaaacatgttggaaaattcggataaaataaaaaaaatgggagaaaggtcacgaacgtcaaaatattttagaaatgataaggaaaaaattgatctatgaaaacaaaacaaaaattaaacgtggaaaa

SEQ ID NO: 82973 - DNA, 2407 bp, Oryza sativa
ccttctccagtgaaatcttttgaggggaaataatcttctcgatctcctcttccttttctcttatagaaactccggtcaatttcctttggaaataggcggattcgagattgcttcggattcgttttcccccgatctttccttctcgtcgccggcagccgtgggccttcgccgccgcctccttgcccctttaaaaggatccccgagctctcctctacccgccgccaccctcgccttcgtctctagtcgtctgtagcgccctagcgccgtgccgcctcgcgccgccgtcgtcgccaccgctccagccgtgcgccgccgtcgctccagtcgtcgccgtcgttcgggaagaccgccgtcgtggtcgccaagtcgccgccgtcctcgtccgccccttcgccgccgccgaagaccgccggagctccgtcgccgccgccaacccgatctccgccgccgcttctttctcgccgccggcgccgtccgttgcccttccgccgttgttttggtcaccggtgagttcgctgcgtcgccctctacccgttggtgccctccgttcgcatcgtcgagccgtcgttcgccggcgagcatgcgcgcccgagccgccgagtcgccgccggtgctgacgtcatcgctgacgtcatcgggatcgtccgccgtgagccggtcgtggaccgtttgatctcggccgtccgttttggatagggttgatctcggccgttcgtttccgtgaaccgctgccgtgcacccggtccaccgcaaaccctagccgctgacgcaataatccttcttttccttttcaaaaataattcattattgcgtcataattcaattaaaatcaatataagtgttttaatccgatttaatctttaaaaattcataactaattcatttgaactcagtttaatgtggttcaagttgcaaaagttgtgtaaaataaagatctacatattaaaattgtccataaattgaattaaatttattgaattctttttaaatgggctttaaatagatttaatcttgtaaaattcataataaattcatttgaagtcagaatgaggccgttcaagtctcacaattcatctaaaattatgatctacatgtttgtttactttttatgtactgtttatttggtttttattagtctttttcttcgttttgcgtgttagcttgtcgtttccgtcgttgcgaaggttcgcgagtgcgccgtaagtattcaagaagattaattgaagaccgattattgcaaggcaagtcacacagatcctaaacacaatcctttgagcatgttgatcctatatttaaattctctatttatttcaactgtgcatttattttcaaatgtcactgggtggtgtgaacctattcctttgttatggcctgtttgcattgattactttattccttgataccttgggtgattataacttgactagttgagctatatatatattggttcagctagatattagatatgattgcttagccatgcttagaaacattagcacacaattgggataactaatgtttcactatcacttatggttatatttaatggtagctcacgatggtcaatcgtgattggttaattaattacttgccaactaaaacttgataatggtgggttgtgagcacatggttttgagagtcgtgctcatgacaattaaggaccggttcacgagctactattgtgaaacattaaccgtgccaaccacaagccagcgtgggcaacggctttaccttttgtatagcatgattcattgcggagcactagactgagaagtggcggagataagcccacgggggtcgctggggagtccatgccttgttttataagggggtgattatgatccaggaatggtgcactgtggtgagttgtgttatgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtcccacacctctcacaataattatggatgttataactggtaataatttgtttagctcctggtttggaatggtatattcctggtttggagattagatctgtacaaccgggtatggttgttcagaatggttgggcctgtgcagcatgggtgtgctgttcagtgttgattaaaatttctgattaattactccactattttacttctcttaaatgttttgctaaatgctgcttttgcaaatgagcctatattatgccatcctttggtatccttgtgcacttgcatatttgctgtgtggcttgctgagtatgtcatatgctcaccttgcaataatcaattaacctcagttgaagaaaaagg

SEQ ID NO: 82974 - DNA, 1471 bp, Oryza sativa
cttcagctttaatttttccaaccccacacgcctgtgcctagcctgaaatttaattcagcacaacagattatatttttgtcattcaatagccatttaaatagctttgtatgatatgacctctagtaaaatatctgaacacccagtttcctgaaactagttgtgaacatagtagcagttcagaatagataaatatgctaaattgattgctaagagtaaaataggtattcgaacaaaagatggacagctacatttctcaagttttaacaagggcattttgctaaacaaaaagccatggaaaaaaataccaaaactagaatgtatactacagtgtccacctgaccacctgatagcatgactttaaaattttttgcatcttcttgctcattcaattggcatatagtattggtcgttcaatctgaagctcaaatgaccttggccaaaagcaaagtgatgcattctagacagcaacaacagagtgcactagtttttatttttcaggtgtgctcccactgcatctacaataattcctggagaatcaacaaaccaggtttctccctcacaaaaaaagaaaagaaagaagagagcccatgttcagaaatataggatctgccaattgaaatatatatttccttgattacagagcaactgataggcaagatttgcacacacacatagagagatgtgcatggaattttctgtggtttcaggttctactactacaaaccacatcacccctccttctaagcagaacatgactgatacttcaatccatacagccactcaattcatcaactagcaacaaattcatccactagataagtcacaaaatcttttctgagtgggaaaagaggagatcaagaatcagacctgcttcttagtgtccgggctgttgccctcgacctcgccctctcccgcaactggtgaatcccaaccgaggaaggagagatggcgagcgccggcaactgggcgggatggagagcgggaaggagagcggcggcggctgaaacgggatggagaccgtcggcggctgaggacgggatggacaccggcggcggctgaagcgggatgaagaccagcggcaaccgacggcgggatggagagcggcggcggctggagatatgctgctctcggatctccaccctagagccgcctcttggacctcgcgccgcctccaaaccctagcgcagcgaggagtcgaggaggccgagcgctgcggctggcttggaaaagaaaaatcgtctccgaggcgatttttctctccccgtggaattggtgtggattgggtggagaattgctccgaccccagcccaggcgaacgcatacatgggccacggaagaaaattcgacccggccgggatggcacacggggattttggcccattccccccccccctcaaacccagccgaaaagaacaaggcctgaggggggaattaatcccctttccctcctctctctttcccccttaattct

SEQ ID NO: 82975 - DNA, 31715 bp, Oryza sativa
actaaagaagggcaaaaccgtcttttatcccgctagttaacatcgtcaagtgtaaaaactaacagaagtgctacatagggaagggaaattttagaagtgcctggatagggaactttttaagtttaggtgctatagagggaagagcaactttttttgatgctagatagggaattttctctaataaatttgagatgatggaacatatacaacacatcaaacttctgtagttttttatcaagttgattcaaacttctctacctaagtttattttagatgagctaagaatagtaatatgaaaaggaattgaactttgatatgtgtcgaggaaaaggaaaatctatgaattttgcctgtgatcttctgtgtagtactaagcggctgaagcataccataccagtctttcataatttaatattaatataaatatataatttaaaaagggagaatcaacatttagctattggcagtcaaaattatagaatcttgaaatttgtgaattgcattatacaaggtccatgcttcagagatggtactttgtaaaaagaatccttaaattatgaggcatagcctggtaacactttgaactgtgcactgcaacttccatctatgcaaacacacaaatcttaccgctgtattttttccaagctataaaataatattagcttgttcattaatttatagcaggtgcaggcagcttttaaggttagttatgttgatatataggtaactataaatcgagttatgttgttgtacatgatgaaatcccaaattctaaagagagtcgtatttgaagtttattgatgttagagccttaagagtcattttttattggaaacaatccagcaacttaaaatactacctccgactttttctcacatgtttgaccattcgtcttattcaaaaattttatacaaatgtatatgatataaatcacacttaaaatactatgaatgataaaacaactcataacaaaataaattataattacgtaaattttttaaacaagacgaatggtcaaacatgtgagaaaaagtcaacggcgtcatctattaaaaaacggagggagtatcctacatggcgcaaaagtacacaccttttatggattagtattacagattataacttatatacgtataggaaaattagcattacttgaaacatataatttacatatacttttaatctttattgtcttagaggcatatgcccaggtggcaacaacagcagagggcaataatagaatatgcaattcctatgacatgtagcatataatgcagaaaacatttttgaagataaaatcatacgatggcacgtgaggaggaggcaacagcagcatatatagggaaatgacaggaagtgcaattcatatgacatgtagcatataatgcagaatttatttttttagataaaatcataggatggcacgtgaggaggctagactcctcctcctcatcgtcgctgcggccgctagcgaagaccaacgcacagcaataagcttcttcaggccatgaccggtcggcgtctggccgtcggcggcggcgccagacatggcatgcatgcgtgcaagttagggactacatgaaatcgatttgcaggctctattcatatgtaacatctgcatgaaacccaactgaaattaaactaccaaacattttatcattagacgcaaacggaattgatcgccctatcgcataaatccgatcaacccaattccagggcatccacccaaactgctgattaatctaccgactgatatgagatcatacaaatcaaaagaaatcaggagattgccaagtactcctatttagcttacctcgaaattgatgtcgtggaggtggggatggaagtggatgcggatggtggatcgacttgatcagcgacggcagtggatgcatggggatggcggcgtcgatgggagtggaggtagtgacggcgatggacggtgatggcggcgatttttggaagagaatagcgagagcgatgtttgcgctattgtgggagagagatatcggaagaggaagagacggcgattttttcggagaagagatggggagcggaagaggcgcgagctttccagagagaaggcggccggcgtattttttttttcacatttactcacgcgtgggaatagattagatatacttacgcaggggagtatccccgaataatgctgcgccacgtggcgtttgtctctggccgggaacgtgcatggaattcgtatatagagatacggaccaagaaaattacattagcataataatccgtgtgtaacacatattatatttttttcctttttaacccgatacctacacctatcaaattcgatacgtgagtatcacccccgatacttgagtatcagagccaatacctatagataggggtgggaaaaaaaaaccgaaccgaactaaccgaaaccgaaaaattcggtcatcagttgtaactaaccgaattttatacggttttttcggtcatatccttcagttaaccgaactaaccgaatcaatatgaaggcccaatacagcccaatagcccattagcgagaaaaccctaatcccccgtccccacctctccttcccactcctcccgtcctccccaggcccccacctgcgccgcgctcgcgcctgcttctctccgctttctccgctttctcctcacatcgcacatctccgctttcttctcctcgcgccgtgccacagccgctaccttctcctcgcggcgtgtcgccgccttctcctcctcgcgctgtgccaccgccttttcctgctgaatcgccgccgatctgcacatcctcgactccgacgaaccctcaactcatggtggcgccgcctcctctccgacaggtgctgtggaggtcactcatagctcctagatccagcgccgcatcccgtcgtcaaggtcctcatgccaccggcgaagcccacctccacgtgttgctcgcgccccttcaactcctcttcggttagcatgcacttttgtggggtttttttttcgatctaaaattgtggatggtctgtgttttattcatctcaagaatctcggtcgagaccgagaccgaaaaaaccgagaccgaattgtccggtcttcaattttatcgaggaccgatcggtcttgactttctgatgaccgaaatttcatccaggaccgaagaccgagaccgaattgctcggtcagaccgaatgcccacccctacctatagatatcagatccgatacatgagtattaaatccgatacatatagatatcagatccaggacctgagtatttgtcacaccccaatccggcaccgccgcacaacggcacctgacaggagcgtgtcgtagaaaaaacggcgcgaaccgcttccttacgaaaccgcgatctcggtaccagtcccaggacatagtgctggtacccacggtgacaaatatgaatcatagcaatccttaaaataaatagaggacttatttaccttaacttaggttgcagctcagacagcccgagaatgcaaccgacgacacggacgaggcgaacaccaacaacagcagcagcagcggaaccaacggactaacacccaacaccacaggcgacggctgggaaccaggacgaaaccctaatcttcacttcactttatcttctcttcagggcggaggaactatatatatatatttatatagagcaagagtgagtactttcgtactcagcaagtcacgggaacttaggtgtttgatgcaagcttggaggagaggcaaggttgttttacaaatcttttatttgaagatattttgaaatcactaagtgatttatttctttctatgtttgggcgaaaagagacttgcgtctcgattcgactttatgagatgcttttcaacagctcatttagtaacgtaccgacctcccgggtcagatcattacttctcggctcccagagcttttttcattttctcggactcccagagtccagctgcccagcagcacaacaatccgcttccactcgggaagcctagtctatgatgcccgcagacatcccgaatcacacagattcgtttctgaccactcaggtcatccatctgccacataggctgattctggttacgattcccacaccacaacaacttttcacaaagcacaggcaaacaaatctacgcaacgggaaccacctcacatccgcccatgaccgtgggcacggctgttcgaacagtttgttaacctctgcagaggggtacactttacccacaagacacgaacttactccagacactggccggtgtcagaggttcgcgacaaagcctttctcaagccgacccagggatacctcatgccacatagaaggatcaaatcctcacataaacataggccattttaggcgtgcacaaatcaaactccaaccacctcgatcggtaatctggcaagcttcgcgttcttgccttaccaggaacccggtttggctccaaccgaccccgccccggcgttcccaactattggcatgcgaggtttccctgaaccgactagctacttagccagggtgtcccattccaccttgtggttgcactttgattatgttcgatgagtttcccacaggaatcggtccttatatgcgaatacgggacagtgccacataggcacaacccccgcatcgcgagttttcacaattcattttattttcaaacacaccgacaccacatgtcgggttttgaaggcttcacaaacccatttcccaagttttcgacaagcaatggtgtatgtgggatatttggtatacgcgctcagagagcacgaataccgaggtaccacaagggtggagcgacaaggaatcagggtaatacgacctacggaaattagtgcgactactgggtaggtccgtcggtttggcacgcaaaccgaggccaagcaagttaagtgtgtgattctaataatgcaagttacaaacaaaataataatgattttccaattataggagcaattggtcaaagggtgacttgccttgctcaaagtcttcacgaagcttcacgaatcttcaagaaaacccgcgatcgacgaaaatccggtaaccgcaactatacgcaaacaactgaaaacctaagcaaaagaccaaaagagggatcctatttagactaattagtagtgccattaaatagatctcaattttacggaattactggaagtggaacggaggcaatcggacgaacggatagagggatatgaattttggaagtttaaaggaatttttctggacaaggagacgatttgtcggaattttctggaatacgagagatagtttatggaatttatagaaataatattctcaagaatattattgacatccactgacatacgggctcgaggggacgaattattggaatctccggattaagaggatgggtttatggaatttggaatataggaaatgatttattgaatttctagaaaagagaaatatgtgtggagtattgaaaaagatattcccaagaatatctttgactcattgacacgtggggccaataagaaggtgagagagagaggagcaattggagggagtaattgtggacttttagctcttgggtgatggacactgggcttggacaaagggagtgtatgtggactttgtttgtcttacttatcaggctgaggaggagggtggctactgggccaagcccaagagcaagagagagggggcggctgctgactgggcgtcggctgacttggtcaagtggggccgacggctgaggtggcgccaacgtggacgtcacgtcggatggggaagggagaggaggccgggcggctcatcggacggctcacggcgtgcggcgggatccggcgaacggcggcaagccggaggggcggctagcactggcggcaggaggaggagaaggggaactcattccacggctcggatcaggaagacgacgcgcgacgacggccggcggcggcggccaatctcgccgacacgccaacgtggccgcacgcgagaagagcgaagggcacgcgggctcgggcttcaccgaaccggtatggggttgcgacgcgcacgcggtgacgcgggacctgatggtcaccggcgacgcacgcgcggtggcgttatgcggcggcggaaggggcgacacggcgcggaggcaaaggagaaggccggtggcctagggacagtcagggggagctcaaggggatctccgggagcgtggcggcgagaggaatcggctcgagaggtgccgacggcggtcgattgcggcggcggcaatcaccggcgagcaaaaggggaaaacacaacgagacgacgaggattcgattcaaaggggtgggagcatctccggggttcaaggaatccgtttctggtgtcggatggggcggagaagcactgaggagggccggcgacgagcagcggcctccgggagcggacggtaatggcggtgaggccatgccgggcgacggcggtgctagggaatggtttggggaggtcctagggagctcaaggacggtgttggcgagggtggtcgacgagctggggcccgacgacggcgcgcgactgcgcgcggcggcggaaacagagcaacggcgaggcgcgcggcgcatcgtgcggcaggctatggcgtgcggcggcgggcgcggcatagcgagcggtaggaggaaagggttcggcggggagctcaccgacaagaggaagcggcgtcggcggatcggagggagtcgtggtgaggtggtcgcgatggtgggacggaacggcaccgggtgggcgcggccggggaggaagagaggagaggtggcgcccggagctcctcgtcacgcgcccacgcacgcaccggttcctccggtgctcggcggcggacggcgacgacgagatcgagtcgagcggcaacagggcggcgacggttgttcggctacaatggcgcggtggggggcgaaaacgagagagatggaggggaggggctcggctgtggttttataggcgcgggatgtggagcttcgaggggaaggaaccgagcacgggcgatcaaggagaggcggtggcggactcgcggtcaagttgtgacagaggcggtcacgggtggcaaaggaggtgacggtgtggatgcgttgggcggcgaaggcggtggatcgagcggcggaaaatcgaaccgcgggagcgggaggattagcacgggctggcgcggtcaagttgggggtggcgagctggcgctggcgtctgcgtctctgcctccgagcgcttgcggccaaggagtggaggcatggcgtcgttgcttgggagggaaaaagagagggaggacggtggaaagggggggctttaccatgccggtttgggaaaaaggaggtgggagagggagaggagagcgcgtgaggcagagagacgtgctgcctccacgtcttggacgcacgcgcgcacagggtgggggcgagcggcagggcggcatgggcggccgtgcggcgcaggcggccagggctgatgcggcggcgaccgggcggtctgccacgcgcgggcgagcgcgggaaagagcgaaggcggtggcgggttttgggcggcgacggcgggaatcggcgccgggaggggagagagcagagagagagagcgaagacgggagagagaaagaacgagagagcgagagagctctctctcggctcacatgcgtgcaacgcacgtgcgaggggggttaagatgatgggctgggaggggagatgggccgggggagaaaacggcccacaaaaaatccgagggaggcaaaatagactttttcggaggggattgattcgaagagaatttgaacttggaatttgacttagattttggaattgggatctcgatgagaggaaggagtagacggaggattcaagatggggttttggatattttggatctggggaagtatttggcgatgattcaaagagagggatagaatttcagagtttgatttggagacttgagtcggaagaggaatttcgagggggcaaatttgtgatggtgacgagagggatcaaggacggatttgaattgagatcttggcacaacttagactcgcacacaaagaacgaaaattttcgcaattaggatttttgccgaattagtttttaacgcctcacgaaaagcggagcgttacagattggtgtaacatcccggcctagggattaataggattaatagaatactcatatcaacaagttgcaacttcttttccggaagccaatctccaaagaactccagggttaagcgtgcttggcctggagcaatttgggatgggtgaccgaccgggaaattctttccgggtgcacacgagtgaggacaaagtgtgcttccgggtgcacacgagtgaggacaaagtgtgcagaaaagacatgtgttggtctgtgagggcagtctatgacctatgaaagctatcagatgtaagcgggcccggcctaggggaggcgggacgttacagtattaaacccgatacctatagatatcagatccggtacctgagtatcaaacccgatacctatagatatatgactcatatgtaccatacctagtatttgggtatcatgtatgatacaatctaatacctgagtattacgtatgatacatacatgtatcttgtatggtatctggtacttgcgaggcatatataaatcaggcattgtgggagcccaacgtgtactagtcaatctcaataccagatataatagtgtatcatcaaatattatcaagacaaaaaaatctttttatttttcacaaaccttgctccgtgactcgggaggcatattgctctgccaagacatccggccatgcctacccaagctcaattaatactccctccgggttgataatacttgtcgttttggacaagggtgaggtcaaactttagaatctttgattatgaatcattttcaaaatatttgtctttcaaatatagtgactacatgtatagattagtcttaaaaagtactttaataagatcatatatttgttaatacttttttacatattatgatagaaaataatggtcaaagttgtttttttaagaccttgcctttatccaaaacgataagtattatcaacccggagggagtatatcacaactcagagtgctcaactcagcagctctcctgagacctggtcattgagactaaattaatatgcaggtagaatggtccaagctggtgcacttgcactagtggaaacacggaatagctcacttttggtgtggagcggcatgtgcgacttgggttcggaaatggtagttgggagcgatggagcgctagatcgatgcaggggaggtgatgtcagtacttatcctgttgaaacagaatcccgttgtctagccgtttttatttttaaagggttaattggattcataccattacaaatttatctattaaaaaaaataccattacaattcatttatctaaggtgaaggcgtcaaagtcctcctcccgcttcttcttcgcctcctcgggctcgtcgcggcagcgttgctgcgttggcgtgcagggtggcggcgtcgggggcggcgttctcgtcgtcgacggagacagggatggagcccgtcgtgtcttcggcagtggccgcggcgagctgggtcctgcgccttgctggaggtgaaggcatcgaagtcctcatgccgcctcttcttcgcctccttgggctcgttgcgcgcgtcgcgacggcgttggcgttctgggaggcgtcctcgtcgtcgatagagactggccgtgcgtcttcggtggtggccgcggcgagggagtcgtcgtcgccggcgagagctcgtgcctggtcaatcctccgcgcatgcctccacgtcctccggtgggaggggccaccaacgtcgaagagaggaggaggcacacctgaccggatcaccggagtagcttcagctcggcggcgttgcgggtaaggattggtgagtggaagaggtcagtgcagccagggaggaggtagtcgtcgggcaggccgagtggatccaccaactccgccatcgacactcccagtcccagtcccagtagcgccaccaacgatgtcgtcgcccactccgccgccggcgtagtgccaccaacgacgtcgtcgtccactccgtcactgccggcgactgccccgccatcgccagagaaggtgagcaacgacgaggacgtaggtggaggaacgacgtgcgacctgtacgacggggagtgggtgcgcgacggcgacgaggaggcgcggccgctgcacgcgccgggtcgtgcccctaggccgacgacgaggcgaacgcctgcgcgtcgaacggccggccggacgcgccgcctacacacggtggcgttgggcgccgcgccggtgccgcctccctaggtagtactagcaagcacccggccaccgcttggctccgtgccctcctcatcctccagccacccatgggccatggttgatccaatctcgctaggtttgtatgttcaacgtgacggatttcctggcgaggctgtgcgcggccatcggctgatgctcattggcgactccatgaaccggaaccagttcgagtccctgctcaccgccgccgtcgccgccacaactagcccgctgcccatggctgcttgttcagcagaacaaacaagtttcgttcctctattacttcagcttgcgaatgcaacttgttttctcagaaaccatctcctcattttgagaaaacatctgctcctactcagagaagaagatgggagaaagaaggaagaagacggaaaagtaagaaatagatggaaaacgtgacagtagtggcatggttctatttttgtaaaattctaatgacacgactacgaatagataaatcgtaatgttattttttattacacaaatttgcaatggcatgaatccaattaaccctttttaaaagttgcaaggagaataaataggagccgcggcacaccaggtaagcaaataaaggataggcaaagcagccaggggtgacggcagatgcgtataaaattgaaaacccgattatgataagattcatttttaaaatcttaagcaacgagatgactatttagcaaaattttaagaaaattattttttaataaaaagttagttaattttaaataggtgctagctagccgtataattacgcagggcacatctagtcagttatgctaatgaaactaggttttgtgccaatatatataatgtagcccatgtgtaataccggcttcaagtggaatgacggtggtaaacccagcatgcatgctttgacctggaagatgtaaagtttcgttcatccatataggaagtgctataatctcaacaactatgtttcttttttttttttgagaaacaacaactatgtttcttgaaagtgttttaccttatgtcaaccttaataaattcgatcggggcacttcttcaccaccgatccggtgaaaaaaataatgctacctccgtttctccgttttttaatatatagcaccattaactttttaacattcttttttattaatttattttgcaaatataaaaaaaataattcatacttaaagaacatttaataataaattaagtcacaataaaatatatgataattacataaaatttttaaacaagataaatgatcaaactatctcaaaaagttaaaagttaatgatgtcgtatattaaaaaggaaagagtaacaaccgttttggaagacttgtcgtttgattacactgcaacctcgtgcaacaaaatatatctagaatgcaatgtacaatcgatacacaggcgagagagaatttaaattcagaacttgaatttgcccgtggagacggccctggccctgtcgctgagctccttctcgatgtggcgccacagcttgtcgatcatgtccgtgcgggtctcctcgtccagggtggtgtcgaagtagacctccccgatcgcatccatctccttgaaccgatcgtcgtacccgctcgcgatgatgtacttgtccgtgaactcgcgccacagctcgttgtgctccaacgactcctcctcctctgctttcttgatcgcatcttcctcatcatcatcatcatcatctgaatcgtcggcgtactccggtcggtgatgacagccacaggtggtagaggaatcacggtggtcggaggaggagtcgccgccgccgccgccgccggcgggatgaagattcgtctcgggatcatagcgggaggccgatccgaggacgatgaagtaaggatcgatgcacttctcagcgaacctgcggcacttctcttcttcatcctcatcatcatcttcttcttcctctgcgtcgcccaacttgacgtccgatcggtggctactactacgacctctctcgccggcactggcgccggaggagtcgccgtcgccgtcgccggcggcggcgggatcaaggttctcctcgagatcacggcgggagggttcgaggacgaagtgggtctggacgatgtcccagaggtcgaacttgaggtcgatgatggcgcatgacaggtagaacctcatcctccgttgtgcctctggggacagcgactgtgacggccactgtttctcgccgccgtcgtcaccggcgaccttgagagcatcggcggctacatctccctcggcggccattgctggatcgggtttcttggctcctcgagttaagcgaagaatcaaatcaaaactaatacgtactaaatcgtacgtgcaactgctgtgtacgtggtgcctggaatagttggcttggtagcaaataaatagggaggaacaacaactccgaaccggattagcaacgcaaaatgcagcttaatttccgagtaattaattgtttctggatttatcaaagccttcgatacgtacagtatccgagtcggagaagctagcatcgccatcattgagaaaacaaataaataaaaataataattagagatattgcatcgatcgatacgaatccgatactagcttagatagacggcccactaacccctcatacaacggattgacggcccacaagatagatagccatccgtattgagtgagatgagagatcagaagatcaccgccttcttcgccgcacgccggagctcagtcggagaagccgccttcctcatcaattcctcgccggatgtcttctctgcaccgcttgctcgatgctgatccctcttgcacctgaattggtcggagctatgcgcgtggagggaattttcttggtcgtcgtggacggtttgcgggagactctaaggccctacttggggaagcttgttccagctgcagcttttctcaaaagctgcttctgctagaagctgccccaaacagtccacagcttctgagaatctatagttacagattctaaaaaatgaactaaaaagtcagaagctggagaagctgggttttaaagcttttccagattctcagaagctggctaccaaacagctgcttctcagaatctaaagccctccaaacaggccctaaggccattcccaacccaatgactaggatgttgtccatagcattaaataagctgtcacctaaaatgaaaaataatgtgacaagtgaataaataaggaaagagaaggaaaccatgtcttgcatgagacatggtttctacgcaacattcaagacatcatgtgagataagtagcattaaattcaagtatagaataatgatgtttgcattggaagagtagtgtagtacagtttttgatgatgtggagtttatggaaactatgtatagtgtcttgggttggaaatggcctaagggcaagtttcatgggggagctgggtgccacgtctaatttaaaccatgtcatcttcttattaattaagaggtaacaaatacaacatgtcacctctagtacacaaaccccaatattagtttactctcacattatcttacatttttcttggagattgtgtagaggttgccccttgcatgagggctggtttattctctcttctaacttctctcttccaactcatcacctaatcctatttggcaaatttagaggcaacatgtagaggcttatagtacttgccctaacagttactcctacaacttcttttaaaatctccggagggccccattcgtttataaagaaacacagtataactactaaaaataattagccgtaaacgtaacacttatgtcaaatctagagttgacttaaatccagataaactagttcaacctcaaataacctaaccggttatttgagctatcgcacaatcaatcccaatgtttgcaatgttttgctttgatctaacaaaaaccctgtgcgatgagataattactgtgatatgccagtttttctggccccaacgagaaaatgaaaataaactacaccggttatcctgggatctctcttgtgcagccgcaagtcgaaaggtgggctgggttatagagaattgcatctgttctggccatgctgtgctcaagttctcacggcgaaatactaccgtgtggcaaacttctgaatgctagggacgggccggggatttcggggatgtttagattcagtggtgtaaagttttggcatgtcatatcggatattatatagggtgttatatggggtgttgagacactaataaaaaaactaattatagaatccgtcagtaaatcgcgagacgaatttattaagtctaattaatccgtcattagtaaatgtttacagtagcactacattgtcaaatcatggagcaattaggcttaaaagattcgtctcgcaaattagtcgcaatatgtgcatttatttattttttagcctatatttaatactttatgcatgtgttcaaatgttcaatgcgaaagggtgtaaaattttaaagtgagatctaaatatacccttcatatccctggagattggagaagtattgtacgaggcttgaaagctctgaatgagtactgatttggggagttggtgatgccaatcagattgacatttggaaggatacatggataccggctggcattactcgtaggcctgtcacgcagcagagcgggatgatctttgtggagattatgggtatcccatatctacatggcgacggtatttggattgggtaccggatacttaatgtagatagaatatcttatctgtatctcgggtttgtttcttaacttgtatatcaaggaaacaccctgagacttagtcggttacgattgtattttacctatatcttcatattccgttaggaatatagattatcttttgtaatccggactccttcccatatataaggggggtccgggcgcctctaggggtagatgctgatttttcccgaatcataccatcaataatacactcggcggattcatccccggacaggagtagggtattacttcttttataagaaggcctgaacctgtataaatcttttgtctccaaacccatacactttccgagcttgatagccacccccttttattattgccgaaatctagtttcgacagttggcgcgccaggtaggggtagcgtcaagcctttcgccgattagtgcgatgggttccgtcaccggcatcgacgacctcgtcttcccaccagggcagacgtttcggttcggcagcctcgacttcgtcaccaacaacttcggcaagatttctctccttgactcggaatcagaccagtcgggagagaatcgacttccagtcccgtttggattcccaaacgcggctgaaagttacttcaagaccatctcgatcgagtcggcttcaaaccacccggccgagatcgcattttctccaacgacgccagatcaagatgatggggcttacccaccgatcctgatgaagctccccgacgatctagcggccgtcttcaccacgacagcgtcttcatcccgtaggcctaggcggaagtcggcttcaacaccgatttcgcctagcttcagggaagtcggcgtcatcctccaaccactcggcacggtttcgacggatcagctggatgactacaacagctctcccaccgtcgactcacgtcctactgacatcgtggagtacgacgaatttagttctcgctacaacgacttcgacgacttcaacgacttcgacggaagcctagatgacaattacacccctctctactttggcgttttcatggccaataatgagacggaggagcaacgccaagcccgggagactgaagaacgtcgccgactggaggaggagcatcaagtacaagaacaagaacggctacggcgtgagcagcaggaccgtgagcggatcgccaaggaggctgaagatcgacgtcagcgagctttggaagcagggcgccgagcgcgtgatctcatcggccaacaagatgtcgaagggacaccggttttccgcacccctcaacagaatgcggttgccgcgatcacccttctcgacaccctcctcaaccaaaacgagctcaatcgttccgaccacgtcgtcaacatcttgaaccagacgaagaccatgatcgcagcatcggtcccagttaactccgaaagcgtccacacgccgactggcagccgagttccccacttccgatctcatgactaccatcatccaagcctcagcatcactggagcaggatccaatcgcaggagcaggggccacgacgagcggtctgttcactcgcctcccgaacttcatagggagcgccgagtggaacggcctcactcaccacctcgtcgccgccccatcgatcttcgcgacacaatcatacagcgccgagcagctcgaggctaccatcactcgccggatcgccgcgacgacgaccttgatggagtagcggccttcaccgacgatctgcgtcgagtggattggccagccggcttcaaaccgactggaatagagaagtatgacggcaccactaaccccgaatcgtggcttaccgtctacggtctcgcaatccgcgcagcaggaggagacaacaaggccatggcgaattatctaccagtggctttagcggattccgcccgatcttggctccatggattgccccgtggtacaattggatcttgggccgaactacgcgaccacttcatcgccaacttccaaggcaccttcgagcgtcccggcacacaatatgatctttacaacgtcattcagaagcccggagaatctcttcgagattacatccggcgattttctgaacaacgtaacaagatctccgacatcaccgacgacgtcatcatcgccgcattcaccaaagggattcgccacgaagaattggtcggcaagttcgggcgcaagcctcccaggacagtcaagctcatgtttgaaaaagccaacgagtacgccaaagctgaagacgccgtcaccgcatcgaagcagtcgggtcccagttggaagccgaaaaatacgccggctacgggaggaggtggaagtaacaatcataaggaccgcaagcgtaagcctgaggaacttgttgcaaccgccgctcactcttctcgacagcgttcgcgcgtcaacaccttcgacaagatcatgaactcccaatgcccgcatcatccaaactccaatcacgtggccaaagagtgcttcatctacaagcagttcgcggagcagtacaccaagtctactcggaagaactccgacgaggaacaaagcacgtcaaggaagaaggacgacggcgacaccccggctggatttcaagaccaccgcaaggagctcaaccatattttcggcggccccatggcttatgagtctaaaaggaaacaaaagctgaccgaacgggagatcaatgctgtccagcccgacacgccccaatatcttcgatggtcagagatcgcaatcaggtttgaccgctcggatcaccctgaccgagtggtccacccggggcggtaccccctggtactagacccagtggttcgtaatgtcaagcttcgcagaaccctcattgatggtggcagtgcactcaatatcctcttcgccaagaccctggatgatatgcagatccctcgctccgagttgaaaccaagcaatgcgccttttcatggagtaattccaggattatctgcaactccactcggccagatcaccctcccagtcacttttggcactcgggaaaatttccgcacagagaatatcagctttgaagtcgccgatttcgagacagcataccatgccatactcggacgcccggcgttagccaagttcatggccgtcccgcactacacttacatgatgatgaagatgcctggtccccgtggagtcctatccctacggagcgacatcaagcaagccgtcacatgcgacaaggagagttgcgacatggcccaaacccgcgagatggcgtctgcccgagaggaaatccgactggctgcaaccacggtgagcgaaggagaagtgcccgctgccaagacttcaaaaagtggggaaaccgaagccgcgactaaaaagattcccttagatccttctgatcctaccaaaactgctgtaataggcgccgagttagactgtaaataggaaagcgcgctcatcacctttcttcaaaataataaagatatctttgcgtggaaaccttcggatatgcccggtattcccagagaggtgattgagcactccttacatgtcaaagaagacgccaagcctattaaacaacgactccgccgatttgcacaagacaggaaggacgcgatcaaggaggagttaaccaagctgttagcagcaggcttcatcaaagaagtccttcatcccgactggctggcaaacccggttctagttcggaagaaaacagggcaatggcgcatgtgtgttgattataccgacctcaacaaatcttgccctaaagatcctttcgggttgcctcgcattgaccaggtagttgactcaaccgccggctgcgagctcctcagttttttggattgctactcggggtatcatcagatccgactgaaggaatccgactgcttgaagacttcattcatcacgccttttggggcatactgctacgtcaccatgccgtttggactaaaaaacgcaggagcaacctatcagcgcatgatccagagatgcttttcaacacagatcggccgcaacgttgaagcctatgtggatgacgtagtcgtcaagaccaagcaaaaggatgatctgatcttggatctagaagagaccttcgcgagcatccgcgccttcaggatgaaattaaaccctgaaaagtgcaccttcggagtaccgtcagggaagctgcttggttttatggtgtctcataggggcatccaagccaacccggagaaagttaccgctatcctcaacatgaaaccgccaagcacccagaaagatgttcagaagctgactggatgcatggcggcgctcagccgattcgtttcaagacttggcgagcgggggatgcccttcttcaagctactgaagaaaacagataatttccaatggggacccgaagcacagaaggccttcgaagatttcaaacaactcctcaccaagccaccggtcttagcttcaccacacccgcaggagccgttgttgctgtatgtatcagccacctcccaggtcgtgagcacagtcttggttgtcgagcgtgaggaagaaggccatgtccagaaagttcagcgaccaatctacttcgtcagcgaggtcctggccgactccaaaacgaggtaccctcaggttcagaagctgttatatggtattttaattactaccaggaagctgtctcattactttcaaggtcactcggtaacggtggtcacatcatttccactcggcgatgtactgcacaaccgcgaagcaaatgggcggattgctaagtgggctttggagttgatgtctttggacatatcattcaagcctcgtacttcaatcaagtctcaagcgttagctgattttgtcgccgagtggaccgagtgccaagaggaagcccccgtggagaaaatggagcactggaccatgcattttgacgggtcaaaaagactttcgggcactggagctggagtggttttaatttccccgactggagaaagattaagttatgtgctttggatacatttttcggcgtcccacaatgtcgccgagtatgaggccctccttcatggattacggattgcaatttctctggggataaagcgtctgattgtccgaggtgattcacagctggttgtcaaccaagttatgaaagagtggtcctgcattgatgacaacatgatggcatatcgacaagaggtacgcaaactggaggataagttcgacggactcgagcttagtcacgttcttcgacacaacaatgaagctgccgacagacttgcaaactttggatccaagcgcgaggcggcaccatctgacgttttcgtcgaacacctttactcgccgacagtacctcataaagatgctactcaagttgcggacacccatgacatcgctatggttgaagccgactggcgagagcctttcatacgatttttaacttctcaagagctccctcaagataaagatgaagccgagcggatttcaaggcggagcaaactttatgttatgcacgaatctgagctatacaagaaaagcccttcaggaattctgcaacgctgcgtatctttagaggaagggagacaattgctgaaagacatacattctgggatatgcggaaaccatgctgctgcgcgcaccattgtcggcaaagcttaccggcagggttttttctggcctactgcagtgtccgatgccgacaaaattgtgcgcacatgtgaaggttgccaattttttgccagacaaattcacttaccagctcaagagttgcaaactatcccgctgtcttggccgtttgcggtttgggggctcgacatggttggcccgtttaaaaaggcagtcggcggttatacgcacctcttcgtggccattgacaaattttccaagtggatcgaagctaagcctgttgtcacgattacagcagataatgctcgagatttcttcatcaacatcgtgcatagatttggagtgcccaatcggataatcactgataatggcacacaattcaccggcggagttttcaaagacttttgtgaagattttggaatcaagatttgctatgcctcagtagcacacccaatgagtaatggacaggtcgaaagggctaacggcatgatacttcaagggattaaagctcgagtttttgaccggctaaaaccctatgccggcaaatgggtgtcacagttaccatcagtactttggtctttgcgtactacgcccagtcgggccacaggccagtcaccttttttccttgtctatggggcagaagcaatgttgccgagtgaagtcgaattcgaatctttgcgcttccgtaatttccgtgaagaacgctatgaagaagaccgagtggacgacttgcaccgactggaagaggtccgcgaagcagctttgattcagtcagctcggtacttacaagggttgcgacgttatcataatcgcaatgttcgatctcgtgcctttctagtcggcgacctggttttacggaaaattcaaaccacacgagatcggcacaagttatctcctctatgggaagggccatttattatctctgaagttacccggccaggttcatatcgactcaagcgcgaagacggcactctcgtcgacaactcttggaacattgaacatcttcgtcgtttctacgcttaactttatcattgtatttccctattttgactgtcaaacatcaagttttctccttgaagttgtcagtcgggggctatcatcataataatggagtgtgatttttatcaattcagtttgcttacttggtttatcattgccttgtttggtttttctacttagtttgcgaggactgaaagtttttaatagcttctttgggttttaggctcaacaaagcttagcaaaaacttttaagaaatcaaaaactttgcaagaatcatcaagcacagcataaatatgccagtattgtacaaattgagcctccatgtattacatttacacttagtcagaatcagtcctttcatcatcagagttattatcgctcggctgaaggtcgttgttgcggaattgttctacaacatcacttgcaatcttgtcagccgcactctgagcattactgataagatcaagagcagcttcttcacttgtcccgtctgcaaatccatcaatggtgtcgacttcaattctcgggtacaaggattttgtcatcgccaaggccatgccagctcccatacttccagctttcttgatatttttgaaatatacttccggagcaacactcagcttgtcaaatatttcggttgcgtcgagtgcactcggaccaccattattgaggaacatggcttggataattggtgcagcggcattggcgacgttatcccttgctccttcaagcctcttgatcttaccaaccaggacgtcaaattgggcttgcgattttattttgcgatctacaaaacacatttatgatgaggatttattgcattataaagagagaagctcagattgtctgctagcggtaccttcaacttccttcaaggctgagtccctttgcgcagccagttctgtcttgtctctctccagggcttcaatttgcttcgccatctgctccatcctggcggcttgcgctgtttgaaattcagatggttgaggatacagttatgccagtttaaaccgataaaacggatctagggattaccttttgatgaaccactcagctcatagtttgaatcctggagctgagcgattcggtcccttaactccttctccgtcctcttggcgtgctccttggcctcatgtagctggtccctaaccgcttcaagagttcccaaatgaggaaccagcttttccaaagttgtggtcttggcctcattgcgaagatggattctctgcatgatggatcatggttcagttctgctaaaaagaaaaacaaagttaccgaaggctgtcgctcggaagacttacatttacaatacgagtggcctctccaagcgctttcttcagctggcacacttcttcatcttctttttgacggtttatgactataccggcggcttgtgagttctcgtcccaccatttaatcaagataggaggacgagagtcgtcggtcgcctttatgcgagggatttcttctccgtcatcacctgatggtcctgatgtgtttccaagacattagacggatacactgaggttatttaaatcgccgttgtatgaaaagacaactaacctgaagatgtacctagctgagcgtgaggtgatctttgttctttgcctggagatccagctatcgagtcattaccagcttctggcccttgggaagctgtcgtctgcgcttctacttcagggatttcttgatcagggcctgcgtccgactggtttccagtcgggggctcttgagttgttgctgcttcagttgttgccgactggtttccagtcggcggctggtcactcggattggcctggtcacccgaagcatgggcgccggtcggctggcttttggcagtcggctggctttcggcagttggctcggggtctttggatatattttgctctgccatggctggatcggggtcttttccagatggatctatatcagatggtttcctgcaaagtattctttcagaatttagcatcattttcatgagagagcttaccaaagtgaaatcataccgagaggtcttatacctggaagatgttctaatttttagcattgcgcggccggccagtttcttcctgggcatggtgcgctttgggggtttattaggcgagcccttatccccagatttatcatcgtcgccttcatcgtcatcaagcaccagtttcctcttgcgaggacccgtctgaccagttgatttggaggtctgaggttgcggatctggtctgatcgttggccctctacctccctgagcagtgtgttggcgaggagaccggcgctgagtgactggtggatctgacttcatcagtgcatattcctgaacaagatgcttccatagttagtcaattcagcatgaagacaaaattatgttctgatcatggtttgaagatttccgatacatacctgcggaggcggattgaacgcattatatggcactactggcagctgatgagagtagctgactacaattgcatttgagaagattttatacatcctctccttcatgattttgaaatccagggagtctggttcttcacggttgggatcatgtttgccgtcgaactcgaatgctgtgcgggatctttccttgattggcgctagtcggcatttgatgaaatgccgagtgatctgttctccctgtaagccttgttctttaagatttaacatacgatccaacaactccaaggcttgtactgcttcatctccgattggaagagagttccaagtatcttggtacattggaggaagacaagagtacccgggaagagcaggttcaggattctgaacatagaaccagtttgcatgccatcctttgttcgaagtcttgaagggcattgagaaatatttttggctcagagttccccttagttggaatcctgcccccccgactacacatggtttgttcttgtttggttggggcttgaggaagaagatccgacggaatagggcaaagtgaggtttgatccccaaaaaggcttcacaagcatggacgaaattggcgatatgcactatggaatttgggtttaggtgatgcaagctgattccatagaaattcaagatcccgcggaaaaattttgaggtcggaagagcaaagccgccgtagaagaaatgcgagaagaccacaatctcatgagtatccggagacgggaaagcctcaccgtgcgctggtcgccacccgatgatctccttggcagggagaacgccgtgcgccaccatctccttaagattctcttctgttacgtcggatgacgcccattgaccttcgaagctttctctctcttccgccattggtttcactcaaatgtgttgatttgatttgagggatggcttgggagaggtgagggattgaggcggtggatcacgggaaggattttgatgcacttttcggaggtggatttggccggagttgtgaaccctagttcgccggcgcagctttgcactgtagcggggagtggggaaaatggcgagagttccggcggggaagacgaagcgtcgcttggatatcggattttttcagttaagggtatcggaggtgctaatgggcctaggcctgaacagtacttcagcccaataattttaacagcgtggcccattgtgttccttagggacttaggcatattttgctttggcaatattatgcgcacaacagtgttgcccaatgctgatcaaatcctttttatgcggtcatataattctttggaattattgcaatgcaaattaaaaaggtgcccgacagaaaggcgttatgctgtttttgagcttttttaggctacaaaagctgtttgggttaactaggaatgacttgtttttactatagtcatttccttggcgtgttatatgcctgttttcatggtaaatagtcatggcctaggctatttgacttatttattaccataatctttataatgcttgatgggtaatctttagagtttttatattcggatgcctatcaagtgtgttcgttcgtgaaccttttagagtgtaaaccactcggatttcttttattgtggctaaaaagcagtcggctagcatgcctatttaggcgccgcgtatgcttttgtcatatgatgcacaattgtgttattattttgtctttcaactatatgtttagtttgttaactaatcacatagttgggggctacacctaattaggtgcatctattcgatgcaccatattctttatcttttcgccctttacagtccactcggcaggttttggcttgaggagtttgaagtactcggattatcatccttgagaaggctacgatggtcgactgcaaaggactcgggggctactgtggagattatgggtatcccatatctacatggcgacggtatttggattgggtaccggatacttaatgtagatagaatatcttatctgtatctcgggtttgtttcttaacttgtatatcaaggaaacaccctgagacttagtcggttacgattgtattttacctatatcttcatattccgttaggaatatagattatcttttgtaatccggactccttcccatatataaggggggtccgggcgcctctaggggtagatgctgatttttcccgaatcataccatcaataatacactcggcggattcatccccggacaggagtagggtattacttcttttataagaaggcctgaacctgtataaatcttttgtctccaaacccatacactttccgagcttgatagccacccccttttattattgccgaaatctagtttcgacaatcttgaacaaagttgcagacctcattgatccaaccactggtgattgggacatgtccttagtgaaaaaaaaattgggaaggaaataggaggaatatcctggcaaatccactgaaaagagaaatggatgattttgtggcatgtcatttcaacacaagaggtatcttctggtgaagtcagcctaccatgtgattagttttttttagcagttttagatctattaggtactttagggtttgtctttcatcatgtctatggagttagcattgtctaggctctttttctattttttttaatccctttgttgatgtctctctcgctgtcgtggttatcattgaagacctcgaaacacatgtctatcaggttgtccatgattcaatcggtggcgttggcttcaggttttggatcactaatttgtttggtaacgttggttcgcagatgtctgatgcgaaaactaccaaaggattgagagatggtagccggtgtacacatttgtattgtcattgtcctaaatatgggataccccattgacatgtaattacctcggcaagaccaccgtatatcaagtcatctatgaaaacaaatctcatacatatggataagatctatattatataggaaggaatcccagataagtaaagaaaatacaaattcatgcttaagtccgactagtactataggactagataaggttttccttccacatactttgtacttgtaagagattgatggcaacaccggttaataggagtgtggtaattacccatatcgggagcctaaacctaattaaaaatccatgtctcccttaatattgctacaccttcatttacatcctcataccccaaccccgcctacgtcctcaaaatataatgtatgtgtaccaatccctgtggatgcatataattttggaaaaagtacgaattaccccccgaactatcgtggtcgaccgaattacccctctaaaccataaaaccggacatcattcactcctaactttgcaaacctttcaaataacccccctgctctatccacgacggttttgatcctacgtggcagtccagtcagcaattcatttataaaaaaaaggtgggtcccacctgtcattttcttaccatcactatctctcttctctctcttttccaatctctctcactctctctctctctctcttctccatagagagcgacggcggaggcagcagcgaggcgagcgcggcggcggcggctgaggaggcgaggcagcgtggcagggcggcgcagggggcgggcgcgagcggcggcgacgtcgcagcgtacagcatcagccttcaacgtgcccatggtcgtcagcccgcaggccgtcggcggcgggaagtgccccgtcctcggctgcgtcgtcgacctcaactgcgagtgcctgccggggcagcggttctccgacgatgccgcctgccgcggcccgccggagtacttcaagggccgccaccagctagaacgctcgcgcgcttgctcgcttctccgccgagacgacgacgagaaatcccatgcctaatgctgattaatcaattaaactgtggctttgtgcatgttaattactagtacatcttaattaatcttaattagcatcatagattcacaatcacttccagaacaattcgctaatcgtggtctcggccaccgtgtgccgccgtcctcactgtcgcatcccacgccgccaccgccgccgccgccgccttcgcatcccaggtgccgtgctcgccaagagagatggagagagagtgagagaggggaagaggagagagactcgccgagagagagggagagggagagagtgagagaggggaagaggagagagtatatatgacaggtgggctcaccgtgtttaaaaaaaagaaaatgctgactgggttgccatgcgtacgccactgtttggagagaattttagctagaatctccccgcccaggaaaataaaatgtgcggacgtgccagtgtactaagtacacaaaaataaaatggacaaaggaaaatgtattttattataattctcaaggaattactaaaatacaaaatccttagtcaaatgtgctccacagcccatcggcgaggtggatctgacttggcgattgtgttctcatggttcccggggtctcggaaaacacccggttaattactctggtgggttaaacccgcgagacacctccgattaagctgcgctgtcgtcattggtcttcgcttcacgttctcccatgcatgattgtgatggtggtgatgatgtagatgtgtgtaggcgccggcagcagtccacggcctcatcggtccgtgcgtcggtgttggtgatgtcgccttcacatagactccgcccgctctgccgttcagcctcgtcggtggaggtaaagatggtgcttgtaatggagactagcatggcattggtcgtcggtagagatgccaagcttgtcgtcactggcgatggggtagcatcgcccttctagtctccacagcactggccgaccatcgtcatggtacaagagttagccttctgatcgctgcagcacatacttagtattgagcggtttttaggggatgttaggggcgcagcctagcctgagaacgataagacgcgttccaggaactgggtggccctcttgtatatgcgccgacaatcggagccaaaacccaaattatgttgggtcgcctccgatcgtagtggcttgacttgggagtactgcgccgtcagtcttcgcttcacattctcccatgcatgatggtgatggtggagtagatgtgtgcgggcgccgacagtggtccacggcctcgtcggtccgtgcgcaggtgttggtgacgtagtcttcatatagactccgcccgccctgccgttcagcctcatcggtcttgaacaacgtgttggtgtatattgttgttgaagatatgcatggaattgtgtagctcagatgactcgatgctatagtaattgcgtcggaattagattataaaggtaggaatgatcaacacggatgatagccgaattagtcatggcttgaaggtttagtacggagcaggatcattttaacttctcaccatgtgcggtagcatgcatgcacatttttatttgcttgcttgtcataatgtacagtagcatgcatatacatgcattcgtacagtgcgcatgcacaatacaagcatctgagtaatttcagcgcggcggctgcaaacgacgtgatagcctccggggaatgatgaccttcggatggcttggtcggcagctcctcggcagcatagtgacgctggcagcgaagccgatgaagagcatgtgcggaaatatgcagtgccggttaggatgatattcaatagacgttggcggcgacctgtagaggctacaacgagcgtgggtgacgcagggcgtcaccggccgattagtagagtctcagtgggacatccgtgcccagcaagggcgcatcatgacaggtgccggcaacaggggtccgacgatacccatcgcgaacttgtggatgatatattaacgacttccggatatcgacaactagcaccttggcgacctggcaatggccttctccggcgggcagcggatgatgatggggactagcgttagctggcaacgcctcgccatctatggatttaggcggctcagcggtgtccacggcaactccagcgagatggtttgggacacagctagagctgatgatgccttgcaggcaccgagtagtggcgctccggccggcgttctcttcaagcagcaagacaatgtgtgtagaggatagcagctttgatgagggcgagcggaagtcaacgatgttgcggagaagaggccgcgaccggcaaggcgacgacgtccgatccagcgtctcgacgacatcacatcgccaggtaaagacgtcatgggatagaggttgcggccggcgaggcaaggacgtcgcggcagcaggtagctgtgccaccggtgaccggcgtctccgacgagagggagcaacgcgatctccggctggcggtgcctccgacaagcggagaggacgctatatccagcgggccgggcagcaccggaaactcgcctcgtcgccatcttgtgcatgcatgatgatctgaacagaaagagaaggaaaacaaaagaaaactaagaagttaaactcatggcgatggctgagtacgctgctccggcgatcgtctcctcctccgcgcgcctcctcgccagacgccgaggcactgcggccaacgtcaccggccgccgagcgcacaagttcccgccggatgccgagatacggcagctgatgtcgccggccgcagagcacgcgtgttcccgccggacgccgagatactccggccaagacgacgtgcgcgatggttgccgatgagcagcccgtgtccgctccttgtccttgtgcttctctgtgtttctctcctgtgtctatatgtatgtctctctatggactactgccaaggctgggcacggcgcagcgcctgccggcggcggcggcgtgaactgcaggccggccctcggctcgtgcctctgtactctctctgctgctgccccccctgtaaaatgaaatgaacatccttttgtataggggtgaaaacggtacggaaacggacggaaacaacctttatcgttttcgtttccatatttttttcggaatcggaatcggaatcggaaaccccggaaacgaaaacggaaacgaatattatcgaaaccgaaaacagagcgaaaacgaaccggtgtggatacggtaacgaaaatttatcggaatacagaaacccctcaaactgagcttcaaacttttgtgaagttcaattctcaagttttaacagtcaacaattcattataaaacacaattatatgaagtctaattggtaagtctcaacaacaaaatatattcttctataacttcatataatttgtataacaaatattctaaaaaaattacagcaaaataccatggtataaggtataaagtatacactattagcccgtagcccgtagcccgcagcctctctctccctccacgggccggcttccccttcccctcctccctcttcgggccgccggcccagcccttttgctcctccctcgccgagaagtctataatgcctccttcctctcaattcaaatattttttagggtagtaaataatttcaaatgaaaaaaatgtcaataacaaagttgtataacttatcaagatcaacaacttttgttttggtcattttgctatatgactttgtttcaataatttgaatttgaatttcaaattatgacaacttcaaacaacatttttaaatactaaatgatttcaaatgaaaaagtcatcaacaacaaagttgtataactcatcaatatctacaacttttgttttgatcattttgctatatgactttgtttctataatttgaatttgaatttcaaattataacaacttcagacaatattttcaagtactaaatgatttcaactaaaaaagtcatcaacaataaagttgtataactcatcaatatctataacttttattttggtcatttcttcatccgataaagtgatagtaatattattcacaaattttacatata

SEQ ID NO: 82976 - DNA, 3698 bp, Oryza sativa
caagcatgatttatacagaagagaacggagcgagcccccagcattagaccgtagttggcctgacatcggaagcactcgcacaatagatattgtttaaaaaacatgctctaggtaaacataataaattatagatctgacaatatcgtatagattggaaaaataggtacgataaattgtatataaattaccgcgtacctgtgtagatatatgccaaatatatctacgaaattagtagatcaattaaattattcaacctactaattgccttactgtgtatgcttggtgaggaatagtaactccttaattgatccgattgtgtgtatggtactgttccccatgtaagcatgaaccttgtattttggtcctttaattgatctgtttgccacgtcgttggaacggccaaccaggatgctgcctagagattggattctagtgcgagcataagagaactcctccaatccgacttagaatttacacccatgtacatatcaatctggctctagatttcagctccacggcgctcgttttgttggtggagataagccgagttcggtttgaacttagccagccgatgtctcacaccagtcgatgccgcacaccatggaggaatcggtgtcggattgctcttggatgccaccgacacagtagcactcctcggcgatgatggttctgatctagtcggaagatgtcttggacaggttggatctccccacagccgaagtcgtcgagtagcttgttgtcggagagtccatctcttaaacccatctcgtcgaaatcctgaagcaccaaaatccccctacctggcgcgccactgtcgacgtttgatgtctcgactacggtatttggacagtatagggatcgtcggtgctagggtatacgcgagactgaggtaaaagagatagagacatggatttttatacaggttcgggcccatgaattatcaggtaataaccctacatcctgttggccggagccggagttgctttttattcaccataatcacaccagtacaatatgtgaggtagtctatctaactgttgtcgacatggcggttgaaggtctgactcgtagtcgacaacagggtagccttcctccttaaatccgtgtccggcgagatcagagatagcgctttcgtatctcctgacggtatccggagacaccgtaggggaatagccatgcctatccctgaagtcgatatccggcggcgtgtcttggcgtatgtaggcttgtgtgttgtggcttctggtggacgtgtgttgattgtcatgggtgtcttccatggtctcctcaccctctcctcctaggggggcttgtatttatacccataggtgtccccttgtccaagtagaactagggaaaccaatatggatacaatccgagtagtccttgtcgtttccatgtagaactctggttgtatttccttatccggaactccctcgaggtcagtttccgtataagacatggtatgtggtggatcctgcctagatttagtcaactactattaggtatgtggtatccataaccctgatagtagcccccgacttcgatgcaaatgaacgaattcatattctcaaccgcgcgtagacattggagtaactgttatcgagctcatgtgaccgttctcggtgagtttagagataacgttggacttcctttgtcagcctcgtgcgggcaccgaaagggtttgtctaagtcaatctctgatgtcgaccgagaaagtatagagcgtacgactaagtctcacgtcttgctgtaatcgagaatttggattgaagtcaagaaattttatctcggcgggtacaccatttcttcattctctattccttgtcgagatccagcaaccgttctcgagcgatcgagaaggcgtagagtctgcgacggagccttgtcaacattggtcgtactcgccttagtcgatcttggtgtagaaccatagagacatggagtcttccacaatatcaaatagaattttcctgaaaccaatactcagaaaagaatatcaaatagaaatagcccccaagcgaatgctcaaagggtgacatgttataatatgtatggtaaattgaaaataaattaaatttactgatcaatgttttgtgtatgagcgtcttctctcttaccgacttcgatcagtcagtagagtcatacactctccctagcccccagccttgtcgtcggagaaccgttctaggaggataaggctcttggacccttgacctgccttggttgaataaacactgatcctagcccccagccgtgaagttggaaaagtcaatttccgattacacggcttggttaatacgcacggcgagaactctaacacgaccagatcttacatggtcctttgtctctgaaggatccgacaaggccttatcggctctgggcgtccccagacgaggatcccttaggttcctcggaggccttgtcaagacggcgtaaagggacagtaggataggtttcaacgctaggtgtcatcgtggtaagggatctctgggtaaaacattgggcgatattgtgtacctgctatcaacttggttgaaatagaggtagtaggagagtcgctacaccgctggtcgaggaccaggcagtagtcgtaactcgaccacttaaagtgaaagtagtgggagagaagctacgtagctggtcgaggaccaggcagtagttgtaattcgaccacttggagtggaagtagtggaaggaacgctacgtagctggtcgaggaccaggcagtagtcgtgactcgaccacttagagtggaagtggtgggaggaacgttatgtagctggtcggggaccaggcagtagtcgtgacttgaccacttaaagtggaagttgtgggagagacgctacatcactggtcgaggaccaggcagtagccgtaactcgaccactgaaagtggaagtagtcgaggaacgctacatcgctggtcgaggaccaggcagtagccgtaactcgaccactgaaagcagaagtggtgggagaaaagctacgtcgctagtcgaggaccaggcagtagtcgtaactcgaccacttgcagtggaaatagtgggagagacgctacatcgctggtcgaggaccaggcagtcgtcgtaactcgactatataaagtggaagtggtgggagaaacgctacgttgctggtcgaggaccaggcagtagtcgtaactcgaccacttgcagtggaaatagtgggagaaacgctacttcgttggtcgaggaccaggcagtagtcgtaactcgaccacttaaagcggaattggtgggagaaacgctacgtcgctggtcgaggaccaggcagtagtcgtaactcgaccacttgcagtggaaatagtgggaaaaacgctacatcactggtcgaggaccaggcagtagtcgtaactcgaccactagaagcaaatgtacgagagatcactacgatcaactggttgaaaaccggtgagtaggtgtccctcgatcatttggagtcgtggtgcgaggaccgctacgctggcgtagtcatacctcgaccatctgaagttaaggtgcgagagattgctacatactgatgcgagaaccagtgagcgagcagaattatctctcgaacaccaatggaagttgcggtgcgagagattgctgcgtactggtgcgagaaccagtgagcgagcggaattatctctcgaacaccaatggaagttgtggtgcgagagattgctgcgtact

SEQ ID NO: 82977 - DNA, 1158 bp, Oryza sativa
actctagaggatcccctcgtaagctcataatctattatgaaccaaataacctagcgattgatggcgattaaaatcaagtgatcaaccaaagagacatttgtttggaccaagggtttcagatatgtcttctttggatcaaaggcatgcacccgttgtggagaaattggacacgttgctagcatgtgcctcaccctctgccctcattgtgaagaagaccatccaccaggggagtgtcccatccgcaaggtcacatgttttctgtgcgagggtacaaaccatgtgcccaaggattgccaacttagtgtgttgttgaccaagaccgcagaaatccaacgaacaaccctacgattgtctcgtcagctagtcagctccaacaacaacatcgatgatatcatccacagcaccaatgctcctcttgctccacctaactctgcaataaatcatggcaataatacctttagcactaaccattctctgcaccgacagcctcagcaaagaattgtcgtcgatggaagaagttgtgtctctccccgacctactccaggccaagcaaagggcaatcaacctccggagggcgataccaagcagaagaccgtcatccgcttcaaccagcaatcagaaggaagcttctcctgtgaatgatagcattatgcagtcctatcacatcatcacagaaccaatcaaggatgcagtcactagaacaatgccagctatatttctccagaatcaaaatgagcagccatgtttgtggttttcagttcgctacttatcatggtgtaatcgaaagtttgcagcaatcatgtaatacataaatatattcatgtttataaacagtgagcttgctatgcttatggatgattcatgttgaggatacaatgtaccgatgttaagcaccgtccctttttgtttgaggcagtgcctcgtattcatgtaatgagggagaaatgtgtaatacagacaagttccatgaggattcttttggaagatgcggatatgtgattatgtgtataattgcttactgataaagaagacctagggtctcatttcaaaggaactatgttctaaccttgagttaataaccaacctagtgatggaaaagaaaaccaattaaactgtgttgggttaaaaagccaatgagacagtagttggggataggag

SEQ ID NO: 82978 - DNA, 1034 bp, Oryza sativa
aggatcccccatttttaaattaaaatttaaatgaagaaattcgcaaatattcatttaaagagcatataaacttcaaatggccataacttggccatttgaactcggaattggactgttcaagtctctaatttttccttaagaagtcaagaacccatttttgtgctttgttcctacttgttatatggagtttattagagtaaaagccttttcttttccgttggtcgtgtaaacgctgcagcttcggaagattcgctcttcgtggaagttgaagccgacgtttgggaaaatgagcaaggcaagtcacatcatccttgaacatattgaatcccagtttataaaattattttgatttaaattattgcattatcgctttatttaaattcccgcgttatccctgttttatctagccatgcctatttacctttgttatgaccttattattgctattgttattattatcttgttcaccctaggaaaataaaaccccaactagtgggtactctattcatggttccactagtatgaatttaggtagatgcttcgccgcttaattaggtaacattaggtggttttacaactctagactttgggatattcatatcacttggatactatggaatggttggcttttgttggaattggacacacacctccccctctattcaaaacccctaaaatggttttaggctgggctcgaggtgcgtggttgggttttgctagtcgtacctcgggtactataaggattaagctcgggcctctgttgcaaagcactaccgtacttccacatgtctagtgggtaaggcttagtttgtcgctcagtctggttataaacaaaagtacacggatggagatggacgaagtcgggggtcgatggacatctctaggacaaatgaaggctacacgagctgcggcccggtagtcgagatgtcatgccacagggccggtgtcctgctgctagggggctcaatcctgcctacctgtcccgggggttccggccataggtggggttgggtcggtactcttgtctatgctag

SEQ ID NO: 82979 - DNA, 1946 bp, Oryza sativa
acatacttcatcaatgccgaaaccaatagaatcccttttaggctagccaaccccaatctaggaatctggaaaaacaccatcaagtcatggccatcaactgtgaaaagttggacggcttggtataaaagggtatcggctagcaagcaaggccactgggaagaaattgggatagcacaagctttagccttgactgctacagatatggctaaggacgaacccttgatgtcggctgccagctaattctggtccaataccttaaacaccttccttttcaaccaagagccgatgacccccacactcttggatatcactatgataactggccttgatataacctcatcggctaatccagtcagcttgaacaccaagaacaaattcgacttcaaaaccaagagcataggtggctggtctggatttgtctcaatgaacatgggtgatgggtctgtaagcctgacggatcacacagctttccttcttatgtggttagaaaaatttctattctgtggtgcaaggtgcggccctactgcaaactggcaacatctagccgaaaaactggttgagaaaaagcaattccccttagggaaatatctcctcggctatctttaccaaaccctaagcaatgcatcagctaagattgcttatgggacagtaatcggcacatgtggtccatggtggctacttcagatctggctcaacttgattaccaaggaagttgtcgatcgaccatctttaacagaagaagacttcccaaggtttgagctgatcacggatgaggatggtgaagaagtcacccaccgccgatgcatgtcctttggagaggcagcatcaaggaacaccggggccaagctatctgctgaactgctcaaggactgcttttgcaacttttatgatggtttcccgaagaacgctagagtctggttcgcatatgctgattcggctagctttcaacttccttcggattttagatttgatgagatcaactctgagaagtttgagaaatccagaaaagtctttactatagccatcaccccctgcatacttctagtcggcatccatcagggcaaaaacatccagatatcttatgagttttatcacccaatgagtgctgcaaagcaacttggattgggacaactgtcgattgggttgtactttgccgacaggatccaaagtaggggagaaattacattggctctgatgatggatcggctactaaacattgaaggaccttcacttggcagtatagagaacatcgaacaagccttgttcgggagcaaatcttttgaccaatggtgggtcgaatggaagaaacacctctttcatcagacaacttcgatgtatatgactgatctattctctgatctgatccctcaagtaagttcttttacctttgtcaattctgtttgatacctgcaagccgatttgtacgtaaccagttttttcttctgtttgcagaccacagagacttctccccctcatcaaagtgagagtggtcgggagatcgattatgcagcaagcctccttccaaacggtggtagattagcttcccctatcatcggcttccatgcccctaagacagcaagccttctccaagggcagatgagagagccaatcccagctgatgctggaaagaaaaggaaaaccaaagcatcggttgcggatccatcggctgcagaaaaagaagtccaggaagcaaaagataaagtgtcacgtcctgataaattcatcccgaaataaaaatcatcctctaaaaagaataatagaattaattaaaattcgaaaagaaattggcaaacactaaaatacgtgcaacaaaaatttgaaaatgggccggagaattttgggtaaaaactccttggtctaaaaagagcccctaaattttagtggaattatcagagcacaaataataattattaagaaataaacaaagctaaaatgattttataaaa

SEQ ID NO: 82980 - DNA, 631 bp, Oryza sativa
acttgctttcgcgttgacaaaaaaatcttgaggaaaatttcctacctatgttctccaacgagtggcgaaaaggttggattattttttatactattatgaatagtaatgggccccgtgggccttttcaatcttgcattcggccttttactgttcggcctctgcccgatgggaatttactgtttcgtctacccttggacacgtggcgggttttgattggtctatagtcgaactgtcgcttggcgagtctatataaccctgccgcgggttaccaccttcccccccgctcttcactttttactaccgccgcgctttccttctctacctgtgctcttagcttttcaccatctctgcgctcctgcgcttgctctcttgactctttcccccccccctctcgtctttagacttctgcttttgccgcgggttcggtggctccttgcaagctcgcctaggccggtgtcacgcccggaaaaattaccttttctcgaacactagtgtattaatccccggtccacgataagccggggtacaccacataaacatgatacaaaggcacatctttattatatcgataatatttgcattaatacaaggcactttcagtttgacataaaaaataaacaacagcggacta

SEQ ID NO: 82981 - DNA, 9447 bp, Oryza sativa
agggaaggcgaatctgttattggaattggaggttattgttggggtggtaagcgaaactaaccagcaaaagaaaaatgtctttacatatcatacaccagtacattaggattgcactataatttttttcgtaaattcctagttaattagattgcacagctagatttagttcatattatagtctcagcacaagttcaactggcagcaaagtttgctgtggaggtggccaaaaccaatgaagttgaagcgattgtcatctctcatccttcagaggtgattgctgatgatatgaaaggtgaacttaacttgttttgatttgatgcttaattggttgcactacatatacatgaattatctagtcattttatgtaagttgtatccaagaagcctctgttttgtttactaaattcacattgaacgcaggtgtcaaatgccccattgaaatccttggaggtcagaatgaccctataacaccaccaagtttggtggaccagtttgtgaatgtgttgcgtcaaacaactgaggtgagtttttttttttttgagaacaactgaggtgagttgctgttgggtttcattggcacttgatgccaaatgatctttaaattttgtaaaaaaaaattacaaaatagaaagcacaagaataactgaaacagagtttattcaccccccctccccaagaaaaaaaaagaaacagtaaacagagaagagataaatctcccagtgatgatgagatattaaaagatcatgccggcactaattggaagtcaacatttggaaagttgtttttgagaagaacatttgggaaatttacaataactaaagtctaaacactagtacattgcaattaaagttccatacatgtacatggccataaattcggaaaatatcctatatcttcttgacttgttctatatttgcaagaagaccctaattttttcttcaacacaaccactcaataatgtttaagaaaagaagcaaattaaaaagtgcctctaatggattgcatctttgttgcaggttgattactttgccaggatctttccaggcgtgtctcatggctttgcttgcagatataacgccagcaaccagtttgctgtcaatactgctgaacaggctcttgccttaatgcttgactggtttgagaaatacttgaaatgacaatatagatattctattaaaaaaatgacaatatagatagttatttgtgaaaatgcagaaaatcgcacttattcattttcatctaaataaattgccggtgtccatgtataagtataaccagccatgtcaatgtgattaattggctatgattttctctgaattgagcttgtcgatgtattaactgctgaattgatcttcaaattcagcggtgggaattcaacccaacgcacatgcatgtattctcaagttcaaagttaaaactaatcttcaaatttgaacgttggaacaaatgcaagctgaaagaggggacttctgcagttggagcttagaaagttggaggtgaaggcgttgttttattttatttattttagatatctgaggttttcattaagcaaataaaagcatctatatgttcgacaccaaaatgtacaatcaaccaaaaaacacactcagacacacactacaaaaagaaatcagagtagcaaaagaccttacacaactatatcttgacttaaagaaactcaagtaagactaacatatataataaacacgccatcccaatggcgtaataatttcactttggtttttgagataaaaagtaaaagctatacttttttttcttacagaactcttacaaatgctgatgtgacataccgtgattaatctagattcaaagcgccgttactgaggtataacttttgtttttccgccgtcatcctcctctctttccagtttcccttttctctagaaaattaaactgagtaaattgctgtcaataaccgtagggaaaagaaattgacgcatgaacatgctatggaagctaggatactgattaaatttctagaaaataatagagtggcacacttttttttcaattaaatggaagatgcacaagcgcacaaacctccacaaggtttcgttcaattcattttgacaaagcctgtaatttttgttcgtgtacagtggtggggacttaggataaatactgtgtgaccttgagaagctaaagctatataaaaaaaatagaacaggtttttttcccgatgattaaaaaacatgcttgatgtttgtcagtttctttttatatcaaacattaacttttggacattgtcatggttcgaggtaaactatggtatcctttgctaattcaatgctggtattaacctttttcttactgatcgaaagtgagaattcgtttctgtaacgcatgaattcatttcatttttcaattgagcaccatcaccaaaatgtttaaatggtctaaaatttttgggcaataagaaaataatattacatttggttactcattatttatgatattattttctttatcattttccccaatatttatgcgatttcaacacatatgattcgataccgccattttgtatggagcgagcgtgacaagataacaatctacatgaggtcatgagtcattgtcactattcactggaatacatgtgtaaggtgccacaattttgagtgggtagattttcccgttgtaacgcacaagcattttactataagacataaactcacaaaaccttacttttggtatgtgctttcttatcatcctcgctttccgattatccttcatcgctaaactcgacttgctttgaaagcttttgacgcacaagtttgcacttgtggttcttccttttatcttcaaaagataagccgttgttgtccttgttatctttctcatcctccttgatagatttcttgagcttgggacacgtagaattgatccgaatgtggttcaactcactacgctccaaacatcaaattggaccacgctgaaacgacaactagaaataattcgaaaggacagcatgacaaataattggagatgacaatgacaaatagttagggagtactcccccatttcatattataagttgtttgacttttttcttggttaaaattctttaaatttgattaagtttatagtaaaaattagcagcatgtacattgctacaatatttgttttgtattgaaaatgttactatttttttctacgaactcggtcaaagttaaaagaagtttgattaaaaaaaatcaaaccaattataatataaagtgtaatagtttatattatacgtaatacaaagtgtaatagtttcactttgttttttttacaagaaaaaaggggcgcaggattgcagcgtgcagctgactctaccggttaaaggcatgtacaaaagcccaagcatcatctctcactcatcagtatgcaaattaaccatatggcaactgcttcgttgagcctcctgatcctctgcctcgccgcgctcgccgcggcggccggcgccgccgccgcggctgctccgccgcgcttgcagtgctttgagcacccgccggacatgaaggccgccggcggcggcgaggccggcgtggtagtccacgacctggcgggctacgaggcctacgtcaccggcgccgcccactccgaccgggccgtcgtcctcgcctccgacgtctacggttagtacgcacatatgattgcctgagctagctaattaattaagcactgatcagttatcactacttccatttcttcattccataatgatgattatggactgatgaaccgctaatttaattttaattgctgctgcatgtgtgattgttaatttggttcaactcctcaggtttccaagcgccgttactgaggtaaattttctttgtcatcctcctctttttctagttttcttttctagcacaaatcatattatttttttattaaaatataatcgtgtgagatcttgctgtaaatatttaattataacaaatacaacggtacgatcagatcgtttatatgataaataatttatgaaaaaaatagtttaaagatacgagaaggaggctaaaataaaatatatggaaatgagatataaagtgtgtagctttgcatgcgtatggatagacacctcttgcactagccaaaaatgcaacaatgtagtaggggagagcatctaatttttcaccataaaatcgagtgtcccatttgtagccacatcgcaatcgcacagaaagaaaattgacacatgaaccgctatagaaagagactgatttaatttctatatagaaagtaatggcgtggaaaatgttcattttttatggtaaactgtttttatttcaattaaatggaagatgcaccaacacgcttgcacaagtttctcattccaattaaattctttttgacaaatcctacttttttttttcttgtacaagtcagaagcaaacacactcacgcacatacagagacacacctatgttggtgagtcctatgagtatctccaacatactatccaaattatacgaattagactttttaaacactcatatagccaactcttcatctaatttgtcaagtcaaattcattactcacttcaacatcctctaagtctgtgacaatgggtcccatatgttgaccttcccacccttcttcacccatcctctctattcttctcttcttcttctctccactccctccacaccgctgccgctccccctttctccacgctgcggccacttcctcggccgagagcagcagccagcagaaccgggaggagctgggagcctaggagcagctgccggcgatggcagagaggatgaaggggaagggaagggtgcctcgagatggccaccctccgtgtcaccaccgcggcattccctggtgcatcagctgctcgtccctagcttcctccacgtcgccgctctgtggggtgacacgtgacggagggagggtgggacggtgatggcgataagggcataaagcaacggtgacgaggatgaacgaaggcggagacggtgcgggggaggaggcagtggaggccgtgggtgcggatgccgcggagcaactgctagtccgttaccatggccacaatggcggctggtctagctggcagagggatgaattaaggagcgatggaggtgggcgctggtctaggcggcgacggggtcagggttggtggtggtctcgggggcagcaacagatggtggtggtggtggtggtggtcatcacctgcggcagcaggaatcggtgtggggcggggcagggcagcagtgggaaccggcggggacggtacttggaagaagtccggtgaggcggcggacctcgtgcgcggctacgacctctttggctggtcagtaggatacttggccacggctgcagtcggctcctaggacgacagtgttgctctggttgatggaggtagagagagaacgtgggaggaggaaaatagacgatagtattgagtgccatatttggccagctagattttttttagataagccatctagacggagagtcttttggagcacttttttttttttgctatgttggctaaaatttagcttgaagagttggatggagagtctcttggagatgctctaaggctgaattcagtgttgaaggttaggaacccttcacctccggcatataaaatggagcggcgaattagcatgtaattaattaagtagtagctaaaaaaacttaaagaatttattaatatgatttttaaagtaactttttatgtattttttttttgaaaaaaacaaatcgtttgacagtttggacaatatgcgcgtgaaaaacgagggattagcaattgggaaaatgttgttctgaacacaccctaagtccctaacacatgtatgtgtgtgtgtttttgctcttatgtgttttctctataacttcggaaaacagaacacatttgcgtgataataatgatgctgacaattacaggcaaatagctgataaagttggtgatgccggatattaattacgtcgtggtacctgatttgtttcatggagatccagcaaccacatctgtgaactttaccgaatggctcgagtctcactctccggtacaattcttctcgatcaccatcttaaaccatcgtttggataggccaaaatttcgaagtcataccccatacaaatggatggggcaactggtccattgaaacgaggctgaagtgatttgtcttacagtactcctgctccgaggaatactccatccgttcaaaaaaaaaaacgtaggatcggatttgtagtactggaaaatattaaatccgatcccaggttagttttttatgtaacgaagggagtaagtagttttggaacacgtgcagtcaatatgagctaattttaatcataaaaaaataaaatcgtttaaaatttaggttcactaccaggatgcgaaagtttcccgtgtgcctataacacccaggaaactaggtgaaacacccgggaaaaatcttcccgtgtgtcaacacccgggaatgctcacacgggagcgttgaagctttcccgacttggattcccgggtatcaagaaggcagcgctcaggaaagctctagacatcctgggtggttagagcagcacgggagaaaaatccaacgctcgggatgttcaacagaacggaaacggcaacagaatacttctcgggtgctggttcttttgcaacacccgggatgtttcagtactacagctcaacattcttcccgtgtgctaaccacacccaggaagtttcagtcctacagttcaccatcacacgggtagtagaaataataagcaatgaaatagaatcggtacaagcactcaaatattcagcaatgtaatacaatcagtgcaagtactaagcataaactgatctgtacaaatgttaataccagatatttgttttagttgcacacatacatattcaaacagccacaaccaatctatggaatacacacaaaagtaatgtttgctccttcacataggtagatttttttcgaacatcataagtaccagttcttgaataatatctgggagtccattggataggtaagaccaaaataacatgaactacatccaaaaatcattgttccagatcttgatgtttggatggatttctgtagcaatgaatcatggctggcaattggacgcacttgatctagatgatggctgaaaaattatagtgtgtcagaaggtgctgataaatattgtatagaatatattgccagataaatattgctatagcatattatgaaagtttaagagtgcacattgttagagattcatgcctagatggattaaaatcacaagcccaaagacaattaacagtacaaatgtcaagcatgccatttgtctaaccaagtggttcctacttgtcctgtacaaagagcccagttagcacaaaccaggaagaagatacataaagaactagattgaactatagctagcaactagatacatgcatcaaatgtagttagtcttacttcttaggtacctatatatgcattttacctatttagattaaactatgtgttatatcttaggcaactgtttacatattgaatgcattcagattatatgctttttcgaagatggaactatctggtaaaaaggtcattaatgttggtataagattgctcgcctaaatagacagtggggcatgttggtataagattgctcgcctaaatagacagtggggcatgttggggccgctggtcgtggaggcaaaacattagctttcatcgcagattgaagcgcctgaaatttatttacacatgacaatgcaaatagttaaatttatacatgttgatgaattttaaaattaataagtacatagaggaggcaaaactacaagttaccagctgtatcgcagatgttaagtaacatgtttcatgttggcaagccttaccatcaatgggttatttcatcaaatcaggacttgcaccatgcttttccttaacaactccaaaataagcttcctggatgataagttgggtgtttattcaaatgggaagagattaaaaagttgctgatcaaattttgtgcaagctagagtgcaactacttacaagcttacccttgacacggtcagtacaatagtcctctccatcttttccattcttccttgcttctgcataagcctcaaatatacccactggcctcttctccttcttctccttcatgaaacaaaataacaattggattattttaatctgtaaaatacatttcaagattttatgccaatatgtgaaaggtgatttaagttaccatgttcttttggaatcggtcaagtgaagcgctgccttgacggtgtgctggcccatccatcatttccctgtataccctaccttcacatgactcttttatccactcttcattacaccaatgcagttccgcacacaatttccatccttccggagtcttttgagcccaccaatacacaaattcagtgacaaaaaattcctcggattagtcaacgagtaaaaagaattcatactacaatgtccacttctgttgttctacgttcagcaaattaaaggcacaaacagtgcactttaatgaaaactagaatatctctctagtgttaagctgaaaaactaaaacaatggcaatacatcgctagtaatcagaagtacaagtcctaacaagtaaaaatctacacggccaagataactaaaatgagaagcataaaaggaagtaaatattagccatatcacaatgcattaaacatgtcaagtttttttaccttgcttatgatctggatgaccaaatcactctctgaacaaaaaaaagtgaacggatatggctgggtgggaacaacctgcaaatcatcaaaatcaagcacattatatgacagaaactgaatcttcattacatcgaacaaaactagagggaactaaactgaggaaaatcagaataaaacataaataccagtgaagccgaggagggtagaggaaggcctggagatggagtatggctcaacctggtggatgatggctgaggtggggatgagctgagtgggggaagaggaggtccaaaggggtgacggcggaggcggcgatggacggtggaggcggcgatggacggcggagacggtgggggaagaggaggattaggcagggaggtgggtggaggagttggtcggcgttggggtctggcgtgggggagttgcgtggaggagttggcctgcggcggtggagcggcggcggcttcgtgcgcaggacggtgacgccgcggagtcacgcgctggcggcgtagttagggatttctcagattggggatttctcgggagagagatggagtccgaaaaaaaaatcgggaaacaaggaataaaaaaaaaatcggcgctctggggggatggagaaaattgcatatctaccatcccataagaatggcttcgctagaataccattatgaaaacaggcttcgctggaataccatcctcaaccagagtgtcttcgccaaaataccatcctggacggaaatgcccctggctcttcttct

SEQ ID NO: 82982 - DNA, 49960 bp, Oryza sativa
ccggccgccggagtcgcgggctcgcggctcgcgggagcgccgtcgcccgtcgggagtgggaggccgggagagtgagtggagaagccagagaaagataggtttttttttttttgccaggcttttttttttttttgataggccaaggaaaatgaatatacatggtcttctcgttaggctcggttcgggaggaacctctcctccccgcacgtaaaataaagtctctcttattatatgattaattaagtatttattaatttttttaaaaaatagattaatatgattttttaaaacaactctcgtatagaaaatttttgaaaaaacacaccgtttagcagttcgaaaaacgtgcgcgcagaaaacgaggaagagggggttgggaactactactaccgaacgcatcctaagagcaggtacaatagtgggctataagggcaagtactataagcccctacatattgcccctaaatttaccacataagattagataatgaggtgtaagagagaagttagggcaagttttaaaaaagaggtggatgttgcatctaatcttgatcacatcatcaactgataaatgtagaggtaacatgtacaatatatcacatctatactaattctaatacactagccccaatgtttgtttgtccaatctactcttccctctctctccttttgtcttgaattttgtgtagtggttgcgcctcttgcatgagaggtggctgcttatctctctcatctcttctctcctccacctcactattttagctcatgtggtatctaggagattgtgcttggatgcccatagtacttgcccttagaagagagagaatgagccacccctcatgcaaggggcaaactctacacaatctctaagaaaaatgcaagatgatgtgagagtgaactaatattaggatttgtatgttagatgtgatatgttgtatgtgttacctcttaattaatgagaagatgatatggtctaaattagatgtgacatccacctccactataaaacttgccctaagccagctataaacatattttaaagagataaagaaagagggagaagtgcagcgggctacagatctgtagccagctgcagcacgagctctaagacacaatgtgtgtatgacaggtgggaccaggtattaatagtatagcaagcaactattgtatgaattggctattatattggctatagatgatttggagctagtagtggactatactattaaacttgctctaagccaaattctagggtagttccgacttcttagcctacctggacaaccctttagaccgactacattgacaagttgagggaactttggtgtgcttttttcttattcttatgtctttttttttctgtttgacttgtgattcagagtgcacgaagatgggggtactccttctgttccatataaaaaaaactaatatgttttgtgacttatgtggctcgtactattaggatgtgacatattcataataggtttgttttttagggacagagaggatatgttatggaataatgggataatgattacatcatcttgaaatataaaatataaagattcttactctaaatttagacaaactatcatcaagattcgaagttagaaatattttagtggtctggatatcaccgaatgcattgttttcaaacgtgttaggcaacttcggcttagttcttttttgcaaacattagcccataaattttccctcaaacctttctatacatatgaattttgcctcatccaaatagttttgagtcgtgagttcacttgtaattttccttcaaaatgattatggctgcttccaacctatgtttgcggtaaactgatatattccacgcaaaacaagacaggaggttagtgaatgattaattaagtattgacaattataaaatttaaaaatgagtatatttgattttttttaaataaacttacaagtaaaaaagattttgcaaaacacgcaccgtttaacaatttggaaaacgtgatcacgacaaatgatagagttgcaaaagctaaacgagctttcaaacagagcctatattgcccttatctcatacttgtatgctagcctatttgggaaaacaaaattctcaatgtgaaaaaaagactcatttgtaaaataaataaagatggtagaattatttgatcacaaatttgacaactgaaatttaaatctttaaataaatttcagaccaaaattgatggaatgcggacaatattaccaccaaaatttaaacccaaacaaaaaaatcatggtttttaatttcttggtgaaactcctgtatgtgtttaatcaaattcttcaaatttggctaaaagtttcaattttcaaacttggcatcaaataatttcgttccctttgattttattttaaagcaaaaccatattaagatttatattttcaaataagttgcctttaaggatgagagaagggcattttagagaaatctaactatcaactcacggacaaataggtatataagaaaacaaaataaaacttacgggtatataatggatgacgcaaaattcaagagcataaaaaaattgagaaaaagaaactcatgtgcatatagggatttttcccttctttttgagattatttattgggttatcgaaacggatatttgtccgacacattgaaaaatacattttttgcaaaaaaaaaaaaaaaaactttcttctactattaattcgttagggaaatttgttagattgagtcttatttaagttgtaattcgttcaataagatcaacaaggagaaatgaatctgatcaacaaggaaaaaactttcttcttcccaccggtgtgcccaccccctctgtgcatttctttctttctatctgtcgtctctgtgcctcgccggccgtggggactacggcctcgcccgcctgcgtgacactgtctcaaagcaaagaaaaaccaagcataataaaattttgccctaaatttgctggggctagtaatctgacaaataaggacagaacaaatcgtcaagtattacaaccgtttttttgacaaattggtccttgcaaaaaacttattttgaaactagtccctactaaaatctatatctagaaataggccgtcggctcagcgccagcgccaacgggactggcgctgacatcgcgccagcgtggcgggcgaggcgcgacgtggcagggcctcagcgccaatgcacttgacactgacaccttgcacaccctaaatagaccgatgtgctgcaatgagttaacaatgtcgctcgtggtgcaacggtaattttctttcttgctgtaccttaggactagggttcgaatcccaggtcagccatttttgtttttttttttaatcatcaatcaacgtgcgtacatattagtgatgatctccattttcgtttttgtcttcaaatcttcaatgtacttttttttgtttaaattaatttttattaaaaagaaatatcacatttagtacaaatttaaaaagtagaagaatggattaaaaaagtttagagacaacttttaaaagaaatatcacttttttataaaaaagaaattagaagaatggatttaaaaaaacttgagtttttttttaaaaaaaataaacaacaagttgagaactaagggtaagttttattctaaaatgtcacgtgttttaataaaattaaaacaacacttgaacttgtaaaagaaatatcacttttttaaaaaatatttaaaaggaataacacatttagtacatatttaaaaataaaagaatggacttaaaaatacctgagctttgaaaaagttaaaaccgcaagttgagaactaagtaaaaaaaaaagtttagtaaaaacataaaggagagggttcgaaccctggtcactgtaacgccacctttcaaatacctaccactgagctaagccaaacctaattgttgcttttgcttttgcttttatttagccagtataaaggccagcgccgctgtagaacatatattctgatatttatatttatatatatttaaaaaacagagagcatcattaatcatttatatgtactaatgtacgcacgtagattgaagatttgaagaaaaaaaaaagaacgaacaaggctgccgtgatagggagtcgaaccatggtgctagggtacacaagcaaatgatcataccattgcaccacaagtgcattgcttattaatggccgcgcatccttttaattagcctgtacaaggggtcagcgccaaatacattggcgctgaggccctgccacgtcgcgtctcgcccgccacgctggcgcgatgtcaacgccagtcccattggcgctgatacgaacaacctcagtgccaaagaggttggcgctgagccgacggcctatttctagatatagtttttggtatggactagtttcgaaataagttttctataaggaccaatttgtcaaaaaaaggggtattacaaggtcatatgcttcatgccttcattcacatacagcactgcaagctggtaaaaggaacgaattgtcgtggttctgccagttcattaagcattccagtgataaattcgagtcaaccacataaatccataagaaatgccttccactgaaaaatgtttgttttcctgtgtttacaaccagtcaaccaacatgctcttgtttgaaatttgtttcttttgtacaaaaagaatcagtaagccaaacccaaagactttaaaaagatactccctccgtttcaaaatatttgacgccgttgactttttagcatatgtttgaccattcgtcttattcaaaaaatttaagtaattattaattattttcctatcatttgattcattgttaaatatattttatgtagacatataattttacatattttataaaagttttttgaataagacgaacggtcaaatatgtgctaaaaagtcaacggtgtcaaatatttcgaaacggagggagtattatttaggggcatgtctcctctatcaaatttgcagcgcgttacacctagacaatactttgctccgatcagctacagctaaaatttgtggtagtcaggtttcagcacccatattgcatcatttgcacctccttgcaacgttgctgttggcttcagcaggttctcaaacagcagtatatccatggatagaatgtggttcttgttcttaaaaaaaagagttcttgacatgttcagctatgcccattgagcggaatgaaccaccatgcagttttatgaaggtgtagattggcagattaggacttcaggatgaacaagtatcttcctagtaggaggccttaaaacagttcagcagggaacagtgatttgcagacagagaatggtgctccaacagcaccacagcaccagctcgtccaatgatccaatccatgtagcaacagaaaaattgttactccatgataggcataaaccttaaaagcttcagcttctctttatgccgcctgtgaagcttctgcttcttctaggcgcagcttctgttaatcgttagcatgcattatgtccgcatgattgattgcactctgagaaaagtagaaaaaagggtattcttttcagaaacaaaaattgatccaaattatttgtgttagagatcataatttttttttcttacatgaatccctgagcacaaaaaagactcttcaaaatgttggatacttcgtccataccaggatgagctcagctcagtctcagaggttgtcggcgcagccaaagctgcacatagctgatcttattgcttcatttggaatcccggtattgacatcttcagacaattggctgaaaatatttgatgtttcagttcaatcattattgtcattgtcttgcagcgtgaacaaatccttcacatctctagctttaaaaaaaaaatcacctctgctaagagtatttcagtacttcgtttcacaggaaattcttgcatacctgctgatgataggctttctcctctatcgccacatctctaattttccccgtagtctgtaccacatataatttaagctggtaagtatggtattcaaatacaaatgcaaaggaaattggaattcaaacgcatagggggttcaaatgcaggcctccattgctgctgttgtaattaatcaacagaaaaataataatttgatcatacaaaatttcaaaaagcaaagcgctaatgtctagcgctgcctccacgggagacccgactgtatgtatgccgtatttgacatcttaacgtatttatatggatgcagcctaaccggcaggcgcctgccgtgccccgtaacgggaggggaccttatgactgctccatttttaatttttacagcagaaggtgtccgccaaaccgtggccacggtggggatcttaccgctgtatctagtcggtgtgggtgtctccggggaggcaacacaacagaatcaaccagagtttataaagaggtcgctctgtcgcaaaatcagcgaggtgggacaaaactaattgcgggatggattcagtgcgagccgaagcgcgtcgcgcagaccaagctaggagtagagacgaggcctacctgctctccacggaggcccggcggcaagggcgccgttgatctggccggagctgaagcttcgcgccgcaaggccgccgccgtcgccgatgccgcggagaccacggccgatggatgcgggtcctccaggagcagagatggcgcatccgcagctggctgcttgccgccggacgtcgggaagcgccgccatcggggaggagagggacggcaggacgggaagcgagatcgagccttccatataaggtgggccatgtggtaagattaccatgagtccagttcacgtcctccaggcccagttcacggctgggcagttttgcccccttttttttcttttttttttaatgttttccccaaggattgttgtttcttgtatgtgctcagattggtactggggttgtttggttagtactagtcattccgttccaaaataaatataccaatctagataagaatttgatataagctatgacaacgaatgcggacaggttatatcaaatcctattcaagattcgtttattttgtgattgataaagtatgctctatgtgtttcttttttttatgatcacatacactcgaccgtaattagttctaaatatgagcgcccatattaccgatgaatacgagcatttgtactaccactttgaacctaagtagacaagtattactgcaagaaacctacctacggtttgtttgttgtatcttcaaaattttaaaaatgcatcaatgaatttttaatgcgattatagagttaagcttaggaatctaattgatacaccctcgtctctacccctatacacaacctatttgtaccaccactgccacgagcttggggcgctaagatttggccaccctaacctcagccacgtgttgatgcaaaaaaacacatactggcctgggagatctatttagctccagtgtaggtccaaaggttatatgcggcgtgccagtcagtttgatcctacaattgacaagacatgtaaacaacatatcaaatagctgattggctgacaagccggtggagtaattccagtcgatagccgatgtcaatggggttttgagtaatcggctatatatcatatgtagataatgatgtaaagacaatcggctgatgataataaaatataaaaataatataatccaatagaaaccaatcggctaataataatatgagagtgtaagtacttatccgaaggttaaagcatacatcggctggaggtctgatgtcataaaatctaaacgattagataaacatccagataattcattggctgaaaccccgatgaaacccttattggcaatcaggaagcaggctagagattatggttctaaacacgacttagtatatcaaacttaacctatgcaacactaagtttgtaaagaaacacaatatctagactatcaagcccttagactgatttctcagggtggtagatgtctaagctaatttaatctagcaaggcgatttagtcgataccggtagaaaccctaaagcgagaaacaaccgatagagctaaatcaagatgctaatactagattaacagatataaatgataaattggtaggcaaatatatcattcaaaccagagcaatccaagaggtcgaatgtactgatgcagccatgaacgacgccaacgtagacgatacaattgcctggggcggcggaaaattggatttagcccttccccggagatcgaaaaccggtgcagccccgcgtcaggtgccaaattccgcagtgataaataaaaagtggaaaaggtaaaaggtggcgatgcgccaaattgtattgatcgtggagatagtttacaatgaccccgggtgtccatatttatacccatgggtagatactagtatttgtaggacaagaaagaaacttttgtaaagataaaaggaaactagcaaaatattcataattaatactccctccatctacttttaatagtcatatttcatcatagcacacaaactaaggataagtgattctacttatcatccatttaaacatgctactagtcattcctcgtaaacaagcgattcattaatatttacatttctcgatgcccatgtagccaatcctgtgtggaagaaggagagtcacgcattaaatccgagaaagtcattaagatgataggttgttggattgaaatatgtctatcaaaaataaatttttcagatttggaaatatgcctatcaaaagtagatagagggagtagataacttgccacgccgcatcctgattaatttccttaactgaatatagcatgaatccggctattgacaacgtgataattctcttagggacttaccaaatttcactgttataaaccaatgtaggtaagaatctgataaaagctatgacaacgaatgtggatagctatgataaccccctcccattcccccacacccccacctcagcgagttcaccggcggtgaactccgccgcctccggcgtccccccactccgccacctctgcaacgaactctccctgtcagcggcctctcccctctcctcgtcggcagcctctcccctctccctatcggcgcctctccacttctggcggtgcggagctcgatgctgggcggagcggcgatggcgacgacatcctctcccctctccccttccgcggccacgagctccggatctagcctagcgttgggcggcgagggcggaggtcgatcttggcggcgcaaatcgggtcgacgagctccccaacagcagcgtagagtgagaggctgcagccgcctggctcgaggcggcgagggtggagatggatctcagcggcgcaaatcgagtcgatgagttctccggcggtggcgcaaatcgagtccacaagctcccgacggtggcgcaaattgagtcgacgagctccccgatgatgttgcggagtgggaggttgcagccgccgtcgagctcatccgacggtcattgaggcctccgccatcgagctcatgtgtagtggctgtatgtggcgagggagtggcatggagaacggcttttacagctttacatgtgcccttttcatctttttcaggcgaggaactcgcctcttcgttgaggaatgaaaagctctgcgaaggtgtgagagcccacaccctctctccacggcatcacgaagtctacatggtggaacgaaggaacgctccagtgtggatgcctgagccaatgcaaaatactgtagttcctctgcattttactcttcaacgcagaggatctaaagtatttcagtaatactataatcttttttttcttctattggactcttcttaaattctacttttcaccgtaaactcaaaattggtaattttcacttcaaatttatattttttccattttgcatttgtggaatgaaatgctcactactacatgataatcagctcttgcttcgtttacagctgcagcaaacaatgattaatcggtgtcgtgaacatttaaagaaaaatcttcaaatcggggagaaaaaatgatcaaaagaaaaaaggaacagaactccagccgagggcgtctctacagacacaccatacttggtaataggacaggtgaaaatcacacgtggagctgcatcaagcaaatttttcattttactacggaacatcaagcaaaggaaaaacaactttcagaacatattttcccattaatttcaaagcaaaaagaaaaagggttatacaaactctgctgcagtctgggttctaatctgaactcgcaagaaaacagaggatatataaattggatttctgagaaaatatgcactgcatgtacaaatactgtttgccgtgactaacggtgttcgtatttgaaaagtattgattgctcacattgacaactgagacatcatcagcttgacagggcaaatacctgtagtttgctccacgcggtaacaaacgagcatgtaaaagcaaataagattattttttgtttcttcagccagccaaagttcctagcagctcattctccacatgctgacatgcaatggtgaggtgacatgcatctgtaaccatggccctctcaacttgtaacttgcacttcaaatggcacccccgcatatgtaaatgacctagttcacctatatttccatgagaaacatcaggatagcaaacctgtgtcacaatccagatgatgctgaggattgtcagcaacagcgcaacaaaatttgagcaatggttagggaactaaatatgagctgccatagatttgaaaagataagatagattcatacatttttaagcagttccgtgttcaagacaatctgctccagttagctatatatctctggtttcactatagctggagcctggccttcaataatgcactacaatttcacattttcacttgacttcagcaatagaaaccttactgcttggggtgtagtgtagcacatcgcagttacgccaatatttactccaactgccatggtctttgactacagagagatcaataaagtgctttttaatattaaaacaatttttgaaaaaaataattattatgtgagccaatcaaattatcatgttgtatttgtcaagtgtggaatgatgacgtgtttatgttttaaatgggtgcaaacatgtgacatttcttaatcttcattgctacaattcgccctaactagtaatatagtgtcgccatacatagcacactcaaagagcaacagttttgaaaaattattgttataaattgtgaaactgcctatttgattgttctatttcctctgtgcttggattggttaggatgtcattttctgatacattgccatcattcggttcaatttttcacccccagaccttcctgcacaactcattgcatgacttgtccaatgtgttatttgtcaccctggaaaattgaggacttacttgtactgacatgttgcttccataccgttacggtacggctacgcccagaaaaaaaaatcaagattactttcactttacatcagtagttgactaacttgatactttccctttcccaagtccaggtccaggtcaacgttcttgtgagttgtgattatccctgacgtggtgttttaattcatgtgcacataataggtggtttttgtgtcatgaatttatttccttacatgagaaccaaacagttcattttgcagagcccaaaggaagaacctcctctggccaaacaatgtccccttatattatccctctgtgcctgattctcttcatcatcaaagctagtcattccatgggagctcagatcaatgagacaaccattcctcaaggttctgaaatcaacacagctggcccccaaagttgggtctccccctcagggcgctttgcgtttggcttctatcccgaaggggagggattctccattggtgtgtggcttgtcactgatccatccaggttcatcttgtggacagccttcagaaatgatcccccggtttctggtggttcaattctgttaaccgctggtggttcacttcaatggattccacctaatcaaggattccaagggaaggtaatatctgccgcccctacttcggctacttctgctgctatcttggacaccggcaactttgtgttatatgacgccaaaaatcaggtcatatggtctacctttggtactccgacggacaccctgttaccagggcagaacttgcctcctggcaatcagctgttctcaagtgtctctaacaccaaccatgccacaggaaagtatcgcctttccaaccagccagatggcaaccttgtgatgtatccgataggcgcgatagatcctgatagtgcatactggaatactggtacttatgcacaaaactttcttctcactcttacactggatcccaacggcaccctatggctgttcgaccgaaatagtccatatagaatggtgttgtttctgactaatcagtcattgagtgcctccccagattcagagagttactaccatctgacattggatgctgatggcatactgcgactctactcgcatgtgtttttcaagcaaggaggagcgcccaaaacaaaggtcgaatggttggtgccaccgagcaatgatcgctgcagtgtgaaaggtgtttgtggtccaaatagcttctgccaagtaactagtagtggagaaaccagctgttcctgccttccagggtttgaattcttaagtgctaaccaaagcactcaaggttgctggagggcacagactggtggttgcaccgggaatagccctaatggtgacatcggactggtagccacaatggtcacggtgaagaacactagttggtcagataggtcatacaacgtcccacctcaatcaccaaccattgaagagtgtaaagcaatttgcatgtctgactgcgcctgcgagattgccatgtttgactcctactgctcaaaacagatgcttcctataaggtatggcaagagggttcctggtagcaacaccacgctatttgtgaaggtctactcctatgaaccaaaaaggactgcaagtgcaacttcaattgccatgttgacatctggcgctgccctcggcatgctctcacttgtactgctctcggtgtctgtaatgctatgcaagcgccggccatttttgaggtacacacgtgctccacaacatcatgaaactgaatttgatgaggagagcattggaatccgaccatactctttccatgatctagagctgtcaacagatggctttgctgaagagctaggaaggggtgcatatggcacagtgttcaaaggtgttctaacaaatagtgggaacaagggcattgcagtgaagaggcttgagaggatggcagaagatggggagcgagagttccaacgggaagtgcgtgcgatcgcacgaacacaccataggaacctggtgcgtttgttcgggttctgcaacgaaggtgcgcatcgccttcttgtctatgagtacatgccaaatggctcccttgccaatcttctcttcaagcgcgatgcaacactacctaactggagcaacagaattgcgattgcgctggatgtggctagggggttacaatacctgcatgaggagatagaggtgcctataattcactgcgacatcaagccagagaacatactgattgacagctcaggaatggcaaagatcgcagattttggcctggcaaagctgctgatagggaaccaaaccaagaccttcaccggtgtccggggcacgcgtggctatctcgcaccagagtggagcaagaacacagcgatcactgtgaaggtagacatctacagctttggcgtgatgcttctggagatcataagctgcaggaagagcatggcacttaagttggccggcgaggagtgcaacatctctgagtgggcctacgagtacatgttctcaggtgaaatgaaagaagtggcagccggcaaaggtgtcgacgaggttgagctggagcggatggtgaagatcggcatttggtgcactcaaaatgagccagtgacacggcctgtgatgaagagtgtcgttcagatgatggaaggaagtgtgaaagttcagcgtcctccaccaccagcatcattttcacagtcactacgctgaaatcatccagagtatttcatgtcctatactcctattgtcttaagtcagaaggcaaaggatgacaaatcatctagagtatgatcgaaattgtgcgtcttacggcaaaactgctagcagtaagggcatatcaaaacatcaatgtatctcctctgctacctatcttaatgtctagttgggtgtttattgtaagattctttcaagaaattaaacttctctcggctaaatacactgtttttggagtattatatatggagtaatcgaactatgcatccaaaggatggaatggtcaaattgcaattggttcgattaacccatgagtagcaatgagttcaacagaaaaaaaaatggacaaattgcaattggttggattaacccattagtagcaatgagttcaacagagaaaaaaatctaatgttacaaatttcaaaaagccaagcgctggtgtctagcgctgcctccaccgagagacccgactgtgtgcctctatagggcctcttttcggcagggggtcgcctgccgtggggatcttttcactgctccattttttttttttttgcagctggccggcagggggtcgcctgccgtggggatcttttttttttttttgcagctgaaatggtagggcggatacacgccctaccgctgcccattgcagtcggggtgggtgtccctggggtggcgatggagtagaatcaaatcgagctaataaacaggtcgtgttgtctcagaatgggcgatatggtacaaaactcataaccggatggattcagtcggagccaaagaacagcgcgcagagcgacctagggctaggagtagaggtgcgtggcatacctgctctccactccacgtcgagggcgccgtcgatctggccgtgctggtgaagtttcccgccgcccggccgtcgccgtcgccgtcgccgtcgccgctgacggccggatccagattctccggcagcatcaccagctggctgctcgccgccggtcttggggaagcggcggcgttgggggagagtgggagaggtcgggagcgagcgagaagccgagaaggcatatgcaggatgctgggccatgacctaaggacgatgagtccatccttctgacgacgcacgtggggctcgagccgaagctttcccaggcccagtttgctactaggctgatttatcttgttttgttttttttttagtttcattcgcgtccttcaaccacaaagaggtatatagcatccgtcaactgtcaaaatcggaacgagtatcatagttgtttaaatgacggtttcgactgatttgatgcctacctaaaatactcttatggacatataagtttaatagttgatttatatcattagaagtttcaaaaaaatataaaaacttttatgtggccaccttacacagtataaaagtttaagttttaattttttttcatttctactttttaaaaatataacttgttttttatatgatatataaaatattttttgtgttgttgtttttaatataaattatctttcatatgcaacataagatattatcttttgtgtaagctatttctatctgatataccatacaaaaatatttttttaaaaaaaaatatataaaaaatgaaacttatgtacatacttatctgttgtgtaaggaggccatataaaaaatttcatattttctgaaactttctaatgagatagagtagattctctcaactttatatacatatataaaaagtttatatgtatgtatgtaagtatatacatatgtacatataatatatattatgtatatacttttgatgtataaaaatacatatacatgtatacaaagtttgcatctaatttaaactttcaaatctttcaactcgaaaattttaaaaaattaattatgtatagattttaaaactttagattctaactttttaactttcaaattcaagttgaaaacttccaactcaccaattgattttattccttgttaaggacgtaggattgcaacgtcgatgcgacactaaacatgtcgtaggtgcgtctccttttgctacctacagtggcggagctagcgtgggggcggagggggcttgagcctcctctaccccgctggactccatagagttgtgagggaggagaagggggaaaagaggtagaggaagaagaaaatggggggagaggggggctggagggcgctcgatctccactttttttttctttttcttcggtttttctcttcatcatttctctttatttctttctcccattcttcctttctctttatttttttctcccattctttactctttttctagaaaaattaaaaataatttggtgaattgaagactagaacccatgatctcatggtttacaacaaactctctcaataaattcaccctatgaccctgtgtgatttgagatcagtgtttgttttctttgtatatctgttcaaattttgtgaacacaaacccactatgttactatatgaatcataccttgttcggtagtaacaatcgcatatgtgcagtaacacgacacgttactgcgagatttattaatagtttgaaacattaagtattaatagtttgaaacttatatttttctttaattggaatataatcatgtgatatcttgttataacgatttaattccaacaaatacaatggtggtggtggcggcaatggtcgccaaaacaactccggcggcagcggttacggaaattcgggtggcaacttctaccaacagcagcaggccggtcttcgtcctgccggcccgtggttctgcttcaatccatgggctgcgcaggcctctacatggcgccctcccagcaatcccggcaacagtgctggcctccttggcccgtatcctcaagctcacacagcttttgccggttcctatgtgtctccaccaactccaggatggcctccaatgccgcaagtccagcccaactgggaccaagctggtcttgttgctgctcttaatcaactatctgtgaacagtccaagtccatgggtgcttgacacaggagctacttcgcatatgtcctcgaccgacggtattctcgttacacgcctccctaactctcatacctttattaccattggtaatggtcatactattccggttatatgtcgtggtacttcttttctacctataggaactactaggtttgctcttaaaaacatccttgtcgctccctccttggttcgaaacttactttctgttcgtcaatttacccgcgacaacaaatgctcaattgaatttgacgagtttggtttctttgtgaaggaccttcaaacccagcgcgtgattcttcgttgcaatagtcgtggggacctctacactctacctactgccgtccctgccatcaccgcccacagcttcctcgccgagtcatccactttatggcatcgtcgccttggtcaccccagtccagccgcagtacaaactcttcataaattagctattctttcttgtactaggtctaataataagctttgtcatgcgtgtcagttaggaaaacacacgcgtcttcctttttctaggtctttgtctagtacttcttccccttttgagcttgttcattgcgatgtatggacctctccagttttgagtttgtctggttttaaatactatctagtggtgcttgatgatttcactcacttttgttggacttttcctcttcgtcataagtccgatgttcaccagcatctcgtcgagtttgttgcctatgtcaagacccagttcagcctacccattaaatgctttcaggccgataacggtaccgagtttgttaatcatgccacctcttctttttttgctagccgcggtatcgttcttcgcttgtcctgtcatacacttctccccaaaatggcaaagccgagcgtgttcttcgcacaatcaacaactccatccgcaccctacttatacaagcttccatgcctccttcctattgggccgaggctctagctactgccacatacctactcaaccggagaccttccacctctgttcgcaattctatcccataccagctcttgcataacaagcttcctgactattccaaccttcgagtctttggttgcctttgttatcccaatcttagtgccacgacacctcacaagctctcccctcgttcagcaccttgtgtctttcttggctacccggcttctcacaaggggtttcgatgcttggacatctctactcgtcgtctctatatttcccgccatgtggtttttgatgataagacgtttccctttgcggctattccccaggatgcctcgtcttttgattttcttttacagggtttctccaccgcggtagctccctcctctgaggttgagcgtccgcgattttcctcggtgactccctcccatgaggttgagcaaccgattcccgacgatgacacctcaggcaccgaacttttccagcttctgcctggacttcggtcttctgctgccggccgtcctcttgtcggcttgcctgttaacgctcgacttccgggcgggtgtgctaatggtgccgctaatggctcttcttcaagcaatccttctccggttatggatcctcctgctgcttctgtcgttcgaccagctccatctgagggaccaaatacatcgctgatttctccttatcggcacacctacgtgcgccgatcacagccggcacctgcagctattcatggcccgattcgctcctctcgagcgttccgtagtgctacagatcaacagcagcagacaggtcacaccatggtgactcgttctcagaccggccatctccgacctatccagcgtttcacttatacagccactcatgatgctgtttcgccggttccttccaactatcgcagtgccctggccgatccaaattggcgtgctgctatggctgacgagtacaaggctcttattgataataacacctggcgattggtacctcgtcctcctggtgccaatgtggttacaggaaaatggattttcaaacataagtttcattctgatggaactcttgctcgtcacaaggcacggtaggttgttcgcggctattctcaacagcatgggattgactatgatgagactttcagtccggttgttaagcctgctacgattcgtgttgttctcagtattgcagcatctcgttcttggcctatacatcagctggatgtcaagaatgcttctccatggcaacctcgaggagactgtgtattgtcaacaaccatctggatttgtagatccctctgcacctaatgctgtttgtttgctccagaagtcgctatatggattgaagcaggctcctcgtgcatggtaccagcggtttgcgacatatattcgtcagttgggtttcacatcctcagcttcggacacttctctctttgtttacaaagatggagacaatatcgcatatttgctgctgtatgttgatgacatcattctcacagcttcgtctgctactctacttcatcatattactgctcgtcttcactcggaatttgccatgacagatcttggtgacttacattttttcctgggtatttctgtcacacgatcttctgatggtttattcctttctcagcgacagtatgcagttgatttattgaagcgagctggtatgtctgaatgtcattctactgcgacaccaattgatgctcggtctaaattgtctgctacagatggtgctcctgtttctgatcctacagaatataggagtcttgctggtgctcttcagtatcttactctgactcgccctgagctcacttatgctgttcaacaggtgtgtctattcatgcacgatcctcgtgagcctcatcttgctcttatcaaaaggattttgcgttatattaagggcacacttcacattggtcttcaccttagaactacaccagttaactctctgacagcttactctgatgctgattgggctggatgtcctgattctcgtcgctccacatcaggatattgtgttttcctcggcgacaacttggtctcatggtcatctaagcgtcaaactacagtttcgcgttctagtgctgaggctgaataccgagctgtagcacatgccgttgctgagtgttgttggttacgacaacttctttccgaacttcatatttcgcttacttcggctaccgttgtttattgcgacaatgttagtgctgtctacatgactgcaaatccggttcatcatcgccgaacaaagcatattgaaattgatattcatttcgttcgagaaaaggttgctttgggacaggttcgtgttttacacgttccttcctctcatcagtttgctgatattatgaccaaaggcttaccagttcagttatttactgagtttcggtccagtctttgcgtccgtgataatcccgcttcgactgtgggtgggtattagaattagattagatttgtatagtctaagtatctctcgtatatgtatatatctcttatttaagagtttgttgtaatctctattgtatttggctatataaatataatcgccccccccacgttgggttgtgtggcgtctcataattttctacaggcaattctggatctagctaattagtaacattagagcaggtacaagtacaatagcaggctaagccagctttaagtatattttaaaaagataaatgaagagagaagagcagcgggctacaaatctgtagccagctgcagcacggactccaagacgtaacgagtgtatgacaggtgggaccagatattaatagtatagtaagtaattattgtatgaattaactattacattggctataaatgatttggagctagtagtaggctatactattaaacttgctcttaatgaaaagtccaaacactagcacaaataaaaaagtttacaattgtttcttaaacacaaccactctttaaaaaaagaaacaagttatgaagagcctcttatggtttgcatctttgttgcaggttgattactttgccaggatctttccaggagtggctcatggctttgcttgcagatataacggcagcaacccgtttgctgtcagaactgctgaacaatctcttgccttaatgcttgactggtttgagaaacacttgaaatgacaatagctaatcatgcatgcaatgcaaggccagtgcaattgtttatttccatcaaaatacattgccagtgtccatgtatatcctggtgttaagtgaaacttacataaataagcactagtgtaaagtgaaagtacgtgttgaatatggtgcgaagtgaaacaaagtgtactttatgaagtgcaaaatgcaaactccttttgttccgaagcgaccattagcatggcatattaaaacatcagtttgtaggagaacaaaaataatgtgtgcctctgttgccattttaacaagtcgatatgttcaatcaaatgttgtatgctactcatcttaagcacagcatatattgggtacctcttgactatttcttatggccacaaattagacagatgaaagtcgtgtttccaagaaattgctggcccttaactaggatggggacttctcctgaagctgtagaggaaacaaggaattctgattccaaccaaaatggatgggtgatgaaccatttgcgtgcaaaacacagaaaacattcccagtatttcatctcctattgtcctaagtcaacaggcaaaagatgacaaatcatccagccaggttgaacagttaaaaaaactttttttgtttgaaaaaaagctaagatttaatgtcctccagggagttaggcatacctggtctcgccggaagccagtggcgaggttgctgtagatctggccagagctgtgttcacatgagcatatctccacctcatcctatatatgtgcgccgccacatccagtgccaccccttggttgggttccatcgaggaggtcaagggagattcatgttgccttaagcttttgacaagggtcgaggggcagctctttccagttcatgtaggtgcagaaaaactatcacaacttccgagcatccaaggttggcgtgtgaagcttctgtctctaggtgcagcttctggtcgtcgttggcattcatgattgatcgcactctgagaaaattaaaatatattttagaaacaaagtgttgaggaaaaccatttgccttagggataacaaattattgcttacatgaatccctgagcatcataaagacccttcaaaatgctggattcttcatgcacttgggcagagtatggtatattttaccctttgaattcctggatgaatttggtcctgtcccggaggttataactaatcttgttgctagtcattaggaagcttggtgttcaaatcttcagaaaactggctgaaaatattggattttaaatcaaacctttactgtcatagtcttgcagcgtgaataaattcatcatgttgctggctttaaaagaactcctctggtgagtgcctttcagtactttgtatttcagaaaatgctcgtgtatctgccaatgatatagacttactcctctagcatcccacttataatcagtctatatactgtcatatctctagcttgccgaattctctatgcacgttcactagcctaatccacagagaatttaatttgttaagtagagtagaattaccattaaaaacaaaactacatataaggcaaaactcagtgaataaatgacaaagcgttaccatgctaacaatagaatcggtagagtatgatagaaaattattcatctaccagatcatctctcactggcatccaaccaaaacttggcaatgaggttagaaattttgcatcgtacggcgacattgtagcaataagggcatatcactagcatccagtcaaaacttggcaatgaggttaaaaattttgcgtcttacggcgacattgctagcaataagggcatatcaaaacattaatgtatctcctctgctaccatatcttaatgtctagttgggtgtttcttataagattatttttccttttaagaaacagaaaatctactacacggtcttcccgttgcaacgagagaaactaaatgcgcgattaattcgcttcttttcatcttcatcgtctgatcgtctgattatctctttgaccctagggtacaacaacctagcggctgcgctgctgctggacaatgccatcgcggccgtgagaaacaggtgtcctctcggcggtagccggaatgggcagcggcggcgcaacgtcttccggcatgaccacaaccttaggcctcctagacgcctcctcccagaggaagggcacgccgacagaagaccgtagcagtggcgtcgtgggttgacagcgcgtcgaggtccagcaccttgcttgtccgcgaccacgcgcgcgccgacgcctgcaggcacagtgccacctgcgctgccgctggacggcacctgcaggcatgcgtaatggggagcgccatgctgtgggcggcgcgggtgttcgtgttcttctccaccgccatgctgataccagtatgacagctgttacctgatacttgtgatacctggcacctcgtacctgtggtatctggtacttgatacatgtgacacctggtacccgatacttgtgatacatggcacctagtacctaactagtacccgatacccccgatatttgtgatacctggcacctagtacctacctagtacccgatacctgatacctggtacctgtggtacagtatggtgtacgctaattaattacacattaaaattgttccgtgacttcacttttccacggtatcccgtgggctagctgccctctttaagaaattaagcttctctcagactaagcaatgagttcaacagagaaaaaaaaaatctaatgttagaaatttcaaaaagccaagcgctagtgtctagcgctgcctccaccgagagacccgactgtgtgcctctatagggcatctttttcggcagggggtctaatgtttattagctcgatttttttttttttttgcagctggccggcagggggtcgcctgccgtgccccaaagtaggggatcttttcactgcatttttttttttgcagctggaacggtagggcggatacacgccctaccgctgcccattgcagtgggggtgggtgactctggggtggcgatggaatagaatcaaatcaagctaataaacaggtggtgttgtctcagaatgggcgatatggtacaaaactcataaccggatggattcagtcggagccaaagaacagcgcgcagagcgacataggaggagtagaggtgcgtggcgtacctgctctccaccccacgtcgagggcgccgtcgatctggccgtgctggtcaagtttcccgccgcctggccgtcgccgtcgccgtctccggcagcagagagggcgcatccccagctggcagctcgccgccgatctgggggaagcggcggcgtcggggagagtggagaggtcgggagggaggagacatcgagcctaggggcttttaactatttgccactcttacgaatggtccttaacgatttgccactaggcccacatgtcatagacacatgagggcccacgtgtcattgacagagcgtggcaaatcgttaattgccatgtcacaagagtggcaaatagttaaatttccctcgagcctagctcccatcgatgactcaggtatactatgcaggatgctgggccatgacctaaaaggacgattgagtccatccttctgacacatagggctcgagacgaagctttgccaggcccagtttgcttctgggctgatttgttttctttcgtttttgaaaggaataagttcattttaggtcccttaacttgacagctagttcgattttcgcccttaaaccgcaataccagataccgttggactgtcaaaaccggtgtaatataggtcccaaggtggtttggatagtggttttagcccacgtagcacgctatgcggctaattttgttttgaatgaagtggctaatttgactcggttttcatctaacatggcatatgaagcaaaatttaataatttaaaaattaaaacaaaatatatgagcccatgtcaatcaaaaaataattcccagatggcctgttgaaactgaactcgattagaacaacagtttgagtttctccatttatttatagaatactggtttccttcaaatatgcatttatccatttagttttacatttatttttttttatcttatgcatatgtcacttgtgaatatgaaaaaaaaaatcatccctcagcctttacaagattttttctacctagtattataggtgattaattttaaacaaattggagagtgaaataacatgtactacggtagctctttcactttctgccatttttcccctattgatgaatatgtacagctttcgttacatgaaaaattttcaaaatcattacttgcttcaattggttggtgataacatcgaagtttcctacgcatgctcacaacccagtaaagcatggctgaagcctactgacactgaattttgtatgttttcttagaacttctttatttcccatttaaacttatgtaaagatcatacatttgaaagtagtgggagtattgtgttaattgacatgtagttttacttgtacaaagtgaattttgaatgtgtttgacaattgaggatagacatatctgagaaataaaggtgtattttttaatgaaatccttaattatttttatgttttctaaaatttctagctaaagttagagcaaatcgataatttcaataggaacagttgcacttttctttcttagttatgcttatttctgctgctaattttcttttaaaaaacacagcaaaaacacatattctcacaacgttgctgcttattttctagtatatgcctgaatctaaaattgatttatatttttctttcttcttcccctgtcatgctgtctgctaggccaattggcccatttaacgtgtgcagtttggttcataggtatattggataggatatggtcatccatacttgcaaggatgtggtgctccagttatttgtttagttgtgtggatatggatccagcttcttgattggtcaggtggatgagaatggattgaatgaaaacaataacatattaattaataataaaatatgttaattatcattgatatagacataatttatactaattaataacagaatagactaattatatctaatcaaccctaattttgataagttaattactaactaacaacaaaatacattaattattgctaatcaattactaatgatcaagattagcaattgtggatatcctcatccagcatctctgtggaatgttctctctccgggccgtattatccatccttgcccaccacctagacatactaaattaaaactggatcatcatctcccatctaagatattcctccaaccaaacacacccttagcactacaccagacccatacagaccaagctgcccacacttctgcttgtgccagccagccgcagcccgcaagtcacgcagcacggtgccagattcttccatatatggttttggattctttttatttttgtccctgacaactcgaatttatctttataggcaccacgtggaccaatcagatgatgacataacatccaacattagatgtatagatagattagagaggcaacacaccagtgatttggaggagaagaagttcctctcgaaaggaatagtcatttagtagaagagatcatggctctaagccctccaagtttagttgtaagagccccgctccggtgctttctacttgcagtagaaagtaatctaagccgttgatcgtgtttaatcgtagggttgagatctagttctactcccattagagttagtggcggtagaaatgtggaagggtatatttgtcaagagataataattttcgtagggtattatcgtaatttatcagtataattcccgtccatccctctccttcatcggctgatcccctccatcccgcctccgtcgctgtctctcactcccgcctccgtcgcctgtcctggtgtctcctccccatccagcgttgtcgcctcccccaccctcgctgccttctccagctcgctgggtgcgtccatctccgcgtacagcttcgtcgtcgcggccacgtgccgctccatcttcttgaactgattcgtcgcgcccctatagaacccaaccgtcgcgtccagccgcgcgagtccgttcccccacttcgcctcggcctagacacggtcgaaaatcgtgcaggaacggcgcgccgtgcagcaccgcgtcccgaaccgcgcagcgctgccggcggcgcggtcgaggtccgccacgacctcgccacacgcgagccagagcaggagcgactggtccgtagacgtgatgcgcgcaacgccctcggcgcgcagcgtgtccacgcggagcctcctgatctccacgtcagacaacgagcagtagagcgacacgagccgcgacatggccgccgccacctcgaacgccaggatcttgagccccgcctcctccctggcgacgccaccgccgccgaaccgcacacgcagccatgcaggttggcgagccatgacctcgccccagcgggcatgccaaaaacctcacacccgacacggcaccactttacttaccaagctcaagagcacccaacgtaacgagcagacgcgcagggcagatcaaatatcaccagtacgaaatcgagatgggatagctcatgcggattatgcgtctaaacagctcaactcgcaacgacaagctgatacgcgagctcagctcatagcgataaccttttttttacggggaataccgatagctgatgcggcgtcgggggctcggggcaacgcaacctgatgcgaacaagcgaccgagaaagagaaacatcgcatatcaaaattacccctaatctgtattaagagattactaatataccctttaaaatatacggttgagattaattctacttgcagtagaatactgcaagtagaaagcactggagcgtcaccctagttgtaaatgggcaccattctttgattctctcgtgatgcatatatacattacgaagaatgtcaaaatataactactggtgtgaacatgaagttatggttgtttggtttcattcatcaaggttcaaatctttatgtccatatacacatctcgcatgtgtattttaattggtgcagagaggcggtcattctatttctcttgttaaaaaaaaaaatcaaactataaccatgtgttcgccatgctttataccttccatacaaaacttgggtcataaatgtgagctgccaaagtgatcttaatggtttagaagtaagttgcttcctaacatggctccattatagaagaagaaaacaatgtttcattcatctcctttaaaccaagatgaaattaagaagccctcttcctagttgcgggccaggaagcgactaaccatttgtggacaagcacagccaagtaaagccccaaatctcatattgttgtaggacaagataaggttgacaacacacccaggttttgtccatgttgatgatcaattagtttggttgttcaactgtcccgattaacatcttcaaagcaaagcttccaacagaccaacagtacattgaatgaaccgaacaaaacagaagagaatagatggtttctttgcatttaagttttattgtaccacttcgactcatttgtattcaagttttacgaaacttcttgattaactgaaaactgggctaggtatacttagcccgaccaatcagatatgacttttcacccttcctttttcaccaattaactaggaaagtatcccgcgcatgcattcgtgtgcggggatgcatatattagtttgtttcaaaaacacatcaaaatctaaattaaaagtaagatgttttcctttattctaattgaatgttcattggcactctttctttccataagcaatctcgatttttaccgctgatgaatgtattttattataatgtcaagctggacatccctctaataggtttaattgcatatagtttacaaaattggaggaaatatcatctcggtgatatttgacaccataaaatatgatgagaaatgcttgaaaaattattatgacattggttattacatatcagcatcatgtacaatcaatggttcatgtaagtaaaggaatacaacggcgaaaatggatcgtaaattggatgtataatttaaatgtacgaaagagcatgtagcctagtggttatagtgacctgagtagtaccccatggtcctgagttcaaatctcctatggagcgaatttcaggttgggttgttcgcggggctaagttccctatttcaatggccgtatatatccggttggatgtagaggccgggtaaaaaatacccttctctaaaaaaaatgtataatttaaatgtgatgaacgttcaaagacaatgcttctatattttattggattactactcatgggttttcttctgtttgtcttgcttaacactgttgttgtaggtgattggccctatgtctggctcaattatgaattgattccaaaattgtagtgaatatgacatgtttttaatcaaaatatagtagttaaatagtttttctatggaaacatgttggcaccttatccaattgcattgtccagagataacaatatgcctctaaagaaaatgtaacagccagagaggtaccgagaaacacatggaaaaatgttcactcgaacatcaatcctttgcaaacattgagttattatgggtttttgatattttctccttataaggtctaatttagctatgtatgtttgtgaggaagtatatgatgaaataatatatgctgtcaaatttctgtgttattgtaaagactatttaatttgatcaagaatgataagggaagagctagaatatggctccgcgtcatttttttaatcaaaacatagttaattgtgatttaatattttcccttttatgtttgagggttcgggacttggtggtagggtaggtgttaattgcaatatcggagataaagatgggatcgaagcggaatccacaggataaatcgtatcgaaaacagagtgggaatcggttggagtccgaatcggctatggacaggatcggcagagtttgggtcggacaaggttagcagattgagccgattcttacaacacaactcggtacatatcatcaggttgagtcaaagtgcttcatacggattgccacgtacggattgagtcctggaaaggcaattgtatctattaattagggtattttgtataatttccttatagatatgtttgggcaaaagtctgccgcaaagacttatggtatcttagagtttgttagtgataagtgtcgtgtccggcaaggacatgttttgtatctcgggtataaatatgacccgaacccatgtaaacagacaacaatcgttcaatacaatctcggcgcatcgccacccttttttactttcgtttatttcgacgagttcttgctttcgggttgagctgcatcgatttcgatcttcaactagaggtaaagcttgttatggcagcttgcattatcggggttaatgcttccatctttatgatactttaaccttgtttatgtaatccatcgagttatcacacacatgttacaatctatgctagttgcgttatataacttgttatcggctggttcttattgttaggaagcaattggtagagttatgttttgttattaatttaggttgtatcatgtatccaccatctcttataggttttcatcaccttgcttagatctcatacttgtctttatgtttaatgctgcatcggttgagttcgatctattaagtgatatttataattatgatatctggcttgttttatgatcatcgagagagatagtattggggtttcagccgatcttacctgacttagctttatgttttatatgcttgattgatatgctgtctgccatttatattaagatcttatctcaataaagtatattaggcttttgtttgatatattctatctgttttaatatcttaacatagagtggtatcggagtactagctgatacatgccagatctatctgatcggctatgctataagcgtttataatcttcatgttaatgtatatttcgatttaagtgatttatactgtctcggcacgatgaccgatctatcgcaatcacttggtttaaatatacatcaacagaaagattatatagtgttaatatctacagccgatcgagtagatttagtcttaccttacttatttataactgccgatcgattcacatatgacatcggcttgtaaataaatgatatgtcatcggcggctggccgatcggctatcgtttatggatttaaccgcggtttcttttgtctttatttcttgttgattgcaggatcaaatcaactggcacactcacgaacctaaaggcaagattttggacttgcactgaagttaagcagatcttctaggccagtgtgtgtttttcgcatcaacagtgggatatatatgtgagaagtgtttttagttatcgcgcaatccaagtacgctttaacacatttttttgttacattataaatttatgatcaaagttacacaatttcaaagccatgaaaataatcaaacataacatattttgaactcaaacggactacttcaacaactaccccctcaccattttcacagccaatcaaaacaattaaatgcgagaaaacatgacaactctactagaaaaaacgattttgaccaacgtttggccttttatttttctaggaggacaaaaagatactctcttatagcctttttgtgaaaatacctaaagaacctctaaatttagccccgcctacaaaaaaatcaatttttcagacgaaccccttaagagatccgcctataaaaataacattatttttagggtttgttggaaccatgccctatatttgcaaaatttgagatatgccacccgtatctcaatgacatgtaggacccacatgagtcaatgacatgtgggtcagggtggcatatcacaaattttgcaaaatttgtgtggcatggttcaaattcaggcggacccccttaagaggttcgcttggaaaaaaatgatttttgcaagcgggaccttaagtgatccgcctgcaaaaatacgataacactataaaatttgataaagtcccagcggcatccttcacttctctccctctccctcactttcctctccttcccatctccctctcccttcccctctaccggacacgtggcggcgccggtgctggcccctcccctccctctccctccggctccccttccttccctcccagatcctgcaaaggggagaggttccgatggcggaatggccggaggaggggatgacggtggcggtagtgtggctccctccctctccctcccagatctggtggaggggaggggcgtcggtggcggtgcggatcctctcccctccctctccctcccagatccggcgggagggaggagcgcctgcggcggcagtgtggctcccctccctctccctcccaaaaccctaaccgactgtgcttgagagcaccagatccagtgggagggaggggcaacggtggcggcgtggctagaggtgtggcggccgtgcgactcctctcgcctccctctccctctccctctccctctccctctccctcctagatccggtaggggaagggcgtcagaggcagcgcggctggaggggagggcgatggcggtgcagctcccctccctctccctcctaataccctaaccgactgtgctcgagagcactagatccggcacgggcggtgctcttcccaagcgtgcgacagtgtcgacggctgagggttgcgacaacgacgacgccaggcagcatccacggtcaggctcggctcccggcctccatctcctactgctcctccagtccttttcccttccctcccagatctagtgtgcgatgcaatttgtgaatttggaatcgaatttgtgaatgtgaatactatgaaagttttgtgattaaacttggggtttgattgagattcgatgcctggatgaggagcagtgtacgctgcggattttttttatcactgaaaaatgattttttcaagcggactgtataaccaagccgcatactaaaattgatttttccaggcggacgatataacctggccacctggaatgttgattttcgcaggcggtcgagacgttcgactgcgaaaataccggattttcacatgcgacgtgtctggcagcttgcgaaaaccttttttagccgccaacgaaaatgatttttctagtagagtactactaaagttaaaaaacaaaaagataatcgcaaacctagggcgggagaccgggactactactccacgaggtaccaatggtcaacaatctgtatcatgccttcatatgcatctccctcccatagtctgcctacgtcatacaacacgttgcgtggttactgcagacgtcatgcgtttctgcactttaattattattactacgactcttccatctccgtctctccatcctctttcccggatcctgctttggattaattaataaactcattaacaaggcaaataaaaacgcaaagcgatcgcattagcccccagttgcatgcgcttctgacttggatcgcagcttctgcaaaagctcatgatcatatgccgggctttacttagcacttgcacaagttgagctgcactatccatcagatttgacttatctcctagctccctcataaagtaccactagttaataagaaattaagtatttttataaacgaaataaagaaattaaagatgctcaaatcaaatcgatacggccttgatacactctaaaatatactttttttttatgattttccttaaaacacaatgcaaatacaaacgctttgttgaaattataagcacataataatttaatttattccataaataaatcatgacattgcagatgtaaattagatttaacgcatcattagatctacacatgtaaactaagcagtaaaacatgaatagatcaaatatgtgcaacatgtcgaacacgtaccgaggtgacggaaagaccggttgctcggcaactcgcggtttcgggcgtcgacgaaggcgcgcagcacgcgagcggagaggaagacgagcgtcgtggacgaacagggagcagtcgcgcgaagcgcttcccaaaaaccttattgccgccttctcccggtgcaggacgtcgaaggcagaggttccggagacctgctctcctgatcgccggtgcacgccggcgaacgggatggagtagtctacgagcgacggcgcagtacagagtagtaggcaaactctagattgatttcgcgtgtgttgcatgaaggcggcggctcggtttatatagagataggtcgcttgatcagagtgcccacgtaaccaaaccggataagttgcgtgtaatttatccatactccacgctgttttcacgcaccggatttttcggaatgtttccaaaacaaaacaaatccgaatttcctgcagcaaaacaaaactgcaaaaggaggctgcatctgcgcaagggtgaggagccaattttgcggaccattcgacgcgtacgtcgtgcacgcgccgcctaacctgccaggcgagcgagcgcgcacgtgtgtttcccctcttctctccatcacacatgcttcaagtggctaggagggcatcctcccttttaaggaggtccccctctcctagaataaccaaggtggtactaaactgcacatgcatgtcatcccatgaagtgggcttttgtgattttccaaagaattaatcttcgaatgggccttagcccatctattaattccaacacgcttatattcacatgcgtacacctacatcttagtcctataaacatctcaaaaaattaaaggtatacctatatttatggtgccacatatttaaaaataatagtcaaattggttttacactatgatttgcctacacttacatttgagttatgctcaaatttcatgtttgtcttctaattatatgcaatattgagaatatcattcaaaaaaaataatttccatgccatgccaattctactaatgttattctaaatatcacatccaactatatcttatgtattagtgagttaagattttgaaatctgattacgcacgttcttaaacgtttcttcggaaaaaaaaactacatctaaatattaaataagtaacaggaagtatcttacttagcctagctaggtaggtgtattatattctcgtaggccctaaaaaggattggttaaacaaaatcaacttgataaaagcgatacatacatgcacttgcaaagaagggacaatgcacagagtgaggaaattgcgcggtcaatggctaatcaagctttagctttagttgaccttgaccctaccactattttaggtcagcttcacaatccaattcagacactgttccttgtctaaggttctcatttcgaggtatacgtttcattgatttctcttgtttgtatttagttggtgtagcacgttgttttttgggaggagagtgagtgttgaattgtttttgaaacaattgagaggatgttgaattgtgattagggccaattaaggactttgttgtagctcttggcttctagctgcaagtaagatagctgaccggttcagcactatgacaaataacaactaaagtcaatggttaagttcatggactgttgaggcaaaattgtcaaacagagataagaatcaaacaaatgtgaactactcctacttcatctggacaaaaaaaaaattgccattttatatgtagttggagtaaaactttcaaaacttcaaccatcaattttttttatcagttatattttcatgacactagtgttacaatttgatctacgtttgaatatacttaaagaaattggtggtcaaaattctaataaaattcctgaccggagtgggtatactaatcaaagaaagcacatggaacctctgaccccaataaacaagtaatcaaaatctgaccccaataaacaagtaatcaaaatcaaagcagctgctagcagcacacatatactatttatcttaaaagtggatgccccaaatggagataatcatgatggttattctctttttaattatgcacatcatgtttctaggaacctctcgccacaagtttcaaaggtttgactttgaaggcaagtcacattacacatctccactctcctaccaaaacatgaagaaaaattaaaaaaatacatataaaattgtggagtggtgagtattctatcctcgttccaaaagtccacccgttcaataacggggatcccaccatttggtcatgggtgctcaatttgatgcaacttttacaaccaaagcacaaaattcttctgaaattataaagggtaaccatgtgagcaaagtgcagcgttgcttgagtttaaaaaaatagaggcaaatacgatacataaaacaactaattcatctaacaaggatttttttcattggagaaaagggacgagtgaatcttttggtgttttttttttgaaaaaataaaagtctacaagaccgcgtataaagaacacatacaataaacatgtgctccaaccttgtaccgcctaagcagcgtaagcggtcgactataccatataagcgtccaattatgccgcctaaacgctacaaggtgggggtgacagcatgaaccgcataccgcttatcaaaacattgttcagtgtgctccaaccttataccacccaagcaacgtaagtggttgactattccatataagtgtccgattgtgccgcataagcgctaaaggtgggtgaccgtataaaattgtgtatcgcatttaaaatattattcaatatcttatcatcatgattgatcgacggtggaagacaaaatgttatttccttaagaacaattcggtgtcaaatctttccaaaaataataatgtaaggactaatgtgtactaaagaaaagtataaagttataaaataaaaaggacggtaaaaaaaatccataataacaacaatttgaaaacaatatcatttcatagttagcaaaaacaaatttaagctatgaatttccaaaaacaagttctagttacgtggcaaattattaatgccacatttccttttggaagccattcaacgtgctttatcaataaaaaatatagttacattgttcactagaatgcttagtaaaaaaaatagaggtttcatcaacccagttataacaattcttcaaatcaaaaggcacatttagctacaacatatgtcatccaattgtctatgctcccaatttttatccaacagagaaaaaaaaatcctcacatttatcaaaacgtgccaaaatgaaattcccatcttcctcaaggtgctaaacataaaaaaggatagaaaaagataaaccacctcattgacttccctcgcgtctatccaactcctcttcgtcttcctccctccccagtccccaccaccatttccacttataaaacccatctcccccaccccaaccccgttcccacctcacaatctcaccctcaactcaccacccaacccaactcaagcacctcctcctcctccaccggcaaacgcagcagcggcgcgcgcgctctcgcctccgtctccggcgacccatggccgtggacctcatgggcttcagcccgcgcggcggctgccgcccgtccgtggagacggagcagctcgctttccaggaggccgccgccgcggggctccgcagcctcgagctgctcgtctcgtcgctctccgccgggggggagcaccaccaccgccgccgcccgcaggagaagcagtcttcgccgccgctgggggagatcgcggaccaggcggtgtccaggttcaggaaggtgatctcgattcttgaccgcgaccggccacgcccgcttccgccgtggccctgtcgtcggagcggcagctgcggaggcggctgccgcggcggcgtcggcgtcaccgtcgtcgtctcctgtctcgccgcctctcccgccggtgacgacgcagccggcggccgccgtgaagagcctgacgctggacttcacgaatcccgccaaggtcgcggcggcgtcggtgacctcgacgtcgttcttctcgtcggtcaccgccggcggagacggcagcgtgtccaagggccggagcctggtctcctccgggaagcccccgctcgccggcggcgtcaagcgcaagcacccgcacccgccctgcgccgccgccggcgacggccacggccacggcgcaggccacgcgcacgcgcacggcgggtgccactgctccaagaagcggaagcagcgggttcggcgcacggtgcgcgtggcggcggcgagcgcgcgggtggcggacatccccgccgacgagtactcgtggcgcaagtacgggcagaagccgatcaaggggtccccctacccgcgcggctactaccggtgcagcaccgtcaagggttgccccgcccggaagcacgtcgagcgcgccgccgacgaccccgccaccctcgtcgtcacctacgagggcgaccaccgccactcgccgccgccgccgccgcttgtttaattaattaattagcaaaaatcgttagccccttgtgtaaatgagtttttactttttactgctgctcctactactggttgtactaatattaaatgagaaagcaaattttaccgagcaaaatcttaatcgtttggttgaattttcttttgccgagctctgtggggaagtcaaagtggggcaataaattccgctttaattgtggtgtcgggaggtggggcccacatgtctggccggatgaggatgatttcactggcgctggtcaaaggcgcgggtgagcggtcgctttcgtcgtctcgtcccaatgggctgaccgcggcccgcttcgctttaatttgcgcgttaaataaagagtggggcccacgggagaggagaggggggcccggatgctttcaacgcctcggtttcttcgcctgcttttcttggccacatctctcgcacagcccgttgacttttacagcctccaaatctatgcgtattctctcggtctccgaattgctttcggcaaaatcacgcgacagtttaactttagtggtgattatttcgttcggcaattaactttgcgacgaactttctatcatggtactggtgttcaaattttaattttttgttttaagcctaaatttatttatacgacagaaatcatacgtaaaatctatagtatcatacaatcccagtactatctaacaatatctcaattaaaaaaaaatagacaaatttatgagtatcacctctcgagtagtatatgaccaatgttcaaaaaaaaaaaagcagtatatgacctaaaatatgtgctatgcaaattcttctagaaattggatgcccttgatcatataacatcgtgtgtgtttactatgttcatattagttcatattagtggagcaagaacaaagagaggaggaataataaagggggttacaaacttacaatgaagtgttaagtagaaggaaataaaaggttataactaaataccatcatggctccaataagacaattatggatgtgttcttcccctatttccccaacttctattccattgttttccatgtaagttattttaaaaattatattaattcatttttagagttctttttacttattttaattaattatgtgctaatgagccaccccattttgcatgtgaagtggagaagttgccaacttaatgaaaagaacacagcctatattactatgcaaggacttattactctgtagtggtatttagaatggtattctagccgtagactttaatccatcgcttggaaacaatgaccaccaagcactttttgggtgttaattataattttgcaaagacaagactttgtctagcttgtaaacaatgtcacatttgccatgaacatgcatacttttgcttgcttttctttcatgatgtactccctccgtttcacaatataagtcattctagcattcttcacattcatattgatgttaatgaatctagatagatatatatgtctacattcattaacatcaatatgaatatcggaaatgctaaaatgacttacattgtgaaatggaggaagtagaatagaactagacaattttgttcatgatgttgccctatagtctgacccataatctactcgacctgtttcttcaataagtacatgcagatataatgtaagttcctttcaagtggatgtcaagtgggcttccctagtcagaataaaggaatcataattaagcatttattcttggaacatatcttatcttttgtttaaagccatatgacttgactaatatctaacctcgcttccttttttttgtggggtcgtgcaaacacataggttttcttttttgttgtttgtttcacaccgtttgtgataagatgtactacaaacctaataataaattaaagtatatcaatattgattatatatatatatatacatatgtatatatatatatatatacatatgtatatacatatatatgtatatatatatatacatatatatgtatatatatatatacatatatatatacatatatatatatatatagagcaggttttctattcaactagcttagcaaattgaccctattgcacgtgggaacaaagtcaagtcaatataacgagtgcgttcttcacaattttatcgagtgcaatcaagcctaatggaaattcagaatagacctttcaaattgacgatattggtggataaatacattccgtattaattaaaggcgttgttttgaagaatgttacttaggtattgtgttttcatttcgctcgagcaaagtgtcgcaacacgatcgtgaggcatgagatgtcattttcgagctatcttaagatatatcttaataatatcttagataatcatgattcggaaatgcaattttcgatagtcatacagtctgaattgtgaagtttggtttgtgccgtgctaatcacctacaattttcatatatatgattgtgggagtccaatggttcttttacctaggatttcttatgaaatacgaccaacctacttagttttcaaaattggcaccaaatcattacaggcaaccaacaatataatattagctatatgtaaaatatctttacagacgggcaaagaacattttccctgacgggcttcattacgtaaaatcattttcgcatgtggctaggctacgctgtccaccaaaaaaaaaaagtcttatagtcggcacgtggttggtggctgccaatgaaaatggtgtattttctttggctattagtcgctagcggcattgccgtcgcaaccagaggaaactttacctgttcgactgagattccgagaataccaaataggtttaaccaagctaggtgatgaagtacaattaattagttggaccatcccaacaattatgataaatgtgggctctgtggaatactctgaacaaatattttcgaattttaggttgtttgactttacactcatgattatatcaattttctgactttacaaatatttgttttttacacaattctaagcataacatgttcattacggcctgactggcctcttcctcgttcaagttaattaactacatgtagtaattaagttgttcgatcactggaaagaacatgccaaagtactgcttctagatacgagattatttcgcgaaagttactttagcttctggtatatatgaccacctctgaacatgcttaattagaccagaagatgcccgttaaataattttcgtgaaattggaataaattaaagctttgccctcccattgacccaacttggttcccacgtgtggcatctcatattcttgtcagaccaattgcactaagtcagcaaccttaaaagaacagctaatatatattcaaatattaagaagctttagttttttttttaacacatctcaccagctaacagtgtgaacactcataaaaatatctttctgttcttgtacaatagtacaaaagaagaagaaggcatcaacggtgtctttggtgacaatcaagctggggcagatattagtcaactcttatattgcttaaacaaaaagacgactttcaaaagtccaatgcttttgattttgttgatatacgcatgttctgactaagcatgcaacatgtcaaagtaagcaccccactatatggaatctctcaagcggtcaactttgttggttttctgatgaactaccaaagttagtttttgctaccataatgtcaacagttaatagtcatttacatttacaatatgctctaaggttagcgactcggtcagttggtgaataggattactgcaaaatagcggttgtgtaaatggattgatccgtgaatccaccaacgtgttactcacttattcatttatttggtctataattaggttgacgggttagcccaattacacctctaatagagatactctttctgatgatcataaatatataaatatgtgacgtttagaataaaattcgatcgaattgttaaagatttgaccatcaataatttctcaaatcctaagtttaaaaaataaataatggtacgagtgattttttctgtaaaagtacttccacaatacacaataccataaacttcttagattctataaacttgttataatgtaaaattaatggtaagagttttaaaaatctgatcaaatcatcctaaatgttaaatatttacggctaaaaagagtattttgggtacaacttataaatagcagccacataatcaatataatttaaaaataataattttagtaaaagatttagctgttattaaaaactaaagctaagttagcgtatatttgaaatatgatttttttatagaaaacctctaaaaaacagtttctactccctccctccaaacaaagacaaaccctggatttccgtgtccaacgtttgactgtccgttttatatggaatttttttataattagtatttttattgttgttagatgataaaacatgattaatactttatgtgtgaattgtctttttaattttttttataatttttttaaataagacaaacggtcaaagttggacacggaaacctaggatttgctttttttttcgaaggaagtagtacaatttaaactggcttctgtttggttcaaaatgaataggagtaactccaatggaccacatatgatacgaggctgaagcagagcagagggcggttggtgtcgtcgagtttaatggtgcctagctttccgttgaagagtctgcatcgacgcaatcactactccgtacaaaaaaaaaaagttaaaccctgaattttcatgccaacgtttgactgtccgtcttatatgaatcttttttataattagtattttcattgttgttagatgataaaacgtgattaatactttatgcgtgacttatctttttaatttttttcatatttttttcaaataagacggacggttaaatgttggacacggaaactaggtttatcttttttttttttttacatagggagtactcatcatccagaggaggcgaaagtctctctctgattcgtggatggatcgccggaataatggcgtcagagggaggggttgagtgaatgcagagaggcgacgacgggtcaggtcgatcatttcatcagctgccaccggcgggccggactttgttggcagccggcagccgcagtgcagtgatggcgagctgaccgcgagtggtggttagtcgtagagaaggttaagggtgtgtttagttcacaccaaaattagaagtttgattgaaattgaaacgttccgatgaaaaagttagaagtttgtgtgtgtggaaaagttttgatgtgatggaaaagttggaagtttaaagaaaaagttgggaactaaaccaaacctaaggaatgaaaaaaaaataatggaatctaaaaaacacataattataataaaaatgtaagtgtaaatagaggattacgaatgaccattagattggattgtaggaaaaagcaggaatcagataagagatatatactcgaagaattttttttttcaaaaattgttgtttttgctgagttttctttaaatttttttaggattatacatttcataggaatttcatatggtaggataggatcgaggacttattcactttatcgccactttcaacaccttattaagttttagcattaccaaattttggtaagacaacaaactaaacatatacttcctccgtttcatattataaaactttctagcattgcctacattcaaatagatattaatgaatctaaatacattcatatagatattaatgaatatatatatatatatatatatatatatatatatatatgaaaattataagctactaccgggagtaactactcccatcttatccactgtacggtttgctacgtggcagtgcaaatttctgtatatatatatattgacatatatatgaatatatgcaatgctagaaagtcttataaactgaaatggaactgaaatggaggtagtacttatcaatgccaccttaccaaacttttgacaattctaatagttttcactctcaaaatttctatcaaccttggtaaggttttaaactaaatgcatccaacattacctatatttagtaacgtcaaaatgtgtcaaaatttggcactattaaaaatagctaataaataaacaatgttagaattttttttcatagaattaaaattctccaaaattcttatgttttttctacgaagcaagggccttaagctgtgtgttgtatgctaatggggtctttattaatgacttaactacggcgtgaactacgcagagagggctagcatagctagtagggagaaaataaacaaaagtattgtcacgcccagaaattcacgaaccagaatttctaagctgaatgtgcattaaacctctgtttaggaccagccagggtacacaaacgacaattgttgacatacagatccacgtcttacaaaaatataaaagattacaaatgcagcggaaaaaggtaaaagcgagctaagtctgaagacttgactcctgcagcgaggagactctattccacaggcatccttgacagcagcgacgaaaccaacttcttcgacacagctccaactgggaagaacttcagctctggagtggggaagagagagcaagactgagtgctacctaatgtactcagcaagtcataccggaagagtagggtatgatgcaggatatatccaagggaggctaaaggttcatttgcataaaactagcatttaaaagcaatagttgaaagcagtaaaacagttgtagtaattaatcaatattaaccaatcactgctcaacgctacaccacgttgagacaagcccaaaccaccacctgaactatccagttccattagctaactaggagtgagactaatcacggtgaatctggtcgaccgcccataaccgcgggcacgactattcgaatagttttactctgatcagaggtgtacaactgtacccacaagacacatccccacgacacgttcccgtgcgccgacatgctaccacgacataccggaaagaggccacgacagcgggcagtcccctcccatgcctaggtgaatccggaagcgacaaaggccgtcgtagggcccatcccgctccatcacgcccacccttgcctggatgcgtaggctagaggaaagctacactacaagcccagccgttgcccatgctggcctgtggtaagtacgataagttcatccagggcatcccgcgaaccagtccttaatcgccatgggcacgactagcaaaaccatgcacccacagcccaccatgtagtgtattttaattaaccaacaccattgcggtggcactgatgcaaagctatgccaataattaaagtctatgcattaatatgatcccctttgtgtactaattgaactaagcatggctaagcaattcctaatccaacatctatgcatttaaatacccaagttatcaatggcgtaagggaaacaacatatagctgagtaataggacccatcccacatgatattgtaaaagaatgcaacgtttaatagaaaatgtgggacatttgtaaattgggtacaatatgatcaattgtaatgcatgacttgccttgctctcacgctgatgggaccacagcaacgtcttcgaggaatcgcggatcgacgaaacggccgaaatctacgcgataaacaaagcacacatgcaaaacatttgataagtctactgaaacaggaaacaaaaccatttttagtggattctatgcttttttatgaatttactgagacttgaatggacttaatcggagctcggatgaattagttatgaattttagaagattatatgtgtttttactataaaagaaaaaaccttaattatttattgcgcaacatgtcccaggctgacgtcatccaggaggggggcgccggcaagcgggtcccacttgttagcggcacaaggggagggagagggggctcgggcaagtgggccccccgggtcagcggctcaaggttccgatccaccgtggaccgggaccacgtgggtggtccacaggaccgatgatccagatcggtcgggaggccgattggacggcgcgggcggggctcggctcggcctatagccggccggccggccaatcatggcgatgcggtggcgcgcggtcgccggtgatggcagccggcggcgggaggcggcgacgggcggcgcaaaaggcagcggcgtcggccggaagtgacagcgagcgtacggggaggcggcacatgcaggagagagaagtgggaggaagaggaggttcctcaccgtggggtggccggtgcggaaggcgaaggcggcgacgatgactcggcgagcggaggggcggacgggcggcggcaacgccctaggggagagcggagaggggttagaggtagggaggaaacccgcggcgacaaaaatgccggccgaagatagggaggacagcgaggctcaccggcgtgcgaggagaaaagggctctggtggggttccagcgacgcgaggcggtggccgagatgaaccacgaggcggtgaagttaacggcggcggcggcgtgcggccggaggtggcggcaagcggcgtcgctagcagcgagcagtgcaagcgagatggagagcatgggagagggcggcgagcaagggaaacgagagatggggctcgtgggagtgtttttatgggcgaggaaggggaggacatggacgggaaccctctcgatttggccggcgacgtgggaaggtggggagggagagagagagggggattcaaattgaatcccgccccttgcaagcgcgcgcgcgtgcgggagaggagtgggaagtgggcgacgacgtgggcgcaagcgcaggagaggcgtgggatgggctcagacggagtggaggacgtggggcgccggcggatggagctcggttccaacggctggaggtaggggacgaccgacaggttggccccacctgtcagcgtcccgaatgggaagaggagggggcacgggccagcccaataaagaagaggccgagcgcgggagagaatgggccgacggcccaagaaagaaaaagatggaaaagaaaaagaagaaaaagggaaattgatttgttgggaaataaataatgcacatgctcatttttaattggttaaaattatttcttaggctctgaaaattccactaaaaatcatgttagtataatttgacatgtagaattcaggaaaaattctacatgccgattccgattattaattgcatttttttattatatattaactctaggttaaattaaactatttcttcggacgatttattttataaaattttaaacaaggaaggggaacttcagggcgtgataagtaggtcgtgtttagttcaccctcaactactccaaacttctaactttccatcacatcacatcacatccaaaacttttctatacacataaacttccaattttttttctaaacttccaactcttttcaggaactaaacacaaccgtactccatttgtttaaaaataaagtacaagatatgacatattttattattacgaatctggccaaatcaaaagatctcctatacatattcataaatttaaaatgtgtcacattccattccccattggtgtattttgggagaagagagtacatgtacttctcctgaagagagagtaaaagctagcctcgtttcctagactcctacgcccacggcttacaaaatcggtgaaccatgtggttaccgtggtaattgcacttatcactgaggtatgataatgataaaaccatggtaataccatcaaattcaaataatttagaactatgaatttttgaaaaaaattacatggtttctcattatttgccatggttatcacacagtaaccgcacttgccatttgtgtgcggtaacccgtcccccattgtaaggaaactctgcctaggctgtgctagaaatttacgctgatttaatgatcaagccagttcacctaggtaaaaactgttacaaaatcaaagcgcattgagctgatatgcataataggcatagaatcaacgagtgaagaaaccataatagtttattctttaaaaaaatagataaaatgcccgtgtatttttttttgagagcagatcaaactattaatttgacccggcttttgggagaaagccaaaggtaaaacaaagtacaaggtctgcaaagagcaaaacaagagaaaaaaggctgagcgacaaacgctggggactccagcttccaacagcacactagggaggggtgaacacctacgccctcaaaccaaacctcagatagcccacaacacactaagaacacacaccaaacggcctactcagaaccgaaacaaaaagactaaatggctgcaggaaggaccaacggtttcacttgtcgcagtttgtccataatagcttcatgccagccatccaacaccttttgttcttctcctcttaggaacaccttccacttttgcgccagcgagagtgacttgtaaacgacctgtaagggagaagaaaccagaacatctttaaagacccagtcattccttattagccacaaagcccaacaaatactagccaaaagcaccatccaaaccctttttttcccctatcccaaacaaagctagtgcaatcccagaacgagaaaggtctcctttttaaatgcaaggcctctttaatcacacaccaagtaaacacagctaaaggacagtgaaacaaaatgtgatcagaggtttcatttttcccacatagtttgcaaagctcattcccccctttccaattcctttttactaattgaacagcacaaggaagctttcctctcccaaccaaatagagaaaatgtttaattttaagagggattctactcttccaaacagcccacatgactgaatccttaatcccccaaaaattaactgattatacattgacttggcggtaaaggatttatgtttagtatagggccagattacttcatcacaaccaccctcaatctgaactgattgaagcatcctcttcaagtcattcagctcttgttctctctctgtactcaggatcctacggaaggacagaatccaatccccattattccacagctccctaaccgtagccttctgatgcacacttatatcaaacaaattattaaagactactctcagtggtacattcccgcaccaaatgtccccccagaaatctgtcctagaaccatcatgaacttttttttctaccagtctctgcagaaatttcttacaatggtgtagccctttccaaaattgagaccccccacttcagagctctgaaaaaaactccccctcagatatttccttctcaacacctcaaagcacatatcaggggccccattctctagtttcataatccatttacaaagcagacaaatgttcattaccctagtattcatgaagcccatacccccaaaactcttttggacgacacaaagcctcccacttgatcatatggtattttctcttctccccagtaccttgccaatagaatttgctcctagcagcatccattttagcatgaaaaccctcaggaagagagtaaaaacccatggcataaagaggggcactagataggcaagagttgatcttaatttccctacccccataagacaaatacccactcctccaagattgcattcttttttcaagggctgcaggaat

SEQ ID NO: 82983 - DNA, 3263 bp, Oryza sativa
cgcatttttgaattaggccagaacggtattaaaaataaggatgggccggcaacccgctgccggacttcgtttacctaagggggttggtggaaaaagtaaaatggttggcagcacctcgtagtacttcgaaattttgtgtgcggttgggaaaaaacaaatttattgggcagggtgtggggcactcgtgtttaaagggcttttcgcttccgtttccacaagaaaatggttttgatttgttccgccgtcttcgtttgctgggatttggttttcgggccgctacatttggggacaaatacggctcccttcctttttactactactccttttcattctttttcattttcattttagtagatctactgcagtatccggtgctgtgcgtacagcgtgcttcgtgcttggaactcgcactttcaccgaatatttcctctcttttttttatatatctctcgcaaaaacaaattagcaatgtttttctttttgaaaaggttaaaaacagggttgtacagcgagtacgatcctaggatcacgctggatgtaacgagacaaaggccactccacgcgaaacaattgcagatacatctgttcaaacagtgcgcagaagtttcgaaatccaaactagtagtacgtgcaggtgcagttgcgaacttgccgttgcggttgccgtggcactcgagtcgacttaccagtcgcgagattttggtgtagtttgggttgttgggggagctcttccctcccctccccctcccctcccctcgctcggttcagctgtggccacgggctcatttgctcataatcttaggctaatcgttatcgtttggtgagatttcacaaactgggaagacacgagatggtcctctcccctgaaggctgaggagataaggatcggattttgatttcggccccaaaaccggatgaagcacactgtcggcgatcggcaatcaggttcccgtgccgtgcctgcctatctcccgttgtcaccaactcaccacacgcgtcatgagcgcgagctcctctgaaatgcatgattctaaacatacatggatagaaaaaacatacaattggtatgtcatgtgctaccgaatcttctaagaatcataaatacaggaatatgaaacatgccttctttgggtggttcaaagggaaacttggtggcttattgagagagtagagagaaagagataagttgtacaagacttctcataggataaaaaagtgtttagttcacgctaaaattagaagtttagttgaaattggaacgatgtgatggaaaagttgaaaatttatgtgtataggaaagttttgatgtgatggaaaagttgaaagtttgaaaaaaaagtttgcaactaaacacggtgaaagtggtttgagctcattacctagtttcctatgaaattagtgtgtagaaactcaattcatgggaattttgtgggttcaattcctttgttccaaatggcatgcgtagaaaaaattcctaggggttgcaatccaaaggaaacattattgtcttcatcgatcaaatgcattggtcaaaaacactgctgtttacttactgacgggaagaagtaaacgggggcttaaaaaaattgtccatgcaaccgggggaaatcagatggaatatgcgtcacgtatggagtacagtgcaaggttaagtaaaagccctttttattctgtcttgagcatcaagcgtcgtcgatgtgcaatggacagcacagcaagttgaacaccaagttccacgatagatcagatcgttctcccaagatcttgtcggtcaagccggaggcgtggttccttccttttctccttggcaacacatctcgatgctcccaagaaaggaagccggtactgcgtatgtggccccagacgacctccacggcgagagaaagtgacacaggttgacgatcaccgagtatttttactgatggaagttcggacgagtggacatattcgccgtggcgacgtcaatggctgcaacagcaacaggcagagaagatttttttgccatggcgacgccaatggcagcaactgcaatgtcacatttgtcaatggcaattgggaaaagccacgcagtggcatcagtggccagcttactgcaggggctttgtagggatttcagttttagccaaaataaatactgcagttgtgttatgtagcactctgttgcaatggcctatttcctagttttatgtcgtgtcacacgtaacctccaaaatatatcctatgtacataggccatatatcctatgtacataggccatgtttggttctatgggctaatgtttagccctcaccttttagcctcaaattagctctcaaggatccaaacagatggctaattttgggttaatatgaattagcccccctcaaaacattagctcctcccctccaagaggtgctaatgaggctaattttgtgtggggaccataaaaaagcagctctctctctctctccttctctcccatctctttaaactctctctccaccttttagccttgaattagcctatgaatccaaacatccaccataggataatgtttagcctagcaattcatgactaaacattagctctcaaaattagctctgggcacgttcttcaaatagtaatgtgtccaagaaataggatatgttccctaacctccaaccacacattgcatagaatcatctccacatcgaaaactttggtgcaagtaacaatcaagaaatcctgcgtgacacacatttggggccaaagaataaaagtgaaaatgatatgtaaacgaccaaacagctatagatgacagcacaggacggaagctgagccagagtgtcaccctccatcgaggtgtgttgagaaacaacatagattactcctgaacaaagaaggtgccattgcacaaggaccaatttaacacgcgacacacaacaacaaacattctagcgcacaaaactagaaggtaaataatctcggcattgcatcattacacatctgctattgtcacctcaacctcaacaccaggttcaattgttatggaggttatctgcttcaccacatcaggggagctgataaggtcaatcaccctcttgtggatgcggaactcaaaccgatcccaggtgtttgttcctgataacacagagaatgtgatttggtgaagttaatctcatgacacaagaatattcaaaatgggcaggtgtacaatattagcattcacaagaaggataaatcaagttagacatggcattactagctcaagcactccttaaattagaagacaggctacagtttga

SEQ ID NO: 82984 - DNA, 771 bp, Oryza sativa
  unsure (1)..(771): unsure at all n locations
cgggcccnttagangtacantctancttggnacccccccgagcgggcgaggagcgcggcgcggccccgcttgagggcggggtcgtagtagtcgttgaagttgtccagcccaagcacgccgtccccccgccggcggagggcggcggccgcgtgcagccgacgaagcccgcggcgcccgtgacgaggacggtgagcccccgcccgttggcccgcctgacgcgcgcggacgcccgcaccttcttctcccatgcggcgccgccccacgtggcggcggcggacggggaggacgtgtggagggagcggcgcggggagtcgggcgccgcccgcggggccggcgcggtggagggggagaggaggaggaaggcgaggaggagcgagagggagcatacggaccataaggcgagcttggagaggagcgaggtcggcgaggggtggtggtggctcgtggcgaggcggtggtggtggaagtggtggaactgcgggttgacggactccgtgccgcccgccgtccccggcgtgtcgggcgcgccggtcagcttgtgcgccatctgccgatctgccgtaatgtggattgagcttctcgtcggatcttgctaatttgggtggggttggggagagagatatgtgggcggggggggcttttctttccttttttaacctctttatttaaattaaaccccatcccttcttctgggttaacaaggccggtgctctttttgttggttttcctatctgacccgtaacaattttatggtcccggttctatttttct

SEQ ID NO: 82985 - DNA, 7226 bp, Oryza sativa
ttttttctgctgtatatcaggtaatgtgaagtaagaaaggactgacgcgaccaaagatcgtgagacgtgacgagctggccgaggatgaataaagtgactgctgtcagttgtcacattcacaggctgcgatccagaaactatggatgggactatgtagtaacgtgctgatatattattgctaagtgttactactgcatggttgcaagggtggtagaagtaccttagcttccaagatcgttgtaatgtgtgagtttaattttggcgttttaagtaataagtctagtgattgcaggattgtacggggtaatgtacttgcattatccattataatcttaagcatccaatataattatgcaataattcgtgccttactgctcttagctacagctggttgggtttgaaggctttatttgttattcttacatagtgtatgttactcatgtcattatttagagtctgctatatactgcttatgcattattattatctgttgttgaacgtttgcaaagttttagcgggcatgtttctttgttaaagaaaggtgcacgaactaattcattcagtaaggactcctttgaaaattaagcaagaagtttacagtatttgacagaatttagttcaacttctaaaaaaaatccttcagaattcctccattgtaaatgagctgtataagatcatagcttgcataagaacaaaaatgcatatatgtatatgtccatagtgaggtgtttgtggtgacgacgtcaatttcaagatataccacttcggtcttctagaggtaggatatatgtgtattcgtagttggtaaatgcacgtgtatgtacataagcttcggagcttatgttgtactagtagtcgctttaactttttttcttgtaacgtttgaccattcgtcttatttgaaaaattagtgcaaatatgaaaacagagaagtcatacttaaagtacttttgataataaagcaaatcacaaacaaaataaataataatttcataattttttgaataagatgaaaaatcaaaagttaaaaaaaaactcaaagcgacgaatatcctgggacataagtagtattttgaaaacaaacataaatgtgtagtggtagctctacaagataagagggcacgtagatgtagctagggaccaaagtggtgatctacactagcccacagtgggccactaatcgagtgtggagagaatgtattctcagctcaggtgtttatctccaaggctcgatgttttagaagattctcctattgtcctattgcctatatttgtcatataaaattgaatctttatatatatgtacttctacagtacatataaagatgcttctacagtatcacaactttattatcatatcctcgatggagataaaaggttcaaagtcaggtcgtagaatacatttgtaaatgtagatgaacttgttaggtttcttacagtgaaacatacctactcaaattaagtctatacttgatatggatgctcacttttacggctaataattttaggcaatatgtatatatcgataatgaaacgcatatggtaatttcgtatatcaaatatgccgaccaatattttggaggtgttacaggggtaagtatgtgcgtttgcatgtatttatacgggtaagcatgcacgcatattaatgaatgcttgcatttgtaacatgtttcgaaaaaaaaatcatgccataatttttttttaaaaaaataagtataaaaagaacatttgcttatgtactatgttgttatatttcggcaacaacgataattagaccataggaatgagccaactaaaagatgacctcatacaagtgcaacactaaacacatgggcccacatgtcagtctgccgctttgtcctaccaatccaagcttcaagccctacctacccctaccttgtcgggaagttgtaactacccactcgcgccggtcatcgtcattgtcgccatgtccttccatctacaagcccacgtcttcatggcgaaccctctccatggcctttccacttctaccgccgtggatgaaactttgattgtcgtataggctgagctcttatctctactttcctaactcacctccatcgtttccgcacgcacgtttttcaaaccgttaacgatacgttttttgcaaaaaaaataaaaaaaattctatatgatagtttctttaaaaacatattaatctatctttcaaatttattttagctaatacttaattaatcatacgctaaacgctacttcgttttgcgtgccagctcccgaacacaatagtaaattttatataaaaagataaaagtaaaaaaaaaaaaagctgatgcgcactaccctgtgctatttcatgatgggctgaaacttttaggcaactacgagaattgggccggcccgaccaatagatggcctcctgcaactgcaacactgaacacgagggcccacatgtcagtgacacaacctccctacgctttctcctaccaatccaaccacctactacccccaccttgccgggaagctgcaactgcacactcgccgccgccgccatgtccatccacctccgcgcccacgccttcgcggcgagccctctgcgcggcctctccgcctccaccgccgccgtctccccgtcggccgcggccgacgccctccgctccctcctcgacgcgggggccggggcagccgacgccgcgcacccgcacccgcacccgcacctctccaagatcctccccttccgccgcggccgccccctcgcgcgctcctacgactctcctcctccccccgctgccgcggccgcggcgccgccgcctcctcccgcctggcgcctcgcgtggctcccgcccgcgcgcgtccccgacgtgccctcggacgccttcgtgttcctgggcgcgcacggcgaggaggaggggaaggaggccgcggcgtactgggccgtcgatgtgagcgagcgcgacggggagggcgccggggatgggtcggcgtttgtggatttgaggacgctcatggtggccacggactggagggacaaggacgccatgggagacctcgccatcgcgggccacgtgcgtggcgattattttgttgttatcagagacattcgaattactacattttttgtggttgattggatttctgattcgagcaggctcgggcgctgctagaatggcatagcacagcaaaattctgcggagcttgtggatcaagggctgttcctgctgaagccggaagacggaagcagtgcagcaatgaatcctgcaagaagaggatataccctcgagttgatcccgtatgatttgtgctcaattcctgacctatcttgcagttggagatggcacctgttgaatttgacgttttgttatccctatttggtgtattgcaggttgtgattatgttggtcatagataaggaaaacgatcgtgcgctcttaagccgccagtcgagatttgtgcctcgaatgtggagctgtcttgctggttttatagaggtgcaaattagctcttagttttcatgatttcttatgtttaatgttcagatcttttcttcataataatatgtgcttagttccattcctttcacttgtaattttcttatgctggttttggtttggatgaaacagaaggatgctatagataacttggttgtattacacccattgttactgcatactgcacaatcctggttagatcttatttgtgagttggtgggatggttagatcttatttgttagttggtgggaggaccggaggagtgtatgtacacacccaccacacaagtttggatcctctagggctaacttggattcatcttcccccgtgggtatcctcattttatttatttttttaaaaaaagagttaccatatcctcattagccatgcttgtaatttgtaggagattatttagagcacttcactatcctaactatgatgaattcattccaaatactgaaaagtaacttgttttcttgtttaagttttgtcctatgcttatgctaacttcaactttctgtggtactagcaagttcatttcattatcatcttgccgtgcactgaaagaagcttacacatgctgcaactgttctttttgtagccaggagaaagcttggaagaggcagtgagaagggaaacgtgggaagagactggtattcaagttggggaagtcatttatcacagttctcaaccgtggcctggtaatgaattgttcttaccatatatctttcgaatgaaaaacacaggaaaggataacactagaagataagaaatatgttttaacctttctaattatcgtatcaaaatacagaagtacttataatgaaagatactaggcaagaactatatcaaattaaagtaataagaagaaataggtagaggacttgggcggtggtggtggtgtacatgcataccaagagacatgtattagggctccctttggcattagagtgtattctcaaaacaaaattatttgtgctttgggatatattatgagctgttatcgtctttttcttgagttgtagagaaaagtcttaatagaatcagtgacaatctccctaacccactctgatagtatccatgttgcttccgatgcttttttcagttgggccgagtactatgccatgccaactgatggtgggattctttgcttacgctaaatcattggagatacatgttgacaagaaagagcttgaaggtttgtcagtatgaaatgttattttttttcctactcttttttgcaactgattggcctggtccatccatataatcctacgtttcagtcggtcttctgttatttttcttatgcaatcttacaagaatatttagatactaactgagtaaaacttatctaattgttaaattggtgatctgtaatacatcgaagatacttttctacaatgaacttcataatagttctgcgcagaccttttagttctcatctctcgaatgccattcttttaccaatgtagatgcccaatggcacagccgtgaggatgtcaagaaagcactaacatttgcagaatacgagaaagctcagagaacaaatgcgctcaaggtcaatcaaatatgcaagggtgttgagaaaaggcagagcatctctgctgacctcaaaatcgaaagtgaggagcctgctccaatgttcgttcctgggccctatgcgattgctcaccacctcatatcatcatgggcttttgaaggagcaccaaaggcacctagctccttctccaacctatgagccttgatcctgttattcattttcactaaacaacacaacaacaggagatagggaataaaaaattttagtcccatgtatcatgtatgccttagtttcttgttagtgtagatgtgaaatgtgtccattgccggttgtaataaaaggttaagaaaagtacatcacgttcactggaggatttggggggagtacagattacagagcaagtgtaatattttagcatacaatttgtaacagtgtatagatgcagcacagatgtgctgatgtttgtatcttccatattcaaagagctggcatcaagtgtgaaattttgccaggtttgttacaagttgaggacaatcttttacatgttgactggtatagttctgcttggagaaaactggaatattcaagttaattttccacatgagtacatctgtttgtcatgcaagtgaatcaagaattcttgtgcaggggttgatttttcagtgtataggggtatgaaatgaatgtagagagtgatgtgcctggacttttgttgctaatcataattgaagcttctccttgaaacaagcaaccacatgacatctttgactaatctgttgcacaaaaacaataattaacccgcatcaatcttcaactggtcaacataaaatctactgttggacagcaacaccgcagcaccttgtactaattttttttatgctttcatccaactactgacaaagaattctcgtcagtttttcaagttcagaacaaaggcaggaactctgattaggtgtagcctcatatacagtactaatatatgctaggagcacttaattaattgctgttcctctctaggtagtacttaattaattaggagtactaattttgcactttgtgacacgttttatgttgattcacagtgacttgattcaagcacaagagaggtggtcacagcaacatgtgcaaaattgtcattagacgaaacgtatcaagctctaattgcagccgaagaagcaagaagcaaaccatccaatcagctgcacagctagtcaacacaagctagtcaaaccgttgactaccactgtctttgttgcgcgccagatttttccacggtgcacagccgcaacgagatggagacatggatagagtaataagcagcagtagcaatgcaacgcaatgcaacacttgaatcacttgcagcttggaactgatctgatcagccatggcggtcggcgtcgtcgccggcgtcgagagccaggagcgccgcggcggcggcgccggaaccggaagggtcaccgcgttcgtcgtgctgtcgtgcgtcaccgccggcatgggcggcgtcatcttcggctacgacatcgggatcgcaggtacagtgtaacacaatgtagcatgagacatcgagagaagtgaagcttcgttaatggcggcggcggcggcggtgcaggtggcgtgtcgtcgatggagccgttcttgaggaagttcttcccggaggtgcaccggcggatggagggcgacgtgcgggtcagcaactactgcaagttcgacagccagctgctcacggcgttcacctcctcgctctacgtcgccgggctcctcaccacgttcgccgcgtcgcgggtcacggcggggagggggcgccgcccgtccatgctcctcggcggcgccgccttcctcgccggcgcggccgtcggcggcgcgtcggtggacatctacatggtcatcctcggccgcgtcctcctcggcgtcggcctcggcttcgccaaccaggccgtgccgctctacctgtcggagatggcgccgtcgcggtggcgcggcgcgttcagcaacggcttccagctcagcgtcggcgtcggcgcgctcgccgccaacgtgatcaactacggcacggagaagatcaggggcgggtggggatggcgcgtctcgctggcgctcgccgccgtccccgccgggctcctcaccctcggcgcgctcttcctcccggagacgcccaacagcctcatccagcagggcaaggtcgaacgctgcgacgtcgagcagctgctcaagaagatccg

SEQ ID NO: 82986 - DNA, 10660 bp, Oryza sativa
tcgagctaataaacaggtcgtgttgtctcagaatcggcgatatggtacaaaactaatttctatatggattcagtccgagccaaagaacagcgcgcatatcgacctaggagtagaagcgaagcatacctgctctccacgaaagccccgcggcgaggggcgccgtcgatctaagccggtgcagaatcttcgcgccgccgatgccggcatgccgcggagagtacaccggagatccacatcctcctggggttttgacggcgcgtccgcagccagctgctcgccgccggagccggaattggggaagcggcgtcgtcgggggagaagaggaagcgacaaggtgagggggagatcgagggttcccatcgtccatcgtcccatcgaatcacaagtgtcgatgtaagccacgggctgggcttctctcttcacgcctgggcatcaagcccaagctgctgcaggcccagtccacgcctctttttgttttcttttcttttttttctaaaggaatttttgtttgtgctcaaattggtaatgcggttgtttggttttagcgcgcggttacaagataaaataagtaagccaaggctatattgatttgttcacgaaggcatgtagcctgcccaaaaatttggtagaggacaatagaatcagtactaggtttctcaggaaatgtttacatatctgccgatgatagactttgtcctctatcggtacatctctagttttcccagttttccatgcacattccctagcctactcaacagatgatttaatctggtatggttattagatacaaatgaaaatttgcagagaaatttactactgaaaataaaatcacgtgtaaaccggaaattaataaatagcaaggctttacatttgggtatgatccaaaccattcatatgccaggtcatctgtcactagcatccaatccaaactcggcaagtcgattagaaattttgcaaggatcttagcataaatgtctctaaaacccaggccatcttgtttctttgcctttttcagtttatcccaactgatccaatgcgttttttttctccttctcttgctggatccaccaatacctagaaatgagagtgcttatctggtcacctttgtcaaatcaaaatatgccatggtgtagatagggatagcttgagcagctttgatcataatctcctttcacctgtgaattctttgccagactcttatcttttagatactcaagagcttcagctctagattttctaatatacattggaagccccagatatttctcattttgtgttccctttgttatgtgcaacgtttgcatcacctcgcttctcttctgatccctagtgttcttgttgaaaattacagctgactcatatcattcgccctgaagacaactcatataattggagaattccttgcaattgcattgcatcctccccatttgcacgaatcagaattaaagaatcatcggcaacagcaggtgagagatgcttggtgctcctgggcaaattttaaccctgccaattcttccttcattctctgccttcagtaatacagcagaaagccttcagcacagagcaacaaatatggtgataatggatcaccttgcctcaatccaaatggttctcctcgtatacagtaaacaaccaagtccagctatatttccatgataaaaacatcaggataccaattagcaaacaacatttaccacatatttagcagtagttgacaaatacctagcactgattccccgcaaaaaaaaaaaaaaaaaaaaaaaaaaaaaaaaaaaaaaacctagcactgatgttcgaagaaggatagcatagtatatgggaattaaaaattcactacttctgcataagagcaaagacccgaaacaaaaaatactaaggatcgatttatggaggcaattatatcaacagcctggacaggtactgcatgtaattggaagtgcaattcataaccattacataatcgatttatgagagaaattcaagcccaactgattgaggtgcagagcaaaatgtttgctaaagaattgacgctacatgtgaaagctgtaaaatacaaacatggagaatttttttttcccattttagataaacatggagaagacttatgtaggcagggatgaactgtacaaaatggttgaaacaaacaaacgaaacgtcaaaattgaataataagttcctgcatgggcaatcagaaaaatgaaattacaatgctggtactagtcagataatgtatgcctaatatcaagtccaagtgttgagttcagttacttcttgctatctcaaagcaaataacaaattaagaatgatcagttaatcattctgttgtcatacctttttcacgtgtacactctataccaggttcccataacaaactttgcaccaaatttgttggggctcataatctgacaaatgagaaagaacgaattgtgaaggaagtattaccaggacatgcttcaatacatatatggcaatgaaagttgggaaagaacgaattgttgcagtcctctagtcaataccaaatgtttgtattccagtatgtacaacatgtcaactacatgttcttgtttcagatttgtttctttcctacaaaagaaccagctagccataccagaaggttttaaaaagacatgggagacatttcccataaatcaaatttgcatgtcttatctgaatgaaattaacgtttgctgtatgctatactaaccaaacattgctatggtcagcttcagctaaaattattggcagttattcttcagcatccatgtttcagcttttaagcctctttgcgacagtgctatttcctccagcatatttatgtactctgagaaaattaaaaaaggacagtcatttttacaaacaaaaatcgaggaaaatcatttgacttaaggatcagaaattattgcttacatgaatccctgagcaacataaaagactcttcaaaatgctggattcttcatctacctaatcagaactatgctgctatggtctattatttccgtttccatgcctggacaaattcagttcagtctcaggctctcagcggttgtctgcaactctgcacatacctgatcttgctgctttgcaaccttggtaatcacatcttcagacaatcggctgaaaatattggatgttccagccaaatctttactgtcatagacttgcagcgtgaaaaattcatcatgtctctagctttaaaagatctcctcaggtgtagcttgctgaattctctgtgcacttcgcaagcctaacccgcagagaatttaatctgttaagtatggtaatatgataattcagatacaaacgcacattttacagaaaaaaatactattaaaaatagaattatatataagccaaaattcggtgattaaatgacaaggcattacttatactatgctaaccatagtatctgcagagtacgatacaaaattattcatgtgccaagtcatctctgacaggtatctagtggaaacttggaaatgcagtcggttagaagttttgcgtcttaaggccaaattgctagcagtaagggcatatcaaaacagcaatgtatctcctctcctctcctaccctatctttaatgttttaagactttatttaagcttctcttggcttaagacaaggaattgaaaaacgattcaacagaaaaaagaatttcattcaaattcaccttatttaagcttctcttggcataagacaaggaattaaaaaaaagctaagcactagtgtctagcgctgcctccaccagaggcccgactgcatgtatatgccgtatttgacaacttaccgttgccgtattggaggggatcttttcactgctccttttctttttttttttacagccattattataaccggaaggggatacacgcccagccgatgcccacatttgggatcttttcgctgtattcggtcggggtgggtgcccttggggaggcgatggagtagagtcgaaccgaccttataaagaggtcgcgcttgatcagaatcggcgatgtgggataaaacgagttactgggatcgatcggcgccgaagcgcagcgcacggaccgagctaggagtagaggcaggcgggcatacctggccccatcggaaaccggcggcgagggcgccgtcgatctggccggagctgaagtttcccgctgccgtcgccgagactacgcccgccggatcgagagccggctgctcgccattggacgtcgggaagcggcgccctcgacggaggtcgggaggggatcgatgaagtatgaggtccagttcgcatctgggctgctttttttttttcaaaacaacggttcatggttattcatttatgcttttctttttctgtttgacttgtgatctgttaagagtgcacatcgctccttccattaaaaaaaactatttgtgacttgtaatcggaggatgtgtcatatttagaattaaattttaaaaaactgttcattgaaatttttttagaatatttgagatgcacaattttttacgaaaatatactgtcgatctcgtacaaccgttgtgcgaaaatgatgtgagcgtgacgtcgcggatggtcacaaagtaaaagtgtgagaccgtgcggtcttatggaacgaaagtgaaccaaacagcgataccggtgtcatgccgatttaattagtaattaattatcctgattagtcaattaactaattattaattagtcgctaattaggataattaatcacttttattattagttaatagttaattaggtagttaatcactaatcaaatggagccgttagacggtgtcgctgattggttcagcgagactgttccgttccgcgagaccgcgcaataccgtccgcgacgtcacatctatgtcattttcgcgtaatggttgtgcgagatcgacggtatatttctaaaaaaaaacttggatgaacagtatattttcaaatttaattcgtcgtatttgtactaggtttttttacatgatggagaggttatgttgtatggagtaatggaataatgctacattcatcttgaaatataaattataaatatattttaactctaaatttagacaagcgctcatcaagattcgaagttagagatattttagtggtatggatatcaccactagcattgttttcaaatgtgttaggcaacttcggcttagttcttttttaaacattagcccataatttttctctcaaaccttgctatacatatgatttttgcctcatccaaatagttttgatcatgagttgacttgtactaatatattgacgtgtaattcttttgtgtgtttgtgaaaaagagttgacttataattttctttgggctgcattccaacctatgtttggaataaactgatatgttccacacgaaacaaggtaggaggttattagtgaataattaattagatattaacaattataaaattgaaaatgagtatatttcattttttaaaataaacttatatgtaaaaaggttttgcaaacacacaccatttaataatttggaaaacgtgatcacgataaatgatagaattgcaaaagctaaacgaactttcgaactgagcctatattgcccttatttcatacttatatgctagcctatttgggaaaacaaaattctcaatgcgaaaaaaaaacactcatttgcatgatagaattatttgatcacaaatttgacaactgaaatttaaatttttaaataaatttcagaccaaaattgatggaatgcagacaatattgccaccaaaagatcaccaattgatggcgatctgcgaggccgtgcgggtcacggagcgcgtctgtgggaggagaggcgggcctcacgggtgcggcgggtggtgaagagctcggaggcgctcgtcatggcgggtgggggagggtgtggcacacgtggcgcggtggcgatggtgcgagactgcgagctcctgtctcctaccggatgcagcgatggcgagggcacagccacggaagcctcagcgcggagatggcggcgacagtgggggtacggcgcagagatggcgtccctccccctccctctcctcctcgtccttggcctcttcgttccttttgtcgaatctgggagacggtggcggcggggactggggctcgagggagatgatggcagatccaggaggatgacgataacgacggtggcatggtaattgagttcagcctgatccgcgctaatgtgtttgattcattacctcgtgatgtgatattgctgctaatccatggggattaattaggtttcttgggatcaaattcgtgagctctagattaaatttggtctttttcgtgctgtttttggttgtctcgttgattaattgatttggggattggatagcagatcagattagaaatcggattcggtgggaaaaatagcgccggataaatcgaataacgcggtggtgacggacgaaacaacgctggtgaaaagatgtgacgattggaaaaatatcaatcttttaattacttaagattaagacttaagatattattcacttatctgtatgcctgctagataatattctcaaagtgaaactaattagatgagccaattatgcgaggtctgcaagagctgttgattagatgtttttttgagtaataaataaaagcgaatctgaatagtgcttacagatatttgcattagtactttgattagctgaccgcaatttgcatatgatttcaaataaattgaactttgttttatatgacatgtaacatgatggtgcaaagttgctgaagagcacctagcgaagttatgcactgcgatttgtttaagttgttatgttgttttagttttttcatagttggagcatcacttaagaaaccttctgccatcagttttgtgaacacctttgatatttatatttacatgtttgtcagtttgacattctaattgtaaatacatatttgtctattctgccttctagcttaatagaaattcctcttgattaatttttttatctaacacaaaatatttcacgcagctgagcattttgggctgcccacggttaactttggatggccttatttccaatctcaagtcatttaatacgaatgcggtgtttggaattaagcacctcagagttggaacactcttcagtttacggaaggagcagtacgaagagttattatccttgttgaataccgacaagacacaggaggtgcataatcgggggccaaagattccttcatgctaatcagtttttatcagattgcaatgatggatagatatgctcctgatattgagatgtgccctatttgtcagaactacaaacttgtttatgattgccgagatgaaggatgtgatgatagaggccgagtttagttccaaattttttcttcaaactttcaacttttctatcacatcaaaactttcctacacacacaaacttccaacttttccgttacatcgttccattttcaaccaaacttctaattttagcgtgaactaaacacacccaaaagatcaggtaatttcaagggttgtgctgtttgcatactgagatgttatgagtgtggaaggtgtgtagacaagttggcattcaaggagtcattttctttggactgggtttgccctaattgtcaagagaagaaggatctgtctcccccaatgaaataggggtttgtcccccaacgaacactcttcctctgctaacagagaacagcgtgcaatgctgtcatgcaagccatcttaacgtatcatttctactgagaaaacagacaaaaaaaacgatgagtttgttattcttgaaggcgcagccatcctgacatgctgcattagcttcttgcaagaaaaagaacaaaaaaagagtagttagtttgattcagcaaaaaaaaaagaaaaaaaaaagattgtttcgctactatcgtctaactggtgacatttcagaggtgagtttttcctgattgctttgatgttatacatcccattgaatttagtcttatgtgagagatcatttcctatctttggtttggggttgcttccaaggattgctgttcaagagcggaagcacaacgtgaactttacgtcagtattgcagcagcagctgatattcttggaatgttaagatcgaagatgaactgctctcctcctctcacggtctcaccagagcaaatagaggattgctgtaatttaccttatacatgcgtgccgcaatgttgatgttgtgtaattctgaaaacatttgtcacactaccatgtaatttacaactacttgcagagaaataaatgacttctaaccaaacttttgctttcatgtcaatttgtcaagtatggtgaatggccgtcctcgttggtaacatgatgggaatatcctggaagcaaacaacacctgtcggagtgaatttctgctgtttcgcgtagtagagaatgaaaaagagaaggccaactcaacaattacatttggcaaatgaaaagaaaagaaaaaccaaagttcagtttgagatcgtcacgttgagttaggctatagcacataggggaaaaaagcaaattatatttgtgcctctgtttggctaatctgcaagtctgcttgattcattgccacctgtttcaaggatgaaaatctgagaaaacatgtggaactacgacaagacgtatcatggaacattttatacgctccaaaaccgcagtaaaaacaccaacgatttgagaactagtcacgcaattaaatgtttttgattgaaagaataaataatcagaatacagtgtgcagccattggcagagctaatcatgggaagaattctacatgaccgccaatatccttgcacaacaacttggcttcagaagcaagcttactgcttctaaaaatcaccaggtttgtcaaccggtgcttgggctgtggttcaaaggatctagcttcggccttcttaccaagcagcaccagctcccgggccggcattacattcccccaccagaaatcacgcaggacttcatggatgagctcccagtattcgcgatctctaggtactcggaaaacgctgcttcggtgggagtccacagtagagctcgacccaatctctggccattattccatcaggccctgcacctgtggcatgtaatagtatggcatagcgcgcccatggcagagcgaagctcaggctttacccttgttgaacggggcacttgacttctaggatcccacggtttgggtcaccccctagaacaccatcaggtgaagctccgagccagccaaagttggcctcagtgtgcactgcgaagccaagggaacccactgaccgtcgggtgatgcttgtgtactgctctatggctacactttcattcaccgtgccccagttcatggcagacctcgccgcatcctccaacttgatttctgttgatccaaatactttctcgctccacagctctgaccgtctgttgccagcccagaagcccaaggcagtgctgaaggtgcttgtggtgagcttgtccttgcggagagcaaaccattcctctgatcgctgagcaacatccgaagagttcagctgggaggacaccacgagagctgaagatggtgagagagatagcagggatgactggctatagatctgcaatgatgaacctgagcagctctgaggaatatagccttcaaaatttcgtcttgatggcaagaatgcaggtgaggtcaaccgcacacgaactgtcgagcgaaaggctgttggaattggcaggagtgtcctgaacaaatatgaaactgcgcaatggttaaacatcatgctaaatgatggtgcagtctgcataaatatagcatagctgagaaagcatacaggaagtgctcaacaagaatggttaacctctgaatgtggcatacatgaaaagctatacttatttttatatgatgaacatgcttggctttttgcaagaataatgcaagcaagtagcaagggtttattccttgattgattttaggaagcaggcttgcttggggcaagtaaaagtctgggctaaaactaagaaagagatcccagcttctcaagcaatggagtatactacaatgaagcaaactccaggaagatgaaaaactgcaaatagctctaacctctcacgccggacaacaaagattccatttacagttcgatcaagggatatttgtctcctgcttattttatctatgtgttatcaaattatataggccgagcatacttcagtcagtatttaacatgaatccaagcctcatgtatactactaaaacaatctattcaggtgcagtcctgatgacgaggtgaagctaaatttaagtcacacccctgataaagctgaagaattgataagcgcagctatacacatgatatgaattagcagggtaatttgaacaattttctgaaggcaagcaagaatttcagaaaacgaaattacagctcattgagagtattgaaatcttataatccttcacattttcccttatctcttcatttatcttctttttctcccaaaatccctttggcatttggcacaaatactcaattaacatgtatgcgccccaaaatcaacgctaggagtgtccttgcccccaattgcaagattcagttaaccaaaatgtactatgcatcctaatggtcaatggagcatttggtttcattccatactttgttttgtagttgcaagctcctccagagtttcatgccattattaagcgttcacttcccacctagtcaccaccaaaagacattgtcctaaaccc

SEQ ID NO: 82987 - DNA, 1299 bp, Oryza sativa
gattataatactctctagctaccaaagccagccagccaagtactactccagctaggattattgttcttagatcgtactccgtatatgaaagatggtatcaatatgatctatgagctagttagtggttatcgacctaattaacgagtcctacatgtcttaattaactaactaacattgtgctctaaaacaatataaaatttaactatggcgtacttatgttctcgcaactgtttgtgtacaggattttcagttatgttaacgaccacggctaatgtattctttttcaacatacttttatttgagctgcccccaacagactggtgtctggtggccagatcgaataacgatcgatcgtacgaacgtaccgactttcactcgatcatcaattcatcactcgtgatgaatcttactcctacgaaataggggttgtcaaatctaactaaatcaagggactttttattcgtcatgcatatatgatcatatggcctacttttacctttgttggagcaatataagtcttagtattaggcctagcttatagtatatcatccgctattaaattttaaattttgaaaattaattttaaaaattttgtatcttagtttattttgtaatttttcacttaaccaatcgataaaattcaactagggaagaaacgaagaaccagtggtatgatggtggagtcgtgggtgtataattctacccaccatggtttaaatcatggtgctcacgaatattacgtacatgcatagactttaaacatgactttagtgagatcaaagatgtgctgttagtttccgtgtcttaaatcatgtgttagggatgcatttcaggtgatccggggtgagagatttgtttcactctagtgcagctccacttgtgagctaggccaaagcgaggcaggccgagcgaagagaggtaggagggaacgaactgtgctagggctaaaaagaaggaaggagcttttggcccaaaaccaaggaaggatattgattatttttttcaattatactgtaatatagcgatctcaatgtttcaattgattgctcagctcataatagccattgcacccctaaaaaaaatagctttacttattgcaacgcacggtttttttctattaaataaaatatatgatagttaagtatttcttggttttgttgaaaaaacttatataaggatgaatatgtaatgaagagagtatttaatataatcagccttattttttaaaaataagtactgctctcttgtttttaatataatcagcctgagtagtagcatagcatttcttcttctttttta

SEQ ID NO: 82988 - DNA, 7234 bp, Oryza sativa
  unsure (1)..(7234): unsure at all n locations
ccgtccatattcgttgtactaaattatatcgtatctcatattatgttgggttttttttaagaacgaagggagtactctcctgttaaaaaaactaatatagaatcaaagacgatattttctaatagtaaaataaataacagcctcttgtccaaattcgttgtactatacaatgtgattctctatattcatggtagtagaaaatatcgtttccaatactagattagttttttataggacaaaaagagtacattaaacatctcaaaatgcaaatgatttacacatcagcaggcagcaatgagagcaaagactccccaatgattagagcaaaatagcatgtcgtcccccctgcatccttaactggctgtgtctcgcccggcctgaatgcccctgcattctgttcccccttcctcttccatacacagcttagatctggaatgagtactagttgtacatttaaataattacaactcctccaataatccgttaatcatttggtccattaattttagagtatttcgatgcaattatatattacatactccctcctgttttgtgaatgatcatttgtcttatttaaaaactttatgtaaatatttcagaaaataaatatttacacaaattacaacaaaataaatgatgattacataatttttttaaaataaaacaaataattaaacttatgttaaaaaaatcaataacatcatgcattaaaatacaaatggtgtacgtaatgagtaagcttgcacgtactcctgtaatataatgccgactggcggacagctagttgcagtgttaaggagtacttacttaggttttaaaccataatttaatctccaattacaggagggattaacttaacatggcagggcatatgcaagcgtgagtgacagctgatcgaggaagatcataggagggtaggccatgtgaggccggtcggtcgcacacaatgattggccagttacgttagtcgcccattgatgaatgatccatgatgatcatcgatgactattaattaattaaagctggccttaattcgatcgatctcatctgagctggttaattagaccggtcgtatcatgggtcgatggaccggtagtatatataacacactgcacgcacgtaccaacataattaagccctttaattcattagttagttagttaattaatcacactgcagcaggaatgattaccacaacatggcgttgtcgggcgcgattatgtatctagctactcactcaactacactcatatgaatgcatccatcttgattaacgtatagtaaccacattatatatgtgtatatgatgtgtcaagggtagattaagggtatgttcagattgataccaaaaataaaccttaccaaaacatggcaatgccaaaattttgccaaattggtaatattgccaaaactttggtaggattggtttaataatgttaccaaaattctatacacttaacaaaaagacacgaatatagggaagaacataatatccaatcattagaatgtgtgatgcatgcttcgaacccagaacgtctagcccaccatcttgtggagctagccggaaaacccctgggtatttctcaatatttgttaaaaaaaacgtagttatataattgtcaattttactaaataatggtatagttgaaaatgtcatcaatcttaaccggctctaatttctcctctctgcatacatgcatggtaatactgtaagcaatgtatatactgtagtcatgtgacactaatgacatcttcagaaagcaagaaaattctctgatgcatctgaagttttggttaattaatccttcctatgcttttgagtttgttgtcaacttcattgtataccccgaattttagaagagtcaatttgttggaatggtctagccagttaattttgttggttttgttagttatgtcgtttctgctagatactatatgtagtacattcttctgtttttttcttaatgatgagtacaagtgtatattatcttcattcacactatttcttttcaacaaacacaacaccatgatagttaatccacctcaaaaaaatgcagtacgtacggattatatgatgtgcacatgatgtctaccattattcaactaactgactataatcaaccaacattgacatgaaatgcatgactaatataggagtgcgcgcacacacaacatcacattaattaaatcatcactactgattgcttaattaggattatgcactatatacggttcatatctatcatgcaaagagcttagtctctgcaacttgcacactgatcacaaattggctcctctctgtctccagattccttttcaagtacaactactgtgcaatgagtactacctaagcagctatatagcatcttataattcagacacaaagctggcaatatagtccatgaaggggttaaggaccatgtagtaagctgtctcatggggtcgatccatcattagaaccatgatgaaattgatgagttgagtcgaaaatgatgagctagccagccattgccactgtaccatcatttgatcgatctgctgcttaacccaaaccgatcgatcgaccgaccgaccgagccatgagaccagcagggctccacccagcagcagccatctcgacatgcccaaactggattgtctctcaattttcacccgggaccaacaataatgtcggcatgattaaggcccccgtttggttttagaatggatttttaggagtaattatgtttatttgtaattttagatgtgagagatcgagttagtgcagtggaaaggggtgtacgattccaactccaagattccgtgttcaattcctaacacgcttataattatttcttaaacaaatgtttggagggacgtagcgccctccaaatctcttttttttctagacaacaattttctcacaaaacaaaattacaacagtttacaaatctattcgaggttgaattttatgaacgatgctaatgctttgtaataatgaatagttgaatgcatgtacaccttatgcaaaagctggaatatttctttatccaaaaatacgaattcatgctattactctgacataccaaagattgaaataggtagatagcgtaggatttttcaaaggaattgaattaaatcgtatgaaaatcctgcaaaattcctccaaataccgtcagtaaagcttcttgcactgtggctagcttcaagctcaaaactgaagctcaaaaattcctagattggcacaactacacaacatctgaaatcgtgcagccgcactccatatatttcttacacagatcgatagcgactcacccaagcacacgtacacagcaacaaatattttggatgaagaannaatatctnccttgactggactagtttattagctgctaatctcacctgggacgaagaatccccaatattattattcagatgattgatacactcgcaagcatgcagctgcaattctactaccttcttcgtcttcttctcatcaagctctatagctgtattctgtaatggtgcccgttaagtcaaaacaacaacctcgatcgcaaactgcaggatcgtcccttggcttggcctcaagaatcttcaaagcagatccacccacgcgccaccagctcatcattgtcgaccaatcttcttttcttgatttcaatccatgatcttctcatctatttatacccctcgtcttcttctcctcctctcttcatcgtctccgacgccgacgaactcccactcactagtagcacttacttgtagctattgatctagagcacttaagacatggagaggcaaggcttggatcttggcctgagcctcgggctaggcttgacgacggcggcgacatggccggctgctgggttctgtctgaactccggcatggcggagcaggaagtgatcaggcgtgatgatgtggttgcggcgacggcggcggaggatgagaggttcgcgtgctcacccggcagcccggtgtcgagcggcagcgggaagcgaggcagcggcagcggcagcggcgacgaggtcgacgacgccggctgcgacgtcggcggcggcggcgcgcgcaagaagctgcggttgtccaaggaccaggccgccgtcctcgaggagtgcttcaagacgcaccacaccctcactccggtaagcttcttctcctacccatcgccaatggtggattggattggagatgggattgaatccgagagaatggcatggctgaattttcttcctctgatccatggatgatgtgcagaagcagaaggtggcgctggcgaagagcttgaacctgcggccgcggcaggtggaggtgtggttccagaaccgccgcgcgaggacgaagctgaagcagacggaggtggactgcgagcacctcaagcggtggtgcgaccagctcgccgacgacaaccgccgcctccacaaggagctcgccgagctcagggcgctcaaggccacgcccacaccgcccgccgccgcgccgccattgaccaccctcacaatgtgcctctcctgcaagcgcgtcgccaatgccggcgtgccctcgccggcggcggcgatattccccggccacccccagttcttgtgcggattcagagatcacgccggagcagcgtcgtcgtcgtacggcggcgcatcatctggactcgcgaaggcggtcagggcggcgaggtagatcgatcgatgcgcgcgccgccatgatcgacatgaccaagctagcgatctctagctagaagatgatgacattgagcaagacgcaagagtagaacagagttgaattgatctctcgttttcctgtgtatttttaaggatcaagtgcaaagttaatttagtttttgacaaatgtaggatggatccatgtatgcacatgaaaagttgatgaaataacatgagaagaactaattaattgaccttcttttttaaaattcgtaatttagtatactcactgttttgagctgaattcttttccctctaccaggcatagcctcttttttttttcttttaaaaattaaaaatgtagctgttgaatctttggtagttagcaagcacaagtgggaattgaagcaacttttgacagttcatttagattgggagttggtctatcgtttggttagttacgtcaattagatgtgcacacttgcactaatgtagtagtatcatctacgtcagttttgagcagacaaacaaactgcaacttcaaggtgtgacttacgattttagttactctgttgtagacttatgatttaattattagcgtattcttttgccatccttaaataaaataattattagcgtattgcgccagcgatttttggccttacacgacacctatcttaggctgtgtttagttggatccaaagtttggattttagttgaaattagagatgatgtgaccgaaaagttgtgtgtgtatgacaggttgatgtgatggaaaaggactgaagtttggatccaaattttggatctaaacacagccgtagtctctaaagtttattttaaaatataacaacttctacactagcataatgaagtgttaatgggagtgaggaagtgtatacttgtcaacaattttcagggccggctcaacaattttgagagctctagaacacacttgtcaccagagtgtcggaggtggactagtacagtggagttgttgtgcagttggatggtcgcaccgtgaaccatcgcagtgatcgctcatagtacgcgcagagttcaaaatggtacacgaaacatacgacaccttgtgtatacatggacctaggcccctaatcgagcaggggcctaggccgtcgtaccctgatctatccacttgaatcgggtctaacaattgttactctctccgtctcaaaatataaatatttttatctgcgtgtccaaattaatagctaaaaattgctatattttagaatggaggtagtaaatcagagtagtacctctataatctctactacttaaaagtaaagtcatccgtccttccacccctcgcacatagtgcatgcgctcctcttcccacaaggtcttaatgaaaaaaaaagctctgtccaagagaaaaaaaaaagaaaaagaaaactgttgctaaaaaagcgcatgctttaaaatagatcacacattccattctaagtggtatggcccctattctcattctcacaatctcagagatatggatccgttttaacgtatgaacatattactaagttaaatgtttaatgttatggcattgagaaaacatctcgttcgacacttagaaactatacatgcaagttcatttttcttggctcacacgttcgatgcacttaaaaacattttaatttcctcccccgagtcaggctcactcattttatccgtgctagctagttcattagaaaaccggcactactaaaacaatatcatgtgctaggttgtaacaacaaacgacactaaatatatgacatacgatgttatcaatatcttatttttataaaccggcatcgatgtagtctcatcaatgtaggtttttgtccgtttgggatgcatggtgggaaaccttttatcaatatcggttcttatcgacctgatgctgaatgggtttaactatttgtcattttcaagatgtgacaattatggatttaccactcatagtctataacatatgggtccttatatatctatgacatgtgagttcagtgatgaatcttaattaccgcttgtaagagtggcaaaaagttaaatatgtcgatgatgataattgatagggtacctttgagcagttgtatggtatagtggctgtacatacatatacgggcctaattattctctggcaacacttctctctaggccggtcggccggtcaatccggccatgggagctagcttagagcaagtttaatagtatagccaactactagctccaattcatctatagccaatctaatagctcattcgtacaatagttacatactacactattaatacctggtcccacctgtcatacacactgtgtcttagagtccgtgctacagctggctataaatttgtagcccactactcttctctctcatcatttatctccttaaaatatatttacagctggcttatagcctgctattgtacctgctcttaaagcaagtttaatagtatagctcactgctagcttcaatttatctatagtaaatctaatagccaattcatacaatagttgcttactatactactaatatatggtcccatctgtcatacacacaatatgtcttaaagcccgcgcgcactgcagctgg

SEQ ID NO: 82989 - DNA, 711 bp, Oryza sativa
agtaaactttcatgtttaaaacaactccataagattaacttctaaagatgctgtcgttttataaacgttctgtctagcatgcatgacattgtttcggtccatacatccgcagacatagatgattgaaatgaatagcatagcttagctaaccttgtgcaaatccagtcgcctgccttccacccagcacgaactgcgctgctgtcgagggcacgggcaaagtcaccgttggcaacaccaccaccttggcctgctggaaggtccttcacaatggcgccacatttgaagcagcttgctcggctagcaaagttgtgatagccgcagttgcagtaccactcgcccgggcgaatgtccagggaggtcagcacaccacctgggacataaccatcgccaagcggcaggtcctggcgtggggtatggcagcgctggcagtagtcccggcggctgaagttgagatgctggcacgatttgcagttccagtctcctggcttcctctggatgttcattcgcagttaagccctgcatgccatgtatgaagcgtcaagaagctgtggtattgaatgaatacaacataacacaacaaaagttatatgctaagtactcttaagtcttaactaatcattgtctcatttattagtatattggactactgatcaaaagaccatgctacgaccttgcagtttacgaatatatccaggaaccaatgtgaatatg

SEQ ID NO: 82990 - DNA, 2309 bp, Oryza sativa
caaatttacaatctctctatgactcgctaagcgaggggaagcgtcgttggagaattaacgcaggaggcagtgacctggaggtcgttggagagctcgacgtcggcgatggtggtgagggaggagaggtactggtcggcgccgagcgcggcctcggggaggacggcgcgctggaggacggggtcgcgggtgagcatgtccgcgagctcccgctggatctgcttcgccaccatccgcacccgccggtccttcgccatgcaccgcaccacgcgcagcgacgacgccgacgagggaggcggccgcgcgggcgccagaggggacgcgacggcgaggcgccgcggcagcggaggggacaccagcggccggcaggtgaacatcgccgatcacctcgacgcgagtgtagcggtggcggtggtggcggtggtggttttccggcggcttcgcggtgaggccgtggaagacgatgagtcggggaagtgggaggggatagtgtcgtcgtgtcgaatcgaacaatatctcgcgtctttttttagttttgttttatttgaaagcattttagacgattttaagaagagtttagtgcaatccattttatacagttctggttgtaaaagaaaactccagcaaaatcatcttgcccattcaggccaaaattctacaaatttctctctgtaaatttcatcgtgccctggaaaggcactaaaaggataatacgattttgaagactattatctgatgtagatggagtcatagaaataagaaatctaataaaaatgtcaaatactccctccattccaaaatataaaggcataaccacctctaacccaaagacaaaaaaataattattattatcatctcgtagttttattatcctaataaatacaatgcatgtatcaaatagaattagagaacatgagagtaaaggattttaaaaagtaataatttaatagagaaatggtcatagttaagggcttacatgcatgcatgccttatattataaaatactccttccgtttcaaaatgtttgacaccgttgattttttagcacatgtttgaccgtttgtcttattccaaaaaaaattgtgaaatatgtaaaactatatgtgtatatgaaagtatatttaacaatgaatcaaatgatatgaaaagaataaataattacttaaattttttgaataagacgaatggtcaaacacgtactaaaaagtcaacggtgtcaagtattttgaaacgaagggagtataagaaaagtagttgtgccttatattatggaatggagggagtattttgtaggattgattccatagtcaaaccaagcaacatacagcccatgggcaccgtgcccacatcttggaaaggaaagcccatctaggtaaccaggcctataaacccggcccactatatcatcaaatgccacgttgccctagacgcttaaaccctcacctcccaaacgaacacacacctcaacctcccccgagacgacggcggcgacggcgacggcgatggcgaaggagaggaagcggaggcagcccgccgacgcgccgccgccgggggacgacgacgaggggagggaccaccggagggagaagaagccgaggaaggagaggcccgacccggtgctgccgtcgcagatcaagaacaaggacaagcgcaaggaggtgcacgcgaagctcaagcgcgagaagaaggcccagaagcgcaagctcgcccgcgagcgcggccaggccgcgcagcgcgccgtcgagctcggcgagcaggcaagcgcgcgcctcgatttctcccctccgcagcgagctccccctctcgaattcctccaagctttgtttcttaggtttttctgatggttttcattttgggtgttcgcagccgccggagaagctggtgccgcggacgatcgagaacaccagggaacctgacgagaccgtgtgccggcccgacgaccaagaggtttgtgcacgttcttctgtgtttcttacttggattgatcctaccaatgcgagtttctcaattatcggagtaattgtaattttaatttctaattgtacattcgaacctgtttgactaatagtagtttggaatcaaggacatttatctgacagggtctccttaatgttgcattaggtttgtggaacatgagaattacatttctttggtagttaggctaggtatgcggtgaggttggggcaatttctgaattacatttctttggtagttaggctaggtatgaggtgaggttggggcaaattctttctttactagttatgaccagggaaggctatctggaacgtggtgccttgccgaggttaaggaat

SEQ ID NO: 82991 - DNA, 9404 bp, Oryza sativa
taattatttgataacctctattcttaagaagttgcatctaacactttatgtttatctgcacatatgtctacagaggggacctgcctttattgaggagttaatgcaagtgatacccaattcgtgttatgttaaaagaggaacttatgaactcaagaaagtatgacatgttcaaagtagctaacctgttcatttgtttgaattagacacttcatatggactgaaacacatttctttttagattgtggaatatgcaaataacagagatttcacttcacttgttgttgtccacacaaaccgaagggaacctggtaagaatccatcaatttattagttcaaaatttgcacttgttatctgttatgacatatttattgttatttgtgtcacagatgctctactgatcatcaatttacctgctggtcctactgcacattttaaactatctaaacttattctgcggaaggacataaaggtactttatctgtattttctttatcatactagcaaaatgcctttgctatgggtaaaatgcacatgcttatttgaatatatgttattcacttgattcaaatgaatattagactattatataatacaagaaaatatcaaggactattttgtaagttgtgcaaatgtagttgtgggttggtgaaccaccaccaccgctattgtcttttacagtagtatagattatcacctactaactaatgttatattgttttcttaaataatatctactgaaactacaactcttagatgagttattcaaaattttgttggaaatggtaacctgtatttatttatttttatttttgtttttgggagaacttgttgaatagctttggtgttgtctacatatctttgtgctaacttagcatatattttcaccataccaaagggataggacagcaacactgttatccatcttctatgtgttctgataatctttgtatttgcattgtgaagaacaaatagtaacagctacttcagacaagcacaaattagtgctatttttgaagaatcatatgcatactatcttctgctactgcaaatctcctgtattagttagtttataataactgtttgatctgtttgtgtttttaattgtgatctgatcacgatatcctttgttcttagttttttgcacacatgtaagagtgagaaaatcccacggctgtctagatcttagcaaattgacaacaatatgctagttgggaactgtgattatgtcctctccagaaaaaaaaaagttaactgtgattatgtgttatgatgactgagagccaacacacatggctattttctgaattctttagatctaatgctgatctttaccctattaaacatttaaacctctatacacaaaaggaagaatataaaattatatgagtatatttaaagtcagatagtaaatgtgccattgttttattttcagaaatcttaaacacaatcttgtttttaccgaatgctatcaggaattcattagggacatactggttgtggtttggtatattgttatctgcaggaaaagagccttgcttgtgcataacaactccttttgagggtcttatattattgttagtaattagtgcggtggcctattggctaatataaacacatagtgtagttcagaagataaaacaaactttgatgatcacgttcatcacaatgatgaatatgaaaatgtcaactaattcgtaacgttgtttagatagttatggtaataacaatgattatatcatagctgcatatctgttattacaccgctaacctctttagactaaaggtgcactggaagtgaacaaagcccaagttgacatcaattggtcatcctacttgtctctagtttgtctctaggatgacttagtcatctgagctttgccctcaaaatcaaatgtgcatgtgactatgttcggtatcatatgacatgtctgctagatgctgatccatgtctctatccaacatagcatgttttagttttagtttttccagtctttcaatgattgtataaattattgcaattgcaatggagttgggttgataaccatgttgctgatggtcatctagattgatggaaagcagaaaaaaaatagctggaaggaacgtctttattctgctgcacctggactttgactaattttagtagcgtttcatatccagatttattcagtttatttgatatgttcttgttaaatgacaaaaggttctcagcttattttccaatattatataaatctgtttttgaattttagctttgcgaaccagttaatattcatggctttgtttacctttttggttgcagaaccacggcaaccccacaagtcataagccagagttagtgttgaacaatttcactacgcgccttggtcatcgtgttggaaggtgatttgtgaacatgaacccttgtgctcctttgctgatcctgtttagaagaactctgttttcttttacattagcatgttcatgtctgctgtttgcttcacttgtcaattttccccttctgccttttcaggatgatacaatctcttttccctcaagaacccaatttccgtggtcggcgagttgtgaccttccataatcagagagactatatttttttccgtcatcacaggtgcatttatgaaaattcaagtaggaaaaaccatgttattaaaggactcctgtgtgtctacgtaattgtcttttgctgggatttgttgcataatgtggatcattacaagtgtttttagtaattacttcctggacatttctttagctcataattttgttgatctgtgaagtgtgttatcaaaaccatgctatcctccttgctagtcttgacatgtgcttttgattatgtttgtggcttccattttactgtgagtattcaaacttattttcttatgcaatactaatgctaggtacatctttgagatgaaagaaaacaaaattgcttcaaaggacaagaaagctaagacttctgaaagcaaaagccaacctgagaagcaagtaatttgtcgcctccaggtatttgagctacttattcagtactcactacaagttctgtaggtgatggcacatatttcattcagttcacaatctgttattggtcatcaccatctggcaaccccaaccaaagtgctttctatgttgcgtgtttgaagggtgtttctggttttccgagatatgctctcgctttcaacatcaaatgcttactgtcttgccagttagacaaacacaatgatatcattacttaggcctaatgctatttataattgttaccatgttattattagccctagcagtaaacctaagctgttctgatgaactaggaatgtggtcctcgcttcaccctcaagctgctcaccttacaacatgggacctttgacacaaaaaatggggagtatgaatgggttcacaaggtactattattcatttaccgtcccatgcccacactacactctacatgaaagttttctgacatgctgcaaatcttgcatcattgcatcatttacagccggacatggacacgagcagaagaagatttttcttgtatttagcatgggatcctcatgccacaccagatgaaatattagtgttgttcggaaattactgcatattcgttttgtgcacttagaatcgtatcacaaatgtaacagacctctatgcacatttgaagcaattttgatgatctatcaaatgagttgagctatacgaatcttggcctctttactatatggttgttgttcccgtatccagtatcttgcacaaaagctgccctttgttttgttccagccctaatatgtcttgctatccacaagatgtatcatcaaatctgctgccatacaaaggtcgttatcatccaactgccatgggattacacctcattgttcctgcccttctctccatccaagaacttatcattgctggccccatgttcttcaaggctgctatagccaccagcggcgccatgacagccccaggatcatcgtatccccgaggtatacctcttctcggcctgttacctactctggttataaatatttgatgtttaggttagataacacttattttaaaagtgaaatatttatacctgattagcctatatagtactctaacttacaagtagtaatgagatactggttggccattgcccatcaaggccgctgatcttttaaccctttttattactgcaaagtactagatgccactcatttaaccctttttattactgcaaagtactagtggatgagctgatggtataccctatacctctttctctatctttaagactgtaattacaacttgtgatatctgtggccattgcccattgctagcgctgttaaacttttgacaaatttcatgctgttactactgctaggtagtggctgagctctgatgagcaggctggctggcagatagctgcctgctgctgggtactgctgctacacatggcctgggggtcccatcctatccaagtaaggccatatgtttctgcgcgtacgtccgtgcaggccagggcgtacgacacagaggtgcgttctctctctctccttctcttggtcgtcttctcttttagatgagatgagaggatcgcattgcaccgctagcttgaaagagaggctcctctccatagagtaattgccatctgaaattgctgctaggtgggttggtcacgagtgcagcagtgcagcggcacatggcttgctccctcccctggccctgccatgttatctgctccagtttggtccaatgggtgagtgaagttatactgccacttcatctctgtttctgcagcatctgcatgctagctactaggtaaatgtttgttcatccctcttcttgaacactgtcagttagctgcatatacatgctcagttgctggccctggccatggtagatctcgagttacagctaaaaatcaccccttttatcttcagttttgaactgagttccaggtcactagaagtcttaaccatgcagtcaaatttgggtgagcagcttttatgcagccatttgggtattaaagtggatactggaatattagtatcgcgcacaaaagctaagcctggacataatttgggtgagcagccattgcgtacatgcacctacgtgcaactaggcgttaattactctcgtttttagatgggaaatacgttaatttatggcgtgttactgcatgatagcgaagatgatcactctgaataatctgcactgtacgtggcaagtgtgcatgcatgggttgtggtgcagactatttacatgagtggatcagatctgtgcactgttggatcttccgtgttcgatctgtgtgtgttctcatgcaactcaaaactattatggtccgagctgagcgaaagcaactgccgagtaacaactaagctacctgcatgtagctatatatacttctgtagtctgtaccgtaccacgtacgcacgtacaactacgataatatctctcggagggcgtatcagcgcatagccaatatgaggtgctaattaatatccgtgcttgtatacttcctctgcctcgttaatttgtccagtttcatcgctcgaaataaatttgcgtatagttacaccagaaatctaaggtatatactcctcatttctaaaatgtagggccagttcggtttggttccaaattgtgccctatcaattcattggtaattttcaatagtgtttctagttgtttggattggtgccaaattttaacaatacatctctttagataaaaaagttttggccgtctaaatttggtagtgccaaaaattgcttaaactttggcactaccaaaattttggtatggcaccaatccaaactgacccgtaattattttttaaatctaaaatagaaatgtagctatattttaatacgaacagagcaattactggcatcaaattgacgcagtacgttaagtaacatgaggtccttccgtcctttgctagtggctacaaactacaagttatacaaaaacaactagttatataagctgcctgtcagtcagtggtggtcactactacaagcacacggcgatagccaatatgaatggccagaaaattaggctagctctctgcattcacatacgtactgacgtacatatcccaatcaatacaccacgttgagaggctttcggccggcaattaagcccgaaagatatctgcaggctaattactgatcatatacatatcacacagggatattgcacaatcactgcatgccagatgccacattatattgccacatatacacccgggctagctagatgcttgctagctagctaccttttcaacctcatcgtcattaactattatcacgactactctttccattaatcaaaatgtatacatatcaagaacacatgcatggttgcattttggatatctcgatctctagctatatagctagctagctagcttcttaattagccggccggtcattcattaccttaatttgcatgtacaacgagaccaaaaaaataatgagtaaatgatgattcagttcgttcgaactcatcactcaccaaaaaaaaaaaaaacagcatacatgcaacgacaccagctaagctagctagctatagctccaaattaattaaacttcgccttcgtcttcgtctacctctagctagggcgcgcgctaatctgcgcatgcgccgctagctagctccgacgatcaagatgatcaatcgatgaatctcgatccggccggtgtggttcatatttacacggtagtattcattgctagatcgagctaagctagctgatcttgccggagcaatggaagaaggaattaatatagctagtgtacagatgcggcggcggcgggttcagcgggtgcaggagtagtggagggaggaggtgagggagcggaaggcgacctcctcgcaggggaggacgaggaggccgccggcgccggcgccggcgaagccgaactcctcctcggcgcggcggagcagggagcggaactccggccggtcgagaagcgcgaggggcaccacgaaccgccgccgccgctcgccgacgtacaccgcgaagtggcccctcggcacgtcggacggcaagccggacgcctcctcctcctcctcccactcgctgacctgcttctgctcctgctgccgccgccccaggctcgagcaccgcttcagtatctgcttcagccccgccgcgccgcccttcttgatcgccattgccgccggtgagctcaagcttgctgtagttggtggttggtgatggtggtgacgaggaggcggccatggcgagggggtatatatagggagaggtgggcgaggtcgtgaggtctcgccgtggttggtgctggtggtggatgggcccgcggcgcccgtgggcttgccgggcctgggcctggtacagggtgtgggacccacatcgcaggtccctgtgtttttcaccttagacctagtaattagttgctagttgctactacctccctcccaaactaattacattttgagagaattaaagatagattagcaacaaacacaatttaacacaataacccaatttaatgaccacacattacctacataaacttgattaaaaggaaggtcgagacaataagcccacttaattaccattcttaaacttgattaaaaggaatatttggatcctttgtcagcagaaatttttttgggataaaatttaaatgatagaaatgtaattatttaagacggagataatactagatagtaatggtagagttgcaatggttgtgattagtgaatctgatctgataatggtagtccataatgtggtaccttggggagctccttgttttttcatttttcctttttatacaggagtttttgttgagtgctagtacgggcccattctttgaagatgaaaattgatggatgatcgccttaattacagggatggattaaatactatatattataaatctaataaataacttagaacaatttatttaagcaattctgatttatgaagttttcggacaaattatagttatcaaagcgtggcaatgcatatacaatctatcagggttaatccaaaaagagcgaggccttagatttagagttaaatgatgtaatgtctcattttaaatatgtaagttcagaatttcccacctttttttacttgtatgaaacatggtgattttctggcctttcgaattggacctgtttggaatatggtaatcttccaaccttcaattccgaataagtcaattttcatatccacatcaaaatgaaatatttccttcctacgttcgaggcgggccttcatagaatgttctagaagaaggttgttcgaagttatccaagaaggttgttctaagttttcgaaagtgaaaagataaaaaggaggagaaaaagttgtgatggggggctagctaaaatcctcgatatttccctactcttgcaatttgcatggtagagacaaggtcaacacactatagttagctagtatattgtaggatctaagtatcaatcaagtggcagtgaacataaaagagagaaaagaggagctcaagtagtggggaagcaacttcaaggggttgacatttgacaaaatggcagtggaaaaattccaagtctcacatcaaagtgagtgatcaaaaccaccctttaatttcttctgctttttcaatgccctgcagccagtgttgttgcagacacgttcaataatggtccatgatccatatctttcaggtatctctgaccactgtacgtctgtaccggccgttgccgctgctgcatcctctacgcatcacaaaagatgcctagatagttttttacaacagtttctacttgcatttcatcaggaaaaaaaaaaagaagaagattcatctgtgtttctgaaagagaactacaacaagatttctctcctagttcaggttaatcaggttcaggagtcaagacttcaggtagcaattttcaactattgataatatttgaataaattattttattttattttatttaaaaaaatataaaactattaaccatgttaatttaacatatgaagtataaatttcgcatggatttgagatctcgagccgtgtcaaatagggagatggtaaagattacatagtgaactcacatcctctagagccgaagtattgcaagaaccaatagttcacatgttaattaactcaaaatctagtgcagcaatatccctcaaactgatgtaattaagtatcctcctagctaagtagctaggcttggctacttcagaactaattaatcttatctttattcagttaactaatctttgaatgatagttgatcaatcacagatagtatgtattatcagctggtagatctgcagggcaaaatataatcaagggctgccatgcacttgccactggcactagtgtggttgcatctcatgataggtgatgttgctatgacatggctactgggcgtacggatgggtggccacccgttt

SEQ ID NO: 82992 - DNA, 59088 bp, Oryza sativa
ggcagggagggagctagccatgactgctaggtgagctcttcacgcgcgagatggaggaagaagaagagccaggggcatttctgtccgggatggcattttggcgaagacactctggttgaggaaggtattccagcgaagcccgttttcataatggtattctagcgaagccattcttatgggatggtagatatgcaattttctcggggggatggggactcatgtacacgccaatattttcatctgacaagtgggccacagtatgttgcaacaaatctcacgttatcttggacggaaaccgttgccacgtatcttcccgggagttatacaggcatcccgtgtgcattgtcccacgcccaggaagcttcccgtgttctttgtaaaacacccagaaatactttttgacacccgggaaagtttaccatcctggtagtggtttttgggtatatgaaaaataatatattcaaatttgttgtgacaaaatctttcatatgatattacctactaaggggtgattttgatcttatagttgcatagcaaaaccttcagtccttgacctggctgagatgcttatggagggtaatggatggtttctgtaggaagctgagggtttccccctctgttttttagaaaattaagatgcatatcaataagtcaaaaggttgaaattgagtcaataagttgatattgatcagcatattcaattgaccattcatggcaggtgaaagaagctgaaaaggctaaatcaatatttgcttttctaagaaacgaaggaaaatcagtcgttggagttggaggatattgttggggtggtgagtcatattgatcaaacacaagaaaatgtatttatgtgtttatactttatatctatatatatcctaatctatgaatattatctaaaaaaatcttaatctatgaatacactcttgaaacttcctatccacattatactatgtttgatagaaattaaagtctctaaaaacatgtttatctggcaggaaagtttgctgtgacggtagcaaaaaccaatgaggtagaagcggttgtcatctctcatccttacgctgtgactgctgatgatatgaaaggtgaagttgaactttttggcgctatgcaatatttatcatttgatctaatctgtattatttactcatattaattattcccgttgataaacagaggttaaatggcccatcgagatccttggaggtcagaatgacacagttacaccaccaagattagtctaccagtatgtgcatgccttgcgtcaaagaaacgatgtgagttcttgtttgatttcgttgagcatgtttttgtctcgttacctttttttctcggataaaatcttcattttccactaaaagttgacacgatttctaatttgtccatcatcctctcaatcacatataggttaaatccacgtgttgatgactcatcgtgaataaataagggatttttttaaataaatcggcacatgcagcaaatttcattgaatagagaaggaaaaaaaaacttatgtatgttataataagggattgaaagctctgaacaactgaaactgaaatatttggcaagttaacgaggcgatcaatgtacaaggcacttgtaaatcaattaaaaaactgtggctttgacccaatttcttcttctagcatatacggtacagagtaacacaatgatattgttgttgttgcagattgatttctacgccaagatttttccaggagtttcccatggatttgccggtcgatataacaccagcgacccgtttgctgtcgaaaccgggaaacaagctctcgccttaatgctggactggtttcagaaacacttgaagtgatgaaacttaataaatactacatgaaagaacatgcaaatgtttcttcagaataaattaccggtgtccatgtacaaatttgcataaacagccatgcatgcaggctgaatacaatgagtgtctgcaatctggtggcttggacccagaatttggttgctaatttctttatacccactcaatgcctgttgggctttactgtttttccaatgatggaataaaaaaataccggccattgtttaaagagctacaaccatttattaaaaaaaaatcactcaataatgagtaccatcactttcttctcttaatttcaccattatagtagaggtagaatcctaatttggctccgccgctctacaacgcaatagactaatattgatagctagatttagtgccaattacacaagtcaacacgctcaattcctttagcacgactagtacttgtttactcctatactatagtctagctatctattatttatttattttatttattatcatattattattattattattatttattatattataaatatatcaaatccgatgatccaaaatcatctaatccaacatccaggatttacaaagccgattggtttgcgtggtttcttgatgtttcgacaaggctcagaattaattttcggttgaaattttgaatgctttcggatagattcaaatgttacacagtaaatttggtcaaaattaggtcggaattcgtcgaaaaccaaaccgtgatacgatacgacggggcttgaatggccaaccggtaaatgtataaagggtaaattggaaccatgccattataattttgtaaagtttgagatatgccatcggtatctcaatgacatgtaggacccacatgaattaatgacatgtgggtcaggatggcatatctcaaattttacaaaattataatggcacggttctaattttccatgtattgtataaacccttgccaatgccttgtaagttgtatcgccacgtttcccctctctctctctctctgaatctctcgcacacccgcaagccctcaaatcacgccgccgcgccccgccgtcgcggccgccggcgacccctcaccccgcgacgccgccgacgccctgccatcgcgcagtccccccgtatcatcagaaaaatcagggggcggcagaacccggcgcactcccggagtcgtcaaggttttctctcgcggagttccatcccggccgtgctcccctcccccacccccctgcacgtgccgcgctcctcctgtcgtgtcgtcgtcgctccaccgcaaaaattctgtggctcctgagaggtacaatggtgccattgctcccctagtgctcgatgatatgcctttagggcgctttttttttgtgggggggggagggggggtaataatttgaggcaaaaattcagttcaccctagacaatcatgcggttgaatgagttttgatttccctacgaaacctatttgatgattgtgcaatttttagatctaatttcatgatattcattgcagctgataaatgcctcattatttttggagctaatttcttaatattctgttgatttatctttgttcctttagttttttcatggattgccatcggaaccttgtagcttataccctgtcatcggaaccttgtaggactatatacctttgtacatattgatcttccatatgcattggtttgttgagtataaacacaatctagatgaatatgtttcctgacaattgtttttcatttagaaaggaccaaatatgctaaaactattcactaaaatggtcaaacagaagaattccactgtcacactgcactttcaaaagtttttactcatactggatttgattctctttgtgttccttcagtattttgcaagattggcgacgccaaccgcgccgtgacctccccaaatcacgcagctgtcgctctcctcccacatcgccgttccctacgccggtcaggatctcccccgtcgtcgccacgcacaaccacctgaggcgctccctccgatatcggaataccctgcgcctcccctctctttccatcagtcacccaccgaagatcttctgccaacaaagtgctgccgtccgccgctatctttcaccaacgctgcgcggcgttcagcctctgcaaacgattgccaagaaggccttgccgccttccctccgattgagtgctcaatctgcatcgacacggtggtctacggaaaggctgtggtgcggtcacgagttccaactcggtgagcagctttctagccctccttgcaattttttagtccttacaaatcttaggctgacattgccgtgatacatttattcaaacctgatcgtttagtttattttgttctccttttgcattggatcaatgtgattacccttcataatttgggagcggctgcgttatacgggagcatgataacagatgctatgaatcatcctaatattaaattatcgatggctattatgcatctgtttaaaagtgactgaaatagagataaaatagtgaataaaaatgaatatatactttctgtttaattttcctccctcccactatagcatacatcagtgagaattcctaatgcttaccaattgctgcatcttgattgcaagctccagaaaaaaatattgtcatgattattgtgccagggggagaagtttcggttttttatgtgttttgtatgagaccagtgcaaggggatctacattgttctggattttgttttggtttcaattttgctggtcctactacgtgtgcatatatagacagaaagccttgacgggacataccaaattcaaaaactcagaaggaatcaccttgcgcttgtgcctaattgctccaaagtataaggttggcacaaatagtggcccgatttttagttcactgatttttatgctttcccaatgttgcggttaggctattactgtgtttgaggaaattccttcatatagttttatatgttccgtatattttgaaatttatgcccatagagcaccctaattttgttgacgtgatcagacaataaaaaaggcaccatgacagctatggtggataatgtcatttagtaacacagggcaatgtgttgtaaataataatgggaatggtttgtatcatttgtttcttctatgctcaagatcctggactgttatgcatgtatcatttgttgcccctcgagtcagattatttgacgtggatactttagtactttggatcaaagaattagggtatttatattgtacatagctaacaattgcatatactacctccgttttttaatagatgacgccgttgactttttctcacatgttcgaccattcgtcttattcaaaaaatttacgtaattataatttattttgttatgagttgttttatcactcatagtaccataagtgtgatttatatcttatacatttgcataaattttttgaataagataaatggtcaaacatgtgagaaatagtcaacggcgtcatctattaaaaaacggagggagtattattttcccgttgcaatgtatgggcacctaaccagggtcaggacattttctcatgtttgtagtcatgatcaaatcgctcataaaacatatgcgtgctgtatttatactccgtgtgtgtaagctgaatgttcaaagaacatgtgcatcttaacgctttatataatattagggtagttatttacctgcagggtatagggtatattctatatatgtccggcatgaattgaattaaagcttaattgcacatatcatagaaattttttttgataataggaaaatttaaaagttattaaagataaatagaattacactgtagcgtttagcacgggcatattactagtaatagttttcaattttcattcattattattgttaatagtgctatgttagtactatactagtcaagaggtggtctaataatcttttgcattcttgttgtgtgtggttcaggttcaggttcaggggcatctctcctcttttctttcccttgccgccattagcccaagcagctatctggattctggagagttgttctctggtactagttctctagcgcacgaacaacatccgcgacgaagcgcatccatggcagtggcaccgacgagagcggaggcactgtccctcttccggtccctcctccgcacggcaaggcagttctctgactacaacatccgcgagtacacgcgccgccgcgccgcggacgccttccgtgagaaccgtgccctcggcgacacggctgccgcggcggcagcattcgcggacgggaagaagcagctggaggtggcaaagcggcaggcggtggtgtactctctgtacgccccaaaggccaagagcatcatggagatgaagttgcagtgatcgacgcgagaggtttcgtgctctcttgcttgctgtcctcttactcaggatttctttctgctctgtttctaaagttatgtgataggttcgaggaaaattggtgcaatcaaagctgagatgttatcatgtttgctggataattgccatgacatggttgctatgagttgaataaatcagtcaattccacgattttggtctcttgtgttcaacataccattacctgttaactgtggttggattggtgccgattgcagcacttcgaccagggctcctcgttgctgctggggtccctcgtcctgttgccggcttgcagccaccagtcaccgttgctggtggtggtgccttgtacctgctgctctccgtcctgatggccatggccttcgtcccactggacgagctaagagatctagtgcatctgttctgaatttttcaggacggttcatgtgtcctgtattgttctatgctatgtgttcccatttttgtttttgttgtatgctatgacattgttgctgctctgatctttttttttttctgaaataatgaagataagcttgctagtatttgctttttgggctatcgatgtggtcttaattgttgctggtcctaatccttgtggttttgtgtttcttattcatgtactgggcataattatatatatttgtctcaacttttttttttcagaaataaaatttgtacagataatttgcatgtatgaaccataagcttccattataaggaaacgttcagagctcagagtagtagctgaaactgaaacatttaatttgtcaggctaacgaaaaacgaaggtcaatctgtgtacaatgaggcagttgtggaccgactggaaagctgtgggtttgatccaatttcttctttataatacagctacagagagttctgtgccaagatttttacaggagttcatcatagatttgcctgtagataaaataccagcgacccgttggctaaatcgctaaacacaaggtcttgctttcatgctcgactggtttcttcagaataaattcctggtccatgtaaaaatttgcattaacaaccttgcaggctgaataagtactgttagccatctgcttagtttttttttcacatcttttcttatttgtggtccacagtacagataattttattttgaattctatttaagattaaatttattcatcaaaaactacgattctaaaacgtggcctgtaaagtggttctcgtaaatattctttcatgcattgcagattgagtatatcattcttcactaatctactagacgcgcgaaaccagcttataacaaacacgtctcatgtgtctgaaatggcgtcctaacgtttactgtaatatacttcaatgattcatcaggtatacaatcagcatcacaaaataatttgtatcgcttaattaattacgatgtttcgaatggtggctgtcggtaacttacagaagcatgcatgacttctgattattgttggtactagtagagaaaacaagacggcatcctcactctaaccgtgtaaaattttttttaattcagtgctaaatgtcaacagatgacatatatgccatcaatgaggaacgttcaatgctctccccaagatttataagtctggtgcagatatagttttcttaccgagggaatatatatacacttcgtcttgaaaatgtatcaaatatcactaaaaacattagaaacaaatacttttagtaatattacacatctacacgtaaagtcacatctttaaattcatgatatataaagagaaaaatacaaaattcagatagacttatagccttaaaactgttaaatatttttgttatgtctaaactataatgactatggggttaaaattttcattataggtgtgtaatactactgaaagtatatgcacaatttttttctagaatttattgtgatatttgttagttggtatacacggagtatgcacatgaatcttatatgtagatgttatgttcccatccatctattatgatatataagcatttgttggttgtttagaaaagattaaggtttataagaaaagactttggtgcatcttattaaataagggagggtaagggtgagagagttcttggcagtagtattcgtgctacaagtgattatattttgatataagttttgcaggaggaaagacctaatcatcatttcattactgtcaaatgactacatattatatgattctggtttaagaaatagcatatgacaaggaggaagcaggtagaggccgatagaaaatgcaaacgttaaaaagtatatatagctgtatatctatagttggtggagatgctagctagaacactactaagaaaaccatttctgcagacgaaacccttctatttttcagacggatgtttattttgaaccgtatatacatcctcttatgaaatgcttattgctttctcgcaagtacaaaacggtacggtgtcaattaatccttggttgatatcaacggagctatggatcgattacaattaatggcgctctgatgtgtgtgaaccactataatgtgtaaattaaattgagaacattttttttctgaattacacagtgcaacacagacactcacaatgcacgcacactcatgcacccctataaacgcacgcaagcaaaccctacccctatgagaatcttcgaagactgggccgataaatcctagaaattgacgaagtcaccataggcgcctcgacagggccagtaaatcctgtcgacgggtacatcacctaccacactgaaagcacaaagtcattaaatcctagaaaatttgctcccacggggagtcaaagccaggaccttaggtactactgaggctcttgtaaccactagactagaagctcttttcctttaattaagaacatttaattcaattcaaagtaatagaaaaacacgtgtacattgtcaaaatgaaaaatataaactatagctctgatgatctcactccaagtccgtcccgtttgcctatatagttagcaacgagctgctctctcagtattactaccgaacgattaaagccacgtaaagaaaacaaaaatccaaggtatctcggtagagccaattcttgcatgagaaccatggcatgggcgttgttactcagcctcgccgtgctcgccgccgctgcggctgctgctccaacgcactcccagtgcctcgacaacccgccggacttgacagccggcggaggtgaggccggcgtggtcgtacatgacctggcaggcttcgaggcctatgtcactggtgccgtccattccaccaaggctgtcctccttgcctccgacgttttcggtgagtgcatgtctaggattatgattcagggtttaaaatttaggtccgtgtttagattcaaacttttttcttcaaactttcaattttttccgtcacattaaatgtttggatacatgtatggagcattaaatgtggacgaaaaaaaccaattacacagtttgcatgtaaatcgtgagacgaatctttcgagcctaattacgtcatgatttgacaatgtgatgctacagtaaacatttactaatgacagattaattatgcttaatagattcgtctcgcagtttacaggaggaatctgtaatttgttttgttattagtctacgtttaatacttcaaatatgtgcccatatacttaaaaaatttttggcacacgaactaaacacagcctaggttttaaattttcaaaattttggaacccccccaaaaaagtaaaaagactaaattatttcgcccaaaaatttcaaatatttttagtttgtatgaatttagtaaagcttattcaatttcggtcaaaaaaatgtttaaatttcaaataattttgttctattcaaaccctatgatgattagggatgaaaatggttcggaaagttaccggattctggacatgttttcggaaacggaaagtgccggtcggaattttttctgaaactttcagaaacgggaacgaattcggatttttttttgaaacggaaacgaatatgataaggttgctatcatcagaaactttctggaaatgaattcaaattttctctcggaatcgggaacagagtatttctcatgtacaactaattagcttcagctatctcctcttaatatttagatttatactatgtattgaggtgcttaattaaatagaaatattttttgttgtctagtactttagatttcttttggctaatgttttttttttagtttttattaggtcatgtcatacttcttatagttatagatgaatatagtttcttttctaaaaaagtaaagtgtacaactagttgtattattactattgataaaaaaaaatagaaatgtcgatttgttgttttagaaaaaaatatttaactacatctattcgtcgtcgatttgagaagttcagtttaagagctttttatattccaataaatatccataccgtatttgctccgattcgtatttgcttcattttcgtatttgattctgttttcgtatccggagtttctgattctgatttcgaaaaataaatatggaaacgaaaacgataaatgttgtttccgtaccattttcatccctagccgtgattcatgagtagcctactgatcagtcactgccatttctctatttgataaacgtttataatattggctcctgcatgcatcgttgttgatcgagttggtttcttcaggatttgaagcgcctttgctgaggtacacttcgtccttattttctttatctctttgtcttgttcttccgtagttgttcttccattgccggtctacatcgttgtcatgatcatgtttcatagttgttctcgtttcctccatattttttttcccgacaacagtaccgaaaggaaatcgacaaatgaacaactaccctggaaagagactgaattttacaaatcaatagcgtggataactggtgatcttctatatatgttcttacttttaaaaaaatgataggatctttagtcaactgccaactctcttcgtctttctatagtgagtttgttacttgtgataaaatcaacataatatcaacaatattgtgtatcatccgtccattttaaatcgttatccgtgccgattgagtagcctcatatatatatccaaacatatatttatcggtttgggttcacgaaccggcacagatggtatggttccaggagcatctcacggggacttggtaattaaggtcgatgttttattctgaatttaaacaaaaaatgaatattgtgcctatccaaattatactttttccagaataaattttaataacattcaattaattacaacaataatacgtcattacatgtatagtcattaattaattataatccattaaacattacatcacatatacgtcattacaagtcgtactttttgtcgttacaagaaaccaacagctattttttgttgaacaacttgacaaatctctatgtcttgtagaaatgattgctcttctgtttagccctttctgtttactttgtactccctccttccaagaatatgagactatttcttttgataaaaaataagaagcaattaactcactcactatgtgacaaaaccaatgaacatgcaaccaataagttctacaatggtttcttggtttccgatcaacaatttaatttaacacatagtgactataaataggacttagatttttagagaaaccaaagaatgaaatatgtctcagatttatagaaggagagagtatagtacgaggcgatccctcgatcaatgaacatgtctttttagaaatgtccctaatgacgaagccggcaaagttgtcttgaagttccagactattgtatgatttagtattaatttacgcgtgcccaatttttttttgttcgaaccatttagcatgtcaaaaaaaatcaaactaatatatttcactataagcatttccttcaagcaagtcatctcaagtttgatattttagagaatagctctgatcaatccatttgtaatatatatgcgtcgcaaggagatatatacctcttcaacccatgagatataagtacttgttcctgaaggagaaattatgtgcaaaacatcgtaattttatctatcttgcagagagaggacaaaaaatgcaatacttttcacataataaagctctatgtgaataattaattgtgtgcgagacatacaaaataaatatagagcgaagaagagctttgaaaattcccatttcttcttaaaaaaaaactgcaaaatctcaacccgttgagcaacagggttccctgcatgctctacacttctactcaagcttgtccataattataagggggtttggtgaactgttttgaggccatatctttatcagtgccgcttcttgctgtgtggagggcgcgggctggtatatggtgggaaaacccttatcagcgatgtgttttgttcgactaatacccataggacggtataattgtgctgttttgttgcattgaattccactgaatatatcgtgaattatgatccagtagtagatccggaaacaccttaaaagcatatgtgtgataatgatgctgaaaattacaggaaaatagctgacaaagttggtcaagcaggatattatgtcgctgtacctgatttcttccacggagatccttacacattagacctgaaccttacggaatggttcagcaaacattctccggtaattcgtttcaccgtcttatgcaatttgattttatattccatagaacattaattacctagtaatcgtgatcgttcagatgaaaattctcagctcctgcacctatcaggatgcacaaattaagccgcaaattaagcaaaactatatccaaagtacttaacctatactagctagatgctaattatcaagaactcaataagttgattttgaccagtatatatgaattgatcctgcaggtaaaagcagctgaagatgctaaagcaatcttttctgatctaagaaagaaagggatatctgttatttggagttggaggttactgttggggtggtgagtgatattaatcaacataaagaagaagcacattaatttgtgcatttataattatactactacatctatcagtggtgtatcttaaaaataaaaagagcccaagtaaacttatttgctataaaaactctgtttcaatcttctaatatataatttcaatggattcagcaatgagcctgggcagccgcctgaggttgctagggacaaaaaaaatgtttgcagtcacgaataacaacatactccctccataaaaaaaaaccaatctagtattggatgagatgttttctagtccaacgaagacatgagtctgtccagattcatattctaaggatacactctgaaccttcctgatctcctctccacattgaacaaacagagatctgattcatattaaagtctctcaaaggcaagttttaactggcagggaagtttgccgtggaggtagcaaaaaccaacgaggttgaagcgattgtcaccacccatcctggattggtgactgtcgatgacattaaaggttgatattctttctttgttgctgttgctgaaatatgcatgtatcatctgatctagctatagggttgcacaggaatatatagccattgttttcttattccaaagttcgccgtgacatttcacgcagaggtcaaatgccccattgagatcattggagctcagaacgacacactgacaccaccaaaattagtgtaccagtatgttcaggccttgcgtcatagaactgatcgggtgagttcccctgttataatttcgtttacagttgatatagcaaatgcatcagcatatatagctctatttgccttgcaatttgttatcctttttgtttttcagataagataatttaatttgcacatatacatgaagcacaggattcaatagaccggaagagtgagaacacttgaactgaaaaactaattaagtctattttctgaaaggaaatgagactgtagacacacaagagaattttccacggatgatgatatgataaaagatcatgctggctatattttccttttgagggaatgctggctctaattgctggtcaacatctggcaaaagttagagctgatacaatagcataaaaatcaaaagatttactagcatattgtaaacgggaaccgagaaataacaatagtatatgattaattaaatattaactattacaaaattaaaatatatttatttaatttttaaagaaacgtatacacatatatatatatatatataaaattttctaaaaaagacaccgttcactgtttcgtggtttaaaaaatagtcacagtaaacaagtgagttgcataagcgaaacgaggaaaataactcacccaaaatctaatccacaaaagctaggccatcatttggggcactgcatgtggctttaatcctatacctattcctttctctccttttttgcaagaagaacatatttttctttaaaacattcatcaaatatttcaataacaaatctttgcaaagaaatatattattcattagcaaaaaatgaacgttagaaataaccttttgttcattaattattgaagattgattactttgccaaggtcttccaaggagtgaaccatggatttgcttgcagatataacgccagcaacccattcgaggtcaaaaaagccgagcaagctcttgatttaatggtcgattggtttcacaaacacttgaaatgaagacaaggatcagctaatcatgcatgcaaggccacgactataatttcgtcaaaataaatttccgatgtccatacgtttaaaaattgcataatgagccatgcatcagttgatgtataggttatattgttggttgtaattttttaggatatatgtaaaactcaattaaaagcaacgtgtgcgggttagtgaattattatattggctaaaaagttacatggatatataacatattttagcagctttggtaatctctgtaacatttgtatatatatattaccaaccacagactgcaattattcctatgaagtagctcccaagtcaagccatgcatgtaaccaagaaagattaatttttttaataatagattaaataaaacccggcctctacatctatagaaggatgtacacaaatatggtattacatcaccaaacacttaggcttatactctccatcccaaaatataaggcacaaccacttttctctcatgtctcataatgtaaggcgtgcatgcatgcatacattaactagtatctcttggtcctataaaatttatttgttttaaatcttatactatcatcaaacctcccaatcactcccaatcacattgcttgcattcatcaaggtgatccaactaagaaagtgattaaatgttttcttggtctttgtgttatgggtggttatgccttatattttaggatggatcgagggagtaaacaagttcaaaagcaaacaccaccataggagacaaagagacaacaaagacatccagatcaagtctcacaacaaaaaatttcaactaacaattcaatcttcctctacaattccacctagattttgaataaaattccataacagtatcaagaaagattgataagccgtttgatttcatatatcatgttccaacccatcccagctcaatcatcccctctccaatatgctactgttgacaaccagcccagtccaactaatatgtgtgagatgcttgatttagaagcaggctgtaagaatctaggggttcaatttctcagcttctgacttctaggtagattttggattttacaactatagatcttcacatgcactcacatgcattcccagttcctcagtgaacagcgtgagctagctagcagtgttcaatctttcattttcggtatttgtatcgggggtgtcaacatggcgatatttccgaaattttagaaattccagtctaaaattttgaacaaaatagtcatatttgaacaaatattgtcaaaattcacgaaaaattaaaaagtttcagtcgaaataatatcgtatgggggttccaataggaccaaaatttcggaaattttgttacgaaattttgaaccctggagctagcaacaggagcaatccatggttcccacaaataaatgaagcaacacaggtgtgtcctccactatttcagaacaagatatcttaaccccttattatcagtgtcagtttgtataaaactggcataaaagaacatcaccaccaattggtttttatcatgataaaaactaaattactagtgggttttatcatgcaccacaagtgacaattatttaaaatatttgcatccatgctcctggccatcaaattggctatagatcatcaatgcctcctctctctgtctcccatgaaacaccagtgcaatgtttcttgagaataattagggcgtgtttggttaagtgtcaacaatccgggcacatatgcttactgatcgaactcccatgtgcgcatgcgtgcactgttatattgatggatacatcgacgataaaccaagcattaacttttggcgaaccggatgcactaccaaaaagtccagcaatttggccataggcctgcagcttccaagttcttcgctttgactttgcacaataattgatgattgcgtaggtagtaaaattcacaaattttatgagggaagaaatttaaatgacccaataaccatttctctttgtaatcctgcctccgtacctatataagatggacatggagcccttaaataacatggccaaaactcgatcgtcatatcaatacaacaccagacggatacaatatctaaatatgaatagggtaatacttctcatcgagaatgcctcaacctttctaaatttgtgtccctttacttactcattttagatctcgtgataccccttcttactaccgatttatagaatcaacaaggtcaactactataaattaaacatgatgttgaactcataaccgctgggcttgtggactgtcatagactgatgtaaacctatatgcgtggaaggaattcagcctcatagaagtattctcaagttgaaatttaaaatctccaaatttcaaagagatggtccttgtttgattgtccctaagttttcacttaatctttctcaggcctccacgttttgctcaacaaggtcaactactataaattaaacatgatgttgaattcataaccgctgggcttgtggactgtcatagactgatgtaaacctatatgcgtggaaggaattcagcctcatagaaaagggcacgtattctcaagttgaaatttaaaatctccaaatttcaaagagatggtccttgtttgattgtccctaagttttcacttaatctttctcaggcctccacgttttgctcacattgcctcaaattattcggttatgaaaagagtatgaacgaatgcgggaggtcgaactacttgatgaacaagttttattttttcataattgcactattcattttgagaagatcatatatattctttttgatgagcttctttcaaaatagaataaaaaggtcaaaagtacccaaattatctaatcttcgtgtgattttgccttcagaattgaaactgaaatatattttttctgaaagtacttgattaaattagaacaaatttatgagggaggtgaatttgcccattcaccatttctttttatatttttacaagattttttaaactaaaatttcaatttttctaatgaacttaaaatatggttgaaattattcctactaaacattaaaatttaatttcaattattatcatgtttaaaaatttcaatcacttgaacattttcacaccctttgacaattaaaatcaagaagaaaaaaatatccctagtgagatttttaactttgtgttaggaggcagagatgaccttttttataagaaacaaattacaaacgtagagataataatcattttgagagagagaaatgctacctctgtttgaaaaaaataagggtacactttattttgttgggacaaactttgaccaatacttattctttcatggtataaattttagagtaagttttacaaaactacaaataatttgatcaaactatcacaaaactacatatttaaatataggtatcacaaaactacagatttaacaccaaggatattacaaaactacagatttaaaacttcattaaaaaactacatatttagtgatgaaattatcaaagaactacaaattttagagtttatatcgtagaacaattgaggttacaaaagttgtagttttgtgataaatctatgttaaatctgtagtttctgatataatacaatcaatctgtagttttgtgatagtttgatcaaaatacatacagttttgtgaaatttaatctaatttctatgatacaaagttaatgttgctaaaattttttaaaggaaacaaaatgaaaatttaggaatatttaatttaattaacagtgaaaaaaaacattgaacatgggattgattaattaaaaactgatcaatataacgaaaggcacacaaaaaaatttttctcaccttaaattcaattcaaaatgtcaacaggcagcgggaactgggtgtgacattaaacaagaaactgagggcaatgtgctacctaacctaaggctaaaggccataaacaaactacaaatgccccagcaactatcgattcgatgcctcatatgtatcgtcaaaactcgatagttggaaaaccatggcaccagcgttgctctacccgaccatcctcttcctcgcagcggccgccgtcggcgccgccgctccgccgcactcgcagtgtctcgacaacccgccggacctgacgacggccggtggcggcggcgaggccggcgtggtcgtccacgatcttggaggattcgaggcctacgtcaccggcgccgtccattccaggcggaccatcctcttggccaccgacatcttcggttagtgcatgcctgcctgagctgccagcttatctgtctttgaaatattctttgatgatatattgtggattcatttattactaaccattaattaatcttgaattcttgctgttgcatgtgagtggttgcgtggttgttaattgtgggtctctacttcaggattcgaagcgccattgctgaggtacaatcttcttcttcgtttgtataatagggaaattgctgtatgtacgataaacttgttatgattttggtacgatccagtcatgcatcgtacacttgcatgaacattagcattcaattgtcatgcaagttacaacaatagaaaggtgactatggttattttgaagggatcggatatggtttttggtcaactctctctgtcttttttatagtgatctccagttatttgtgacttgcgagaaattaagtcacacataatattcaatattactgattatatatctgcatgatttatcagtataagacttggatggcgacaggccactcctgtatcgagaatcattatgtactactccctctgttccatattataagtcatttgatatttttctcagtgaaactattttaagtttaatcaaatttatagaagaatatactaatatttttaatacaaaacaaattaacatattaccaaaatatatttaatgttaaatttaatgaaactaatttagtattgtaggtgttgctaactttttctataaatttggtcaaaactaaagaactttgagtaagaaaagagtaaaacaactaaaaatatgaaacaaagagagtagtaaatatcgatatatatgccaagatactctaacgtcctattattcctatataatacacatctatctattatattattaaaggaatagaaaaaggagcctctacgttggctcacattaatcggagaaaaagaaaaagtagaatccatataaaaatataatttagaaatagctgaaattcggaattaaaaaataaggaatatagaagaggagactagagtccatatagaaatacaatttagaaatagttgaatttcggaattaaaaaataaggaatattagaagagtagactagagtccatatagaaatacaattaggaaataactgaaattcagaattaaaaataaggaatattagaagtagagtatagagtccatatagaaatacaattaggaaataactgaaattcagaattaaaaataaggaatattagaagtagagtatagagtccatatagaaatacaattaagaaaaaaatagaaatttggaattaaaaaataaggaatattagaagtagagtatagagtccatataggaatttaaaactaactaaaatttggaataaacataataaaattaaaagtagagtttagagttcgtataaagatacaatttacaaataactaaaattccaaattaagaaaaacatgggaagaagagtttaaaatcaatataggagtacaatttagaagtaactaaaattcgaaattaaaaattaaagaatactaaaagatgagtttagagtccacatagaaatacaattagaaataataaaaatttaaaaataaaaataaataatattggaagaagagcatagagtctatatagaaatacaatttacagaaaattcggaattaaaaaaaagaaaatattaaaagataagtctagagtccatataggaatatatataatttacaaataactaaagtttgatattaaaaataattaataactaacacgtatataaaatataatataaatattacccattagtagttttgtaaagttattgcaaaatttaaaattatgttctcattttaatatatttgaataatataatgaggaaacatatatgctattatatgagagaaaatataatgatactagccgcgcaatctgtgcaggccactgtgctagttttgagagtaatttcttagggttttcaatatgttatccctacatggagatgatcagcagcatagcgacatatatatattggaattgtttcatattctatcctcctacagctaatctctactacttaaaaataagtagaagacatttccgttgtccgtaccgataaaaaccacgcgaaaaaaaggtttccgcatgtaaaagaagcaaaaaaaaaaaagtgtgaaaaaagtttctgcccgattaaaaaaaatcatctgtataaaccgttatccaaaaaaaaaaaacaatgttagtgggaaaaaaagttccgtcgtcgatactggaaaaaggaaaaaacgtgcaaagaaaaggtttccatcttccgtaaaaaagagtaaaaagtagtgcgaaaatttttttgttccgattcttaaaaaaaaaacccttctcccataaaaaaggaaaaaattatagtgcgaaaaaaaaagtttcgttccgattctaaaaacaaagtccgtataaaccggtcatcagaaaaaaaaagattagtgtccgattctaaaaaaacgggttacttttccaaaaattcctaaaaaaaataggttggcagaaaaaaaatgttcctcacaccgttaaaaaaaaagtccgattctagttaaagaaactggttcgacattttcagcttttccaaaaattcctcaaagtatatttgaaaatttaaaagcaaattcaattttccccttttgaataattcttttattcattcaaattatcatatatcaaaatccacctaaacatgtcaaaatttatataaaccgcgtgaggaaaaaacatcaccatttataaaataaccgatttgaaaaaactgtctgactcaacgtgagaaaaacgccaccttttataaaagaatctggtttggcaccatgcaatgcgaaaaaactgtctaaatttagaaagaaaaaacatccaattccgtgaaaaggattcgtaacatttgtattgttcatcgtctaccacgtcggtttggtttttttaaagcgtaggtcgaattctgacatctggaactaagacaagtcttgcttcggttttttttttctgagaacgagatcaaattaatggacgtttgggttagataggatccatcgattttttccatctacacggcttctctttcctcatctattctcttgtattgatagccctgcatgtctgtgtaggcaattatcatactaccatagctactattctttataacatattatatggaaataatattaaaaataaatatgtttttaattgatatttagagaagagtgcacgtggctctattttgtgtagacttaatcatgcgaggcaatataggatttgattgatcctaattttgattgcaagaataagactgaaaagtattaattttagatttttatgcatgttgttagatgaacaatccaattcttttgggtaaagcaaaacattggtaaggttgccagcaccgaggttgggccattgatttaagatgttccagttttctttatgatatgttaaaaatattatcattgacactatgatatgacattcactgctacgggatgggtttttccgtgcggtcaaaaaaaatatccacgtgcggatgaatggcccgcacgcaacacttcgtctgcgaaagtcatgatttttgcgtgcgggtggccctcccacacgcgaaaatcggatttttccgtgcggttgcttatgtcgctcgcacagaaaaataaaaatccagaaaaaaataaaattcacaaattaccgaaccctaaccctagatccgccactccccgccgtcaccgctggccggctccaggcgggggactgtgtcgccgcgagatccgtgcggagtgcagccgccacagccggatgacggatcctggcgtgggaagggcggtgccgctcctggccgccttctcctcgtcgtcggcggcggccgcatgaggtggggagagcggcgccgctcccggctgccgcctcctcctcttcaacgccagcggcggccgccgcgccgcctccaccagcagccgcgacgggcgcctccacgtcggcgcatggcagcggcgccgcttcctcctcctcctcctcatcggcggaggcctccgcgccgccgcccgtcggatccgcgctcccctccatgccgctgcccgccggatccaccctcccgtccggctgcaccgccacagaagcccctcccctccgccagatctagggagggaaggaaggggaggggaggggagcggatcccgcgtggggaaggccggccgctcaccggatctgtgcggggatgaccgccgcccgccggatcccgtgcctgcaccgccgtcgtgtggagctgaggccgatgccgaccgccgttgtcgttgccatcgcccgcgcgccaaaaggagacgaggggagaggcgtgaaagagagaggaggagagagaagagagataagaggggagggatgtgaggagaaattaaaagagataaatgaggaaaaattttgaaatgggtgggagggaaaatagggaatactattttcgcgtgcggctctcttaatagatacgcacgggaaaatcggctcattttcccgtgcggtccgtttaggaggaccgcacgagaaaatcgattttcccatacgggcaacagcccagccccggttcccctatttttccgtgcagttccacttaagaactgcatggaaataaaagggggtaacgtccacgaaaatctatcgtttagtagtgattatcatgaaaagtgtcagggttatggataagatataccctctacccttggatacacgttgtatactgatacggtatacccgcgcctatacggatatttcctatgtacgttaaggaaattcgtcacgagatagatgcggaatccacagatagaaggagtcctactcagacagaactgggtcgttactgtatcgtgtggggtccgatgtctccgagttctacttggagaccaactgacctgcggtataaaaaggaccaccccgggaggacctaagacatcaaatcttaccgccaacacatccaccacagcctacaaagccggagcctacgggagccaagtcgccgggtgatttagttgaaccaactcgactacgatctcgtcggtatcattgagttccactattccctttctaatatgtgattttcattatataatcccatatcactggattagagctattacctatcaaggggcctgaaccaatataatccctgtttcctgtttgcttgatgtcgtactacgtagatcctcatatcagcgtaccccaataccctctatatccggtctacgggtatcccccgtcgacaaaaagcatatattgttattagaatttttcacccgttataacgcacgggcatatttgctagtaatataaatataccaagaggttcaaatataccatttaatagtgtggtaatcatggtttaatatctttaactagtacttagatagcacatataattggacagcaatttaaaatgggcgagtatatgcgccatgataagaattccatattgtgcttacttaaactaaaatatgtttttcatgacacatatactattgtacatcattgtatagtgtgcacatctgcttagggacaattaatatatgtaagattgtgaacccaatgttaattcagaacttattatgtgatcttccattgccaggttgtacgtcaagctatttctccatggcttgcagaaactctgtttatctgccagtactttattttaattttacatttgaaaacaatgtaaaagcagatgtttgattataaggttgctgacaatttcaggaaaatagctgataaagttggtctagccggatattacgtcgttgtgcctgatttgttccatggacaaccctacacatttgaccagaaccgtacagaatggctcagtgctcattctccggtaattcatttcaccatattaattaatttgatctaatattcccctgtaactttaccttgaaatcgtgatatatgattgagacgatagagtaaaagaaaactcgacagctgcaccaaggatatacacaaagccacaaaacaaaactttatcccaaaaatgtaacttatgcgggatgcttataaagataatatgttaaagttctaagaaaagataatatataaacagttataaacgattcaagataataaattaaagttctaaagaaagaatatataattaatattgacaagcattttcaattgatcttgcaggtaaaagcagctgaagatgctaaaccaatctttgctgctctaagcaaggaagggaaatctattgttggagttggaggttactgttggggcggtgagtcacatctatcaatcaatataagaaaatgtagttgtaatatcctgaacttaatggtcaaaatctttgatatggaattccagaatatataattcctaaccccatatattcaacaagcagttatttaattcatattgaagtctctgaaaacaaatttgttttactgacagggaagttcgcagtggaggtagcaaaaactaacgaggttgaagcaattgtcatctcccatcctgcagcggtgactgctgatgacatgaaaggtgaactttctttcttttgttgcgctgttcgttgttacaatagaaaatagctaataattgttttcttattccaagctctccttgattaattaacagaggtcaaatggcccattgagatccttggagctcagaatgacacagttacaccaccaagattagtttaccagtttgttcatgccttgcgtcaaagaactgatcaggtgagttcctgttgattttattgacggttggtcccaaatacatccatgttttttacttctaaactccatctcgctcttcaaatacttgttactggattctatttactctctttgttctaaaataaacaaaccttagataaaataagtctttacctattacaacgaatttaaacaggcaattgttcagatttgttgaataggtaaaagctcatcctatttaatatttgtttattttaggatggaagaagtagtttttgacgttgaccattcatcctatttgcaaaaataattatattacatattaacgatgtgtgttctgccataatacaactacataagttaacttcattaatctttaaaaagttattaatctgaaaaaatgatagtcaatagcgacaagcaaaataatagtttctaaatacaagttgcatgtacaaaacacacaagctagctctcactaactgaaactgaaccagtgtttaatatgctaaaaaaattgcaactgtaaacataaaagagaattaatttttactgatgatgagatgttaaaagaccttgctagctctatttgcatttttttttgagaaagaatgctagctccaatttggaagaataagtgctataacattgcatattacttccttcgttccaaaataaaaaggcaaaatcatacctttttatgttgtagttaacaatcatctccatcttccctaaatttgtttttttcaatcctccaccccaagatctttaatcacattagatgcatgcatcgtattatattgaggtaatccaaatgagaaggtgataatattttttttcttggttttcgtgttagtggtggtttgtaccttatatttttatattttatgattgcgggaataatatattatgttttataactaaataacctcttatatatgagttattgttgcagattgattattttgccaaggtctttcaaggagtgaaccatggcttcgcttgcaggtataacgccagcaaccctttcgaggtcaaaaaagctgagcaagcacttgcgttaatgcttgactggtttcacaaacacttgaaatgaagattgctaattaatcatgctaggaagaccagtgcaattatttcatcgaaataaaactctcgttctcgatataaaagtttgcatatcaagcagccatgcatttgatgtacactattttctttaaattatatggagtgaattaatagtatgttgtcgagttgatgttcgttatttatctataaataattatacggatgtacttgtgccattgatgttcattgctggctataaattacatgtggatgtacaactcaattttcacaagggtactatatatatactttagcaaaaccatcaaatttattacaaaactgtacaattatgccacagcatcagcaacctatatatttaaatcacaatttataacaaatttccatgtcacaaagtttcaatcctagcattgttatcctgatgaaactttcagaatctctagctttgtgatatgaaaaaaaaaaagtttatgtagttttgtgatatattgtatcttaaaattttcttttaaaaaataataataataaagatactgtggatttacatgtgcaatttaaaatagctttattgaaatatatataattttacaaaatttactcactttaatttatatcaacttgtaatcagtatatttctaacaattaggccatgaataattgaaagggttgaaaagctaactatatattaccccatttatttcgttgggccttgggccattcatgagtaataacaataacagtagcaaaacatacagcaatgcatggcaataataataccaattaactttctaaaaaaataataataccaattagaagtctgtacgtatgcttacaaacttgtacgtataagttcgaaacaaatttaaaatgcaaatgaaaaaatagactttgatttgcattttcctaatatgaactttaattgcgaatcagcactctcgtcgctctgcatgcgtttccagtcgagatcggccccaggcatgcggccgttctctctcatgtgtgtagctcaaaatagaaagatcatatgccgaaaataaaaatctagccaaaaacagaaagatagatcaatctagtgagagacgatggctgagcggttcccaataatgtttttgccttttgtggtggtgtaatcaacggttgggcgcactctcctcaacccgtggcccgcgggacacgtgtcaaccaagtccactactattcctgcatacgtatgtataaactttatatacgtatgtataaactttgtatatatgtgtatataaagtttatacatatgctatcgagtgggccaacgagatggtatcgacgcctcagacaaccgccggcagtgtgcctagccatggcaccgggtgatggggacgatggcgagacgaatgccaagaatgcataaaacttttactagggaagccaaacctaccccttgcaatctggcatgccgggccgctcataggccaagcagcggcacgtagacaagctagacgtagcggagaagaatattgcacggacggggatacaagtttgtctcgcggcgagttgcccccctcccccccccccccccgggatgatgagatagtggtgcttgaggccttatgtgcagcgagcttcgagtccaccatggcttcgttggtggtgggtgtgctcgacttcttccttgttgtcgagctcctaatactgacagccaacgccatggctcacatcgccatctatgagtgaaacatgtgggtggacaacaggcaaggctccgtgaagcactttgccaccctccaattagctagttgtcaccctaataaggtgatgtaaggcagggtgacgaaatcattgaattgttttagaatctatttctaggtccacctaggcatggcggagtactttccctcacgggctaccaatgaccgataggccactaggtgaccttcgcgctaattctacctaatggtgggggacagactcggggctctgctttaccagtcaagacatacggtactagtggaagctggatgtggacgcattacacctagtgggggctccgctgaacaccatcctccgccgcatctcctctctctagaggatgagggatctagtcaaggagtcctgcttgctgggggtcacatggctaaagaccaatgggatcactcccttacattgggcacccaatagtctctatgggaggacctaggccccttcacatcgcgtggttgataaccccttaaatatttctaccttgcagtagtgctccacttgttgtctccccattccgaccttcggtacacactgcagcgttctaagaccattatcctagtcacaatggtgatcgcggatgccaagaagatactagggagttcgctacccaggaagaaggtcgctcgcctggctcgaaagaatgcatcagtttgacggaatagtgtggccaagaggtttgggcttacactccttgccatgccttctctccatgagctagaggagaccaacaaggatggaaagcgcaaggggcatcgcggggcggacgtggtccatgctcccaagaggtccaagcagggagcaaatctttggctcctccttttgtgggcgtgcctctacaggccaagcgaccaacactgttgttgtcagagacgtcggtgaaagccttcgatcatgacatcatcgaggtcggttcgtcggtctccactatccatgcaccgaaggtggtaacggtagcggttgccatagaggccaacgagacggcctggcaagtggccctcacaggtaagggtctcgtttccttcctgttatcgtgaggctatattgttatctcttacatgcctctctcttcattttccccttcttcattgtaggttttccagggtacaggtcgtagtcgtcttcttcgaaagttgagacaatgccctcgatgccgtggtggactggagaagaggaggtggcgtcgttgccacctcaagtggagatatcaactgatatggtgatatcggaggcggatggcgtcttgatttgactccggagcaagtgattgccctctgtgggggcatatcatggaggcagctccagagggcatccatgcagaggccatcatccactcatgggatccattgcctaccatcatgggacggctcgtgcgtcccagagacttggtggcgctccggttggatgtggaggcaccgatctggtcctccctgcttggggatgacgctcgtgtattggctactatgatgagatcaatggagctaatggagctgcaatgtgtgttggcctagtaggtgcgtccgtctgtccttgtttcttgttgggtttgttttgagtaatcagagtgccttcctccttcgctcaggccatggtggtcgtcaaagcatccatcaagcgtgggggaagtgatgcagcaacacaacacgcggagaggcttcgtctagacgagattatagccttaggtacagcggaggccagtggtgcagcctcataggtggaggcaaaatggtgacggtgcaactggccctcttgcaggtggaggtgtctcggtcataggtggagaaatggttgtgggatgttcataccgaggtggcccgcctgtccccggagaagaggcgttgtcttaggagattagcatggccaagggagagtcggagactcattcgcttgatgcccgcacactagatgagaatgccgtgcatgtgccctagcggttacgtgggctttgggctccgacttcgtggattgtggatcaaaggacctacagtcccaaaggacaatgcccccatcaccgacaagatgacctggtcgatgaggtaggggcttcaccaagaaggtcatagccacctacgaggcttggtgctcataggccaccacccatatattgtcgttgcttcaacaggagtgtaggcacatcgacccctccgtttgcttggaccccgtggtgttcaccatcctaatgtagggcgctccagcacaccatccccgcgtcgtgacatgaacgacctcacccggaggattgggccctcgttgggtcacaacgttgtagtggctgagctcgccgcttacaccgaggggaaaacgaagagtgtgcccaaggtgtagggattagttaattttttttagtaaatttcataaaactacagttacttcgatcaaattatcataaaactacaaatttaaggcactgtatcacaaaactacagatttaacacaagatttgaggccaactatcacaaaactaaagatttaatactagagttatcacaaaactatatattttacaacttaaatccctaccactactgctatgttagagtgataaatgttgtagttttgtacttaacatgttgcaaaacatgtacttttgtgataatattattactaaatgtgtagtttggtgatcttccaccttaaatctgtagttctttgataaagttggtcctaaatctatagttttgtgatacaccttaaatatatagttttgtgatagttttgtcaaagtacatgtagtttagagaaatttgctctcttttttttcctgtgttccctgtttcttttatttctcttcatgtagccttctctctggcttagccttgcctactgtttggcctccagactatcctttttcttaccttctgcaattcgacataatatataggaaaaatttgctagaggacggtcaaattttctggtatttcctaacgaactcctaaaaggcgtgacatggctctaggactcctaaaagacacgtgatttactagtggacaccacagtcattatttcatcattcctgggcttaatggagggggaaaccatgagaaaaagacagttctgcccctctggctagcacgttgtatgtacattagtggctttgcttatgccacgaccttaacttgtgtcttgacccagtaccctttaacacatcgtaggcttcaccatcctcacccctccagggggtggtcatccctccggccgtcggggcctgcactgctttagcattgctgcctgtttgcacctacggttaccaaggtacatatggtttagtgtgtggcgaggtggccacgtcctccagcacaaccttcaactagaacttcgattgaagtctttcgttcaatgatgaggcacacgagccattgctctagtagctttggtgatcgaatctaggtccatcgaggcatccctagtgcatcggacctattctagatttcaagacatatgacgccgtagggaggttaggcaacatgtacggtggaatggcgaccggtcatggctcgcctgccatgggatgggtcagggtaccacgtgtttcatgggctcaggccgactaggattctagatcctagggctcttcaagcagaacactgggcgggggtccttacctactcatcatgagtagcctcatgccgagtcgggtgctgttgtggggtccttccactagggatccttaataatctagccatagcacaactctcccatgaggtcagggtggctcttacagaagtccgcctttaagggcgattcattaactagtccgtccgaaaaaccgctaatctctaaataaatgtggataattaattttaagtccaactgaggaaaactaatattctgttatatatatgtgtgtgtgtgtgtgtgtgttttcacatttaattaaaatacttattttagtatgattgttaacttatgtcatgtagcctctttatgaataaccatactaaaggaaatattcaattaaagtagtaactgtatgtcttattaccaaaatatagtaagaatcctataaaaaatttgtttacgtcaaaaaggcttaatatgaaaattctatctttttttaaagtttggtaccatatcaaacttcttttttgtcgacgtttgatgtctcgactacggtatttggacagtatggggatcgtcggtgctagggcatacgcgagaccgaggtaaaagagatggagacagggatttttatacaggttcgggcccctgaattgtcaggtaataaccctacatcctgttggccggagccggagttgctttttattcaccataatcacaccagtacaatatgtggggtagcctatctaattgttgtcgacatggcggtctgaaggtctgactcgtagtcgacaacagggtagccttcctcctcaaatccgtgtccggcgagatcagagatagcgctttcgtatctcctgacggtatccggagacaccgtaggggaatagccatgcctatccctgaagtcgatatccggcggcgtgtcttggcgtatgtaggcttgtgtgttgtggcttctggtggacgtgtgttgattgtcatgggtgtcttccatggtctcctcaccctctcctcctaggggggcttgtatttatacccataggtgtccccttgtccaagtagaactagggaaaccaatatggatacaatccgagtagtccttgtcgtttccatgtagaactctggttgtatttccttatccggaactccctcgaggtcagtttccgtataagacatggtatgtggtggatcctgcctagatttagtcaactactattaggtatgtggtatccataaccctgatagtagcccccgacttcgatgcaaatgaacgaattcatattctcaaccgcgcgtagacattggagtaactgttatcgagctcatgtgaccgttctcggtgagtttagagataacgttggacttcctttgtcagcctcgtgcgggcaccgaaagggtttgtctaagtcaatctctgatgtcgaccgagaaagtatagagcgtacgactaagtctcacgtcttgctgtaatcgagaatttggattgaagtcaagaaattttatctcggcgggtacaccatttcttcattctctattccttgtcgagatccagcaaccgttctcgagcgatcgagaaggcgtagagtctgcgacggagccttgtcaacattggtcgtactcgccttagtcgatcttggtgtagaaccatagagacatggagtcttccacaatatcaaatagaattttcctgaaaccaatactcagaaaagaatatcaaatagaaatagcccccaagcgaatgctcaaagggtgacatgttataatatgtatggtaaattgaaaataaattaaatttactgatcaatgttttgtgtatgagcgtcttctctcttaccgacttcgatcagtcagtagagtcatacactctccctagcccccagccttgtcgtcggagaaccgttctaggaggataaggctcttggacccttgacctgccttggttgaataaacactgatcctagcccccagccgtgaagttggaaaagtcaatttccgattacacggcttggttaatacgcacggcgagaactctaacacgaccagatcttacatggtcctttgtctctgaaggatccgacaaggccttatcggctctgggcgtccccagacgaggatcccttaggttcctcggaggccttgtcaagacggcgtaaagggacagtaggataggtttcaacgctaggtgtcatcgtggtaagggatctctgggtaaaacattgggcgatattgtgtacctgctatcaacttggttgaaatagaggtagtaggagagtcgctacaccgctggtcgaggaccaggcagtagtcgtaactcgaccacttaaagtgaaagtagtgggagagaagctacgtagctggtcgaggaccaggcagtagttgtaattcgaccacttggagtggaagtagtggaaggaacgctacgtagctggtcgaggaccaggcagtagtcgtgactcgaccacttagagtggaagtggtgggaggaacgttatgtagctggtcggggacaaggcagtagtcgtgacttgaccacttaaagtggaagttgtgggagagacgctacatcactggtcgaggaccaggcagtagccgtaactcgaccactgaaagtggaagtagtcggaggaacgctacatcgctggtcgaggaccaggcagtagccgtaactcgaccactgaaagcagaagtggtgggagaaaagctacgtcgctagtcgaggaccagacagtagtcgtaactcgaccacttgcagtggaaatagtgggagagacgctacatcgctggtcgaggaccaggcagtcgtcgtaactcgactatttaaagtggaagtggtgggagaaacgctacgtcgctggtcgaggaccaggcagtagtcgtaactcgaccacttgcagtggaaatagtgggagaaacgctacttcgttggtcgaggaccaggcagtagtcgtaactcgaccacttaaagcggaattggtgggagaaacgctacgtcgctggtcgaggaccaggcagtagtcgtaactcgaccacttgcagtggaaatagtgggaaaaacgctacatcactggtcgaggaccaggcagtagtcgtaactcgaccactagaagcaaatgtacgagagatcactacgatcaactggttgaaaaccggtgagtaggtgtccctcgatcatttggagtcgtggtgcgaggaccgctacgctggcgtagtcatacctcgaccatctgaagttaaggtgcgagagattgctacgtaatgatgcgagaaccagtgagcgagcggaattatctctcgaacaccaatggaagttgtggtgcgagagattgctgcgtactggtgtgagaaccagtgagcgagcggaattatctctcgaacaccaatggaagttgcggtgcgagagttggtttattgcaagtgtatctcatgtggccagtatgactcacgtacccaacttatagcatatccggatgtccgttcgcaatcatgtcgggtgatcaagccgacgacgttcgcgaggaattatccgttaacaaccttttctcgagtagtccagccatggccggtgctatgagataggtcgtcagtctttgttggtaggttgggtgcgataactccacaacctactcgagtgctcagttgttcctgaaaattattttctagaagacaagacatatagcagataatatcgagtatgtactcaaaaaactgcatagatcttctagtattatcaggatataacgagcagattaaatatcaggcattatgtaaaccgtaaacaagcatgatttatacagaagagaacggagcgagcccccagcattagaccgtagttggcctgacatcggaagcactcgcacaatagatattgtttaaaaaacatgctctaggtaaacataataaattatagatctgacaatatcgtatagattggaaaaataggtacgataaattgtatataaattaccgcgtacctgtgtagatatatgccaaatatatctacgaaattagtagatcaattaaattattcaacctactaattgccttactgtgtatgcttggtgaggaatagtaactccttaattgatccgattgtgtgtatggtactgttccccatgtaagcatgaaccttgtattttggtcctttaattgatctgtttgccacgtcgttggaacggccaaccaggatgctgcctagagattggattctagtgcgagcataagagaactcctccaatccgacttagaatttacacccatgtacatatcaatctggctctagatttcagctccacggcgctcgttttgttggtggagataagccgagttcggtttgaacttagccagccgatgtctcacaccagtcgatgccgcacacatggaggaatcggtgtcggattgctcttggatgccaccgacacagtagcactcctcggcgatgatggttctgatctagtcggaagatgtacttggacaggttggatctccccacagccgaagtcgtcgagtagcttgttgtcggagagtccatctcttaaacccatctcgtcgaaatcctgaagcaccaaaatccccctacctggcgcgccactgtcgacgtttgatgtctcgactacggtatttggacagtatagggatcgtcggtgctagggtatacgcgagactgaggtaaaagagatagagacatggatttttatacaggttcgggcccatgaattatcaggtaataaccctacatcctgttggccggagccggagttgctttttattcaccataatcacaccagtacaatatgtgaggtagtctatctaactgttgtcgacatggcggtctgaaggtctgactcgtagtcgacaacagggtagccttcctcctcaaatccgtgtccggcaagatcagagatagcgctttcgtatctcctgacggtatccggagacaccgtaggggaatagccatgcctatccctgaagtcgatatccggcagcgtgtcttggcgtatgtaggcttgtgtgttgtggcttctggtgggcgtgtgttgattgtcatgggtgtcttccatggtctcctcaccctctcctcctaggggggcttgtatttatacccataggtatccccttgtccaagtagaactaaggaaaccaatatggatacaatccgagtagtccttgtcgtttccatgtataactctggttgtctttccttatccggaactccctcgaggtcagtttccgtataagacatggtatgtggtggatcctgccgaaatttagtcaactactattaggtatgtgttatccataaccctgacaattttaaagagttagttttttttttcatatttagtggtggtcctatttttaagggcctgtttagatcctccaaaatggcaaaagctatgccgttttggagcactttttgccattttagatataaacactagtagcaaaagttggcaatttggcatttggcatttgctagtgtttacacccaaatttggcacctaggattaaaatagggaaattgccaaagtttggacgatctgccggttttcctctgagagggccggtctgaccgccgtatgtcggctggtcagaccgccgctagtgggccggtctgaccggtagagtccgagtcagactgttttcatcgagtctcgggtttccttgcttgggaagtcatgtttcgtgtttccatctgtttctagcccgagttgaacgtggaggagggcatgtaaagggcaagaccaacccctatataagggacaaggccggttcaattgtaagagatcaatcaactatcaatcaatcgaatcgttcttttacttttgcttctagttctagtttagtttgtccatctttgtcgatttgcgccggtccgccgccgctgtgagtgcgacacctctttgtaggtttgtcctgaaaaccttctgtttttcccacgagacgggtagttatctatcgttctatctagatcggctccgctagccggtttagtttatcaaaatccatcttagtttaacttttgctagattgaggtggttggcgactctaagattaccgcaaagcgttaggtgctgtgactgtgcttgtcaactttatcaaaaaagttgccaacagctagtccatggtagcaaattttgccaaaaagtgctccgggaccacaccctctctctttctctctctctttagtgctaaaatggcaaaactttaagatgcatctaaacactaactagtacttttgcaatgtcaaatcttttgccaccaaaacttttgccatatatttgctattctaaatagatctaaacagaccctaaatgcatttttcttaagagatcatccatgaaaatcgatttttagatgatttcctttatgagaaccacagataaaaatcactggatctttaactgtaaaaatcatgatttttgtaagcctttccttaggaaagccacccgcaaaaacgaatttttgtggacctgccaaaaaaaaggtttttataggtggtcaatgactctgaggtgtaactattttcacatgcactatttcttttggactgcttgagaaaataaatagtgtagcgtcaaaaaaaaaatgatgttttatagtgtatatatcggccggatgagaatagagatcagctggactgatatctctgcacgttaataaaaactgcagctaatctcgtccatccattttgatcactacgggttcagatccaagttgacagtacatatatgtaatatcaacaggcctctagttaattaagtaattagtataaaaatgaaaatatgaagatggttatctggccagtggccttccagtacacaactacacattatcaacagctagtggaaatactcaaataatactgctatgcccaggaaacactagtaattactacctccgtccctcatataaagtcatataaaggatattcactatttttaaaatactaatgtcactcgtcttatttaaataatttgtgcaaatataaaaaagaaaagttgggcttaaaatactttaggccgttccataatatgcagggaaacgtaatacccaagtcatgatctgttacatatttcatatatataagttatcccctataactagtcggataaccatgccgtgtgggtatggggtacccataatctccacagtagcccctgagaccttcacagtcggaaagataatcttctctcgaactagattactccaaagccgagtgcttcaatcatcctcgccatgatctcccgagtacttttaccaaatataaagactgtggagggctgaaaaataaagtcaggtgcatcgaatagatgcacctaatagatgtaccaactgagtggttttgatattgtaatcaaccaagtgacttgatatcaatatatagcatatgcggtgtgaatccccgaataatatgatccaagtgatataccgactgctttgtaaaatatgatgagtgtaacctaaggttggctacatcattgaaaattcacatagcaaaatagctataaagaagcttgtatgttgtgaataaagaaatttccaaagtattgggcatacgtcatgcgcacactgctttaacagatgtgcttaagtccctaaaagacacatggtttcaccacacctggaaatatatggcatatgtggtataacatccgagtaagtaaactcataaaggatttaccaaccgcctgaaaaatgaccataatatataatcagcctaagccataatattggtcaataaaaatgcacacttacatggcaaaaagcaatgatattgtatccaatcaattgcttgataaacccaaacagcaccttaactatataaaaaagtcagcgggacagctatataaagctttactgtttgacaccttttaagatgtattgtaccaactcctaaaaagttaagtaactgcggtataaaaggattttaaggtattgggcacttgatcacgcgcactttggcctaagtaaaaagtgcctaagtccctaaaagaacgtgacaggccacccctgaaaatatgggctgcagacatattaggccaaggccaaaaaatatgccttcgataccctttaaaggatgacgcatgtaacatgctcctgagtaacaaatcttctgggtaatatagaccaagtgtagctcatatgaatagcttctgatctaaatgattatcccttatgggatactccaaaataaatataataattgaatcccgactggcgcaagtattcggttgatagcccttacggggaataataattggtccagtctttgagcatagaaaatagactcatgactatgaatccatgtggaatgtatccggatcaagtccaaattggagatataatcctcacgcttgagttgatgagcccctgagcatatagcttgtccttctgtcatagtcaaaattgtctattggcaatagctgacgcagtcggcatggagatgaaatgaccaacgtgaagacgaaattgctcatcaaaagtaacggaagatgtcagtggtagtaaaaatagtgacaccaatcaaaggtaatgaagttgcataaccatggaggcgaagaaaccagttggcaacagtcaggtcagctagcagtgaagatgtaggcgcccaacaacaacgaaagaacagtcggtgatgacaaaagcaaaccgacgatgaagacgtagacgcgcatcaacagtgatggcgaaatccaccaatcatgaagatgaagaaaataatcggtggcgacaaacgcatccgacggtaatgatgattagcggcaacagagatagccgactatgatgacgaagtttcccatcaacgacagcagagtaggctatgttgaagaggcttgacaagatgttgatgaagatgacgatgtcggtgatccagtcaatagcgatgtagcagctgatgataacgatgagatcctctatcggcagttgcgtagtaggccaaccgtgaagacaaataattggaggagagttgatattgttgcccaactcgtctaaaccgaaatatttgaagttgttgaagtagaatgtctgctctgaatcaaagatgaagataatgactcctgaagttgactcgttggttgatgaattgatttcttcagcttgacataaaatttgtcaaattttgagccttgtatttgtgtagcccccgactctttggttagttgggaaacaactgaacatagagtcgagaattatagcttcttgtcatcgagtagtcattgcttgattgaagatatgtgttgaagatgtccaagtagaaatcctgaatattggagagcctcttgttgtagtaaaataacatggcatcgcatgccgagatgtcgaggctcacaaagacgtcgtggttggtgaagtagcaaaacttgcgaagtagcagcaatagagtttgccagtgccgaagataataaagatgaagtcgctctaccatgatgacaaagttgcattgccgtgatgaagtgaacacgagtcgtcggcaacagaagcaaactggtagtgaagacgcgcagttgtgaagataaaagcactagtcggcgacagcataaccagtcggcgacggaagacgatgatgttcatcagtagtggtagctgtataaaccagatgtagaggcgagggcactagtcagcagcagacgagacgaaaggcgatgaagatggtaaggccaatcaacattggcagaatcatgcagccatggaagtgaagaaaccagtcggcagccatggcaaacgtaggcagcttgtgttgaagatactgatgcctattagtagtgacagcgatgtagccagccgtgaagaagatagcatcagttggcgttataacaagccagccgtgcaggcagtcacaccagtcagcggcggatgcggcggccggtcggtgaagacgtaaacgcccaacaacggcagcataataggccagccgtgcaggcggaaacaccagtcggcggcggtcgaggcggccggtcggtgaagacgtagacgcccaacaacggcggcataataggccagccgtgcaggcggaagcaccagtcagcggcggacgaggcggccggtcggtgaagatgtagacgcccaacaacggcggcataataagtcagccgtgcaggcggaaacaccagtcggcggcggacgaggcggccggtcggtgaagacgtagacgcccaacaacggcggcataataggccagccgtgcaggcggaaacaccagtcggcggcggacgaggcggccggtcggtgaagacgtagacgcccaacaacggcggcataataggccagccgtgcaggcggaaacaccagtcggcggcggcgaaggcaagccggtcggtgaagacgtagacgcccaacaacggcggcataataggccagccgtgcaggcggaaacaccagtcggcggcggcgaaggcaagccggtcggtgaagacgtagacgcccaacaacggcggcataaaggccagccgtgcaggcggaaacaccagtcggcagcggcgaaggcaagccggtcggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgtccgactagtcatagcccccaagcatcgggagtcggcctaggcatttcccaaacatgcatatgagtgacatgagttcgtcattaatggaacaaagtttcacggatcagaatttactactcaggtacttttgcaattattaagagcagaaaataaattatattatctctatgcttttgatttcttccgagtaatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacggaggcaggccggcggtgaagtcgtagacacccaacagcggcggcataatagaccagccgtgtaggcggaggctccactcggcggcgacggaggcaggccggcggtgaagtcgtagacgcccaacagcggcggcataataggccagccgtgtaggcggaggcaccactcggcggcgacggaggcaagccggcggtgaagtcgtagacgcccaacagcggcggcataataggccagccgtgtaggcggaggaaccactcggcggcgacggaggcaggccggcggtgaagtcgtagacgcccaacagcggcggcataataggccagccatgtaggcggaagcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggtgaagatgacgatgcccatcaacgatggtgtgaccaaccgaccgtataggcggggacaccagtcggcggcgacggaggcaggccggtggtgaagtcgtagacgcccaacagcggcggcttaataggccagccatgcagacggaaacaccagtcggcaagagtagtgccgcggcgttacatgcaaacagcagaaaataccaagagagattaatctgacatttagagatcaatctaataaacaacaataagttgaaaaggaaaaaacccggcgaagtcggagattaaaaggaaaaaactcgccgagattgatctcttcgactgactccgagacggagcggaggaggcggaggtcgcagtcgcgggcggcgttggtgtccatcagcacgacgcaggacggcaggaaggcatcggcgtggctgcagccgtctcctatgcatccgattagatcggttttggcatgcttcgtgtttgtagatccatcttgcaacaccatggcatcttcgttgggtagattggacctgtaggcttggtggtggacgaggacgaccatcaaatccgtcgaactgtcgttgccccgtcgttgccgtcgtgctgatgcgaacaagatcaggcagagaatagcagcgacgattcgtcttgttgaagtcgtcggcggcgaggaatcaaggagctcccaaagcgaagacgaagccggcgactcataaagttgattccatcgcactcgtcgtcaggaaactcggcgtttacccctacctggcgcgccaactgtcgaaacatgaattcggcaataataaaagggggtagcgcacgagacctaaaagtggatggatgcggagacaaaggatttagacaggttcaggccctctcaatgagaggtaataccctactcctgtttggggatttgaatccgccgggtgtagtatagatctgacgatcaggttgtctcatgcccctagagggggctccctgccctccttatataggttggggggcagggttacaagatagaaaccttaaccaatacggtatcggtttcctaaatctactttacaatcttatcaaaccaggactttaggccgttccataatatacagggaaacgtaatacccaagtcatgatctgttacatatttcatatatataagttatcccctataactagtcggataaccatgccgtgtgggtatggggtacccataatctccacaacgacgccgccgtgtccgccatgccggcgcgcgtcttccacaacctgaagctgcgacagcaccaggggtactgggtgctcgacgcctgggcgcgcggcgcggtcgccatgcagcgcggcggcggcggcctcgtgccccgcgccgacggcgacgtcctcctcgccagcctccccaagtcggggacgacgtggctcaaggcactcgcgttcgccgtcatggcgcgggcggcgcacccgccggcgagccccgaccacccgctccgccgcctcaacccgcacgactgcgtgcccctcgtcgacaggctcttcgcccccggccgcgacgcggttctcgacgagctgccgtcgccgaggctgatgtgcacgcacatgccgctgtcgctgctgccggcgacggtggccgacggtagctccggctgtaagatcatctacatttgcaggtatccgggactttgtgcgtgataaagtttgaggacactggctagcaagtactcctatatactggcttagtttattaacttacacatgacatgaggaagataaccaattgtggagtaaatggtaataaaataaagtgattgaattaataggacaaaaaaaatgatgctacatctttcgcaaaatccttatgtaggccacaatgcaaaaaattcataccgaattcaaatattaagtctaaactcaaatgtgccggatattaaaagctagatattaggcacatgaaaatttgaaaattccaaacacctaaaattatgcattaattgctaatcataaatttgtagtgccatgttaatgtgttcgattttagttcattttaactacaaaaatatattgtagtagtatatagatttactttatttttgcatttcactttgttttttttaccaattgttaattaaattatttcatggtatttgtaaaattactttaagtttaggttataatatatcattgttacacctcttatctatgaaataaggataactttgcaaacagatagatataccacagggaacaatgagaaccgtgccttcctgatgcccttattacaatattgcttgaactgtcataggtaccggttagaaactggtcataggtatcggtttccgtagtcggcacctatgcagttgcgcataggtgtcggttcttaccacctaacaccggtgtgaggaacaaataaagcaaggttgctcgacatcgagcagctactgatccccatccaagaaccattcctataagatcccctcatcacatccaataacacaattacgaaatcaacactaagatacaaaatcaatatcaaagaacaatagagaatacacagagaggagaataaaataaatcatcgcagttgctgcctctcgacaaaccggtgctgctcccgcttgatccccttaaggaggatggatccagatgatgacgttcagggtggagatgtacaggcccggcagggtgtgcagtggcacgggaccttgcgctgctcaagcccgtgctcaccgtccaccgccgctgccccagcctacaccaccgctaggacgggttactcgtggatggcgctgcgacggggcagaagccactcttctccgtacgccgcttgtctatcctcggcattggctctgacgccggcgctgtcctcgtcgatattctcggccccggtgccaccagcgagttccacgttgacaggtccttctagcggtgctactgctgcgtggtagccggattcggcggaccccgacctccaggcggccggatctagcatggcttagaggtagtggtgaggaggaggggcagaattacttggaggggcgtcaccagggagaggaagaggaggcagaggagggaggagtggcggcggacgaagatggatgaggaggagaggcccgtgtggtggggatgtgcaaaagatgtggacaaggagtacggggtagggagaaaagtagggagaaaatgtgaggatagatgtgtgaaagatgtggataagaaagtggcttggctccgtcaattttatgggtaatagttaattaaaaaatcagttcatataatatattataggttcttttttaattattaaccagtacctacaatatattacaatatattataggtcctagttcatttgaaaatattatgctgattttttctttagaactgacatttatattactcaaaggtgtatgttctatatttttttcatcgtgcaaatgtgagaaaatatccgtaggtaacggttttaaatgtcgaccgacacctatgaatcgatatcaataaggggtattgtagtagtgttaataattgtgatttctgtgatgaataacaatgggcagagaagaatatatagaatcatgtcgttattatatatatgtgcaaacaaaatatgatgagggggagagagagagagagaacggggagggagagagcgactggagggtattgtagtagtgttagtacagcgcaaggcgtacttgtgctagctacgtgatagaattggacaattaacgtggaagtaggtgactgggtgttgtcatatcaattaggtgtaccggatatttgttagctacaataaggacggtcgacggaatgggactgatatatgcatgggctagctcgaccaaagttgctagctactgtgtgtccttcaggtaattaatcggacagatacacaccacactttttatattatactccccccgtttcaaaatgtttgacatcgttgatttttttaagtacgtgtttaactattcgtcttattcaaaaaatttaaataagtatttattcttttcatatcatttatttcattgttaagtatactttcatatacacatatagttttacatatttcacaaaatttttaaataagacgaacggtcaaacatgtgctaaaaagtcaacggtgtcaaatattttgaaacggagggagtaagttgtttgatttttttattagttaaactctcttaagctttattaagtttataagtgtgtgtgtgtgtgtgtgtgtgtatatatatatatatatatatatatatatagaggccatatcctgtgaaaatgcaccaaatgttgcaaacttggaaatactaatctccaccgttgcatccaatctgaacgaccatgataagctcccatccactctctcacctgttggatgcacttttgcagaaaaccgcccgcacctggctgcatatgttacaaaaaaaaccctatactcatcttctttatagattctatccctctcatcttgtaatgtactgctaccatgatttgttccaacaaagctcactggtcgactcctatggccagcgagacggcggtcgccggtcttgagctgcgccatgagccactccatctcggcgcgcttcaagaccgccttcaccttcaccccgccgccgccgccgcagccgtctcttctccatcctcctcctcctcctcctctgctggttcttccctcagcaggtggacgaatccatcctccgcggtggcgatggcgaacggcatcggcgctacccaatcccctaaggccgttagcaacctcgcccccgaccgctcccctgacctggacattgagttgcagggctacgaagggaatcaagtcccaaccagatctgggccaaggtattctcttctccctgatgatggatctgtgcattggagcctggtgaggtagagcaaggattggagggagagcacataagtgctcttggttttttttctctgatttcttagttagaaatgtgcaataaccctggaattgttctctgattggagggagagcatgagaatattgcttgcatgctggaattctataaatgtaactcacacatcatagtccctgaaatgttttttagtttctaaaatgtatatggatctctatttgggaaagtcactctggatgcttgtgctttttattatataattttttttacaaatgcatgtgcatctatccaaaaagattcatgtacaagtttaatttgattacgcgagatgttgctcctattatctctttgtgcaactaacaacataccatgaataagtatgtgcatctgatcacaaataagaaacattctacatctgggcatgccaatgagaaacattcagtagcagttgaattttgttttgtgtctcacaaggaatagttgttttttttcctatagagaacatctgcaaattgtgcataggaagattcaaatgtggggaggaggatgttgacttgaaaagaagatggaagatggaaagaagatggaagatgagactgtttaagattactcatttgattttttttcaaggagttgagagatttggggactgatagctctagagcactagtgataatataatttcaagaatgggataattggggcataccatcttatgcagatattgtgttcttcttttgtatgatcaatgcatgtctaaaagctttcaaattactctggtgttatcctgtgagaagtagtctttttatatggatgacaaacaacctaccggcttgaggtgagtttattggccagggattccccctcgtcaccaaagtgtccctgggtgagtttctccatcttctccatcttccccaatcatgggttgcaacaaaagaacactactgcacccaatgcaagtgggcaagcttgtgcagaggaacacaacaaatcaaatgcataaggaacaaatcaggtcaagaacaaatgggagcacacctcgattatgactgaagaccagccccatctgccaccgccaccccaaaccctaaccctagatgaacacttgttgagcttttgtccatacctctggagcaggaatggaggaggaagattggatgcgaggaggaagctcgagggagtcagggaagcacataatcgtggggatttctcatcagttcgaatcggaaggagggggtaggggactagctgagggtgagaccttttcttttagatggagaggagctgagaattgaggtggggattttggaattgagagcgggataacatggtcctgatattttcagtaaaacatatgttaagtggggtggtaaacgtaaaatgtacagttggaaggggtacattatgatctcatcccttggaataggatctaacggttggtttgcatatttccaacatttaccctgtttgcacctgatatgccctcatatatatatatatatatatatatatatatatatatatatatatatatatatatatatatatatatatatatatatttctaatataaaacaaacatattatcaaaatatattcaatgttaaatttaataaaactaatttaatgttataaatgtgacctaaagaaatttgactaataaaaaagtcaaactacttatatatcaaatggagggtgtatataattaaacaacctctatatatagccataatttgggcacatatattcctctttaatctctctcatcaacagaccgggagtaaatacataagatcttatacacatactctctctttctctttctgtatatgtgtgtggtatatatagatagacatgtcgatatatataatattcaatttgcggcccattatatttgtaccatgatgaagtgataattaactaagattgttaatgtaaacaagtgggatggaataataccaccattttcaaattttgcttggtgcatgtgcgaagaaccgagatcactgaaagacataaaaaggcaaaaattaacaagttgcttgtgacaaatataattctcatatgatatatgttcatcgttttcatggaacacatcatgatcaacaatgttttactcctatcattcatcaaaaatccaaaccacaatttgataattgcatcgtgaataaagtattagagcacacacatcgaacactataatataatcactgcagcatgccatgtgtaattaaaaaaagagcacatcgatcgatctaaagacaaattaaagtttaacatataatgtccagccttaattgagctaggtaccccaaaatacagatatgcctcataatcttcgtccaatgcaataactagctaggtggtaaccaggtttgaactgtagttacgtagtttttcgattttgctatttgttaaaacaccattgttaagtcttattccttttttttgcaataaaaaagaaggagctgtcaaaacatataaatgtacatgtgcagggatcagaaggatgcattggtctccatgtggcacttcctgaagcgcaatgggctacaaaatctgtacgagtccttctgcgagggcacatgcttcgggggccctgtttggaatcacattctcgagtactggagggcaagcaaagcgaacccaagcagggtgctcttccttagatatgagcggctgcttcaagacccaacagacagcatcagggagctagccgagttcgtcgggcagccattcactagctccgaggaagaagctggtgttgtcacggagatcgtagagctctgtagcatggagaatctcatgagccagaaggccaacaaggaaggcgcccaaggtgtgttcatcaagttctctcacgactcgtatttccggaagggggtggcagggggttggacgagccacatgacccctgagatgggaagacgtctggatgcgattctccgggacaagtttgatgggtcaggactcactatctgaatatgcatttagttttacgtgtgtttcgtcttttaatttatgcttaacaatatatagtagtacgcaaaaaacgttggattgttttttttcttgttgaaccttttctccatgtattgaaataatggtgttgtttggaagtatagtctgtaaccttttatgcttgtaaaacggttataactttgtaatttccagggcaccaaggaaaaccctttaattgtaatttccctaattcggttaatcacaatgtagcttgtattttggtaattgttagagttactctggttactgatgtaatgggataatggactagctatctggcataaatacataatgattccccacacattgctgcaagatggctgtggatatcatttgctttggagagatgcgcatactatataaaatgctttctagaagtctatcatcaatgattactgcaccctaagacaaatttagtaaattaaggcaaactgtttcagcttacttaagaattcaactaacttcatatatatttcccaattcaagatgactaaactaactaagtgtaatgtcaacaatcaatccagtatactgttcattgaaatataagctagaaaaattcaacctctaattctttcttttgagaagaataaaggaccaggtcttcgacaatggaagcctttatgccatatccatgtacttgtttatgaagtcataaatcctataaatcctataaatcctataagtttatacaggatttataaatttaatatagattactaagtatgctagtgttattgcccaagccccatatgatgagtcatcttaagggagggagggaagtaattaattaattcacacatctgcaattaatatggagatgatatatactcctcccgtccgtgaaagggcatatagcctagtggttgcagtgatctgagtagcacccaaggtcctaacttcaaatttccatatgagcgaattttagattgagttattagagggcaagttccttatttgataggctaagttcctaatttaaaaaggctgcatatatccggttggatgcagaatccgggtaaaaaatatccttcttaaaaaaaatactcctcccgtccaaaataaaacgaacctaagactggatgtgatacattcagattcgttgtactaaaatgtgtcatatcccgtattagatttggtttttatgggatggaggaagtatatccagtattagatttggttttttatgggatggagggagtatatactgctcgcagcctacatgaagaacatgtcattgcgcctccgctgagttggggcttctatttttcccattttcactgatagctagatctaaattttcatgagctatgtttttattcttactaattgtgtggaggcaaagcagctgtttgcatactgttcgtggatttgtgtatcaaattggcatgtgtgtgttacaggatttgttctagtaatttggcacatgtaattaatttggcacatgtgcgtggatatagctaaaactgctgatttagatgacaaatcaagatgtattatggtaaaccttttttaacatgctccaaaataaatacatcaaatacaaaaatgagagagagaaaaaaatgatgatcgaagtggaacggaggaagtacggtggtaattaagctagttacaagctccagcatacgctgcaagatccctagaacacactactagaaaaccacaaattggggacatcctctatctacaaggcctttcctatccttcgtaaattcttaaattaaaaatcaacacctataacgtgccaatttttctaaaaaccaacacgtataatacaagtgcctgattttctttaataaaagcagtacaaataaagatgtcatatgtgctaggttttttggcacattattggagcagcagcaccagcggaaaaaaaatcacatagacatacgccatatctcctcgtgacctcgtccattcctttcttatatccgtctctctcaaaccctctaagcctccacctaagataatcttcatcttttctctcattgtctctcactctttactcctctccacctctcagcatcctagcctgcgacgctacgatgacaccccaacacgtaaaggcggcagcctgcctctcccagtgacacgacgattgcggcgaacaagccattaggttatcctctcaccatggccacagcctcagttcccgcagacggattcatcgtcattggcgatggcggtggcaccgatgccatatctagattgtccgagttcaggaacctctagatctgccctcctccctcccctagttatcactgtcgaccatgacgagcgacaacgagcaacagtgacctcccctcggtgggacagcatcagcatcctcccctcggccccacctccccacaagcagcggtggtggcgatccacatgactaaccaatacccctcctcccaaaaaattcccctccctgatctctcccaccaccccttatatctgactgtggtcttctggatctgagtagtggtggtgagcagtagcggcaaaggtggctttggcctccgatgggtggtggtggccttggtctccgctgggatgaggcaatggaggcatccttgtgttgatttgtaaatatttttttctttgaggggggaggtcgtgaatgttatgtgtgtaatttctgggatgattctgatacattgtcattggatttgtgagaatcttccattcagtttttgtatgtgttcttggctcgtagcatatgttcgattcgagccgatgcatcgagcattttttttattcatggaatctcaaaagcaccaatttctagaccattctccacatcagtgtcacatgaagggtgccggttgtgaatttgacaccaaagaccggttcccaactgacacaaaagtgagttcctatagtagtgacagatcgaatgtaactgcagcatttacctaaacagaggttaattacaataattaacaaaaaagatggttgcctatggtgattgacaaaaacgatgggtagcatcggaaggattttatttggtgcaccgaaaattacataggtcatagatgtacctgtttataagcataaacagttaaagttaagcctccaaacaggctaggaggctttgttttattatgaaacacatagcttgaaaactgtgactacaaattaaaagatgaaaccccggccataatggcgcatcatatggtgagccccgatccatcaaacttttctcgcataatcgaatccagatgttcgcccatcttaggagtcatgtggttcctccagtccccttccacccccttcctaaaatacgagtcgtgcgagaacttgatgtacacaccttgtatgccttctttgttggctttctggctccttagactctctaggctacatagcttgacgatctccgcaacaatgccagcttcttcctctgtgtcagagaatggctgcccgacaaattgtgcgagctctctaacggtgttcactgggtctcgaagcacctcctcatatttcaagaagagcactcggcctagatctattttgcttgccctccagtaaccaagcaagtgatcccagacaggaccagcaaacccagtgccatcacatatagactcatacacttcttggagcaacagatctggcacattgcgtttccgaaagtgccagatggagaccaatctatctttctggtccctacaaaatataacaagctagagtaaagcaatgtttcattgtcactaaagttaatactatgtgaataaatgttttggattttggtttgcaatttctctctttctaaatatacatattgtatccaggacttgcttttgcgaattcatgaaattttggacaatgtttggatcaagtatgtaagaacaatatttttttcctagggtagagatcgaggttgttgaacaagtccaacaagctaacacacgagacacggggctctttacttctcaaagggcaccatggtctagagcatcatgactcattgcaagggagacaaaataagtttgtttttcaccgaactcttgcatactaatacaaagcaaaaagactagaataccctctactttatcagtcccctacttacctaattacaattaatgcatttgtcccctactttcataaaatccaatgcaatgatgactcaaagatgaacttattttgggacatacaagagggggcaaagataattatatttcagaacagagggactagaagcttgcgacactatagaaaaacatgaactgcctctccatcgatatggatataaggaaaagggaagccaattatttgacctcatcaccttgaactcttgtaggaggataatggcaccagtgaaagacaccatctaccaatactgcaaggatgactctcagacggaggggagtgggtgtggaaggggatttctttttgctttgaaggggctcttaccaaggtcatggttgtaattgtgcgtttatcttcttgtatagaaaagagtagattctataaaaccccacctattatggttcaagttgtacaaaaccatagagattttggcatgtgacacataatctcaagtattatgtgtaaccattttaatgtgctcctatatcaagattttaaaaagtggacaaaacatttatatgatgaataaaattctcaaaaatttaaattgtaattgtagaactaaaaggtgtggttgatcaaaaatcaaaatgttcaatagtacggttttatgaaattttagaaccataatatccggtgtgatgtgccacgtatcaaaatccttatagttttacgtaacttacaccataatagtagggttttatgtactttacttatagaaaaatacaatgttaaataatgacaacaaagtaccagctaatctagatcctgcaataaccaaataggaaacatgctacatcaccatatttggtagagggtcccgttctgtcataataatactacgcagttgtatcacacatagcacagcacgtggtcatgtaccatctttcttcctaacgcttttctttgggaaataaaaaatctctatttaacggccatatggcaaaatactcatttttaagggagaaatacataccatttccaaaattagtttaaagttttcacacatgagatttgagatgagagcagctaatatttgaatctgatatgtataaatttcggctggtgtacaaaaacgaaaacgaccggatatgattcaaaactaagattccccttagtaaaataatattacctccgtcccaaaataagtgcagccgtggatatccgtgtccaacgtttgaccgtatgtcttatttgaaaattttgaaaatatttagtcacacataaaatattattcatattttatcatctaatagcaataaaaatactaattataaaaagttttcaaataagacgaacgatcaaacgttgaacgtgaatagtgcaaaactgcacttattttgggatagagggagtaccaataacaatataacgaataagggatggctagctatagctatggttatgggtacctgcaaatgtagatgatcttggtgttggagttgccgtcagccaccgccggcggcagcagcgagagcggcatgtgcgtgcacatgagcctcggcgacggcagctcgtcgagaagcgcgtcgcggccggcggcgaagagcctgtcgaggaggggcacgcagtcgtgcgggttgaggcggcggagcgggtggtcggggctcgccggcggcgggcacgcgcggcgcgccatggtggcgaacgcgagtgccttgagccacgtcgtccccgacttggggaggctggcgaggaggacgtcgccggcgcggggcacgaggccgccgcggtgcatggcgaccacgccctgcgcccagctctcgaacacccaggtccccccgtagcagcgcatcggctggccgtaggagacgcccgccggcagggcggagacggcggcggcgagctccgtcggagggcgcaccggcgtggcgtcgacgtcgacagcgtccttgaacgcgacggggcctccaccatggcgcacagctgctcttgctgccggctctcctcccttgttcgccatggcggcagcaagagcgagtatcgactcttataagaccctagtacttactatactccgtatattggtttgctgttgagaaaagatttggtatgcatggccagatggccttgacagccggatgagattctctacaatactttatttggcaggttactataggcactatctggacgagattttagcggccacagtttctccaaaaatttctagctctcgaatgatcaatattcttatccggattcttaggcccgtttagtaggactccaagctccaactcccaactttaaactctaactccagtgatagctagctcctataggagctgaagtgggtatataagtatttggctagattgattagctccacaccaacacgtcccttgttggcatttagttgaacacctggttggtgtcgccccactgcctccgccaccgcacgcgcatggccctgcctgctgccgcagccgacgctactctcgcacctcgccctgccgccgccgaccacactccaccgcccacgtgccgtctcccgccaccgttgccgctcgtggccctcgccgccactccaccaacacctgccaccaccgcctgccgctgccgacaccaacggcgccgccggtgtcaagggatgaagatggggatgagcgagaacgggagatggggtaggaaggggtagttcagtagcattttggtataaatagactaaaaaattaaagggtagtgggtcttttgcggtggagtgaagctgtggagtagcaaaaacctagctccacccccgtagtacaaatttgtggagcagctctactaactccgctccaaaaaatagagaatctataccgtttggcacagctccagctgtaggttgtgttcgtcagttggagttgaaaacactttcctcattgcacgcaaaacgaaacaacagtttagcgtatatttagttaaatattagctaaaaatttaaaaaatctaaagtagtgaaaggattcatctttccactggtggagaaaccatctttggtcggtctggcaaaatccacaatagtcccggttccaaaaagaaccgggactaaagataaaaattttgatcttgatctttagtcctggttcataccctgtcagatgtatgtcagggggccgaggatctttagtcccggttggtgtcaataaccgggactaaatatcaccattttagtcacggttggtactcttgatcattagtcccg

SEQ ID NO: 82993 - DNA, 1103 bp, Oryza sativa
ccgccgcttgaccagagagtgacagagggaggtgggagaggaagcttatgaggagtagtttctttaccacgggggggagcttgggcttggcggcggcggcgctcctggtcccgctggcgctggatggacatgaggcgcatcagatccagcatccccatggtggtgaggggatctctctccgccggcctttcgtcgtcgccggtcggcacttctcaacgtcacacacaaaattggggaacgagagttataatttgtaggcaagatagatatagatatcagagttataattttaggaaggagcccaagcagtaggcagtagcagagttctgtttcaattaggatgaggtctccctacgacaacggggaaggaacggaacgtgtggaaaactaaaaatatatttatccacggactccctacttccaaaaaaaaaccaacttctagttataaatttagacatagtgtatgtctagagtcatagcaataagttgattttttttatgaaacggagggagtatgtgtcatcctagtgtaatttacactctaacttttatatatattaactacaatacaaggggtgagagatagggaagaagggagtagtaaagctgacatgtggggttcacgtcggccacactattttaatttttttttgaaagaaacacagcaagggtggcggacggagcatagcggtgcgggcgagctcatggagcagatgggcggtaggtagagccgaccaccagagcgtcgccctcgcgacagccacggactctccgctgtcgtccttggtgaggagctccattgtcggcggttcgtcgacgacggtggaggggcagagatggcggggttggagcggaggaggaggtcgttctcgacatcgatgccgccatctccactcgcccctacgacgatgctgaccaccacgccgtcagtctccttcaagaagacacccgccaccccggctccggtcaccgcgccacccaccaagtcaccaaggcacccatgccggtacccaaggccaaggccacctcattgccgccctcgtctcccccaagtcgaggctttcgtcgccgagtccccacatccccaccacggcgcacgccga

SEQ ID NO: 82994 - DNA, 8453 bp, Oryza sativa
atgtcctcgcacatagagagcagcacgatggcgaggtgaagcgacacgggcatcgacgtgaatgagtcagcaagcgcggggtgcgcctccaccagcgtgtaccaacgccacatgcagatgagagaagggagaagataatggcaaaattgttgttttacatggtttttcttctgtcaattaggtgggtgacatgtggatcccacgatatttttttgtgtgtgaatgacatatgggtgtcacattttttttattctaatgccatgccacgtaagcgccacataggacaaagactcggtaaagaccgccacgtaggcgtcacgttagccaaaaccaccgagggatattgtttgcatgggttgtgatagctggagaagtcgatttacccggttttgtgggtggaggacaggaatcatactgggcgatagttgggggagccgaagtataatttttccctattgtttgtgcgtgtatatttttcatctgggctgcctttgggtgaaatgcgtggcccatttgagagtccacacccacctgggctggcgcctgagccagctaagcgtgaccaaaaagaaagaaagtggcggggtttttcaattttggtttattagtggtgaaaaaaggggtgtgtttgttcagtggaatcctagccgcccaaaggagttggaagcatcttggccgtccaagagcgatccgtgtcgaccgatttggaccaatcagagcgctggatcaaatttggcacggattgagatggtttggttttcccgctcagcgctttgaaaaatttgggggataaatatctgaggaggggatggggcccagacgtcagccagggccagccccctcgtcttccccttcctctctccactcctccaccaccaccggccgcctcgccctccccgccggccatggcgctcgtcctgcccgacatcaccgtcgccacgatcgaggatctccacgtcctcgccatgctcgatgagccgcgcttcatcgacctcgtctccattcccgccgtccgccgcgcagccgagttcgaggtcgccatcacgccgaaggtggactacgatgggtgggtctgcaacaagctcgaggatctccggcgcgtcaggcgcttcgacgacctcctcaccgacctccagaagaggatcctccccatgctcggcaacaaccccgacgacaaggcggccctccgcaatctccgtacatgcgggtacgcaatgtggagcgttcgtcaacatgctcacccctccctccacaacctcgtcgggttctactccaacacggtgacccggaaggctcgccaagctctggatccgtacaaggcctacacgatcaagcaggagtggctgcacgccatggcgcttcgggtggagggatcccggtctgctttcatgccgttcgacagcgactacgtgccaccatctccgcccatgccaccatcgtcgtcagctcgctcgtcgatgtccacggcgtgcgcttcgccatcgacccgcaccgcgtcgagctcggcgccgtcgacgccgtccgcctcgccccggagtacctccacatcctcctcgagaaggtggagcaggagggatggatctgcccgacgctccccgctctgcgccacgtcgctcgcttcgccaacctcctcaccgatctccaggatcgcgtcctccccgggctcctcaacgaccacaccgacccagccgtcctacgcaagctccgcacctgcgggtgtgggatgaagaagctgcgtgccgtcgccaagggtcctctcctccgcttgacgcgcctcttcagcaactgcctcacccgccacgctcgtgacgcgctcgacgcccggaaggacttccgcatctctgccgattggatcgataagattgcagttcgcgtcgacaggtgtctcactataccacttcatcttcaccaccacctggaggacccgttcgttgatcatctccatgatctcccctgagttgagtgccaccctgatgtcgagttgtacagacctcgctaagtcccactaagatgtcgttttagtcgtacaaggatgaacctcccctgcgtcccgtcctagtcctaagatgtctttgagtcttacaaggatgaacctcccctgcgtcctaagatgtctttgagtcgtacagggatgacagtctgatgtctttcagtcgtatatacagatctcctatgagtcatttgatatataaaatttccattaataatctactttaggacattgctcatttctgtgatcaatgcatgcattttagaagcatgattagatttttcagcatcttgtggtgtttattcgattaccgttactttcgtttacacaacgatcccactgacggtgaggaacctgagtacgaggttgagccaggagtagaggttaagcatggcaagtgccctcctgtagctagctgcattatctatcggagtatctgtatcgtgtagtaactagctgaatgcccatgcgttgcatcgggattttaagaaactagctgtgccccccgcgcgatgcgccgacatcatccaagataatcttaatcataaaagaaaaatcataataataaaaaataagcatgattgaaaacaacatagcacataacagagctacacaataataataataataactcgatcagaaagagaatatcacgatgttctcaattttgagtgatttaattggaccataatattttttatataatcaatgttacacgaacaacgggtatctcggtgcataatacaattacatcaacaaaaataaaataaacaacattagtatttcaatacctagcagagtagcagttcccaggaagaccaatcagtgggcgatgattaatttggaaggatagtcaaacaaaactatgtccacagcacatcacagttgtgccccctgcgcattgcgcgggcatatgaggcaacctataataactcaagatcagaattgggcatatcacaagataacatgcaacactgttccacagtaatagcgcaatatcaaaaagggcatataatctaacaatgttctcagttttgaagtgatgtaatcaaaccaaaagtttttttaagagcaatcttacactaacaaacatggatctcggtacatagtagacaacattcttaattcgataccagcagatcctaggaaaaacgaatccttgggcgatgattaatttggaaggacaacggacatcacatcatagatatggcagtggcaactcatattgtatatgttttacaatctatacaaattggccattagcaataacaaatagaaattaaggtttactgctccatgacccagaaccagtgattttatagccaattctggagatatgagagttcagtattctcgccagcttgtcattaattagcatcgatctattttagccaccaataagaaaaggaaaatacatccacattttaaccttgatgaagagcatgcatatcccacactgtacaaacaacaaagcataatttcaacagaataaaacagtttctaatttcctaaagcatgctgagtaatatagcatcagtatataatagcatgagaaagttgaaattacccggactggcggtcacaaaagcatcagtggaagcctgtaggaagccataaacccatgagctatataaaatacgcaacaaaccactaaaatgccatcacaatattcagttatcgtgttagctaaggtccaatgtttgcctcatattgtggtctctgccatgcgcccatgcctgaaaacgaaaatggatgaaagtggtcactgagatgctgccaaatataaatattgacccatgcaaaaatatatgctacagtttagccgaataccggtttatatgataaaaaatagagtagggaaggtcgtttatcaaaacaactaattaaataatgatcatgcatagggatataacaattggacaacaaataagacttcccaaggaactacccaaaaaactgaaataataccaggcaataacaggtagagaaaccctaaagagcaattgccaagtagctggaagccttgaacttgaaatatgaaaaacatagaaattagcaaacgaagccactcaaagaagcaagtacactattagaaaataaaaaaagataaatgaaacgaaatatgcccatgtgttgttgtggatgattgaaaaatcgtatagatatatttgagataggatgatggcacataaatatgtagctaggtatttaaacaaaaggagagggaaactgtgttgcatatatctgttttagtagtaactgagctactcatcatatagtattgggatcacatgtaccaaaacaaaataaagttacatacctgaggcaaggaaaatagaatatgcatttaagcgtatggcaggatgatatgaaaaatagcttttaagcaatactacactacaacaggaagcaagtggatttgacaaactttggtagagataggacagtactcttcatcaactttacattgaaatcatccatgcatttcttgggcatagaacaatggccatgtaaattatcaatggtagagtaaaggatggtgaaataaattaattggacaacataatgataaaaggggatcagggagctgacgaaccactgtcctggattaaaatgaagatatgcaaggaaaataaataaaatattcattagatattgatgccagacattaatattgttttggcaatgagaagtggccaaacggcaacaatcggaggacttctttttattgaaaaatcgtatgacttctggctggatgggcctagcccaaacctgaatcaagattagggcctaatccagatagaaaataatggggagatcatacctcactgtcccaaggaaggtgacggcagcacaatggctagaagaacacttgctccactccatagcttgtacccaaaccctaactgactcacaagatatgtcatccaaattgacgctgcaaaggatagaagcaaggatgctgaagatggagaagcagattgagttagggcttggcttgctctgctctactccatacccataccctaactacagatagattcatcacaaaataagtcatccaaattgatcactgcaaaggataaaagcaaggttgctgaagataagaagcagatcaggctagggcttggcttaccagactgcacatgttgtcaacaccgtgcaaagaggtggacgaaggcaactatggcagcgggcgtgcacccttcgtccaccttgagaaattggccggtcgagcaagcgaatcaagcggaacggtggcggcgcttgcaggtggctcgcaagaaggcgacgaccccggccgctagctccgcaagaaggtggcggcggcgggcttcgcgactcgcgaggggaagatgaagatttgagtattttgggaagggaggcgcagaggatgtcgaggatcgaggggattggggaagctatgccgggcgcagcgatgtgcatgtgaggcgtggacggttggatcaaatcaacgcgtggacatcggaaggtgcatgctgggtgatgaactgtagtactgtagcatcttttcctgggctgaggttgatcaaatcactgctagtagtgggttgtaaaaactaaggatttaatatgataacccatcaaacatggtaaaacccaaaaaaaaatattttcactgtaattatcagattatatctagcataattttagacatgtatgtcaaactacataattgttcgtagggatgaacaatatattggacatgaattatctatatttctaaactattgtatatgatatgctagtcctcgggaagaaaaagtatttttaatatttggttgagaatttccctttacttatttcagtctataagaaagttttctacgacacccatatattcacatggagtgatggaggccatcatccatttgtctccagaagcagatcgacagaataaacaccagaaaaaccaacctactattgcacaaggcatagaagcccatgaacagcccagcagcccatcgacattcctaaccctgactgctaactgcctaactccaaccccggtccactcattgccccacgcggccacgcccgcactcgttccccattcacatcgcacacacgccacgccgctttggatccggctccgtggccagcacccgcatcgccgcggcgcgcgccaacggtggcgccgacctggccgtcttcgagcagttcgagcggctggtgcgcccacccttctctatcccccctctcgtcgacggatcccgccgcctgtccgcgacgggttcgagcagcgggcgaagcaagagcagcggcggcggtgagctcgggcgtcagcggcatgcaaccgtgaaggtccgccggcgtcggcgatgggaagggcggaaccggcaccccctccctgcaggctgctcgtatttcgccacctctccgccccacacgcacgcggccggatcctttccccctctcaccgacaatgtgggcccacaagtcagcatggcagttgtgggaacggacaccacggttgctgtctttttaagatggtatagataataatataagtacgccctggcctgcagatcgaaccgttaatttaatttacagctgcttctgtagagtagtggtgtgctcatccctcttgcttaggcattaaccacgcctgaatatacatacgcgcatgtactcctatcttgtacaaatactaattactgcatgtaaaagatgtaacactactgcagtgataatgttcagaaatcactagtggcactgctattgttattcctgttcagtgtattgattgttctttaacagatttttttttcgaaatatataatcaaaatactgcaatggccaaatgatcggagataaaattgggtaatgtataatctttgcaacaagagcactgtgtaccacatttagagcaggtacaatagcaggttataagctagctataaacatattttaaacagataaaggaagagagagagaagagcaacgggctacagatctatagccagctgcagcacggactccaaaacgtaatgtgtgtatgataggtgggaccagatattaatagtatagtaagcaactattgtatgaattggctattacattgactatagatgatttgaagctagtagtgggctatactattaaacttgctcttatagtgttccttagagcaggtacaatagcaaacatattttaaggagataaataaggagagagaagagcagcgggctacagatttgtagccagctgtagcacggactccaagacgcagtgtgtgtatgacaggtgggactaagtattaatagtgtagtatgtaactattgtatggataagctattagattggctatagataaattagagctagtagttggctatactattaaacttgctcttattatgatctaaagagcattgtgtaccacatttatagtcattgttcacttgtttcaaataattctccaatacggaccggtctcaaactgaacactcgagatgaaaattagtctgcacttgctgacagttttggcagactagagtttatacttcatgtatactcatctgttgctttttcttcaaggacaattgaatactgtatgtttttatttgatttttaatccatcaatcatgcatgaaagcgactacgggtattctttaactccaaccgtgtcattcatgcatgcaacaagttgccctactattcgcgtacgtatgttatgtataggtacatatagatgaattcaaatattataagaaaccgatgcatatataggtgaaaagaaattaaaggctacacactaaaatttgttacaaactctaatgtttagctttttataacccacaaggccacaagtaggtaaatcaaacgttcgagaacttctgctagtaagaactttttaatgtgcatacaacactgctgctaggtggaaactagagttactagtggatatcatgtgcattggttatgatatcaactagtagtaatcattaagagcaaactttagaaaccatgacccatctaagaatctacagaatcatcatcagcagcagcacgattaaacatcgaataactaagataaacatgacatctaaagttcagtggaatggcagctgcagggctccaaaacagtcagcttcactgtggaaggtaccctaggctggatgtatcttctgatagccaagacccctctgtgaccttccatgataatgtccctatctagtggggggcatttgctgattttgctgcctggagtatcacacctaaaaccagtctgagaagcatccaatgtcaagcactcgagtgaagctgtactctcaaggatatggcatgtcagctcaaccaagctctttacagagatgaatgatgtaaccgtcacactcttaaggttgtgatgcttctcttctcgtattgatctcagatctgcaggatgtgcaaaaattgaaacactctgcacgttccgctgcattacctaggatgtgaa

SEQ ID NO: 82995 - DNA, 2350 bp, Oryza sativa
cgagcaggtcgcagagctcggcatggggctcgctgactccggcgtgaactttgtgtggggtcgtcggggataagaacgcgtcgccgccgcagccagggtcgcctcacgccgccccttcctcttacgcccacagccgccggagcgtgcctccgccgccgcgcgccgcgggccgctgtctctccgtcgcgagaaaggagataggagagagatgaactgatgaagagtggggagaggaggaagaaaaggagggctgagaatgacacgtgggcccacgtgggccccactatttttaaattaatttgtgtgtgacactgacatgcgggtcccacaaggtttattatttttctaaatcggattgcccatgtaagcgacacgtcaatgccacatcagatgaagaccaagtcaaaatagccacgtaggcgccacgtcagcaaaaaccactgtccaaaccgccatttgcactggttttgacagttgagggacctgttgtatctggttttgtggttgaaggacggaaatcggattcgttgacaagttaagggatcttagatgaacttattccgggacacgttgctacttcgccagagagatcctcaacggctcgattgtcgcagtctcgcagagatcaaattgctggcaagaagtggcaagaagttttatttgcggttttttttttttggcggggaacggtttctttagttcaagtaaatggtagtacaagtgctaatgaggtggcttatatgttggctagatcgactactggcattgtattcatggttgtatctatgaacttgtaaactctgaatctaggaacttgtaaactctgaatctttatttgaatgaatgagccgaccttgatttaccaaaaaaaaaaatactcactagctgcttgatctgaatgttcaagtgggttgatagtgatggtgaccatgagtccatgaccgtgtcttggctgccacacgtgacacgacagtatcgctctcgtagtcgtaggcgtacgcgtataccaacttggttacaggatactgcttcaactttggctgcctctgccaaataactcttcacatgccaaattgcctatcacccaaccatgtacgtatgatgaactactaacttttcctctcttttttcaataataacttctaactgaccaaacgattgatatgtcaataagccatggacttgttattctggtttctgaagataaacatggaccagctttcaaggcctctttggatcgcaggtgccagatggtttcatctgaaaacgaaaggtaatcaaatgaatcagatctgggtgggcctgttaaactacagaacagaacagatgctcctccttatcaattctgatgatgcgtcggtggatggatcagtgaaagtcagcttcacagaataacagtgcctgactacttgtataatccggtgctccgtcttcataacacagcctgaatcggtgaattgtcaatacgcgctgtgccggtattcaacagaaagacaagtcaggtgctcatgacaaaggaaaattcattgaggacaaagtacattgatcacagaaccaaatgccacttgaacattttcaaagtcagatatagtaaatgcagcaatacgtacagtatgtttgtgatttgattcacaatcggtatggaaatattcatgtttgaaagtaacttacacatgaccatgaatttgtagttgtgaaatgtgaagaagtcttaccctcacaatattgaagatcatgggcaggacttggagacttgaaatgcatggcattacttcatttacatggtagggcgaactagaatatttggttcacataatcacattacagaagatgcacaaaaatgtgaacaggtaaaatcaccttgaaaagaaactttagttgcaatatgacaacagaaaacccataaaatcccaaatcaatcagatgttgcagatgagtgagcaatagctcatagtgtagcgtacagttatcaaaactgagatcttgcattgttcgacaataggctcagagaagagctgtctgaacaataagattgatgctaacttacatccaatggaaactatgctgattaacaataatagtacagacaatcatcatgtccttttcagttcctaagaagctcaatcctcatctcaaactcacaatccatgacagggacaccaaagaaaaccaaaaccccgccaaacaaccgttaagtattttggctgctgaaggtcaatttaccaccatagacaggatacaaagggaaggcaatacaatactcacaatgcttgtcctgaaggccattttgtcacatatgtcctcccgccttacatgcaagatacgaaactggtgctgactttttatcaga

SEQ ID NO: 82996 - DNA, 39482 bp, Oryza sativa
gtgaaaagatcccctactggggcacggcaggcgaccccctgccggccagctgcaaaaaaaaaaaaaaaaggagcagtgaaaagatccctacggcaggcgaccccctgccgaaaagatgccctatagaggcacacagtcgggtctctcggtggaggcagcgctagacactagcgcttggctttttgaaatttgtaacattagatttatttttttcccctgttgaactcattgctactcactcatgggataattgaaccaattgcaaaatagttcgattacttcgtaacactcctccatatacaacatactccatgtgatagtatatagactgatcatccaataatttcagtaaatgtttgactgaaacctccaatattttcagccaattgtctgaagatgtgaatatcaagattccaaatgactagcgacaagatcatgtatgtgcagacgacccctgaggctgaaccaaactcatccaggcatggcatggggaaaaaacagaccatagctcatcccggcatgaacgaagaacccgacattttgcatattttttctgatgctctggattcatgtaagcactaatttctgatccctaacgtaaataatttgtcacagtttttgtttctgaaaatgatttttttcctaattttctcagagtgcaattagtcatgatgtcataatgcaggctaacgatggccagaagctgcacctagaagcagaagcttaacaggtggcacaaacggcagttgaagcttgactccaattagaagtcatgatagtttttctgttgctacttggactggaagagctggtgtgccagggcaccatcctctgtgttcttgaagtttaagtcaacacctcaataggcactggtttaatgagctcttctcagccatcacaaacttcgaatagcagggccaaagtctgacaaacttttagttaggatacctggaatgtgaggagctgcttcagatgcacttgaacttccctttgcaattcgctacaaagaaaaagataaagaggatctggaacatcagctcaacctgggactggcttccaatcacacaccaagttcatcatagaaaggccatgcatcaagctcttctactaggaacattattattcagtctcagtcctaattcgccaatgtgcaccttcagtcttgagccagctctgcaagcaataactgaacatttaaagaactgcattttgtgcagcgatatggtgcggtttcagaatctgttgaaggaaatagcagtgttgtaaagatgcacaaatggtgcaacatgggtgctcaaacctgactaccggtaattttagctgtagctgattggagcaatatttttgctaggtctggtgtactgcataatttagtttcattcagataggacatgcaaattgggaaagggaaaatgtctccaacatccttttgaaaccttttggtatggctgactgattcttttcgtaagaaagaaacaaattaaaaaagcagaaatttgtcaccagaagacattttttctcgatttttctagctgactcaaatgatcggtggcaagttttttttttccccaaaacaaattggtggggaggactgacaattttcgtccttccccaacttttcagtgttacatttgttttgaagcatgagctggtaatacttccttcacaattcgttgtttgtttcctcatttgtcagaatcagttccaagaaatttggtgcaaaatttcttatgagaactcagatggtattctgaaagaaagcatgggatgtgctcaaacagcaatatttactgatcatgcttaatttgtctttgctttgagtgaaatcactacttgactaagaccaacattttactttagaggttaaaattttgtcttgattgcccatgcagaaccttattattcagctttgacgtctcatttgctaatttcagccatttctacaattaatccctagttagctagatatgtcctccccatgtcttttaattttacagtttcctaatgctatatagcctctaccatcttgtctagcgccaattctgcagccaaactttgttctgcacttcaattagttgggcttaaattgctctcatattatgtaaatttgcaagcagttcttgttgagattgacgccattgcttccatgaataattcctctgatgtcataacttcacgtagtgctccctgtagtgtttatgggtctcatgtcactgcttttatgtagtggatcttttagttcccatacgctaatatgatgaggtttcctcctttgaacatcatatgctagatacagttaagacccttacagatagtaattttctatgccatctaacatttacctgtgttgctactagtctccctctggttttcttgtacaccaaagaaatgcttgtcatttacactaatgttgttgtcttattgacctcctatgttgcagttaatgtgtttatctgcaccttggacggcagaggggaacctctctatttagacctgaagagtcattgcaaagagtcattactggacagtcttatttggtagaaggagaatggcctcatgcaagaagagtgttctctttgttgtctctgaacctgcctgtctaggatgcccatcttggtacccagttggcaccttgcaaggacgttgcaatattgtttggaaaacaacctcatcattctcaaatattttgcaatgtagtgtatgcatgcagcaaggtatgccattctctacttctgttccatcttgtcttttcccttttccagagtaattaaatggagtagatagaacatcagattagatatttcagaagatttattcatgatgggcatccctaatatatcaaccggaatagatggttttatttatgactgggttattttttccattcatggttttttgaaattttatttgatgtataaacattactcatactatccttttcttttctctgttcagatggacacaacacaaatcgatgaaaccagcctcagtgagagtccgagctggccgagggtcagcctccaaattaaaaaaatatttttttcctggtctttggaatgccaagacgatggagatgcaggcaatcctgaccgttcattttttcacgtgtcagcacaggagccctctagattgggccggtgttttccgttaccagtgcctttcagctcatgggccacggccagcaattgttccaactgccacttttggggcccattccgttgggtgcgtgcccaaggtgatccggacatgtgggcccctctcgtggtagaaacccttgaacaaccgatcaagatcagctcaaaatcgaatcagcatgggaacaaaggaagagagatgcatggatgtagtttaatttgctcctaatcttatcttagccacgtagcatgtgtacggtttgatgtgtgtccacagatgggagaatttactaatcataaaacatgaagtggtaccgattgcctctataaaattatggggaaaattccaaatacctctaaaagtcactcatatttctaatctctccccgacaaattattttggtacaaaacactccacacaagttcattttctctttcaacttttcacctctatccagttttcagcaatttctcatgccttatgggtctcccattaagttgcctcttgacaccaaagctacttttcattttgtttttgcttttgcatgctttaatttcaccaaagatacggcgataaaacatgacaatgacctcaaattattagataaggcgtattaaatcttatgtccaataagagagaacatagggtcttaattcgctcaccatatgctagagaaatcgctaaggagtgcgatgagaatcactaaaaactagatagaggagggaagttacaaaactaatttgtaggggagattgaaaaggtgcgttatttggatttttccctaaagttattatcctaaacctcggcaataccttctgaaacaaaattttgaagtggaacaataaattagtattcctttgaaacacaagaacgtcttttcaaaaaaagaaagttcatggaaaattagttcaattcttgtaggaatcctacaaatatactctgttcaaaaagaggcttactcttataaaagaaactacatacttagcactgcatggaaatgtcacataattttacaattgacatcgaaattttaaaattatgccgcatcctaaaatcaaatcagcatggaaaaagagatcgatgcatgcatggatgtaattttgtgtgtaatcttatcttagagcatctctttaagagtatactaaaatttgacactagaaattcttgatttgggccatccttaaaagaattagaccaacaaatcaccctctccgccaacagtaatcctaaatttggttttaagtgagtcctcctttaaactgtttctgttttttttttccttgcgagggagagatcattgctaccaagcggatcgaacgatagtggctgaatcgacaccaggagtgccgatacgtgcccaatatttggctcggtaaggcatcgatgttaagcgtgagtacaaaattagagagcttatgggtattttattgaaggcctagattgtgacttaattcctaaagttaagctttaggagccatgtatacggccatacggaactcttggagttggagatgctctggtactagcacggtgtccacatgtagggcaagcttcacatttctatgtgaaagaggaggtgtactcaaaagtgataccttgctcgttaatataaaattatttttattcttataaaagagagcagtgatgatggtgagtgatgaatctgccatagcttgcaccaccaactccatactatttgaaaaagaaaaatgacaagtaggaccaaagggtccacgtgtcaaccacctccactatcaattcattacattttattaaaagaaaaaagaatagtctgagggtatgaaggatcacatgttagtaacaaatacatatatagagaaattaagaaatgatgtatgaaggaaatgatggtaataatgggttgataataatcttctttaattaaaatcccgttgcatcgtagggacaatatgaatatgctagtagtagaaaaaactaaaatctttttgcagtaatttgtagagttttcacgcaaatcagttaaactctctcatagaaaccctttccatagtagacttggttttttgacgaaactatacattcagtgatgcatatagaggttaagagtggtcttaaaataactgtgtattatcttgatgtaattatttaatactagtaaaaaatttcctttttctttcaaacaaaaaagttagtgctgcataggagtttaatgaattttcaaaagaaacaatctgagccatacagaaattgtaaaattatgccctacaattccaaaggacttgtgcctttttttcagctagtgtcctagtgtcgtacgtcctgccccacctgagtggaagcaagtgaaagtcgacgtggagaaacctatccaaacaattaggactatccatcattcaggatagccttccgatcgagcagcatcgagatggagatggagaggtgcacggcacaccaaacacatctttgctttgcttgcagctacagtactgctacatactgacagcgatcagcgatggcaattagcaggcactataatcacgaaatagtcgtgctagtttaatttggaggggggcctgtcatactgtacatgtataattaagccgtctccatccaaattgtatttatttattggaatttgttgctctcttaatcgaaagtttcagtttcacatttttgggatcgtcgagtccataagttggtttatcatttcctctaagattttagaaaaaaaattataatttatatttcttactcttttttttttgtcagatttcggtgatttgtttggagggactataagagcaagtttaatagtatagccaactaatagcttcaattcatctatagccaatctaatatcccatccatacaatagttatatactacactattaatatctggtcccacctgtcatacacacactgcgtcttagagtccgtactacagctggctacaaatctgtagtccgctgctctcctctctctttatttatctctttaaaatatgtttgcagctggcttatagcctgctattgtacctgctctaagggcttcatgcagcactgaggagaaaagaaattgttcggtgcttgatttgggtgatttattcggagaaaaagaaattgttcatggggccatgtctacgtgggtacacgcatgactccaggttatctggtcgtcacagttgatcgaatggtcatgatccggtggatccctcaacatgttggtacccatgctcttgtttggttaattgtgcattaagaggtacgatggactccctgcatctatgtgcattattgtcctccttaatgagacactagggccactgcacttttaattaatttttcaaattttatttgagtaagagaaagatcaaggtcaacaggaggaccctcttgcactgatattatgattttttccccctcataaacacgcatgcgttactcagccctacgaacacacatacgtccccttattcttatgagtagtgcattcgaaagattagaccgatataaataaatgagataaatctattttatactactgaatttgtctgaatttaataatttgccactgatattatttctttctataatataccagtgacttttttatcaattattctacgatacggtattgggttaggcctttttttcaaaaatacctaaaaatatccttatgcacacacaagatttacaatttaattatctcattagaagtctaaaaaatatgaaaatttttatatggccttcttatacaacatgtaagttcgtatataagtttttaagtttttgcatttcttttcttttttttactccctccattccaaaatataaggcacaaccaccctaagcccaaagattaagaaataattattatcacctcatagtttagattaatcaaataaatgtaatgcatgcacccaataaaattagagatcttgatagtggataatttaaataataatattttagtggagaatatgtgttaattaatggcatgcatgtatgtatgccttatattatggaacatctctaaaaagtagttgtgccttatattatggaataaagggagtaaaatataacatggaggttgagagttcgaatcattcaaagctcactctttcggatctattttttctctctttttgcagtgcttgtccactcttttacttcttctttttcagttttgtgtggcttttttttctttaattcttgtaataatcctaggtataacatgaattttttttcttaatatatcgtgcaaatattttttttccactagttacatgttgaaaactcaactatttagtaggaattatttggccccctcttgaaattggctcaagctctgcaaccgcgagcatacatgtcaaatctaatctatcacaagaacaaccacgtggaaaaattaggatggaatcacccttgtaaagtgtatagaaaatacaactgagagtgggcatcaattccatctgaattggaagaggcattgatgaacaaactaaagcacatctgcatgattgtgaattcttttctttaagaaacagggtaatatataaagcagatttgtataattgtagaacaaaataaagctaaaactattttatctggactttaaaaccagccagaaataagagatatatatggtttaccccatggataacctcggcaaaataattgctgattccttgtcgtccaaaaaaagaggggtcgttttagatgattatccaaaatttgtaatgcaaaatcttgaggacatatacagactctaattgtaatacacatggaaataatgggaatcatatattagttatacatcgatatggttgggctctgtggttgtgtaggaatgatatgatttttgacaaatcaccatatgctacatatatgcaggtaattttcagggcaacctattggcttccgttttgggcacaactataaaggtgtgatgaagacggtgagcttttaaaagctgcatgtcgtaagcttgagacgacggttatgcagctttttgccaatcatggatgaaaattcacaaatagacttcaataatgtgttctcccgatattgttttggttaaatttacctttgtgtggtcatttcttctatcatttctgaactacactcgttttagagtgctagattgtaataatagactgtagctctctttgagcaaaggccgagatgactatttcattatctaaaaaaagttatacagcgatatacatatattgcaagacaaatccaacattattactccggggtggccagagtatataactttgcatagatgtacttgattcctccctcccctcccacaaacacttgtttccttgcaattatatatccgacaaattagtagtgggaagaaatatgattatggtgtttctcattaatactctttgttgtatttttcgtgttcccatcagatacatgtcttggaccccgtttgatagtgagtttagagtgtcaactttatcctttcttgttagcactttctaaattattaaaacgtatgttttcggtaaaaaatatatatatataaggtttcgtttaaaaaattaaataaacccatttttcatgtttataatacttaataaattatacgctaatggtttgtgttattttacgtacggcgaaaaatccttgcttaacctcggtaccaaacttagcctgctctgttcgctgctggaggttcccaactaggaacagtgcgcacggaaagcagagcggtccattagcgcgtgattaattaagtattagccaatttttttaataaaatggatcaatatgattttttaaacaacttttgtataaaaacttttaaaaaaaacaccgtttagcagtttgggaagcgtatgcgtggaaaacgaggcgaagggagttgggaacgagcacttacgaacagagccttagagtaggtacaatagcaggctataagccagctgcaaatatattttaatgagataaataagaagagagaagagcaacgagctatagatttgtagctagctgtagcacggactccaagacgcagtgtgcgtatgacaggtaggaccaggtattaatagtatagtatgtactattgtataaatgagctattagattggctatagatgaattggagctagtagttggctatactattaaactgctcttagtctgagtggttataacccttagaaatcaagttttggccggataaattttggacactacaaatcaagactttgcgagatatttaaccatttgccacatttagatgtggcaattaactttttgccaatggacccacatgtcatagacacatgtggacccacatgtcattgagatagggatggcaaatagttatttgccaaatctaaaagtggcaaatagttaaaagccccagactttgcagcttccatcaagtattatattagtggtcaaagaatgaaaaggttgacagaacattcatttgtgacggtgcatagagtataaattaaggtcgttggaatgttccatgcatcttcaaaactaacctggacaacagctgcaaagatgacccatgtgctaaccaatttggcagtaatgtgcactatacatatacttctcgtataggtttgaatgcagtacttgtttgcctatccaaaaagcgattagtgcaggagttgtgctgtagattgatctttatggacatatacgcacatacagcatggagctagctttgctaatagcaaggcaatcaggcattatggaagaagcccaatgattaggcacaaaaatctctgattgaatgatcttcctggtggcacgcagtagacagagtacatgtacacacatgcataatgcagggttgttatgttggagcttagctttggtgctgtccatttaattatttgctgttagttggtgatgatctcgcgatcgagagctacatgggaaagtggttgcgatatgatgcatacacatatcgctagcttagctcgtttttccttttatatgaaactgatgaaacatgaagattaagttgatgcacataaaacgagaaaacctttaacacatagttaatgagtttttaattattataaacttgataaatatatatatttaatattttaaaggaacatctatataaaatgtttaaaaaaacgtactaaaagctagctgctcccttttggccgaatttagcctgttaatttgcagtctgcgctggaaattaaaccgcgggcaatgatacatgtgcggtgtgcattgatatgatgatgcagctagctagcccgtctctcgcttttgattttgcagtggaaaatcggttaggtacacgacgcggtgccggtgcgcgcgcgcgcgcgcgttttcaacgggctcaccagcaaccgtagccgcgcgcgcgcgagagagagaccacgggagggagacagtgcggcggcgacgcgcgtacgcgtacagcagcaacagcatggcacacgtacaggctgtttcctcgctgcgctgcatacaccgcgccgcgccgcgccgcgtccaccggcgcgcggagcgtatgcatgttccggggacaacgcgtcccacacagcacatgggctcgatcgctctaagctgcagtacaccgcatatctgtatgcgccgtcaagaacctgaacctgatgcgtatatactgtccttcccttttcaaaattggaagcaaaacatgcacaaattaacaatgtgatgcatggctagctagacaatggctgagtttagatccaaagtttggatccaaacttcagtacttttccatcacatcaacctgtcatacacacccaacttttcagtcacatcatctctaattttaatcaaaatccaaactttggatccaactaaacacagccaatgtgtgcatgacgaacataggctcgatcgggcattgatttctctcaccacagacatatcgggcaatcgaaaagtgatcaatggctatagccttccgcccttcccggacgcacacgtataccgaaccaaactgggggacggttggtaggtcaacaccagcagacggcctgacggacatgcacagaaacccggcctctcagtctcaggatgtgcgtgtcgcaccaaccaaacctcgcgagaatcacatgcattttcgcaattgggcgcggtgaagtgtgcacgggcaaccggctgatctgccgaaaaattccatttgccaaacaaacctgtcacagacagcactagacagtagtaacgtctggaacaagggacaggtatacccaatgccatatggagaacccgtgaacgtcggctggtctcttcctggagcccgtgcctgtcacggggggcccagctagctagtgctatccattcccatacatgctgccacatgtactgtgttctcttttcatgggcgtcgtgcatgatgaaatcatgcgtatcccactgcacgcggtcctgcgccaccaccaagttctgatcaggaattaagccgatcatgcttgatttagtggatgattaaaatgtactactcccaccgtcctaaaatgtagctatttctagcacagtgtcttgtcctaaaataaagttatttcttcacctacctcctcctctcaaccaatcacgaccattcttcttcacctactttctcttttcaaccaatcacacacttcctccaattattctcacctactttcttaatacctatgccaacctcaaaaatagctttattttgggacggaggaagtacaagcttaattttattgaaagaaaagaaaatggtgggtgtacatgtagctgcgcgccaggtgtttctcccccctttcttttttcataaaagttgtttttctttttaggtgctaagcgatttcattcaagaagagaaacgttcaggggttttccggctagcttcacaaggtggtgggctacacgacctggattcgaaacttctaattatttgatactaggtcattccttaatatttgcgtatttttttatttcattcaaggaaagaagagtgattttacagttgtttatgagcttccatattttttagcgtaaaatttagatttttcagtatcttcaatactagaaggtatgaaaatttgcattaaaaattttagtacctccagatattagaaggtacgtaaatttccactaaaaattttagtgtctcttaagtacttaaaaatttctcaaggaacaaagatcatattaacccccatttgaatttttgcttcaaatactttcatattcaacacccgaactcttttgatcggatgaattacaacttgattcgaatttaggacagttttaatccaacgtgatgcatatgtgtaatgggccttccagctaggcatccgcgtgctacttcctcctcctcctcgtctactcgattccctcctttctcctatatatgtttccggtgccaagatactggtctattcaaggctacaacccaatttgcagcatgtgaagtcgcctcgtccactgcagaagaagagggctagggagcagtggtgatggcagccatagagcagcgatggttaaatcgtggaggctgtcccttttctttgacaagtggtgcatggcctgatgcaactatattttgtgagtttttgaatcgaagagagtggtctgaaactctgaatggagcagcccgtggacaaagaggtcttacatagtgaacatttttacgcgtgttcctcggtgaataaattaaacaaagacgaacacttagatggactgactatgtaaattaggttaattaattacaaaaggtgcaccacttaagcacccctcatatgaaaacaaactatttacaatgtacatgtcgaccacttaagtcacttgtttacgaaaatgtgttttctcatatggttcatcttatatgccgttgtttcgctttatgattcgcctatatgggtatcttcaaaatgaatattttaagtagcgatagtcgattgtaattaaaagcgttgcttgttcgagtactagctagtggtaactaaggccaaagaaactcgatcaagctgaagttctttatgttttcaaagagaagatcgataaagaaaaaaaaaacagcaagtaaaggttagctccaaactgtgcactgcattgcccactggcgcatgcatgggaaggcacaccgctactaatatgatgatacctaggctgcatcatgttgaattttttttttgcaagacatctagttgctggattttgaggagtacggttgtgttcgcttttgctgaagataaagacaaacttatgatacgtaaaaatagaaaaacattatgatatgattgattgagttttaattattataattaaacatgagagaaaaatatatattattttaaagaaactttcatatataaagttttcttatgaagtacatcgtagataaaatttgtagcttaatcataaataaagggaccaagcacactacatgatagatttttctggacaccgcccccttttgttttcaagtggtcgtaagtggaaccgtacggaaaaataaggggagcggtgcggggctgtcgcccgcatgggaaaatcgattttcccgtgcgagcctcctaatccgaccgcatgggataatcatcattatcccgtgtggttgatttaagtggatcgcacggaaaaatcgattttcccgtgcggcctttttaagtgaaccgcacaggaaaatacctccctcttttccctcccatccacttcaaatttttcacatcctctctcttactttttttcttttattctccctcaactaccccccctctctctctaccttatctcttcccctcagtcaactccctccacaccttccactcctccccccttccctctgtcaggctggcaaggcggcgagccgggcgcggcgacggccgggcgaggcggcgggccggcgcggtggcgagccgggcgcggcggctagcgggagaggcggcgagcagggcgcggtgatcaccgagctggcgagtcagcgagccaggcgcggcgacggtcgggcgcaccggcggacctcctcatggtgatcgtccacgtcgtgcacgtcgaccgctgcctcccttcctatgcagcgacgagcaggtggggccccgcccagatctggcgggcaacggctattttcatgttttttttggttgttttttttcgtgcgggtggcataagacaaccgtacgggataatcaattatcccgtgcggtcgtcgggtcgcccgtatgtgaaaatgccgattttcctagacgccgggctacagttgggccggacaaccgtataaaacgtccgcataggaaaataggtattgtagtagtgaagtacgcacctctctaatgatctaatcctgtggtagctacacaacagatgttgcggtgtgtcgatcgcggctggcgatcgacttggtaacctcccctgcaggggcatgcagagccgggcacacatgtatacacaaccgcatacatgcacgtacgattgacgctgaggcatattatcggcgacaccctagctaccgccatgcatccatatcacgcatatatattgatcgactacgtatgcatagctaattaatagctagtctcgtcgccggcaaccgaactcatcatcacatcatatcgtcagctcagctgcgtatacatacgtacacgtacatctcatgacctattgatcgatcgagcgtagtagtacgtaggctgctacacactcctgctcctgcttgtacatatgcgtgtgtaccgtgtacgcggttgttgggtcaaaagccaagagcgacggcgcaacggcgaatcggcgatcctgcagccggcccgactggagtgctgatcagcttgtacatgatgtgtgcatgccggccgccgatcgatcgagggcaacgcgcaaaccaccacaggtcgacgcatccatatatatccatttgcacgcatgcacgcatgcacatgttcccatctgcctatatgtccatgcaaaaacttggacctcatcatatcgaagatcatatacagtcgtaaatctgaaatgctcattttctttttttgaccgtttgggaatagaaaacagggacatatcccgcgaaatccatcaaatgaaaaaaaattaactcgtaaaaaccagatctaaaattcactaaatttatgagaaaattactgcaaacagatttaggcataaactacattctcaccaaatctcagatgcaataacttacttgaaagtaaaatataaaaaaaatgagtgaatagtactatatgttcacgtaaaatttgtctttttaatttctgtaaaatgaagctgattttagatttgagatttggtatggatgaatttcatgcctatatctatctctagtaattttttttataatttttttatgaatttttagaaaactttcagacatggtttttcatggttttttaattatttaatggttttcacttgataattccccccccccccccagaaaacagtgatgtggtggtagaattataggtgcatcactccacccaccagggttcaaatcctgatgcccacgaatagctttcaaacggattttagtggagattaaggatgtgccactgatttccatctcttagatcatgtactagaagacacattcgtagaaatatgagtgtgttgttgcatgtatagtggtgtgtgtatgtgtgggtgtgcgtatgcgtctaccgtgtaattaaaaaaaaagaagaaaacagtcatttattagactctggcattcaatttagactctgcgataaaatatggatggatcagattgtgtgcaactgcgtgcattggatcttgattcgtgaaattgacactgcatgccctcacatttatgttgtcaaaacatatccaccttccgatggaatcgttcctagctatcgcggccgggctgttaatttagactgatcgacatcgatagactccaatctgaagctaaccacacacccaccagctaattaatccagattcgcctcctgattaatcaatcgatcgctcatcgatcctctcatggtcatgggcggcctgaccggtttgatttgatccctgaagcagaaagcctaaccaattactacaccacgtaggagtactcaccaactaacaccaataattagcacccaattagtaatcgtcccttcttttcacaaaactttattattgtagcacttacatttttatcaaaatactccctccgttccaaattaatttacatatagtttttttaagtttttcctaaatgatctacatatttgtgttcattcattagatctatttgttatttgtgcgttggagtaaatggatattgatgtatgcatccatgcacacaagcatttataactcacatacaatatcttgatttgctattggctagaaaatagtggggatggtgcatacattgagtttgttgctagagtaaatatagtatgagggcattcccaacccaatgactaggatggtgtccatagcattaaataagttgccacctaggaaaaaaaatgatgtggcaagtgaataaatgaggaaaaagaagaaaaccatgtcttgcatgagacatggtttctacacaacatccaagacattatgtgagataagtagcgttaaattgaagtatggaatagtggtgtttgcattggaagagtagtgtctagtactagtttcttgatgatgtggagtttatggaaaccatgtctagtgttatgggttgggactgccctgagagagttactccatccgtttcaaaatatagggcgcaactactttttaaaggtgtttcataatataaagcgtgcatgcattcatgacaattaataagcatctcttctctcctaaattattattttttaaatcatacactcataagatgtttaattctattgggtgcatgtattgtattggttggattgattcaaacaaagaagtgataataattgtttcttggtctttgggttaagagtggttgtgccttatattttagaatggatggagtattagcttttcttggtcttggtgtacctatgaaatatgtagatcaatttgatctaattttagagttgacattatacttttacccttcatcaataatgcagccatgcacaattgatattagacgttgagttgttaattaataaggggtgtgtttagtttcacgccaaaattagaagtttgttgaaattggaatgatgtgacggaaaagttggaagtttgtgtgtgtagagaagttttaatgtaatggataagttgaaagtttgaagaaaaattttggaactaaactcggccaatagttgatgatgttttaggaaataattggaatgcagttaaggaggataataacgatataattttgctcatctttttatttggtgtaaaatttcctaaaatgataaatgataatctaaaacggagggagtagtagctagcttgagaccactattttcttcaattagttaagtgaaaaatgcacatatgcacacgcatacacctatgattgtgtcctaatacatcttaaaattttgagaaatttcatggtcgttaagaaagtttgttgaggtagttaaattttacactaagatttttttttacctcaagatactacctaattatagctggaggtactaagttttacacttgaaaaatgtggtacatcttagtaccttttcaaggatataaaactaccctaaaattaaaaaaaaaaggtgtacatgagtaaatatccaaaatcactaattagattcaaatggaaagtgtcacctcatgtttgtaatatttaattatgagcgtcaggacttaaaccgaccattctaaattacagccagtaccatgctctttacttgtagctagtaaaaaataattaatcaggcgtttcccttcttttgcacttgaagtgtcctcatcttggctagcgaatccaaattatcaattcgcactgtacatatatatccccgcgattgctaccttgtaattgcacccctgtcctttgttaactattaacacttcgggctagtacattaatcagttgttagtacatcaattaagctaaaagctagctcttcgtagattataatatatattttgagccataaatgcagattttagctaggctttatttttaaatttgactcccttgcttaaaccacacacaatatctagtgccatctggctacgtagccaacaacgaacttgtttagtaaagcgccgcgtcccaaaatatgccggattattattatatatatatattgcaaaaagtagctaacctgatctgtgtcggcgactgtaacgcgtcaccaatagatttatttaagatcgtaatttggggcccagaaattacagtcaaaagtgtctgaagccactgtcagtagtggacactgatgccaagctagcatgcatgggagccgtagataagtgtacactagatttatttttaatcaaattaacattttaagtttaagcttgtatagttatctctaaccagctggctaattacaaaagtagtgcatttaagacactccagttcagcttttgttgttgtcacttttttttcttaaggagagtgtataagaataatattagggtgcgtgcgtagtgttgtatgttgagtgtatcccttttattcttaagaaatcctttcttgtgaagctaaaaatatcatcatgcaaatttctattcattatcttaaaaaagctacaagtaattattgcttaagtttgttttcagttcttgtttcccctacttgtgtccaaggtgctttatcttattcatagtataaattgtttatctcaatcttcatttaaacttgaattatttttattacgaatatgttgtaattaatccagatgtatagttccaatacttaaactgatggatttggatttaattagcaccaacccattgaactgaactgatgaatttggactaattggcaccaaccaaacgaactgatgaatttggatcaatcggcaccaaccagatgactcaaaaggtccagcatgtatacacctaaccaatgaaacagtttctcaaaaaaaaaagtacacattttggaagttgttaatttacccccagtatgtgtcggcactcggctgcaatcatacaagtcaccaagagattctccgatcctaattttggaaccaaatttgtgttcttcattgaggttctaacctcacctctctcgttttccgtatacacgtctgctaaactattgaacggtgtggttttttaaaaaaagttttttatacaaaagttagtgtaaaagatcatattaatttatttttaaatcttttaagctactgcttaattaatcatgtgttaattcgtcactccattttgcatgtgaacgaaggtgttcccaaccccctccagaagaacacagagcaactcaaactgactgactctgctcttccttcttttctttctttcttttttttccctttctttttgcagagcaccggtactctgccttttgggacacgtagcgaaacttcccaacattagcgctaatcatctttatttatttgctaattatcattgttaacgtagtagattagccacagcccacaagccttcgtccccacccgacagcgacgtcaccaaaccgcgccaccaccaccaccacccgccgccggagcagcgcctcctcctcctcctcgcgccagtataaatccggcctccccctcgccgtgccactcactcatccaccacccaaagacaaagcaagcaagtacagtagccatggcgaagcatctcgcgctgtccgtggccgccgcggtggccgtgtcgtggctggcggcgtcgtcggcggcggcggcggggttctacgagaagttcgacgtggtgggcgccggcgaccacgtgagggtggtgagcgacgacgggaagacgcagcaggtggcgctgacgctggaccggagctccgggtccgggttcacctccaaggacacctacctgttcggcgagttcagcgtccagatgaagctcgtcggcggcaactccgccggcaccgtcacctccttctacctctcctccggcgagggcgacggccacgacgagatcgacatcgagttcatgggcaacctcagcggcaacccctacgtcatgaacaccaacgtctgggctaatggcgacggcaagaaggagcaccagttctacctctggttcgaccccaccgccgacttccacacctacaagatcatctggaatccccaaaacatcatgtacgcatcacaaaaacgaactcaataatcctctcttcgtcaatcaaacaatcatcgtgttaatttgctgaattacgattacttccgctatgatacagattccaggtggacgacgtgccggtgaggacgttcaagaagtacgacgacctggcgtacccgcagagcaagccgatgaggctgcacgcgacgctgtgggacggcagctactgggcgacgaggcacggcgacgtcaagatcgactggagcggcgcgccgttcgtggtgtcgtaccgcgggtacagcaccaacgcgtgcgtcaacaacaatcccgccggcgggtggtcgtcgtcgtggtgccccgagggcacgtcggcgtggatccaccgcgagctcgacggcgccgagctcggcaccgtcgcgtgggccgagcgcaactacatgtcctacaactactgcgccgacggctggcgcttcccccagggcttccccgccgagtgctaccgcaagtgattttgaactcgatcgattcaaatcctcctccattgatgagttcttggcaatgatttgtaattgcttcttgttcttgttttcgtcttcgtcttcgtcttcttcttcttgatccatgtacattttgccatccattcgttctccatttgttacagttacagagacaggttgatggtgaattactattgccgccaatttttttcttcttcttgttactcgatccaattattactactagagttcatcttgcacagttgggcggtgtgaaaaactgaaaaagaaaagggtgtcaaatttgttgctgatgctgagcaagtgagcacatgcttatgctctcaggtatgaacaaaataaacagtaaaattatctgcagctgtttgacccgtttcggattccgcacgctacatgttcgtccgtttgacgcggtttggtaggatgctttgattattaactcgatgattagcacaagatgattaatttagttagtgatgaatctaacgcccaacggcgaggtttggatgtggtgcagactgcagtgcagggaagcagacaagcgggtgacaactgtgtgcttcgctgttcttgggtatcagatttcagtcgtacacgctgaatttattgagcacaacagctcagcctcagctggtaactatccgccatgttcttattggcgtacgcgttggttggttgctgcacgcccaatccaatgatgctgtcaactactggcgtctcactgtaattaagtataggagagtaagttggtaaaagtaaaatcttgcggttaatctacaagtactaccctgataaggaatttgaaatttgaatgaaattgtcccccctggctggacggcgagaacggaatactctgctaagtaaatgcaggatgtttttttttaaaaaatctctgttagaattcgtaccaaaacagtgcccaaattcttgcaagttcagtccagttggcctctcatcactaggagtactaaacagaaacttttttccgataatgaaattttatccgacagtgcaaactcttcatcacttggagtgaacttcttttatatgagcggctcaggttcttcatcaggactgaacttttaccgataatgaaatttaatccgattgttcaggccctttgtcacttgaatagttgaacttagtgaatgtctactactactaaccgataatgtcaaatcatgtcaactatcactccactttttgcccttcttttccacttcaaatggtacaaaaaaaccatccgaagaaatgccactggctgaaagcaacagccactagtttctacagcatcactagccatggcctccagttgacaaaaacccttttattcctgcactgaagcacaatgccaaatcttcaatgatgaaagccagggattacgatcaatcttgtgctgaataaagctgctgagtattttgtgctggtggtggtggacatgaagtagaagaggcaagaacaatgaataatggctgctgctacttcttccactagctgtactgcttttcagctcagcaaattccagaattgcttgtccgggatggccttgtgggacaggaactgggaataaaggttgcctgccacttcgggggtttggcctacacaactcaacatgtttaacacggttgtgatgatgtgattctaatggcctaattggtagtactaatggtgcttggaagttggaatcgaccttttgtggggtcattttgttggataactaataaagtgttcttcttagaggaaaaaaaggggaaaaaaaaagaaaaacaagaggaggataagtgttgctatggaatgaagcaagaggatgaatatagtactccatccgttccaaaatataaggcacaaccaccctcaacccaaaaaccaagaaaccattattatcatctcctagtttggatcaccctaataaatataatgcatgcaaacagtagaattagagatcttgagagtggaggatttaaaaaagtgataatttaatggagaagatgtcctagttaagtgtatgcatgcattcatgccttatattatgtaacatcaaaaaaaagtagttgtgacttatattatgtaacggagagagtactagtacgtccaaataatttggaatctcatgctaagccttttaactcatgcacttcaattcttttccctgcacagaaaagaagccagtgtatgtgttttaagatctctccttcttcttcttcttttttttcatattttcgttttttgaagcaaatattcttatacggtagatgaaagaagaaccacttacccaaaagataatggctcaaaaatatattttgcataaacgtacaaagatgattcacatacacaaatcaacaagtgtatgtgtatgtctatgttctagtacacatacaaaatatattttgcataaacgtacaaaagatgattcgtatacacaaatcaacaagtgtaagtgtatgttcttcttagactctaagacttagagagaaaaatggaaaaaaaagaaaaaagaaaaacaagaggaggataagtgttgctatggaatgaagcaagaggatgaatgatagtactagtaggtcaaaataatttggaatctcatgctaagccttttaactcatgcacttcaattcttattccctgcacagaaaagaagccagtgtatgtgttttaagatctctccttcttctttttttttcatatttttgttttttgaagcaaatattcttatgcggcagatgaaaaaagaaccacttacccaaaagataatggctataaaatatattttgcacaaacgtacaaaaaatgatgcacatacacaaatcaacaacacagaatattctatgtggaatatgagagactatactttgagaacaactaaaacatgcaaaaatcttaaaacatatagacaaatttctgtactgtgcaaggaagctatacaaattttcttcacacttatagaaaagcagtaaaagagaaaattagttgtcgaacccttctgctgtagcagtatgttggttttttttttaaaaaaaagaaaatagattatccaataacacaggacagactcggtcatgtatctgttggaattaatagaggggccttagcccattcaaagattaattatttgaaaaatcacaaaagcccacctcatgaaatagcattaatggggagtttaataccaccttacttattctaggagaaggagacctccttacaagggaggatgctctcctagcaacttgaagcatgtgaggtggagagaagagggggaacacgcgcgcgctcgctcgcctggcatggcatggcggcgcgcgtgcacgacgtacgcgtcgaatggtccgccaaaattgcccttgcgcaaatgcagcctctttttgcagttttgttttgctgcaggaaattcggatttgtttgttttggaaacactccgaatactccagtgcgtgaaacggcgctccttttgcagttttgttttgctgcgggaaattcggatttgtttgttttggaaacactccgaatactccggtgcgtgaaacggcgtgaagtccggataagttacgcgcgacttatccggttcggttacgcggagcagagatcgtataggtgtcctgatatctcccgctgtctccatgcaacacacgcgaaatcaatatagggtttgcctcttcctctgtattgcaccgtcactcgtagtctactccatcccgctcgtcggcatgcaccggcgatcgggagagtagatctccggaaccttcaccttcgatgtcctgcattgggagaaggcggcaataaggtttttgggaagcgctttgcgcgaccgctctctattcgaccacaacggctcgtcttcctctttgcacgcgtgctacgcgccgtcatcaatgtccgcaaccacgagtacttcctactgagcaaccggtcttctggtacccttggtacgtgttcagtatgttgcgcatatttgatctgttaatgctttactgtctaatatacatgtgtagatctcatgatgcgtttatactagtttacatatgcaattttatgatttatttatgaaataaattaaatcattatgtgcttataaattcaacagtatggttcgacaagtggtattagcaaatgtgtgtgtgatgtgtgtgtagtggacgtgtgtaataaataaacactagtaatatgcccgtgctaacgctacgatgatatttaacaatgtattgtaacgcattttcaagaaaattgttatttgacaaatgaaaaatattgtcatactataattttcaaaataattatatacttagattcttatctccatatactgaatgtcaaccgacaagacattatctgtttaaaatgtaatcccaaacgatcacaattaagaaatcacatctcattttttttcagccagcaaacattgcccctatcaataaattgcatgatccacactttttatcagtaaaatcaaatacagaaatcacaaatgccagcctaggataccctgatacggatacgctccgatacatatcccgtacgtagcctctattttcccgattttcagaaaaaagaaataattagggatacttctctgatacgcacggatacaggatacagtacgatctaatcctagcttctcatgggataccaatcctcgctgcgtccatctttttctacccaacggcgccgtcgttctgaagctaggcaaaggtagagccaccactccgcaacgcggggcctactaccgctgccgcacgccgccgagcgcagcatcgtcgccatgccccgtggagccaccgccgcacgccgcacgccgcacgccccctagcttagcgcgcgcagcaccaccgctgctccgggtcagggattgcttcattcaagtgaggtctcgcgtattgatggttcagtgcatcctggatcttgatgttgtgattttggacaccgcaaagtagactacaaagccataagtgacttttgaagatccagtactactgcagtactgttggtctggtcaaagctatacgtgcgtatgagagagagagaggggaagagtgagacagagaagaggaatagtggaagagaatatgacatgtgggtcccacttttttttttataattagaatgctgacaagactgccacgtgtacgccacgtagaccaaaaccaccgtggattggatcgaggggggtaattcatccggtttgcatagttgggggtgaagaatgtccggttttgtggtttaggggggtaattcggacgaccgcgatagttcggggggctaattcgtactttttcctcaattatttgcatgttcattattttggcctcaatcaattctcccattttctttgaggagtgcattatttttcttaatttattatgtatatatagacgtatcctcgtatccatgtttttcaaaataagccgtatcccggtatccccgtatcgcgtatccgtatcctcgtatcggggtaacatagatgccagcaacacttctgcaggaagacaagagcatgtgcaaccagttccattggcaatggaaaagaagcttcttgtctgtatcagaagatcattttgttttagcaagaagaaacttgttgatcatcaaggactttagtattaactagtgagcgtgcacgtgcaaggcacgtttttcaccatttatgatcttttgaagctgaagttatcaattgtgtaaaattagaatcttaagatccatctaacatatgttgtttgttcccatctaaaatgttaatgtaaaaaatagaatgtgtcatttccatctcaatttcaaaatagaaaatataaaataaatactgagctctttttacactttcatagaaatagaataatttgtagaagtatctttctttccatttccgtttactgtccaacattttcacatattgatgaatcattgaatgataaccggaaaccagttcattattgaaaggctaaacttcattatagtagctacaatagcagactataagtcagctataaacatattttaagcaggtaaaagaggagagataaaagcagcaggctacaatgaaaggctaaacttcacgtcattagagtagctacaatagcgggctacaatgaaagactaaactttattagagtagctacaatagcagactataagtcagctataaacatattttaagtagataaaagaggagagataaaaacacatctctcctcttttatctgcttaaaatatgtttatagctgacttaattgaatgtttcaataattgaatgtttatagctggcattaattgaatgtttcatgaacataaatctaacattattcattaataattcgttccattgtcaatgacataaaagatatgatattcatagaattttggctccgttggaaaataataaacattatttctttagttaaccaaacatagttagcacacaacatgtcaattatcaccactaatggtttgttcctatgaaaaaaattgagagttagatatctttttgactggcggaagagtaccggcaattctttagttttcccgacagacaatgaattactggcagacaaactattcctggcaaaagatattagtcctggcagattgtctccctgtttagcatgcaattagacactaagaaccagctttttaaaaaaaaacaaaatataatatgttgcatcgaatgtaccattgccaagtgcaccaattaaattaatgatcatgaaacaaatacatcttttttacacaattaatttactgttgatgactttatccttcacaaaatgcatctgattacaatctaagaaatacaggtcagatgcccgcaccacaaacacccaatctagtctagagtggcacctgcaaacacaaaatagctacttttgatggctttgcatgtacaaaagacgatttaccatccttccagtagatttctccatccaaagcaagctattctacatgcagttcttcaacaaaatgtgaaacattgccagaattggttcagctatcagccacatcccacctagaaaagatgttatacataataagcacaagaggaatgttgcatgatcattttgtaatactgaaagtaatgcaactatgcataaggaaaaggggatttttttttgaacagtgtagctttcttgtggtttgcagctcaaagataattgcaatagtagcattgatcagatagctaaagttgcacatcagatagcccttacaatatgctaaagttgttacctaaaggtaataagtaccgtatgaaaatcctagatggtcaccacacatgcattctaaaactattggctatattaccatcatttagagtacatattatatcaggtagggatctgattgttagaagtcaaaactcaagcataattcttagcattttttttattatggcatctttataggttgcttgttgttagggagatatataacaagccaatcctgggagaatgatgtggaagtatgctaggcaaatttcagagatatgtgcatagctaactcagattctgtaatcaccatgcaggccttgatggtaaaaattgcaaccaaccgaaatgctagtgttatatatctgatcaaaccgaaatacaaccacacatgcaaccaaattgcacgcaagttactataacagaacttgtattacctgtacaagttactatatatggcactgacaagttcaaggggctttatggcactggcctgaaaatagaagggggttactggattgataattatgtaaaaattacaaaccttaatacaaagtaaggagcttattagttggaatacacataaggcttccataagctgacctgaaaatctgccaatgccagattaatgatgttcagtgcagtttatagctagcttgcatgctggaaaattaaatatcccagatgcatgttttcgtgattgaacctgaaataaaacattgtagaatggttatccacggctagcatcacaattaggatatgtatgtatatatggcaggacatacaaaggagcacatgttcacaaaaaaaatcccattatacttagtcctgtgtttaattatcgaattgagagggaaatcaactgtctttaaccacaatatcaaaaaatttagtcaagcatcaccaacttatcattgtcaaatctcaaagcagatccattcatcaggattatttgcaaattaacaaactaataacgaccccctactccctctaccccatcaaggtattatctccatgtaagttacctgacctagcatccatagttataataaagtttcataaatgtctccatatttctgttaaatatctcagattttacagctaagaacacgtacagatgttcttttcagaatacctcaggatcttaagctaggcacaaacaaaagttttatcacccataatttttagaaatgcgttatcacccacattttttagaaatgtgaaaagaagtgcttaaacaaaaaaagtaagcacacagactatagctaatggtttgctgcatggatccactcaatccgttgcaaaattgcttatacccaaaattctcatattatacctcttatgaaactgaggaaaagaaagaagaaaaagaaaggaagatagaaaaaaatgcagagctactaaaagcatttcatctttatctttacagagaaaggaagatagaaaaaaaaatacagagctactaaaagctaaataaatagtttattggataaaatgagaagataacttgcaagctctgcaccacctttcaaacatattcacatgctttattgaaaatactgacatatacttattttaggtatatggcctccctcaagtacgaacatattgaaaccattgcttgctaactgtagttatgaataagaagctaaaaaacctgtggtcagcaggttgacaaatgtatataaatttagtcatgggatgcaatatactcccactctggtgagcatgcatgcccatagaaaaatccagaaaatagtatgcagcctgttgttttatctgaaacatgatgaaaaaataaatacaaaaatgacttgtaaatatcaatgtgcgcatacccaaaggtactcttatacaaaatatattgtaggcgcaatcacatcgaaataaaatgaagctcttacctggaaattatggcttcaatttgcttcttgaattagttggccatctcaagaaaattgctggaaacaatccattgtatcaatacatcacctatctgttagcatgaccctgattcagaattatataattgagctgctcataaaattgcaagctaaaccaccagttaaggttgattcaggtgtaaacaggattcagatttgtttaaatgcataatttgcacttttgttcgaaaacatttacaccgtaacatggttatgccatgcaagtcaatcaccttctcctcaaacacattgtgtttcaccattagcggtggtgcagttgctccatctctctccatagatccacctggaacaacccacagaaatcaagatcagggcaccaccacagaatcatgagttcatatgacgggaagaaattacagaaaaaaatttgaggatattacatggaagagaaagcgactgaattttcctgtcaagaaaaactcctaccagcttaactgcgccacttttctgttatctgagcaaacgcgatggaagacccttctattccgctgaagctagatattccaccaggttgtgatctctttctctctttctttcaatctttggcttgatacgagcgaaaacaaagacaccaatcagacatatattatactcgtattgcataggggataaaaccaaacttctgcaggcacaaatttactcccaaacattgacagtgaaatagcaatcttttactaaatttactcccaaacattgtgatttcatagggtccattgcacgcacatggtaatctgtgcagccactatcgatctattaaaaaaaatcctaagttaattttaatttttgagaggcaccaaacatagagaataacttgggaggagaaggtaattggctatggaacagaggaattccacttaccgctacttcatcgtcaaattccggtcgctggccttcgtcagccattaaaatctttgccttttcgcccacagttgtccggatggaactcaacatagattcacatttgtcttacacaggagcagcaagggagacgtgatccggatgagtttgcggagggggcagaggagtcgcggcggacacaagatgtcgagggatcgacggcggccggactgcgggtaatcgacggcgaggtgtggtggagacgcgagggcgatgcggctcgatggagaccagacggcgacggatcgacggcgcccagatagtggggatccagccagcgaggcagcgagggcgaggcaaaggctagggtttacgggatcggggaccctgcttgtgggctgcggctgaggtgggcaggcgtgacgggacgtgaggagaggtggagagggcggcgcgggagaggagcgggcggagggaagcggcggtgcggcatggggagaacgacggtgcaggcggagggaatcggcggcgcaggcgtgcggggccaggcggaggttagcggcgatgcaaacgtgcgggagcggatggattttcgtttttgttttcttttttgtgcgcggtttttcgggtgtagagggtgaggggttggtcccacacgatagtggaaccgaaggattggaggattggggatgaactcgtactttttatattagtatagataaataaactaccctcaaaactagaattgtgacatagaagaccaagactccctttctagtcagtccccagcaggtacccacggcaatggttcttccagccgttcttgttttcctagtcgaagacttattattttgttccttccaaattacataagcaatcaggaccgcaactgtattgaagcctctttgttcataaccttggaatccttttcacacacctgcaactcaaatgtgacaacaatgaataagtaaattaagctagaggatgcattgcgacaaaggctaatcaattcaatcaaagtcaaaattttattgtaacaattacaagaaaagtttgctatctttgaggtaagtagcaaagaatacaattttaagtattccaccaatgttggtccactcaaaataccgtggagttaaacaggttatacaacaaaacagcagttcagaaaaaaaatgcatttagttacctccaaatatccatatgccaacttcatctattacacctagccaaccatcacaacacacgagctatagatatgcattttcaccacttgtctgcaccttaagattaataaagatgaccttgtcaaaaggatagaaatatgaggtttatcttaatattgccacatctaacaaaacaacacatggaaggcaattatctgagttaatgcatcccaatagaaatattaagaaacatgttctttccaatacccgtttaaggtatcggcaatcccttttttacattcacatcaagggaccaagcagctggtagatcagatagaaggctataactatacacatgctttgttgataactgtaatggagatgtcacggccaaagttcagaaaataggactatctctagatttgtcaggttcagataagaagttggcaatgtgggcggcgattagacgacttgacttaaagggaatccaatggctcacagcgtaaaggatgagaacgatggttcatgtgagacatgggttttctccaggctgtcccgttgacatcatgtttttatcgggatgtgtttaacccgttcttaatttcagaacttttctttcattacacttgattgtaatcaactaattaaacccggcctatatatatatcatgggagttgggtggaatgtgaactaagaaaatcatattcctagtccctttagtagtacaatagccagcttagaacactatgatttatccccaattctcttaattccaaatctgagcacaagctgataggagacctacaacagcatggtggctcaaagccagcggcagtgtgggaactcgagcccatgaagtcctaacttcagtatgcacagatcaattagatacggaaattcatgactgcatttaaaatggaacggaaggagtaaatgaaattttaacgtaacaaacgaaattttctccaccgcaacaatggttaactgaatgaagaacggataaacttataaggtcatgagatactgcggtaggcatccgagatactccctccctccgtcccaaaataaaccaacctcgtacggaatgtgacacatcctagtatatccagattcgtagtactatgatgtgccaaatcttgtataagattaatttattttgggactaagggagtaggcgcactgagatgaaacatgttctatctaaatgaccaaacgacaagaaccgtatccgagagtgacgtggtttcaattactaagcctccagtccacatgatgttgagtcatcccagccctttttacagcacatgatagttttttttctttctttttgagaggacaacatgataggtacttgtgttttatcccaaccaagaaaaggtctaatgcatattcgcttcctgcgtttctcctgaccatatgtatatctctaaccatttctggaagctatcttgtggagtgggaaataatatggaaaaaattcgtcctcacaatgccttgcaggattgaggccgatggaagaataagcagcatggtctaggatggtttctcatctcgttggcttcagttttattgattgagatgctgaagtcagattcataaaccatcactcattggtatacagagaataacaatgcaatcaccatcacaaatcacaaccacaactgcgaagctcattacagcagcatgagcaaattgcagtttcatactttcatgccagtagttctacttttttttttctaggttttgcaatgagcttgtacaaataattggcccatattttatacggatctgcctgatcctattattatcaactttgcatcatttgctacaaattgtgccatacattatggatctatccatatagcagtatatatttgtttcaaaatgtgacagtaatccacttcttttataggaaaaagagtttcttctggtcctcttggcgcagggttgagaactttaatgaatggtccaaaagaaggtacaatcaaatatggcacactgaattctcattgagaagcagttatgcagggttgagaactttaatgaatggtccaaaagaaggtacaatcaaatatggctcactgaattctcattgagaagcagttatcagaatgtgagtaacatacatgctatgtcaacatcttggaaggatcacaattataaagtatctatactgcattaaaagaacttgagtataccataacataaaaaggattatttcacatgacaatctcaggtttcaggatgcttgatttgatctctttgtgcgggagaataacaccgccgttggtatagacctcatcacctacatgtacgtcctctcctaggatagtcatattttctatccgtgcccattgtccaacagttgagtgccatccaataatgctgtttgatatgcaagcatgcttcttaatacgcacgccacgcatcaccgtgcaacgggaaagcctcacaccatcctccacgacgcatccaggaccaatagcaacatcaggaccaatcagacagccttcgccaatcttcgcactctcgtgaactagcacattcccaacaatgtgtgctccagtggctaacctgttggctgatctcttcctaagtgaatccagataaaggcgcaagcctgtaatgtaatcccttggttggccaacatccatccaaaaacctggaaggaccatagcaaagagctttgcatcagctgagattcgaggaaagacctctttctcaattgaagttggctttagctcgatgcggtccaggacagacgggttcaacaagtaaattcctgcattgatcttgttgcctacaaatatttttggtttctcaacaaatttttccaccattccagtggcctcctccataaccacaacaccatattttgatggttcgtccacctacattgaaataatagtcagtatacacaatcaacgagtttataatccaagaaagtggtcaaagaaaggatctaccttggtgaccataattgttgcctcaccaccatggttcttgtgaaattttatgagctcagcaaaagggtattcacttatgacgtcactgttgaggacaaagaatggctcaccagatccatccacaagcttgtcccttgctagagcaagagggccagcagttcccaagggctcagtctcttgggaacacgtgattgtgatgccaagcttatcctcaaagtccttcaggaaattgagcattacctaaaagacggatacagaacaaaccaattagaatgcgaagatagttatacttataccatgagacaacagtaaaatattatctcctttttacctccgggcggtagttgatggctaaaacaacttctgttactccaacttctttcaaggcctcaatctgcataaaccagaaaacttttaattcagagctcattactctcctcaatcctcatgctcatgtttgctggagccaacattttggatataaatgaagtactcttgataactgattggaattttcaaggacagaaaatttggtgtgataccaaaagagttctccaaaatcatgtaaccaaattgataaggaaagaaacagttgaatagtaaaaaggtgcattcaatcacatgcaaatgccacctatcatggatgtttagttgttacaccatgtttatgtgggggttataaacaaatcaaatagtattaatgttctttgaccagtttaacaccctctccctcctttcatggagaggccagtgtcagtgttggaatgttggtaaagaatactgtactaattaacttgtgcccaattcatcgattggcattgcaaattaagtgctcttattactccatcagagtactagcgaaaccacatattacctgatgcagaatcatgggcttgttcgcgaaatcaacaagaggctttgggaaactgagcgttaaaggccgaaggcgagtgccgaagcctccaaccagaatgagcgccttcatggtgaatcgcctcctgttcttccctccctaatccctactccggcggagggatcctcaagcaaggcttgggaaggggaacctgccattgcaacagacaaaatcaaatgtgaaactaggttggagcatcaataaaaaagaaagaaagatttcgatttgattgctcgcggtcgtggcaaagctccagtgagctgctttcgtaccaatagaagggatcagcctggaagatctctcttccttctccacgaccagccccattggaggtaggtagcacagctgcggtcgaaggaggagcctttgtgctgtgctagattgggaatcgagaattggatgggactttatagaggcgaagtggagaggcgacgcgaggaggggaagggggcccacagtagagatgcggttgtgtacttgtgtgtgtctcgctctcgcgaaagaaaattcgcgaccacaggtgacacgtgttccatcacaaatctcaaagcaaatcccatcatctccacaatcttgtgtttggtttatgggtaaggtatgatacgttaaactcatcaagttattggatatctatatatctatatagaaacgacggacgaagcggactaatggaagccttacgaatttttttattagatatagatatctatatacctaattaaaaaataagtaaggcttccggttaatcttttcgtccgtcattaagagtgggcccacacgataattcgtcgctaatccatgatccgaaagcgtggccacgatctcttacgcctgcaaataaaggagaaaagaaaaataaaaagagaaaaccttgtttgtggagcagcccatccaaagcagcccggattggattagtgacgaggcagcccacccaaagcagcagcaggccggcccagatagcagccgcagcccaccagcgagcccacagagcggaggagaagcagcccaccagcccagcacagtactgcacaacactgtagcaaccgaacacgaataaagtttggactcacgccaagcaggaatcggataataaaagaagcgattttattacttaaaacatgtagtcaccaatgtagtcaccaataaaatgaattatttaccgacaaaataaattattttttaaaataaaaataatcacatgtgtctttctttttttaaaaaaagaagtaatcaccaacaaaatgaatcgtgtttacatttggatttttttcccctcatcaattgctcattcgccataggacacctaatcacatcacttttttttccattcattatataatttcttctattatttagagtgaaagttattctgcgatataccacatttttttctttccttctaattatttaagtgaaaggttatgcaattggagtgcaatgaggttgatctgatagctagcaaaaaattatttcttgtattatggctactctttacaatatgaaaaaaatgcttatcaatatcgagtaccaaaaaaataacaaagtactgcaattgactcataataatacatgacaaaaaagtaaatattttttgtggtttcaaactttagtatccatgtcagtgcatttagagcagcaaataattatatcatgttagcgtcttatttgcactagaaagattcgattcgactataaagacctcaatttacctggtggttttatgctcccacacactaattactatttctgtcttcacccaatgcaacgcatgggcattttgctagtagatatagatatagatatagattagatatagatagatatctacctacctatattataattaataatataataaaaatataaatctatcatatacctacccctaattaaaaaattcagtccgcttcgtctgtcatctgtatgttttgagtccaagtcggtcttcaaggaaaaaaaaatccccgtgctagatacccaaattaatcaatcaaccaaaaacagcacgaaaataccaaatttaacctagatatcatgaatttgatcccaagaaatctaatcccccaattcgatccatctgagccaagacacaatacataaacgatagaaaatgaatcacgaaatcacaaatccaaaatcatccagggaaaattaactcacaaaaactaaatcagcgacgccactggtcatgggaggcgaggacgccgcttctacgaggagggtgccgccgccgaggctgtcgataccgtccgttgtgttgtggcggagaagagggtgaggacgccgccgaggagccagggggagggcaccgcggctgagacgccggctgccaagggaagggaagggcgccctgggtgagtggtaggggaagcgacgtcctcggtggggggagagggagggcgcgctggctgaagggtaggggaagcggcgttgccggtgggggaggagggggccggagagagggactgagggagaggaattaacgcgccgcggagagaggagagaaggtggggaaggaaagagataataaggtcgatggggccaagcattgagacgccgctctcttctctagtctagtctcatcccaaacacttgatttcctctaaagcgacacatgtcccccctccttctctcctaccatgtggttcccaattctttatttttttttctcccggtgagatgcagggtttcccaaaccaccagagccggggttaccgtgccccggcggtaagcacggttaccacacggtaaccgtggtaactgtgaaaaaccgtacaaaaccgtgcaaaatttatcaaaaatttaaattattttttaaatttatttaaatttaaggaggttaccgcggtatttatattaccgtatccccgcggtaagcccggttaccggcggtaagggaaaccctggtgagatgttgagcttgggtcggaccatccacgcggtgttgagcgccattgagctcatagtggcagccgggaattggagtcaaggcatcaagctaagccctaccaactttttcttcaaacttccaacttttccatcacatcaaaactttcctacacacataaactttcaacttttttcttcaaactttcaattttaagttaaacttccaattttcgcatggaacacaccgtgctgccgtcctactgaatgaaagataaatcacgtgcatgcgttatctttttttttcgaacagtcagaccgttgccgacgttttatataaagaagaatgtgtctcattttaagaagaaaacgagacaaaaccttacaatgcgcagttaattaggaaaaactggacgaaaaccacaacactctaacataagctaccaacaccgcgaaaaaagaaagaatggcgaagcccaaaacagccatcgataaagagcttgttgaaagcgacacaaaggcttcgacttcgcgtggcaagtgttatcgttgccgagcttgtcacctagcgacacagcagcttcgactccacagctatcacatcatcgttaccaaaggcatcgcagaaaacgagcaagacaccgactgtccactttgaacatcaacccaagccacttgagcactactacttgtacacagctaacaccaacctccctcgaaaacttcaacgtgttatcgttgtcaagcttcatcgcaccccgataaagtagctccgacttcacctagaagaaaacggaga

SEQ ID NO: 82997 - DNA, 1920 bp, Oryza sativa
agagtgggcaccgagggcagggagtatttgtagggtccgcatgcagtgggaccctctacctgtgatgtgatgagcgaagtgacgaagacgcaaagtgcaactcaacacgatttttgtagtcttctagggggtgtttggagagaggacttatgttttggagagtttatgtttttgagagtttagcctctctctcccaaacacccccttacttacacaaacatatatttttaagagatgtgtgaatattatgctcactttatcatgtaaaaaaataacttagtgctggatataacacattatattactatgaatttagacatatttctgtcaagattcgttgtactataatatatcacatctaattataaattctcgtctttttagagagtatggtcgagttgaatttcatgtcgtgctagccatgaccaggcaacgggcactatgactttgtgagtctgatttttgagaaatcaggaaaaaaaactcaaaattcttgcaaacaatagcaatgtttttttttctaattacatggataacgcacgacaacactaacactaagtacccacacaccggcaagtcccaaagaaacgcttaaatggattaacggacaaaagcctcgtggagatcaacatttaaaccgtgcgaagtttccctaaaaaaaaacgtgcgaagtaaagatatgcactcgtgatccacttcttgggtatatgattattacgatagaaacaaaataggtaaatcatcaattttaactttacaggcaaattatgaaagaatgtgattaaaagacgtacaccctccattctaaaatgaatcatatccatatcatatagccccatcaattttggcatatcggaggaaaaagtgaaacgacatatttgtaaatgaaaaataatttgtgaataaaacttttatatacgtgttctgaacgatctaaaagcaaatgttgaaaaataaactacgatgaaaaaaaccccaaaatcaactctaaatttaagattgaaaattcaaactttagctgataagcgtgagtgaaaagatgaggctaataatatccatattattgctaggatgcctcaaacggaacatatcctatatagattaaaccgggatttgtttttttttcatatgattaattttctgaaggaaagggatgtaatttgggcttgggctgaccaaattgatagcaggccagatcaaatcatccagtcaattcttgtattaactctaggcgatatcagtatcacaaaaaggttgatagcatgcgtagcatagtgcaaagacatttaggttgttaatccgtagtactaattactaagcttcaaaatccacgaggcgtcctttgcctgcttaatccttccctttcgtgatcgcaactcgcaagcaacaggtgcaagctgccaagcacaccgccacggtttgtttatgtttagtcatccgcgcggatctccaggcactaggcagcatcgacatgagccacacgaatcgtagtggaaatccacgatctcgctgcgaagcgacagggtgccctgattttgaccaacgactactttgagagcttaggtcttcgctgagctcgtgttcaccatccccatgcattgacctaggacaaattgatacttttctactcgcaactattccaatgcgtgtatggatcctgctgagtttactttttcactctaaaaattaatattagcaattactccattcgtcctaaaatataaggaattttaagaaatgtgacacgtcctagcactaagaatattatgggactgatgttagtggaagccttgtctaacgaaacaagatatcttgtatgtttagttcacgccaaaattgaaagtttagttgaaattagaacgatgtgatggaaaagttggaagtttgtgtgtgtagaaaagttttgatgtgatggaaaag

SEQ ID NO: 82998 - DNA, 5848 bp, Oryza sativa
ttcggccgccgcacgctgttcctcgccggcggcgcccagatgctcgcatcgcaggtgctgatcggcggcatcatggcggcgaagctgggcgacgacggcggcgtgagcagggcgtgggcggcggcgctgatcctcctgatcgcggcgtacgtcgccggattcgggtggtcgtgggggccgctgggctggctcgtccccagcgaggtgttcccgctggaggtgaggtcggcggggcagagcgtgacggtggcgacgagcttcgtgttcaccgtgttcgtggcgcaggcgttcctcgccatgctctgccgcatgagggccgggatcttcttcttcttcgccgcgtggctcgccgccatgaccgcgttcgtgtacctcctcctgccggagaccaagggggtgcccatcgaggaggtcgccggcgtgtggcggggccactggttctggtccagggtcgtcggcggcgacggcgaggaggaggagcgcaataatggcgggaagctttgactgaaacaacgcgcgcgcgcaatatccaaagtgcgttgcacgaatcttgacgcgcatctccccccctccgtttctatgctaccttgttcagaaaacagaacacacctacagattcagagttttcagacacatcaaggcttaagaacatactccctccggtttgagattaattgatgggttactccttcatgtttgagtttaattgatgttttagctttctccactactctctcccttctatttctccagaatacccctcatgcatgcatgcaaacagaaaaaagtaacggctgcttggagtattaatgaggggtataacaggaaatatggatctaattaatactgtcattgatatttgccatgatgtccaaaacgtcacttaatctcaaaccggagggagtagttaatgttgtacttcctccgtacgaaaatataaaaaaaattatatatacacattatcaaaagctagtgttatctacccctcctccgtcaaaaaaaaaaaatcaaaccctaggtttaaaacctagggtttgatttttttttctttttttttccagagtagtagatatatgaccagaagagatggagttagtatgctactacaagattaagcgttttcagataaatcaagattcggagctttcaacacatcaaggccccgttgttttatgattaagatacatattttatctcggttgtttgttggcatgtttttgctaaaccatgtgtttgcgaaaattttttatatagaaattatcttaaaatatcaaataaatatatgtttttaagtttgtaacaaattaaaacttaattaatcatgtgttaatattttttttgtgcgtgcttatacttaatcttttctctgtatctatctcgaacgggtccaagattcagagctttttttttttttttgaatccgggtgtgtttagttcataccaaaattggaagtttggttgaaattgaaacgatgtgacggaaaaaattggaagtttgtgtgtatagaaaagttttgatgtgatggaaaagttgaaagtttaaagaaaaactttagatctaaactcggcctgtgtggtgcgctctgaactaggaatgttttctaggtcagaacatgtactaccttcagattccaggtgtagcttatagagtaccaacagagtgtccctatgcttaatttcagtgtagaaaacatgcagttgctgtaacctgtactctgaaaccaatcgttttgatttcaggccttaaaactcatgtgcaaaaactgttggaaaatcacatcaacaacagttatcaaggtacatgaacaatcatgcatgaggcaccataaatgtactagctagtatcacacatggctagatctgacgagattagtaacaaacagtttgcaaggttcagaataattactgtacgagacatcatgatcatctcctctgcccagcaggtcagcatctaccactaattgggggcaagataaaaaaaagtcagtgtagatgtgcaagaacgcttctttctcctccttgatcggaattacgggcagaattattagaacaggttaaggagaatagactgaacagggagcagcagtacaagtgcagtgagggacagtatttggaccggtttgtgctgcattgtcttagtgttatggagcctgaattattggggcttgtgtgattgatacctctcgcacctgtccatgttgccttgtagatatacacacatcactccatgcatctactctctagtaattatccatgtgctcgtctggttggattggaacaagcaacaactaggtatatacacttgtctctgagtgatcttatatgagaaaaataattcatacaaaattcccgcatttcaaataaaatttatcaaattccttcataattacctcgcttcaaaggacgcaaatatagtgattttataatacttaaaaagtaccgtacttttgattaatttagcataaattttaatacctctcaaataccgtaaaatttctcaggtaaatatcacttattggacaacatgtcggccactcatctagtcatcttagagtttagctcacgttgggacgttaacctaatagcagcactccaggtgtcgtggagcctacaagaacgtcgtcgtcggtgaagatagacaaaccatggtagaaagcaaactttcatgaaaaagcgaccaaattaggcgtatccaatccaatcctccaagcgaagcaaaaacacacgtcacaagaagctcacagcaacaactaatggctccatatatataaattaaatctatcctatttggtgagtggtatttattatctgaaagaatctggtgagttttcatatggatgcctacgtggagacatgttgtgtggccaactggggtccaacctgccaatcatgcattgggccagccatcaggctacttgttagtcgatcgatcgatcgccacgacaattcatatatatcttatttacaaggagagagagaggaggaatcaatcgataattcgagacatatagtgatcaatcatgcatcttctggttgttggaagctagcaaaactgaaggttcttgttgctgttgctgttcatcattatcatagccaataagaaagcaagaatccaagaggagacaggatcggaggaggaggaagaaagcgagaaaccaatcgatcgatcgatcatgctgatcttggaggtgggcatctggttgctgccgttcacgctgctggtggcgccggtgaggaggatggtgaggctggtgcaggagctgcagcggatcatgctcgtcgtcgcctgcgaccggagccgccgcggcggccggccgccgacgttcggcgaggtcttgagccgcctcgaccgcctcgactccgccaccgtcatcgtctgaacgatgatcgattgatcagcatcctgtaagctgtaattaagttgcttcaattcctctgccatcttcttcttcagttcttcttgatgtaaatttctgaatccgaattaagtgcgttttagttcttcaagaaaggatgctctcttctgaatcttttgctctgtgatcttcagtttttggtacatgcaagcacttgcatgtatctgtaattatgtatgtacggtttttgtatatatggggctgaaattaagttttatccagctccctgcataagattattgatgaacaccagtctaaaaaaaagagtattgatgaacaagtattcataggatgaatgaagaagtgttctctgttgtatagagagaaaaggttcctttgttcttcagtttatgctgatgattcataattaatttggagctcatttctttctctgaatgatttggagatcctgattatgtgaatggtttctttctgaattttcctgaagagattgcaggattgctagcatctaggtagatgattccaggtcaaacaatgtgtttcttttgctttctgtccaacattcttttttaggatagttccagttttttgtttccttctcaaccaataaagctgctgcataatcttattgaagctgtcagaatctgtaacgtcaaatttgtatattcacatgtatgtcaggactacttaaaaaaggctgaaggggtgagatgtacatattagctagtaaaaaaaaatcaagttcagagaacatacatcattacctggggcttataatttctttaattttctatctgccattattgtgcccttctagaaatgtagggcaggttggtgtagaataaaatgcaactgcacatggctacgaatttctctcaggaaaaataattttctgagggagactagggaacggtaataccgttggaatggtacagatgatactatgtatcatgcctgatatctaggtatcatacctataccgttccaacggaataccgttctctctatttgatttactctaattatatatcacatcattatgtcttttggaaactcaaagagctggtgccacaatttagtgagtcatcataataatatacagcacgtattgctaatcattaactcttccaagcttatgttgtgagcaaaaataatttgtgagaccacaggtttattgatggtctctatacacgttcgctctcatgatttagaaattttcacgttaatcaggaaaaaaaataaaaattctaagccattgattataatgtggatctaaactataacggtgtagtttaaaccaaagaatccaagtcaaaatacaatttaaaatatttgaaggtcggaataaaaacataggaatcaaaaagagtccttttataaatacaatataaagtttggattaaaataaataatattgagataatagtccatttatttagaaatatatgaaattcatagtaaaaataaataatattgagaaaagagccaatatagaaatacgaatgcaattgtacatcacaatgaaattatcaagaggaatgaaaagtatcaaagtgaaaaagaggaattattttctcatttttctcattccaatgtccaaacgagccaaactaccaaagcaatatgcaattctttaaggaaagtaccaattgtgtttccttcccagaaaaaaaaaagacctaaccagctaatctcaaagatgcagacagaatcatgtaataacaaaatgtgtccaccagcaggttatcaggactaataaagtactactaatacattcacttttgctaaaacgaaaacaagttgagagctagagcatgaatcatatgcacgaaaccacatatatatttcctttgtcaaattatatgtcgcattattgtgctttttagaaatttgcagaatgcagagttggtgtatggaatcaaatgttgctttccagtttagttggacacataataatagtacattattgtgccttttagaaatttgcagaatgcatagttggtgcgtggaatgaatcaaatgctctacttccagttcagtttttccttcaaaaaaaaaacttccagttcagttggacacaataatacaatcacactgtgcatattgccaacgcttaactcttccgagtttatgtatgccgtgaacaaaatttgcaactgaaaccatgatcgtcggtgtaatgtggcaggaacggccgataatggtccggagggagaaaaaatgatgagtcaattttagacaactatagctatttcgttaaaaatatcagtatgctacaactttagtcaagtgtttaagagaactgcaatattgacatatataactttatcataagctgcgactttatatttctaatatccttggatctacatgtcatacatacacattaaatactcatgatcttacaaatcgggtctaccgtctacatgtcatacacacgtagggagtaaaattgtattttttatgataaa

SEQ ID NO: 82999 - DNA, 1172 bp, Oryza sativa
ttgacaaatttatattcttaaaactattatttttgtaatggctaaaatataatgaatttgactttaaaactttacatgtaggtataatactattaaaagtatatgcattatttttttcttgagtctttttatgatattaattagttggtgtgtatagagtgtgcacgtagaacttgtatacatagggtatatatgctgccgctttggatttagctatagtttggaacaaactttgaacaatagaggtaattaactacattctagaatatactaggaagtatacatatgtatgcattgattggtggatccatatatgtccacaaaaagtgcaataattcgttcagtcgtttaatgtgtgcgcattccaccaatcattcgattcatcgatcgatcgatcggcccagagagaatgagacccaatgtaatgggtgtgtacatgcattcaagcttcgatcccgtacgttaatgcgcttcgatcgatcgatcattcattgttggcaacggaaagctaacaaacgccgagctggccgtcacgctgcatgccggccaccgttttgtaccatacgcttcttgtactatcatctacctatatacgtagctaattaacttcttatattgcacacacattttcactctccaattagtttatagggagtactatatatagtactagtacgtacgtgctgcaaataattttatgtgcattgcaacatgcaagtaaattattaactgcaaataataattaacagaagtagtagacgagaattgaagcgtacatgtatatgtgtagtacatatggtggcgtctgacttaggtagctttcaacttccaccatcatttgagaccaataattccctgactagctatccaattctcatcatcatcgatcgatcaacatttcaacaacaattaatctcaccaatcgatctccagctaatcccttgtaccactaactatacatgcattattaccggccaagttcttgtgccaattacacaatgcagctatgattatataagcaataatatattgtcagtaataatcaagcaaccgtccaagcaagttgcatgcgcaacgactgaagaacaaggcatgattagttggaggggatctgggatccaatgacgaaattaatcataagctaagttgagagaagctacagcaatgtatgc

SEQ ID NO: 83000 - DNA, 1953 bp, Oryza sativa
  unsure (1)..(1953): unsure at all n locations
tatatattggggtgcaaaaacagttgcttaataattataaaagcataattattttgtagtactagcagtaactacaaactaacgaacgagatgatataactgatctgatcatacattcatatnnnnnnnnnnnnnnnnnnnnnnnnnnaccactactgcatcattgcggctgcacatgctttccggtctgggctagctagggcttgcataatgattaatgtgcatttgtgctgtgcatatatgtctgtatgattaaacttgataactactaataattacacctgtagtgctcgtgcaaatgagaaaaaaaataattgctgaaactatactccttgtaaagtttgcataaacaaatcaagatgggcatgcagtactgtctgcctgatcatcatgggtgctctctctgaagtctgaaatattcctagatctagctgaatgaggcagatgaactcaaattaaattaataattaagatggatggatggatcatgggtcggacagccaggttagctgggttaatcaattagcatgcggctctccccccaatgatttgctcatgtcatgggtgtggtttgcaaatctgcagtaaggaagcagccagcgagcgagcgaggcgacggttgatggatgggtggatgctggagaggagaggagaggagactgcgcgcacgggggctacgcgacgaatccgccatgggaaatgattggttttgatcggtggcgcgcgcgcgagcatgtggctcggccgccggatcgccggacatgccaggtgcgcgcggtcgcgggagccagagggatcttctctctcatcttttcctccctctctctctctctgtgttttttttattactcctcttcttcttctttcctctctggcggcggcggcggcgtcttctccggcgccggcctggtcgcccacagatttagttgggattcaaatgggcccattttatttctgcagcccaacacgaacgggattgcggcccatataccatgttgggctcgagcgggattttcaccaacgtacagcccatatgtatttgggctggaacgggataggagacgaggggaagagaagataggagaggaagaattaaaataccttattaagggtctgtttggtacagcttcaactcctaaatataactccaggagttgaatctggagtggagttgtggagctgcctaaaccgagatccacaattctagtacattttgtgagagagctccacccaactccactcctagtttcggtggagcgtttggctgagctctagctctaggagaggtggagctggagctgtgccaaacagaccttaagatttgccacttacacgtaggcactatatgtttttttatttattttgtttttgctaactagtatgccacgtcaacaaaatcagccatccatattattatgggatctaatttaacccagttttgcaggttgtgggttaagatttttggtattgtggttgagatgtacaaattaaaatcgacgaaaacataacgaacgtaaagtggacttattcgaacgggattaccagctacgtgtggcccgtataatttgggccgggaagggtttggcccacttatgcgtggcccattctagttgggtcgatatattgctcaaggcccatttaccccttcgtttccgttacggcttctcgtctcctctccccttttcacgccatggccgagcgatctcccggccgccggaatggacgcggcggcggcggcagctgcggcgggaggaggtggtaacgccgccgcgcggagcagccccgccgcgaaatcctccaccatctcctcttcccgcagcgctaatcttcttctcccctttcacgtcgttaccgaggcaccgagcgatcgacccggccgaaatggcggcgggaggaggaggtggtggtagcgccgccgcgcggccagcactcggtgagtgaccaaccaacccg

SEQ ID NO: 83001 - DNA, 43026 bp, Oryza sativa
tgtcacatccccttctaggttgagttttttttagatggaggaagtaaactataagtaaaaaaaacaattgtaattacctggagtatatagcagtgctctatgattggaatgttgcacaagcttaactgccacacttcctcccaaacttgatattaaccacagccaaattaattagggcaagaagctaggtcgcttagataaaaagaatataattttgggatgtggtatgattttcgtcaaggaatttttagggatgtagaaatggagaacgaaccattagttactgacatcacaaatctactagtaactcttataactctatatattaaaagtatgtatcttttttggcagttggtacaccaaaagcaagctttatttgtccatttgggttagtgatgaaatggatgagcaatgaggtagtacatgttctctcaaaaaaaaaaggaaaaaaaatgggaagacataactaagcatttgaaagaagagaaatgacattctttcttttccccttcacatctgcccttcaattctcagaggagaaagatgatagggaaacatcagtcattgtcactgttgcaacctctgatcaccactttgtgatgtagaaatctccactagtgacagctaatgatttgcctctctcagggatacttaatgaggaaatatcaaacacaagagtaaaaactttcactggctggctccaaggtttaaaaaaaaaagagattagtcttgccctctctgtctcaagatgctatttaggctgtgtttaggagtaaggattgggaacccttctctcctgcacataaaacaaagcatgcattagcgcatgattaattgagtgttaactaaaataaactttaaaaaattaatatgatattttaaagcaacttttctataaaaaaaacttttataaaaacacaccgttcagtactttggaaagtatatcaaaaaaaaatgagggaggtgagttaggaaaagagagggaagaatacaaccttaggaccactttgaaacaccgttcagaaaaccgccacaaatattttataaaaaagtttaagcactccaaaaagcgaaatatggataccagaatttgaaccatatcatcatcgaaaaaggataataccagattatgctaccagagtcctggtgactgtgaaaggtcactgcctcactggtgtcaacatccgttgtcgtgttaggtcaaactcgaaggagcctctgtgctccttgcaaacattgtgagtttttactggacatccgccaatcatccacttgcaaacatttgagcttttataatgcttctattttatatccctccaaaaattcatcacccaagtagattaaggtttagagttacttttggtaagttcatctcatcacaaaaacacttgtatgcaaacataatcttgctctgactccgagtgagatattgtacttccgtggtcagtaaaaactcaaaactggggcacacgcttgcattagaatatgacaaaagttaggctgatcatatcacatcaaaatatgaacttaataaacacgagcaggtaagaggccatcaggctcaagctcaactcacattcagaataacacaagccattttcatgagcaagtatttgcaagaatgtaacaattctcagataaatgaacagatgtttacacacgaaaacaaaataatcacatgttactgagattttacagtgttggcactctgctgtacatacttctcgttccctcatgcccattagaaaaaaaaataaaaaaggacacaccagggtagattaatacaaaactgcaagcctcaaaaccaaacctgtgtgaccctcgaaccagtactgaacgcttggtaaaatgggagatggtaagagggcacacctatgaatcgaaagaataagccgaaactagcaaaggcaaactcagactaaggaaaaatggaggactcatcccacacaatgtgaaaatagacacattgcacaacgaccatggctgccaagggctattcaggcatatacaagttgacttgtacgatcaaacagtgctttagctggaggttgaatgaggaaattttaagcatgattcaagctaaaaaagttggagagcgatcttcattctattttgcttccactttggaagcttgctgaatgcttcctttgtcattccaaacttgtctttgaattcagccgaagataagtaggtctgcatttagttcaaaatggggtatgtggtcattacctggtctgaggataagtaatacgaagtagctaagtatcgaaaagatcatatattcacctctcgcctggtaacgtcaatttcagtgacaggatcagcagctgtagttatcaggcgatcatatgggtatactgggagcccctcgtcatcttctggttcattttcttttacatcttcattaatagtgagagattcaactctactggtcatggtgttaatgccttcttttgcatcttcctcttgctttggcttctccaactcagatccatcttaatttgtacagaattttacaaacaacaagaaatcattaacccttcctctgtttaaaggcaattttatgttccaagataagtgtatcacataccttttactgatttagggcgatcaaaagaaccagtgagagaagcagttgcagatgacttagacggtgcacttgatgagtcaggtgtggcagattttgggtaaagttttttaactacgggtggaggggtggaaagatttctgctgtttgcactttcaaagttagcagccaatgcagtgaatgccggagatcttcccctaacacggacacgttcagggctgaaagacatactcctcgagcgctgagatttgtcttgtacagtgcttctccctgaatatgttggtgttcgtcgctttggtttctggtaacaagttagaaagattgtaaatgcaaaggttccacatccacagataggtctgctaactacagaaaaacacttacagaccacagacttacaactagaaatgttataaataggtggttccatgattgtacacacaaaagataaacagaacactgttgtctagcagaaaacgagtttgcaacaaagaataccatatatggttatttcgacatggcagactatcataagacaactaaagtttgtacatatcttacatccaaagcaggagaacctccaccctttacaatggaaagcttcctctggtatgaattgccatgcatctacaagagaaacaagagtgagtacaacacattgaagatgaaaacaaggagcattatggtgcttctgccaaaaggaacacaaactacagttgttcatcttatgaatattctacttacaagtgactttgctgagtcccaagtgaagaaccttgtgaaaaatgtaggctcacttccttccatgataacaaaaattggtgtgtcgctggatagattttccatcaggaaatcaagcttaacgaatttctgatgcagtattaaaaataatagtcagtgaccaaaagaaaaggagatgccacctaaagtgcttcagcatggaaaaacaaatcattacctcaccaatgtccagagcttgtaatcgcactttgacatctacctgctggccaacccaaacaaatatatctgagtgacagtccagaatgaatacatcttctgtcatcagatcatcttgagtgaagtggtatatttctttgatctgctcaaatagatttcacagctcagtcagtgttaaatgcaaaaacagagaatatgtgcagacctgtatatgtcacaattttactttattacctttaaattgccttcatggaccccaataggtgttgttggcagaatagaagagcagatatatatcagaaaactcgaagagcaatgtgaactgaataaattataatagaatggtcaattcatggttacctttgggtaggatacatgagaaaagatggggatcactttcatttgcccttcctatcttttgacttggatactcagatttgcctccaagtaagctccaaaattgatctgtttctgacccttctttctgcgatctggactgcgaatttggctgtgatgaagaaagcaaagcacgaacaattctattgtcactacttgatagatatcataagcaagaaggaacacaagtatgcggtacacaacaaatttcaaataataagacttgcaagtattcctagtaagggaatagaaaactgctgggaaccagcctgcactagaaattctcaattctgtcattctgggattgggctaagtggagccaaatcatcccaagtttcagttagttatgcaaaacaaagttccaggttatgcacaacagaagacccaggttaatgcaaacaaagagagctaggagaagatgtccgtcaagtcactagtgcttgggatatgagctgtggtctggctatgctctcagtctttgtctacctggtgtcccttgtaggtgctctaggtgttgcgcgtgtcagtctgatctgtctagtttccaggatgctgcatttcctgtctttgttttgttcttttgagctgggctgtgctaagtctgatctatctagttttagtttttaagccgggtgtgtgcgcctcatgcctcatgggaagtttcattaaaccgggtgtaaaagcctttcctctaaaagaagttgcacttggtctgatatataagaaagtctatactcggttcctcaattcttcattggtttaattttcattcctcaatgcaataccaaacggaatccatcccccaactatcaaaaccatgcaaataatatccctatgattgttttgcaagtgattttgagtgtggtggcttgccacatcatccttttttaccatgtcatctgccacgtcctgtgtgttagtcctttctcttcctttttaatagaaaacaaataatgaaaaagaagatgcaaataatatgcctagtagatggatgatctaacaggttcctttgttttatcatttcccctgacatcttcatagtgtactgtggtaaacctttgcagggagtaattactcaagatgttaatgcaatatttgttttccaaaataacaataggaattgatcaagtacaacttcaaaagtgtgtatgccttatcaaggaggattgttccataccttaattatgtctagctgcctctcaactacctcttgatctaatgacgtagtaaggtttccagtccaagtgaatacagtatttccatcatgtaggatgtacgaataggatgaattcaaagacgatgccgcctaatgaaagagcatgatcaagttaccttggaagcaatataatctaattccaaaaggagttcaaacatatctttaggaatgaaaatgtgagaacttacagcatcaacttgaattgcctgcatgttttctggtcctgaaccttgaattcggaagagcgcaagtccatcttccaaataagtgtcatcatcaataccattttcagcaataaatttcttgtatccagagcttagaccaccctataatgaaaaagggaaagaaactaagaattggatgttgtgttcaacctgagctaacagtattttatagaagggaaccttaaacacttggaagctttgaaatatgacgaagaattgaattggttcttttccctcatatagtcgtgtctgcatgtaaccaagaacaattagatacacaaggaagtcatgtctggttcactaatgaaatatggagaaactagtaggttacctggacagcctgaaatttcgcagactcaaccatcttgcttgcaagtgaaatagcagttaccctatcctcctgaatccaaattgaaatattttttaacacctacattttctagtatgcactaacagaacatgtaacaaccgcatgctgttatccaaaatgccacttcttaacagaaacagatagatcattgtggcttccagttcataaatcaaaaggatggaaaacagaagcatatgctgtccatagaaccttctaagttctttcttcattgtcctaaagtccggacttcattgataacttaattaaaaactaattgtgagctataaggtggaaactctaaatacaatcttataactatgaacatgaaatcaaagataaattttacctcaatgctcttcttcccaaaccaacttccaataagacactcctccttgtcatctccagggtacatatattgaaatatgtagcaatcgccagtgtaaaattttgattggtcagcagatggcagaagtatcttgtccttatcatttatgcgccagacctgataacagatatagaaaaaagaaaaatgtgtggacattttagctctcagagacccagaaattgaacatatagagcagaaataaaatcttgacaggaaaacattcttgtaaaaattaaaaaatttaggagacaataaacataagataatataaaaggccaaaatattcaagtgatactaaagatctgaaaatttttcaggcaaatgagatgatgttaaaaacactattgttgagaattgacaagtcagatagtgcagaaacacacctgcaaactgccagtgcaatcaatgtaagcttggggttcttcttttgcaggagcagctttcatcaggcccttaacatttaagccctggcgtttcagaagagcttcgagaaaattaatagaaaaaaggtcagaacattttatcaatggaaaagaaacagtgaattgacaagattgcatataataacctgcaacttttcctcttccatcctcagatgacaatttcaagtcaggtgtctgtggccactctttaaattttgacttgaacataactgtctcaaacccctcaattactttgattacatgtgtttttgttcggttatcatcagagagcaatttctgcatacacaaacaaacattaagtatgacggcaaaatagttcaagatccagaattaatttgagatatattagatgtataaaattatgtgatatatttctccagaaaaagtttatgttcttttctgggtgatctggactaagtaaccaaatttctaaaattcagcagaattattggctcatcatttcatcaatgccacaatgaaaatgcaagcatgttggaaaattctggtttcattcctccaagctttcaagcttatgtgattactggaaaaaatgcccgtgcattgcaacggaagaaaacatgagaaatttaagaaaaggttaagaaaaatttacattatgtaattaattaaaatataaaatcacaactatacatgtatacgatgttgaagaaaagaaaggctcgtaaaaatcaaggtaaatgtggaaaaataaaattttccaaataaactatggctggatttattttttattaaattctccatgattaattacactatgtgaaatttttccgatattttcagagcaccattgctaattttaataatacaaacatcattttagcatttatttaaatggaaatctaaatgaaaaccctcctttctccctgggccattttgagcccattctttctttagcccgtagctgagccggcccattaacctcacttctcctcccttccacctcggcctgcaagcgcgcatccagcccatcaagcaaccacaaagtctaatcagcatcccttctcctcctctcactgtcgcgtgggtcccagtgctacagggtcgtcccctacctccgtccgactccgcagcttcccaacaccgccggaaaccgccccctccatgaaatccgttcgcatccacggagataatccaaaattgattgaggggttttgatccttatctctttctctttccctttttccaagaattagagcaaaatcgcatcatatcgacctcggaatcaagccatatagcaaaccacctagagttgtccgtttcgcgtacggggagagaatcggactggcgcctccagggacgacgtaccaaaaaagttggcaaaaacatcttaaacttttataataggtaaagataaagatatttctgtttcacaagaatgtgatgacattacataagtatttcttgaaagaagaacatgttacctcagcagcttcactggcactcttcctctcctgcaaagatgtggttctgcccatccaaacaaataattcgacaccacaatctaacaagtaacacttatttgtcttgagcaactcgtgcaataaggattcataattgataggctccaactttccttggttaaaactgaaaagatgcatttcataaatattgactgacctcaagtgaaaattgttgtcttcaacaaatgaacacagggtttgtatataaatagcacatttccaattaattaccagagcaatttgaaaacagtttcttcatatttctcattatcttctacaggggctctccttggtagaggggcaaagccaccaaaaaaaccccaaaattcaccagcttcagcatcggccatcaacctgccatcctctatgaaaaaagtacaatcaaacatatgcggaaaatatcattgttccagtactatgaacacacaaggacctgaaatagaataacttaccaacagctgcaacttcacacttgccctcgtgaaatgtatctttgatgtactgcacgacttcaagagcctttgcacgctcttgaatagacgaattggagccattgaactggaaaattttggacttcgtgtccagaataaatatgtcatcatgattcagggacgatcgagcaaaaggaacctagtaattgaatagaaagtctgatcaagacatgaatagaaagcccctttctgaagaagaaaacagttatctagatagcttgcctctttgacatgaacaacacgattccctgtacagacatacagacgggtttcgtgctcctgctcattgacctcaacatgcttgaacccagatgccactcctcctggctgtggcatgatgcatggtctaaaatatgagaggaacttatctgtttcattgccttgtatctctcggtattgaacagcgcgtccaccaagtgcagcatcaagctcaactgttaaaattgctgcagttccagattcatcctaccatgcatagaattggtttcaacaaacttttgaagaactgaaagtctgcatcatctaattatgagaattttacctgactagtatctttgccaatccagtaatgaatgtcatgtcgaagagaaccatttttcaaggcagttgtctaggaagaaaaaaagagcacgatgaaacattattacattgattgagaattatgcagcaaagcatttccctttttccatgagaattagatgcaaaacagtaaatttcagaagatagtttatgtcataatatggtaataagagatttagagctgtggtgtcagagaaaatttaagaaactatttcagtttcctaaaaccatgagagaacagtacatatgaatgaaactgtcatattgcagtaacatgggggcaaacacttgggagctttttatgaggcttgctagatactccctccgtcccataatataagggattttgagtttttgcttgtaacgtttgaccactcgtcttattcaaaattttttgaaattattaattattttatttgtgacttactttattatctatagtactttaagcacaacttttcattttttatatttgcaaaaaaaatttgaataagacgagtggtcaaacgttacaagcaaaaactgaaaatcccttatattgtgggacggagggagtaccatgaaaatgctaaacaattttgccatgtaaaacaggcgaacatttatatggttgagcaagctatagaataagcataaatttatactctataactgaacatggatagactattttaggcaaaagactaatgatatgaataagaggacaaaagagaggatgatatatggattatgagttatgacaccatataatatgtacttggataccttcaagatgatgtaagaatcacccatgaaaaattttccatatgaagacgcaggaataggaactggcttgaagttctcgatgcgccatatttccaagcctctgtagtgtattaaggataatcgtggctttgtacattgattggactaggaccaataaaatagtgaactgaacagattgtcaattgtaaatactcaaaaaagatcaagagtttaatgaatatttaaagaaaaaaaggcttctgctaaatcactacagaccctgtgatcattgttatctcattaacttctactctgctaatgctaatgtctagcatattgtcaagaagcttgcacctgtcaggatacttcatatgtgtgcacagtagcattgcaaattcatgatcatctagcaaacaaatgcattttacttgttttagcagaagtgtacaattaaattatcttcttaggaccaattaattcaacatggtagatagtgttcactcaacttatggacaaaaaacaactaaaccacaaattcagagtttcaacatgcacaaagaagttttcctggttgacttaagtaatgttatcttgcaaattaagtgacttcaatcaaggtgaagataatgaaagcaatagaggaaagtacactaaggtgaaattaaaaaaaaggatactccttttgcccagcaccacgaaaagctggatccaaatccttcatagaaaccgacatccttgatgttaaagaaacctctcaattcttctctttcacaggagagctaatagtatgctgtaaacaggggtagaaaaggtgggcagtaattaattagcaaacgaaaatgcacttggttttccttttttacgaaaattaaactagatagttcagttgttaagaaacacgaccgaagacatgccaagtattaggtattctggttatataaagaaagtcagctttgatgatacaatgtctactaacattaaagtaaggatgaaccaaaacaggcatactatcatatcactaatggtgactacatgccccatatagaatgtgaaaaatatgcagtacgccatttccgcatcgaaatacacactccaatgtattgtagaagtctgactagcacatttgcatttcacaaccaacatgaccatgggacatgaccctaagttccccaaacaatgactagaactgtcaaagcaatgcagcaagctaagaagtttgcgcttcctaagggttatgtctacacaattgaacaatgatccaattccaaatggttaagcaggcaccgagaggcacgaatctggatcaatcaatcaaatgagcactcccagtctcccaaccactaggcgccgcccgccgcgcgaggctggacagaacacagctcactgaagcatcaccaccccccaaaccattcctcccctcatagcaaccaagcttaaaacctcacgcgattagcccccacccaacccggctccatacctcccaaataaccagcaaatgcgaagctccccgccgcaactccaccccaccccccaccccctcctgaaccccgtctcctcctaccctaaccagggccgcctccccccctccgctcacctccggatacctccacgcgcatgccgccgcgataagcggcgagtccaccattagtccaccaaagctcaagcaaactatctccaaaaaaaaacaaaaaaaaaaagcaagcggcggaagatcgagagcaccgacctgggagggaggcggcggagatcggagcggggaattcgcgcgggcgaggtgggggggggaatcgatctggagcggcgagaggggaggtggagtagaggaggaagaggaagaggaagaggaaggctcgagagagaaaggaaagggaaaaagaggcaaagcgggcagacagaacagaagcgagagagagcgcaccttttgttttgcgcgttttatgctttggtccctctgattgtccctatttttgttccggtgaatccacgagtttgaggatctggatgttagatgtagctgtacctcgtgacttgtgtggcaagaggtcggtgggttttttatgctttcggactttcggtcttaaaaaataataataaataaatctaaacctaattatgtgagatcacctaattatatgtataattttttacgaatagagtattccttcgtaaaaaaaataaattagaattggaggtgaagtatgctaatattcattgtattagaatacatcacatctaattttaggtttgcttttagagacaaagttattcattatggtactgagatacgtcacatataattccaggtttttatagagaaagtatttatgttagacttttagtctatttttttatgtttatcgaatttgtagtgttgtacctcatattctagctaagtctatagtttatgaagttgatgctatatggactgtaaataatatttagtagggcctctattatatcccctaagatagaaaggcatcaaaatcacccttgactacagcccctattcttgaggctctatgccacagtccctatacactattcattagcgcagaaagacatttttcctcacctatttgttccctctcctccctaccatgcaccgtacctccgccatgctgccgccccaccgtccaacatcctcactattgccccttcacccctctttcgtcgatgcatgctagaagaatagatcgatggttcattgtcatccccaatcttcgttgtccttatcttcaagctccctagatgttgtgttgcaaccaggttccacattagccttcgagctcctccgtcctagtccgccgcaactcttttatttgtcccctatgacatcctctaccgacgccatgttgttgcttggatagacttcaaataactatgaactatgtggtgtcttaaacatttgctactcgtattttgtcattccatatttaaaagttttaaatttaaatttgagttgtggtctttgaaattgtgaatttgtatatgatcagattatatgcattagaaatatttatgttcaattattctatgttaactaataatagtaacataaagtgtatgttgatatagaagagaagaaaattgggggcttgaaaatggagacatcctagaaatgaatgctccgttggagttggaggtattttttaagtagttacttcctaggaaatatggatatcccgtaattgatttttagggctctataatgggggcttcgatcattgccaaaattttcttaccaaattaaagcattttgatatttaattaagacaatttatttggtgctatcaatttttaaaagcaaacaaattgatcaaatgatttattttctcctaatttcttctataaaaatattccctccatcccatcccaaaataaattgatttatattttttttaaatgatctattttgtttaaatgtttttatgtttttttattttattctataaatgatttaattaataagtttctataaaacctcatgcatttatttataaccagtaattagacacatagtacatgaatgatgacatactcaagagaatgagtttaacaagtgaaatttggataacttggagagtagcacacataagtaagttaattctacatcatgcctatcaacttgtgtatagagaaagttctatctcctacctattcatccatcaatactatttttctattacgagtgataatttcatattttctcttcaccattgtatgctcccttcgatgttaggaatgttcttattttgggatataattaatattgtattaaagagcaataaccagttgccctactttggatccaagcatgagccttttgtccatttccgtcatggctagtatagcattatattggaaattattgtcaatcttttgttgaaaacacttgaactcttcgatagccgtagggcctcctcaccttatatagcaaattacagtctatttttacaagttatgattatacgtctatttatctcaaatattttcaccatttactgttcatctaatttgtatacacatcgtttttatttaagaaatcattgacttgatgattggagaaaaagaatcatgagatcaaaagcaaaattatctctaaagcgaaggcactgaaagcaattttggaacaataccaaatcggtggttattggctaacttgctcagagaagttggaggatctaggttcaattttgtgcagagataaagggggtatctgaaaagcaaagctggaacggtacacggcagcaagggtggcaaatgatggactggagcgtgcgtgccactaagcaacacctacaatacagaacacacttatcttttctatcagaatatttttcaaaactgctctaaattgcaaagttaatagtatattcatcacataagtattaaactagacattttcttctttttatatattgcacatatgtgcacacgccacaacttatagtcaacattatatttcacagcatctgctgagttaactaagacttattaattctatctttccaatctagatatttttcaaaactgttttaaatcagaaatccagtcatatattaaaatgttttaaatacaaaatcggttttctcatgtttgcacacgccatggttcaagaatcaagagtcaaaacttcacggaatctgatgagttgattattaagatgtattgattttttatctatgagactatgacaggtgactttggagaattggagtacatttttaattaatttgggaatttcatttgcatttgatattcggaggatatttggggcggtgtcctgtgtctcctcattaatagtctgacctcatagagatgtaatatatatactccatgagggaaatgatagtacttaggccagtgttaatttatcatgtgctactcatgcagctgagaaagtaccacacttattagtagcactatgtactccacaagtccattgattttggaggccctgtggtacttagtttcattggaaaggaagttgggcaaatgcaaagatgcattgatcatcatttgctaatcgatcacctgttttaccagtcatatgggaccagatgacagtagggacatatatagggggacataggaaattggtttctgggttggcactttggcagatccccattctttgttctgttttgggtcctacctccacatttggttattgctttggtatgatatgaagttgatagtttgctttttcttcattacttggaaaatgtaataagtcaaaagatcgatggtcatgaatggcgatattttatatttgatctgataatatagataaggatcttttgcttctctttattagcttacgggtgtgtttgatagtagcggttgtgaacctttcctcattgcacgaaaaacagagtgatagattagcatatactcactccgtttcacaatgtaagtcattctagcatttcccatattcatattaatgttaataaatctagatagatatatatgtctagattcattaacatcaatatgaatgtggaaaatgctagaatgacttacattgtgaaatggagagagtaacaaattaaatattagctaaaaattgaaaaataaattaatataaattttaaagaaactttcctatatatctttttaataaaaaacatatcgtttagcagttcgggaagctatgaaaaaaacaaagacagtataagttcggaagaggtagtatagaacatgcaagtctattgataaattgatcggtgcatgcaacctagcaaattagggaaatatagtcacccttcttcttcacttgcttaaacttttaggtaaaccgactaatgtaatgtaagtgactttaatgttttggattacttaaagggcgatgaagttgcgcatgagtctaacaccccgcgggagcctggattgtcaagggctccttccttttgatattttgaggggttgttgagttctctacccaaatttgcccttcctaataagaaggtagtgctaatatgaccctcggcccttgatccatttaatcggtcaaaaaataaatttcacaaaacctagtatatttgtttcaagtagtacaaaactaaatgtttggaatattgcgtatcattaataaaaaacatttttttccagacgtaccaaaaatggtttttgcatgtggaactctagcctgtctatccgaaaggatatgcaaaaatcgctcttttttcatgtgggtgctttatgtcgtccgcacgcaaaaataaaaatccaaataataataaaaaaactagctccaccgtcagatcctcccgccgccgcccgcggatctggtcgtcatgggcccggtggaggcggatccgcccgtcaccgccggccgcgcccaccgcctgccgccatccatcgtcggccgcgccgcccaccgccggccgtgagagaagagtgagagaggagcgccgctcgcgacagaggagtggagagaagaaaaagaggcgagagagtttagtggaaaggaggtaagagagatgaatggataagaatgaaaaattttgaaatgttaagagggaaatgaggaggtaactcggactttaggtgattacttaagaggtccgtctgcgaaaatatattttcgtgtgtggcccattaagaggtccgcctgcaaaaataagcttatttttgcgtgcggacccttaagagacccgcttgcgaaaattgatttttccgcaaggtcctcttaagaagccgtatacgaaaatagaggacgatttttgtagatgcgactagttatggtccgtctgcaatctaaagagggtctcgtccaaaaaattcatttctgtagcagtgtataaccacatatattagtattatggttatatagtttgtcaaacattttcttaacctattgtacatttgaattctatacttatattcaaaatttgagttcgttcaatccatcgccaaaatattggagtatagccatgtaagtaaaatattttttcttatgctacaatatcgagtaaaactagttaatggtgcggttttttgaaaccttaagaccataataactgcagttatatatgtgacatgtccaaactaacaaggttcttttacaactcaagccataataatataatacatacatgtgaatctataaaatttactcaaaagaatttattgccaaaaaattggctaacaaactgtcaatttgagtctaagcatacctcctatacatgagtttgtgcctttcggtatatggaaataccatatagccaatagtatacgtgaatgtatccttttattaagaaaatacgatgaatagagaaggaaattatcttcctaaaataggaggcgttagagttatagtcgggaagataatgcctccttagtccgtatcatattctatctctccggattcttcttggagaggaagatgatgttcgatataatacaagaccctagaaggagagggaacataccaacaaaatacaagccaatacagataagagctatgaaggctgacatgagggattagagctacctgcaatctcgatgagttcatattcaaagacgaatactacactagctgtcgactacgtgtgagagctacatgatgtcaaaccgacaaaaaaaactagattaggtgatcccaaatattatactcatgtgatactgaaggtagactagattaggtcatcctaaatactgtactcatgtgataccgaggctattacctgtcagttaaggggcccgaacctatataaaattctgtctcctatctctttttaccgtaatctcgcatataccttggttacaacgacagccatactataaatacagtaggcgagtataacccgtcaatacaaaccccactaattaaaacgcaaacatttctatttcttttgaactccgcacgtctcaatttttttggagaggaaaagaactttccattaacttaaggactcagcaaaatcgctggccaccaagtcctccatgcccggaggcatactgtcccatggttcaacggtattccgaggacatttacaacccaaagctgctaaagcatgcgctactctattacatttttgtggtgcaaaaacaaagaaacaggaaaggaaactacttccaatcagctatttcgttgaatatagtattttaccaaaatttttgggaacaacatattgtaccaatttcgttgaatatagtattttaccaaaattcgtcaaaatctgtatagacctgtacgggcaataaaccaaagaaatcctttttccaaaggaaaaagtacaccgaaggtccctcaacttgtcatcgagttacaaaatcgtcccctaatcacaaaaccggatacaacgcatcccctaacttacaaaaccagtgcaaactagatccctcggtggttttgactccggttttaaccgacatgatagctgacttagcgtgggacccacgtgagccccacatgtcagcgtggccacctcagcctcctctcttccccctattctctcccttcctcctctgtccctctctctcacttcgccgaacaacggaccgatgccggcggcggtccagagcagcagtcgtgcctccgcacccaccaccgcggtggcgcccgcttctaccttcgcgcccaccgccgtggcggtcgagcggtccacgtggtggtgcgacgttgagcggcccgggacagcggcgtggcgccggtggcggtcgagcggcctgggctgccaccatcgtcgtccgtatgcaaccaatcgcaaatctggggatgaatctattgatgggagagggagacgacgaggcacgttgctgcatcaagacagagacaaggagcaccggtcaccaaggacatcgggctagcagtaggcggtggtgcatcgtgtgtgtcttttcatcactgaagtcttgtggagatgaagagttgaatacacagaagataagcgtgcgctgtggggcagcaaggacggcgtgcagctgccaccgactttcgcccccacaacgcttgtcacgctgcctcggccggcctccgccgccgctgaccgtgcgctgtaccctataggtagcctctccatgccgtccgggtcgaggtgcaccgccgccgcgtgagagccctccccatctctccttttctcgagctcggctcgccggacccgtgttgtcatcgtcgctgtcgctgtccgcttccacccaccaaacgcgtccctctccttcgacggtgggcacgtcgtgcgcgcatgcggggtgggaggaacggcgtgacaagacggacggcaaagagtatatgggcacggcggacgcgggcggctgccgatgagggaggagatgccaccggcggcggcggcggcggcgactctccgctggctagcgtccagcccgcggtgacaacgacggccgcacgccgcactcccccacacaccccgcgcgcggcgcccgacgcctccgacatgccgccgcccacgaccgcgaaccacccgtagcaacccggccctcagcccctcgtccgcctccttcgccgacgacgacgccgcccgacgcacacgcggtcgagactgcctgctagcccctgcccggttttgcagttttcaccaactcgccgggagctcgcttcggaggatgaagacgacgccgacgccgcacgcgaacgaaagcgaggtcgcagcccgcctcgctcgcctgctccgcggttctcctgcgcatgcggcgaacagctccgcggtcggggcacccgccgagtccatcgccgccgcgtggccccttctcccgtgtcgccgcgccgccgtgtcgccccttctcccgcgtccccgcgtcacctatcgccggcgccgcccagctcctcccccgctggcgccgcccagtttttacgcaccagccatccgccgcgccagccgaaccgtacccagctggccagctgctttcgtgggaggagagagaggaagagaggtggagatgggaggggaagtagaggctgacacgtgggacccatgtgggtcccatgctgagtcagctgctacgtcagttaaaaccggagtcaaaaccgtcgagggatctagttttcactggttttataagttagaggaggtattatatccggttttacggttcggagacgattttgtaactcgatgacaagctgagggaccttcggtgtactttttccttttccaaattgtaacgggccgagtgggccggaaatggcatgaacgccaacttaacgcatttccattttcgaaagaaaaaaaaaaccacacgaattcccaatttcaaacgccgatctctccgtctcgccggccaccgcaaccacccacccacccactctaccacccatggaccacgccgccgaccacctcgacccggcggcgccgccgtccgggcccgcctcctcgtccgccgccgtcgccgaggtcaacgcgtggttggcctccctcgcggcggaggccggaggggccgggggaggcggggtcggggctccgggagggcgcggcggcgtcgtcggcgtcggcggtggtggggcggcaccggagctctcgctggggcccgagcccacgccgcgcggggtggcctacctccgcgcgctggcggccgcgtcgcaggcgaggtcccgcgcggcggggatcgcggccgcggggctgcgcgcgcaggccgcggagtaccgcgccgaggcggcgcgcctgcgggaggcgctggagcgggcagggctcgcgcgggacgcgctctcgccgcccgcggccgtgtccgcgcgcgccgtggccgccgtcgccaacctcctcgccatccgcgacacggagatgagcaggtggagggggctagggttctcagtttttcttcttcttcttctgcgtgcttaattctcgaatgaataagactatttgttctgccattcgcattgccagtgagagatatgaacatctaacaagtcgatctgtttagcatatgcggttttatcctcggcattgggtgaacttcgatgaagttgtaattccagtaggcagttctgttatgcgtaatgctgttagtttagtaggccaaatagcaggaacatgtaatatgtctggagcacatgctagtttagctttcatgtttggttctaatgcagacaaaaacttagtttgggatgcattattgcaacaagaaacaaacaatttgatggtggagaacagtaatgttaggcttcatactttcatagtgagtgttctggtgattctttccttttgttttcattgttctctgattactttgaaatggtggttgtgcagctttgttgtggccagtgcggacctgtcgctgaggagagcagaggtggaggagaagagggacaaggtgcataaggaatcaaaggcgcttcttgattacacaaggaaggccatcaccaagcttactgagctcaagaagtgagtggaaaactattcactttcagtatacttaaggagatttgtgcaaccacttatatctcttgaggaaaatataatgaacaatgtatcatttgaaggatgctggaaaaatttaaaaatgatgtggagaagcaacaagcagaacagatgacggattggcagacaaagttggttatgatggactcaaaggaacgccaatatatactccaagtctccaattataaggtgactagtttttcttcttttgcaagtggtgtaatcagtatatggttttagttcttcttttgacctgatagttttggccgactaccactaaacaaagcagtttctgttgctgaagcagcatatggtgtttgctagagattgtcaactgttagaacttagaagtatatagtcagttatcatttatcaatacttgtgcttgtgagtttagcaggatgctgcaggacatgacatactattatcaagctaaccgtacaactttgaaatcatttcaatccacatatttcctgaatcttgacctgaagaggctgttgatcagatgcttatctgcgcttttatgcactctctgctctatctttgattggttttgtaagatagggcaataactgtatatagcttgtgtgtgttttgggggtagctgtgaaattgttcaatgttgaaataatgatgtatctaactaataggtagaatttggtttgaacatgcatttccatcacttgtttctgctgatgttaccgtttgctagtgacgaagttagtcatatgatgagttgaatagtttcacatcatgatctgatgttgatagtacaaacatgtgttacttctaattttaagggcttatgtgatattatactattcttgttattcttaccttaacagcttggctatctagagctatccatcccccttttagtccgattgcatgtatgccgcaacacactgttctttgatttggtaatatacaatgacacattttagattcactctccttttctatctgttaggcaatgctcaaccgagtgggatatacaccggagatcaatcatggtgtgctgatggaaatggcagagcataagaaggatctagagagaaagactaaacccattgcagacacattgagaagctaccaggacttgccaccagtatgccttttgctttctgttttgttccttttcttcagacataaatctttacttattcttggtattttttgtgactgtcatcaggacaaagctctagcagctctagctatagaggacaaaaaaagacagtatgcggcggcagagaagtatctggaagatgtgttacagtctgcattaaccacacctggcctatgatgtgtgtgtgtgtgtgtgtgtgtgtgtgtgtgtgtgtgtgtgtgttattaagtttgtaatactatttggtctgacatgccattgattgatagtgctatgcagtaatggccattgatttcttgtaagttgtaacttgattctatgatcctgtaaaatgcatgttctactgtttacctaaccacagcatatttcaccacacaaacttatttctgttgcagctactgagctaccatgtcatcgacaaccaggatgcctctgaacatcttggcctgtttgctgtatatcattttgcattgatgtctatgtgattatggatagtcatgatgattcatgggatcaattgatgctatatgctagtagattaggtaaatgtgatcatatgccatatgaacatgccatttgtctttcatctgtccttgcatctttcatagagttaaccagatttgttggctttattccaattgaattcttatgctcatattaaatgttagtactttctgcgatttctattagatgtttagcgcttcttttttccccaaataccataacaaaatgtgttctgctacaacttccagaatatttctttcaggtgaattcaggtattatttgttctctcatcttccattggctaatgatatagcttaatttgggctctttaccaagttattaaactagatattgagctgattgccgaatcaggttggttctcttgagctgcaaataaaatgagggagtaatgaagactacctatattcctgagcaaattttggactttggagacatcctgaatggtggttccatacttccaagaaataggtgggtgactttatcctgaaattgatgtgctttcacactatctgtaatactagaataattatatccatttttcttgatgcctgattattttatttctataggaattgtgtttgcactgtattttgtattcctttctagatctgccttgcctgtcgacaatacaacaatatcttattagcatgttttttattgttggagctagatgacaccatgacaaagtgagaacatctttaggaaatgttctacatgaagaaatcctatagtattaaatattcattgccaattgtgctttctagttatgttgataaatatgtaattatcttgtctatctcttcattaaaaagtgaatgctgtcttgctaacttgctatatatatattgaatcgaaagctctgttgtctgttgctatgttttctggtagacccaatagctaaaggcaattccatacagaatattcaaaattagaacactcaggtagaagctgacataaagaagctggagttgttatcaagtggacttgtgcttcccacttcccagtaggatctaaatattgcaataataatatttttcagaaattgttctttgtttgaatagatgttcttaagccctgactctgaaactcttttcagtcggcctgtaaattgggaacaatgatctgtccttcaaatgtgccttcgcctgattagcacaactggctcatgaacattaaacttggcactcggcagccatttagtgtaacatgctaacacattacaaaaaccatatttggctatagctgataggacactgcaaatctgcaatattgtgacaatttaccttgggtcactattcattataatcgcatcatttccagctgaggaagtgaatatctccctgagctctgattgaacaccatcaaaatatcatttggtttggactgaatggtggtgtggttgacctccccagttttataaatgtattgcctatattttgtattgcagtccctagcatattgtgctttgaaggcctggatgcatgattcccctggttttactctgcatagaaatgagaagtcctggttgcaaagctgtttccagtgctgcctcttagtgaaagaaggaatgctgattcccctcttgcatacaaccttacaattgaaggtcagtattacttttttttttttgctgatatgagcacaaaatagttggcttaaatttcttccattttagtgacttgcttcatatcttagcatggaagttacatggtaagcttatatttactactataaatgggccagctgacttagatttctttgatttaagtagtttgctgcataaatggattatttgacttttcgttggcactactaatagttaaatttgtcattctctattaatccagctcagctcattgtgtttttttagtgtaatgtttttgatattctgggatcaatatatgggtgcgaaggggtttgattcttttttgattattttcctcaaacaaatgtgcaaaagaaaaaaaaaactcagctaccctttctatcagctaactgaaatacttctactgtgacccgcactctgggggatacccatttgggtacctccttgagtcagtgcagtaatcataaatcttgtagttatcatctacgtccttaagtttctgcttcccttcctcatccaaatcctgggtaaaccagctgctgtcattagacccttggctgcaaatccaggcagttttgtacggaatgcaggcgttagcttggtagttccggaagaatgcggtaaatggtgcttgagaccagtcggttttgatacgcccaccctgcgttgcccagtcatcggcatcccagatgctggcgtacagcctcattggttgatatagcgggaagggtatatcattccttagctgattcttcatctgccgaattggtgtgccatcaacaagtattctgcaacaacagaccaaacaaattaatttatgcttagctctaataaagaatacaccttcctagctgtgataaaacctttccacaatcgcttacgtataggacggtattacccaaatgaggactattaatgctgcatatataagaactgatgactctaggaagagaggtaacttacaagatcatctgcgggttccagatgatggtgtaggtatggaagtcttctgttggatcaaaccaaagccggtactgcttttctcggccacctgttcctctggcatagatgttagtgtgcaaggtgtagggctcaccggtggtgttccccaagaactcgagatcaatctcatcatgtatgtcccacagcccctcagttatcatctattcccaagttccggtacaaaggaatggttagtctaaggattcaaggtatattgcagtagcatcacttgtttcttacttacatataatgtggtgacagtgccggctgagtccttggcaacaagcttgatgtccatgtcaatcctcgcaaagagatacttagtctttgagcggaatgcagaagtagtccagcggtcaagggacagtgatacaatttggtggccagtgctgtcatagagcacctgtgtattgccccacagcatgtcaaggctgtcggtcatgtcgctgattactggggaggtggctaggatgagatacaaagctgccatggacatggagggtaggagttgagccctaggttgccccatggcttttgctaatgcgaagtgcctaagtgagtaggcagactgtggagtgtgctgtgttgaaatgttgtagactttatatagactcatgtgaagaggaaaccaggtgttcaagtctaaacaagatctaggtctgacatactattaccttagattcttggaaggtgtatgaactggacatcattggctgacatgaagaagtgggcataaaaaaaatgataaaaattggcctgaaccatagcttgagcaggaatgatccagcctggattctgtagtctggagttgacttactggttctgtcatccaaccaatttgcaagccgccccatggtggcttctgacgaactcacctggccttaagcaagttgaaagcttatggtttagagggttttagccaccatgcagtgcagttcttgtaggtaaattactagatgaactcaattatgaaatatgtgctcagttatggtctagaggtttttggtcgccacacagtgcagttcttgtaggtgaaattactagttgaactcaattatgaaatatgtacatagttataaagcatctggagaattgctagctttatgcagtcctgccacattgatctgtttacttttcatcaaatgctgattttcctcttcatggatgttcgtgatgagggatcgaactgcaactattttttgtggtcgattacattggtccatcaatgacttccataaagaatgaaattatccagatgtaaacagacatttaataagtgatgcttatctttgttaaacaactcaaattatgtgcaagtcagacaagcaagtgacctgtaaacacaaggccatctagtcatgcacactgaagtcccactgggaatttcacacttcacacgtatttgtaaggtcattgtgtcagtgcactgctgcttataggctagtttgtacataactatcttgaattccactgtctaaaaattcctataatactatttgatacacaggccttagttgacattgtaacaacggaagtcgtacctagttatttaacgttgtttgtgttgatagccgtgatactggcacgaatgtgcaggcattgtgagctgtaattttcgatatatgcaacaatagagtactaattctttatccctaataaacggtgcctgtgtttttaatactttatgtttctaggcagtcacatagagattgctttgattcaggttctgtttggcattgcagtggactatgagttttggttcaactgcttttatacattttggtgcttgtaaactgtcttctgtttcaatctaatctcaaatgataatatatagtgctatgcaaatatgaataaaaaaaagagtcatgacagattgataaatattttgtttagctttcatttgattcataaacaaaactacaaccgttttagatttatttttctacagcaacttttagaaaagggaaaaatatgcacagtgcaatatagcacaacaaccacgaattgagcctcaatactttgtagtttggattaacacctttcttaggggccatgttcaacttttgaaatgtttattcagttgatatgtgatagagtgggcaatgcagtaggctgttgatactctgagactctgggcatgcagaaaaaaattgcgatgacatttttatttgagtaaatttcacaagactacatgtgctttgtacaatctatcacaaaactgcagacttagtgtctccattatcacaaaactacatggtttaaccttgcccgttagatgcaccagcacctttgtgcgggacccacctgcagtctccggaaactacagaagtacatatttactcaaagcatccacatgctgatcaggtcaaagcatccgtgcagaggtaacacaaaagcatgtaggcgcatatagctaacacttgattatagaagcatcaaaatgcagaaatctaatacctaattactgatcgcttcatgagacttcaggtgggtcccaaacatcaggtgtcaatgcgtgtaatgggtaaggctaaaactgtagttttgtgataacggagacactcaatctgtagttttataagacaagttcttaaatttgtagtactgtgatagactagcataatacctgtgagttgcaacagatatcttttaagaaaaatagctcatcgtatatattctaaagcccacaataattgttcttattgcctaatattatcatcatgttacttttgcagtcactttctaggtgtctattgagctagagttctcagggtctgtggccttgggggttgggaaataggcaaagtctccctgtttatgggtcccacatggttattgggtacttgggtggtgattcaccaccactaccactaccatcttttacattagcacagatatagattgtgcaaagtacctgttgtcttgtgaaatttaatcattttcttttatggcagcctccttatgcacattatcctactgacatgtgggcccagacccaccttgtgagttgtgagtgatgcaacaaatgatttgcaaatttaagtttgcatttatgtagttatatttgtgagtgatacacaaatgatttgcaaatttaagcatgcatttatgtaattatattttttagtttatatagaagtaacacttggggtaatatggaaagaacaagataagttatacattgggtctggaactctaaataacaataagcaactttttattgagcaggttgaggatggaattgtatttctcacattaatattaaatgttaactactaatctttttgtgataaataggtttattgccaagtactgacatggtgatggtagtttggcactgctgcaatggactccagtgtaaaggaattggtgggatgatatctgctcattccaccactcttctgttatcaaaagcatacccataagtccagagatgctgtgattcagaaggaaggcatgggaggatgcacagagccaattgatacttgatagttgatactacctccgtccctaaatatttgatgccgttgacttttctaaacatgtttgaccgttcgtcttattcaaaaaatttaagtaattattaattatttttctatcttttgattcattgttaaatatactactagtactcaagtttttaaataatattcacaaaagtttttgaataagacgaacggtcaaacatatttaaaaatatcaacgacgtcaaatatttagggacagagggagtactacgtaaaggtaattaccacaatgttcggtcacgtgggttctgtgtgatgtgttactgcaggttgacaagattagaaaaggctataggggatgcagaaattatttagtttttaaagtatttcttagaggatcttggtagtaccttattgcccagggttactagctatatatgtggattagagagttgcgaggataacatgtaaaattattcaataccctgggatatatttattggtgcaaagtttaccttttatgagggcacttagatattcatcctcaaccagctacaattttcactagctgaatttctagccacaccttaatttctggaattagagatggagctctatagctcagcaggatctaattgtaacacacatttgcttccagaaatgatatgaatattgtgaatctttttactgatgaattcatgcgctttaaacttgaatcctttactgccatgctcactctccacatcaagaaaatggtaaccttcatggtcagatattatttttctgtagtgttgatatcaaagcatattattagaggacaagaacaaggcttaaatatttgttctggatacaaagtcctctgaaacacgctacttcctctgataataaggaatgagatgtgttttgcattcaatatctttgtggcaatacattgaagcacagcaaacaaggggtctaactgaaaactgctgtatttccaggttgatcttaccagttacatgtgaggtatgtaagtaatcaagcataatatttagtgatgcaaacacaaatgattttataccatgttattcatataacatccttcatatcttgtttgcaaattgcataattgtgtttatattttacactgacatctatgagttgactggcttttaattgcaactatttgcaaatgtttcagttagccttcacataattaacactagcttgactagaaagcctttacatagttagctcactgcacatgagttgctgatcatatttcatttgctatatgtacagccaacaatttattttcattttaaagtagagtgcttccctgatgcttcttgtaataaggaagatttaggtttcttctgtaagaatgcaatggacaatacatttgttatactgttcatacttggaaagaatgaaccgaatcatccaatacacctctcaccctttctatctgctaattgaattacttctagtttatcgtacactctttggggagattatctttgaacctcttggtgtcagtgcagtaatcgtagatcttgtagttggcatccacctcctgtagttgctgtttccgtgtcacgtccagctcctggttgaaccaatttccggagctctggccgcagagtggggagctctgttgtggggggcaagcgatagccctgtagttccggaagtatgctgtgaatggcgcctgcgaccagtcagtcttcacccgccctcccattgttgcccagtcatcggcattccagatgctgccatataccctcattggctgataggttgggtacgggacactgtacatcaaattgttcttgatctgccggatcagcttgtcatcaacaaggattctgcaacccaacagcattcttattgttaaggtttgtgcctttcaaataaatgggctgcataagatgattttcttgatactattttttctttctttctactacctccttttcatatgtcgctttgatttttttttctatgttaaacttcttttaactttgactaaatttatagaaaaatataacaatatttttaacataaaacaagaaactatcaaaatatatttaaaatgttagatttaataaaactaatttggtgctctaaatattcctatatttttctataaacttggtaaaactttcaaaaagttttgacttaaaaaaatcaaagcgacttataatacgaaaccgagggagtaacatttatttgccatgtagtattgcttatcaaataattgtgaaactggtactaattctgcacaatataagtttaactggataggttgggggagcttacaggatatttctttggttccagatgatggtgtaggtatggaagtctgcagtgggatcaaaccagagcttgtaccgcttctctctgccacctttccctctggcatacaggttagtgtgcagggtgtacggctcgccagtggagttccccaagaactcaaggtcaatctcgtcgtggaattgccataggccctctgttatcatctgttccaagatcgcaacacaagagaatggttagtctaaaagatctgcaagtgacaccaatgctaatacagtaatctgttcattccctggccacttacataaagagtagtcacggttccagctgagtctccagcaacgagcttgatgtccatgtcgatcctactgaagaggtatgtgctcttcgaccggaatgcggaggtcgtccagcggtcaagagtcagtgagatagtctgtttgccggagttgtcatagaacacctttgagtttccccacagtatgtcgaggtcattggtgaggtcgccagtgaccatggagattgctaggatgaggtagaaagcccacagggaggctaggaggtgagccctagcctgccccatggcttttggtggtatgggagagtgagcagagtgagtgggtgtgctgtgtctcaaatggtgtgccctttatagactgaggtgaagggagacttggttgtgcgagcgcgtctaaacaactaaacaatatctagcttgccagtgactttgattcttggaagatgtaagaaactgaagagaatcgtctggctgctgaataagttgtgtaaaaaatggtgatgaaagtggcttccattaaagccagaatggtgatcaagttgactaactggttctagggttcgatcttggctccaaatctgcgagccgtcccacggggtcttctgacaagctaaggtggttctcaagcaagttgctgaaggcttatgttatgatgacaaaagagttttaggatccctttggccattgtggtgcaatctgtcactagatccacataaaaggtaattattagttcagctataaggcatctaatcttgcttgctggtttctcatgttatatgacatctactaggttgtgaaaggctggaagtacacaaaaatgatatgcagttacaagttgtttccagtcaatgccttcggaacagttaccaatgatttgctgttgttcaactcagtccctcattattgtcaggtttgtgcagctccaatagatatcagtcgttcctcagaggaatctttcaaaggagttactcctgactggtggattaatttgattgatctgatggtttttgtgtagaccgacactctggtctagaaacccaactaatgcaagtgacgcggtgaactgttcttccatagacaaattgatctgcaagtcagaaagggtaagtcagttgtggattacgaggtgatgcataccaaaattccaccagtaaattcagacctccaagtttcagactaagccctatgtgcggctgtgcactcatattcttttttcatggatgctcatgggaacaaaaccccagaacttgtgctataaacaatttgcaaatttataacggtacatcttagtacaagttcatcacatatccgtactttgagaagctcaaatgttgtcttgggacaaagtcaactggatttgctttaaatgatcgtaaaaatgtcaacatagcacttgtttgagttaaatctgatgtttgcttttgtatttttcccaaattgaaacaaatcttttgcgcttactgcatcctgccgtaccactcatgtttaagttgtctgatttttatctgtattttctgaataaatataattctcatatacatttttgttctccaggatggtaatgatactaatgaagtatggaattaatcactgaagttgttggggctttgattaattgctggacaaattatactactgaattcaagtaaaaagaaaactataccactgaaattacaccaagcatctggtgagtgatcgcatcaatttatcaattcttttcatgtgtttctacaatctctgacaaaagctacatacatctctgcatcttattcatggatcagcatttcttcattccatcttctggaatttggcgcaggatgccagtatttttcacttgccagtttgtcattcttacagatcttgcgttgactccacttacagtcagtgtgccattttattttaaccacatgtctgtgtagaagaccgtgaagcttgcagcttgcaggggcttgcagtattaaccaaattaacatggcacatgggccgtaatttctcgatgtacgtatttcctacctcctctagttaatggctactgtttttttatatgtgtgagatcgcatcgattcatgctgctgtgatttggattagtaaaaggcattttgatcaggttcgtttctggctttgcaaatgtctaggcacatgagagttgtcggcgtcatttctgtcaatggaagatggcaccggcggtgcttccggtgccaagcttggcatgtgtacgtaccgtatgctcagaggtaaaggaaactgcgtcttagcttccctttgtttaatacggctcttctcggaatttattccttgggttttatgatatgcttgataggggaaaaattactttcaaacaatattggatatgagcatgatttgccaagggatttaacgagtgaagggcgaggtcggttatgtctggtacccgagagttttcactccctctgttatttttttatttatcgtttaatttgcagatcgacaaatcgtttaattcacgtgtttgatcagtatatttttacgtgataaaaaagacattttaaacacagaattactaaactgctttttgaggtctgtcttccactcttcatacatgatgactacgtattgtgagtcagaaatatcttttggttttcggtcgaagcccagggcggtccatcgaaaaaagctgggccatggtcttgattcttttttgggctgttctgctcctgcacgatttgagtcttggccaacacaggctacggccattttaggtctctcaattaaggctacatccatagtccattttaggaggtttttacctgtatgccattaagaaagatggtgcttgtctctgtgccactaaaaagttcgagcctccctctatgccatcgttgaactttactgcgctctccacaccattccgtcactattttgttaaggttcacctatttggcagctctgacatgtgggggctcgcgtgtgggagggtaaccaaggacagcctaccaaaccctctctacctcatccaccaccacgtccaatccttcggtccttccaccctatccgtgaggacaagctcggccgccgcgtccccgccatcaacgcggtaccggcgacggaggagccagccgacaacgcagcgatgctccatccgttgtagcatcctctcaccaagctcacgccgccgtggcgcccagaagctgctaccagcgctaactttccccaccaccatggcggtcaccgcgcatgctccgctccgtgtggcgggctcgcccgtcgccgctggcgctctgctccgccgccactgctctgctcgccgaggccaccctctctctcgcaatggcggcagcatcatcaatgtcatggcttcctattcgactatgcgccaaccgccacagtgcctgcctctacttccatgcccaccgctgtggcgccatctgctcccggctcgccattgccacgtcaccccttctccagtttcgccgcgccaccgcaccgcccgtcgccgcccgctctttcccacctcaccccaccaaccctatgaggagaataatgagaaagatagagaggaggaagggagagaagaggggaaatagatgacgacgatgtggtgaccctgatgtgtggggcccatgttgagtcagctgccacgtcggataaaaccggagtcaaaaccgtcgagggacctagtttttactggttttgtaagttggaggatgtgttgtatccggtgttgcggttgggggacgattttgtaactcgatgataagttgagggagcttcggtgtacttatccacaaaaaaaaaaaaccaggcgtgaactgggcctgcagcagcttgggctcgatgcccaggctgcggacgatgggaaaaaaaccaggcgtgaagagagaagcccaacccgtggcttatgggacgatgggaaactggagccctcgatctctccccctcaccttgtcgcttcctcctcccccgacgccgccgcttccccaattccggctccggcggcgagcagcaggctgcggacgcgccgtcgaagctccaggaggatgtggatctccggtgtagtctccgtggcatgcctacatcggcggcgcgaatattcagcaccggcttagatcgatggcgcccctcgccgccgggcttccgtggagagcaggtatgcttccgcctctactcctaggtcggtctgcgccgctgttctttggctccgactgaatccatccaacaattagttttgtaccatatcgccgattctgagacaacacgacctgtttattagctcgatttgattccattccatcgccaccccagaggcacccaccccgactgcaatgggcagcggtagggcgtgtatccgcactaccgtttcagctgcaaaaaaaaaaaaaaagcagtgaaaagatcccctactggggcacggcaggcgaccccctgccaaaaagatgccctatagaggcacacagtcgggtctctcggtggaggcagcgctagacactagcgcttggctttttgaaatttgtaacattagatttttttcccctgttgaactcatagctactcatgggataattgaaccaattgcaaaaatagttcgattacttcgtaacactcctccatatacaacatactccatgcgcacaataatctgaaaaccgtttcataagcagagagagaagcttaatgtcttcaaacattattaagatagggtaggagaggagatgtgatagtatatagactgatcatccaataatttcagtagatgtttgactgaaacatccaatattttcagcgagttgtctgaagatgtgaataccaaggttccaaatgactagcggcaagatcaggtatgtgcagacgacctccgagactgaaccaaactcatccaggcatggaatgcggaaaaaaaatagaccatagctcatctcggcatgaatgaagaatctcacattttgaagagtctttttgatgctcagggattcatgtaagcaattatttcttatccctaacacaaataatttgtctcggcttttgtttctgaaaatgatattttttttccatttttctcagagtgcaattaatcacgatgccataatgcatgctaatgatgaccagaagcttgacgccaatcggaagtcatgatagttttttttggttgctagttcgactggtaagagctggtgctgccgagacaccatcctcagtgttcttgaagtttaagtcaacactcaataggcattggtttatttagttcttctcagccatcagaaacttcaaatagcagggccaaagtctgcaaacttttaggtaggatgcacttagaacatctcttgcatattcgctacaaagaaaaagatgatctagggactagcttctaatcacacaccaagtttatcatagaaaggtcatgcatcaagctcttctactaggaacattatcatgcaacctcaagtcctaatttaccaatatgcaccttcaggcttcagccagctcaacaagcattaaccaggcattttaagaactccattatgtccaaggatatgctgctatttaagaatctgctgaaggaaatagcaatgttgcaaagatgcaaaaatgatgcaacatggatgctcaaaccttactaccagtaattttagctgtacttgagtggaacaatatttggctaggtctggtgtgctgcataaattagtttcattcagataggacatgcaaattagagatagggggaatgtttccaacatctttttgaaaccttttggcattgctgactgattctttttgtaagaaaggaacaaatctgaaacaagagcatgttaggtgacatgtggcaaatagatgaatacaaacatttatcaccggaaggattggtggcgatttttttttttcaaaacaaacttgtgggaggactgcggcaattcgttcttcccccaacttgtagtgttatacacgaaacatgataggcatgttgaagcatgaaaatacgtccttcacactttgttttttcctcattttttagatttccagctgcaacaaatttggtgcaaaattgcttatggggacctggttggactggtgaaaggaagctcaaacaacaatctttatttaattttcgtttgctttgagacaggaagaagtaactgaaataactattccctccgtactcgtaaaggaaattgtgttggacagcgacacggtctccaaaacacaactttgacttcttgtttctataaaaatatttattgaaaagtgatatatgtatacttttatgaaagtattttttatgacaaatctattcatataatttttacattttcaaactcaacaacttgagagttattcatgatttatatttcgaaagtttgacttaaacattgtcctaaacgacttctaatacgaacgagtatggagggagtacttgactaataccaacatttctttatcatttaatttttttttgtcttgattgccaatgcagggccttgttattcagctttgatgtttcgtgtgttcgtttcacctatttcctattttacattttcctgatactatattatcatcgaccttgttgtctagcaccaattctatagccaaattttggtctgcatttcaatcacttgggttcaatcacttgaccagattacgccattgacttttatgaaataacgtttgattatttgtcttatttaaaaatttggtataaatatgctaaagaataagtcatactgatacggtatcatctatttaaaaatgagagtactatgatacgatgaggttttctgcttcgaacatcagatgctagatgacagtagatgctagatgacagtggaaacccttacggatgttaattttctatgcccttgtttagttccaaaatttggtataaatatgctaaaaaatacctgtgcgttgcaacgggtgaaggctattttaattttattattgttatatggtttagttaaaatggaattcactgtgagagttaggttggatatatatatttttagaaaatcatgagctgcagttaagagtagttagcatgcgagttcttttttaaatagatttcttatatgatttcttctgtattactaaaagcataacaataataaaccatataacaataataagattaaaatagatttcatccgttgccacgtacgggtattttttctagtaatatgtataataggtaaagaaatacaaatattacatatttaactggtgaatcaccaaagaaaataatgaatacagttaaaagtggcttagtgaaaagggtacacaacacaaacgttacatgaaaaacgcatgggttgataaaattatcaaattcatcataaatcatgtacaggatcttctcccgtttatttataccaaaaagcagagaatacaacagaaaaaaaaatcattaactatttagctgggaaggagcaggaccggccaggcaggaagaagcccaagaggcctagggcgatgggcagatggcccagctggtaaaaaaaaaaaaattcaggactcacgagcgcttcctcggtcagatgcagaacagcgcctgtacatctccgtctccgagcgacgtgcggcaaccaagccgacgcgacgatggataaaaaatgggacaacgtacgaaaatttgagggcaaaaacaccttgcataaattaagttgcaacaaaataaataatatttatataattttttaataagacaaatgatcagacaaaaatcaaccaacggtatcatctatttaaaaatgagagtactatgatatgacgaggttttctgcttcgaacatcagatgctagatgacagtgaaaacccctacagatgttaattttagttctaaaatttttcttcaaacttttaacatttccatcacatcaaaacttttctacacgcataaacttcttaacttttttgtcacatcgttttaattttaataaaacttctaattttagcatgaactctacacaccctatgtctacccgtgttgctagtcgtcctggttttcttgtacgtcaaagaagtgctgctagtcattaatgattgaccccctatgttgcagttactgtttggaaagtcgtacctcatcatgctcaaatgttctgcagtgtacaaagtagtgtatgaatgcagttctctactactatcacagctcatgtgaaatgggactccagctgagaaatgcaggacatggaacttcgattcattgcataagccctgcatagatatttttcaaaagatttattcatgatgggcctccctaataaagcagcggacggtcctagagacacatggcagaaatatcttactatatactagtatttagcaagtaaaaaaaatgcatttaactttgtgttcgttcaataattaaggagacgactacacgtcggacatccggagatttgtaaaactccggacggtgtttcactacgtgttaaagagatgtcgcaatgtttcattgtttcaaaaaaaatgtttcaccatattttgcaaaacgtcggacgttattgcacgaaatgtttcacatgttacaccactcgatgaaaaatgtttcaccaattaaaggaaaatgtttcatcgcttgaacgaaattgtttcaaccaaatacaacattcgaaacacaccaattgcaacacgaagaattgatatatgcaacatcaaatcaaaagaaaacgaaacaccttaataaaataaagtgcaatagagataaataataggctgcaacatcgttaaaaatccaaacaaaaatgaacccacctttgttttcttcatctactccatccgccgaaatcaagttaatgatgcagcatgggagaggtaatggctagggaagaacacatatgagcagcctcgtgagaggagtgaccttagccagggccaccacatctgatccacgccgatggcaagtccagtgtctccctccccgacatcctcacgttctgccctcctgctgccgctattgtgtgggcaccggcgaggtcagcatcttcttgctatcttgcatcaccttgccctgccgctgcagccatggatgcctccgctatggaagaggtgaataccgtaccgaggaggaggaggatgcgaggatgtggtggcaacaggagcacgcgacggggaggaggaggaggaggaggaagaagcaaggcatgaagagagccaagaacacaagcaagcgaagagccgtgtgctcgatggctggaagtttcgaggaaggagggagagcgagaggaaaaaagttaatagaaaagatgtggaggagaaggtagttggagttttggataaggatgaagccgtccgatatttcacatgcgctcggacgtacgtcggaaagcatttttgaataattaaccctaggaactgtaccatttcaacaaactaagacaataatttggggagggataagtcagacttttcccaaatccaaatgataaatgactgattggagggacatcaaagaaatgtaatcctatggcaagtaaaaaaaaagaaatgtaatcctagatattattttcccctgtggctgtgttgagaagagtttaagattataagaaaaaaactgattgaatagttaagtttctaataaactagaaaagttagatttcataccttcttgcttcttgtttattttctgaattttataacatagattctaattaggttacgttctttagtctactttccctaacttcactttcctcgtttttctaaatggcgtgttttttttaaaaaaatttctgtagaagagttgcattaaaaacttcatattattactagccacattcgtcacccattgcgcgactatcatgacttttttcaatctctatatgtggactatggcatatgccactaagaaggactatggcatcctctatgtttgtcgtcaattttacattcatatgttgaataaattttacaacatttaatataacctaccagtgcatttgttatagtaaattcattttttactatattcaccttgttgcaaaccccgaagctaagagtttgtttatagataactttgtacttattgtatataaattttacaaaaagaattatattattgtatataaattttacaaaagaatcacatgtttaaggttattcataataattgcaagaaatataccacaaagccatgaatgcattatgaatgggttttcaatttttgtgtttgtaaatgattgagaaatgatattaatatgcatccgttgacatgtttaatatcttaaaaccattttttatttggtaaattattaaaagtggtattaagaaaagtaatctgtctagagtggtaattatctttcataaattagaaactcgcatataaattatctcttaccgtaggtaatttaccatgggcattaagattacaaatttaatcatgtttttccatttgaatcataatttacttgaatatatatatatttttcttcttttattcaatataattttgatcctcctatcttttacctttgttatatctcctattctatttttgataatcatgttattgcattgcaattatatttttcatattttcaaatattttactctcaattataaaataaccagtgtcaactcagtctctaatgcgttaataaaataaaaacccttaaattaactaacttcctttctgatcaaattacatcatgtgtaaacccaatagctacggtctatataatagtaacaggaagcttagtacgtggcctttttttttccatttgactataggtctgctactatgcttcctttctctagatcctttcccaagacctgaaccctgacctgggtcatcttttactgtccaatcctcactctagatccgacgttatctattgaatgcatgttgcatccaacggctctgattattctgatgacgtggcaaattgtgatgatgagaccacttatggagaaaccatctttactcccggttggaaacccccatttaatcccggttttccaaccggaagtaaggatccaggactaaagatgtctctgttaaaataaccgggactaaagatacatctttagtcccagttggtaccaacaactgggactaaagagaggggatctttagtcccggttgatgttaccaaccgggactaaagagacaatagcggcagtaccagatggtcgccttttctttttcttttttcctttttattttctctcgaatcaagtaggcaaatccccaaatcaatcccccaatcaaagcaacatcccaaattcatatcaccaaatacacatcacaaatcataaagttacttatacacacaaatcaaatacatcacaatatcctaaaaaattactcaaatacatcacagatccaaacaatgaatcacaaatttgtatatctcagtgaatcacaatttttttttaaaaaaacaatgccgctgctaccaccactcgccacgaccgccgggcgcggctcaccgcccgccacggccgcggccccgccgactgccgcccaccacggccgccgtcgaccgcc

SEQ ID NO: 83002 - DNA, 32568 bp, Oryza sativa
gccgccgccacaaagacgacgaagaagaacgccaccaccgccgccgccgccgaccaccacacgcggcggcaccgctcaccggaacacggcattgccatggaatattaattcttcaattgattcttcctgatcttcttgttcttgttcttgttcttgctgttgctattcgatttcgagcggaattgtatttataataaccaatcgagaacaggttgatcatcgagaagatgatagaatttgcaggaacatgcgaggcatgttcgtggggaatgtttgagataggggacatggcatgttaggattcatggggatgtcaggctggccaaacactgcaataatctgcatgcatgttgcctcgcctggaatgcatttggatgatgaacacagttgaacacacacgctggtggctcgtgcatgcaggagttcgatcaagagcttaaaagaaaaataaaaaagaacttccatggcgagcgacgaagaacacaccgttgacctagctacctaccaaatgccatgcaacctaacaaccttcatgctgcatgcacgcttaattattggctagttaagcaagtggctaattaatagcctgtgccatgtttcttgtcgaaaaatagcaaagtgtcacatggagaacattgctgattagctagctaggtacagtacacactcgtatggtttcagttcagttgatgggagccaagaaagagagaaacaaaaatgggggttgacttgttattttggagttacctatatctggcagtcagatgtcctaaaacacctgcggtctgcagatgtgcagtagataggaacaattaacttatttttgctagtttggataagcattagaaactctccaacgtgtgacaagtgatgcttagtctatcccaaattaattttcataaatactactcactttgtaaaattatgggtaggattttattattattttttttggaaagttaattcacgtgttccaaaggaggcagcgcaggaggaatcgaagcactccaaatgtcaaactgttgagttagagcctgtttgtatcgttaccctacaaaaaaaaattggtagtgcgccctaaacaagtgataaatttgtacagttaaaagtagaaaattttgacttaattagcacacaactaagaccctctttattcaagtttagacttttaagttagatttttagcttatgtgttttataagcgaatggatatgaaatcttaagtttaatgatggagtcgtacctccaccttgcataaactaaaaaatgcttcttcaatataccttttaacgtaacagtgtaagaatggttcatggctttcaaaaaatcaaactaaaaagttgcttgtttgtttaagtttaatccttttacctcataaactagaaggctgattgtttgtgctgctttgcagtcagctacagctatagttggccataaggcccgaggcccgaaggcccggcccacggcacgcctttttggcccggcccaagcacggcacggcccgacttgggtcaggcccgtgctggcccggcccgaccgtcgggccgtgcctgggcctccccaccggcacgctgggctggcccggcacggtcgggccggcccggcacgatgggccggcaggccaggcccggtacataaagtatagggactaaaaatagacatataaatgtaactgtctaaagaatagggaccttaaatagacttattttagctatttatataccccagcccaaagaagagggaggtaaaatagactttttgtagctgtacatatgtcacagcccaataggagggaggaaatttagacttattctgaggaaaagcacgacggcccatcgtgccttcgggccggcccggcacggcccgaggcgtgttgggtcgtgcctgggccgtgagtccggcacgtgggctggcacggcacggcccggtgcgtcggtcgggccgtgccggcccgacaagctcggcccaggcacggccgggcctgggccgtgccgtgccgggcggcccacatggccaactatagctacagccggggctatgttgcatgtacagtgcaaacagtaaaagaaattgtgttgggcaggggtggattcaacgtgggggtgggggccttgagttcccccaccctctctggacctatggacaacccccaccctatgccctcttcaaaaatttcgccatggatgatagagtaggaggtgcgctaggtatctggatagctagaggttgaaaaagcgtgaaattgggccgatgaatgcatttgggccaggctcacttagaaaaggaatccccttaaaaaggaataaatccactttgactccctgaaatttaacccaaatttaatgcatgaccctcaaccgcaaaaccagatatcttgacccctaaactattaaaacctgtgcaatttaactcccttggcggttttgctgacgtggtgcctacgtggcaatgttgactggtatgtggcattgacgtggcgcttaggtggtatttgaattaaaaacttatatgtgggacccatttgtcattaaaaaaattttgtggggcccacatatcatcctctctttctttctctttctctccccttcggtcgtccgcacggagcacgggctggagcggcggcgggcgggaccagagtggtggtggtcagcgggagttgaagcgacagcggtgggttggagctgaagcgggtggaggcagaggagaagaaggcggcattggactacaaggtcgcacctcctcgcggtggcagaggaggaggagaaggaggcggtcccacgccatctgctcggatgtccccctggtaccctcgggccacactagtgcccagctcttggcccgccgaagctgtcaaccgccgcccccctcgatctcgttggcatcggcatcggcgctgccatcttgtcccgcctccttgccgtccctcgagcgctagctgccgctccagctccatcccaccaccgttgccgctctagctagctcccgcgtcagagagagagagagaggaaggagggagggtcgagatatccggtattgtggttaagggatacgaattagactcggtcactagttaagggagtcatagtggacttactccccttagaaaatacttctaggctgcaggcccacaggccacatctagcccccagcggcccagcccaagtttccattccccaatccccagccccaaatccctagcactagccaaggcagtgagctccccgtgcggcggcgcaagaggtgagcggcgcgggggaggcggcgaggtaacgacgagctgcgcagcggagcgcgctctggcgaggcagcaggcggaagcgtgcggcgcggcggcgggcggcggcaggtagcaggcgaagcgcgcggcgccgcgagcgcgagcagccgagcaggtgcagcagcaggccagcggcggcggcggaggctgcaggccggtgctggcgacgccacgggagcacgcgagcaagaggcaggaccaggcgagcaacaggcaggcagcagctggccaacggctgcaaaataactaaacaaggtatgtaatgcttagaattttatgcaaatatgcaatgcaactgtgattactgattacttaattggaaatttggaatgattcaatccattaacaatttagcacagtttctttctttctttttttttgtctagactagaatctcagcatgtcgaaaagaacattgttcaactattattcaagtggcagcagcagtactcctactgcatcagaggatgatgagaacacaagacaacaaaaattggcaagggtagagtttacttgcttagatattgttagtgatccaggaacgtgcaaaccaattgatgagtatccatttgagattagagatcaagtgaagagggcatttgttttaaggggtccaactcaaccagttggttatacatttccttgcaaatggcaaagtggtgaatggagatctttccaacaacgttggttggagatctatgattggttagagtatagtgaatcaaaggatgcagcattttgcttgtactgttatgttttctttgagccaggaaaacctgaaaaatttgggagtaatgtctttcaaaggttgagcgcccccccacccccccaccccaatctttcattcctggatccgcccctggtgttgggtttggtgatgctactgctgcagctgcatagccgcagtaatatctcccgatcagcccctagcttataagtctaaacaaaagaggatacaaagtgtcttagaaaatggaacagagggaacacctggtggtatacagtgatgcctagtagttaagtagcaaggatgacagtttcagtttccgaataaagtggagttcaaaattcaattacctaagcccattgggccatcttttccccgactcattcctgcatgtgtttcggcccaagtcccataaccaaaccatcaaatcgtctccgcaggcggcggcgaatcgagcggcgcggcggctgccaggcgaggccggccggtggggcgccatccagcggcagagcagcgtgctccaggctaaacctcatctctctctctctctctccgtccggcgttgtccacggcccaagcctcaaagggccacgcgcgccacgcagcgaggctaggtcaccggcgctcgctgcagcctacggtggatgcccgcgggcggcgtcctgggctggcgcggtggctgggggtcaccgttcccagttcaggtagcaagcaggtgaatcccaattttttccccactcaatttttttttgttcaattcgagatggtgaatcagtgaacgggccatttttatcctagcaagaataagttgggttaggctagaatgctagatcacttccatcctgaagaaatagaaatttgaagcaaacaagaacctcaactcctcaagtataaacttgtttacaagctttgcagatttgtgccaactagctgaacttcccgagcgattagatcacacatttttcttgcatttagaaacatagttgtatttgctacacaagatgtaatttgtagctgatttttttgctgttatcaatctttgaacagtaactttatttataactctgaaatcctggggaggtccatttggattttggttgatttctcctattttaaggaacccttagattgctgtaatgctgtggctgtgaggaatcaaatccaaaatcttattctccgttcatttagttttagccttttagatttttattttctccatggtgccatccttaccagtcttatccatctatcctttgtttgatgatttatgtgcttcttcttcagcgagcaagattgatcccaaggtgcgggtgcagattatcttccaaacatgtttggggctctactgggactccatggcacatgttaagtgctctggatcgcttgctattttctgctcctcaatcgtgctcattggctcacacatggacggcttcagttatgcacaaccgtcttgtacgtggctgtttcagcagtttttcagcagcagcagcatcggctattcgtgtacctgttgcaagctatgggacttctgcagcacaaagcacatcaaaggaccagcatggcagcaacatcaacagtgcgctaaaagttttgaatcttgtaccaagaaaggctgactatgacaaagtgggaggtccatgccatcaccaactaatccatgactgcatgaatgacatcttgggggttcaatcaaatcatactatacacaagggaaatggtgtcacttttaactcatgcagcaatcctgcacaggctaaatttgatagctttgtttcaaataatggctcggctttgcgttccaggactagattcataaaggaggacatgtttatgctgataatggagctgcacaggaaaggagaaaccagtacagatcaatctattttggcagctgccatgagttcctgtgctgataggcaaatgttcacccaaggcacacagcttcatggtctattggttaaagttggctgtgattcaactgtctttattggcagctcacttatcaccttatattcgaggtgtagccagttggaaagttcgtacttggttttccagaccatgccaaccaaaaacacagtgtcatggacagcaatgatttctggttttgcgctacataatcgggttgaaccatgtctccatttgtttgcgtcaatgaggctttcaagttgcaagccaaatgacatcacatttgccactctttttagtgtgtgcactaaccacgcacttctagcacttggtaaaagtgttcatgctttacaaatgagaatgggtttccattcatatgtgcatgtttccaatgccctgctgtccatgtatgcaaagtgtgggtgcatagatgaagcccagtccatatttggcttcattgcctgtaaagaccttgtttcgtggaatgccatgatctttggatgttcgcagtatggccttgctaagcattgccttgacttgctgaaagaaatggagaggcaacacatagtaccagatgctctctccttccttggtgtcctttcttcatgccggcatgcacgccttgtggaggaaggccgacactgcttcaagacaatgattgaacatggaataaaaccagggctcgatcactactcatgtatggtcgaccttcttgggcgcgcaggattgcttgaagaagcgtgggatttgatccaaacaatgtctatccctccaaatgccgtcatatggggctctctgctgggttcctgtagggtgcatgggaacatttcgatcggcatccaggctgcagagcaccgtcttaaacttgagccaggttgtgctgcaactcatatacaactagcaaatctgtatgccacaattggttgctggagtgatgtggccagagtgaggatggcaatgaaggcgagaggcctaaagacgaacattgggtgtagctggatagaagtcggtgataaggtttattccttcacggcagagaacagatcaaagagccaccaagtaaacaatgtcctggctattcttgattgcttgcaagctcacatggaatgcaagtatgatatgcttacagaaagcctggagtagtggagtgtgatggctgtgaacatgtcaagacgactataaacactgtatatattaagaggaatcctaaagaagatccattgatgccattataacacctaaacattatgtgtatggactgattggtataaagatctgtatggattgacaagattcacgaccaacaagacatacaggtactgtattttccaagtctcttccagttttgttcctcatttgtctaagaagtgtggggaataagtattcttgcattctgccaccacccaacgatctgcaatttatgtcccccatccatgttacattttcttgttagtttagttctccaaaacacaggtaattagaagaacaatattcagattttttttttgttttttttctttaaattctttctggccaaggttttctgacttaattgatgtaactgctacgagacttcctatgccttcccataaaaaaaagtacagttcattcatcctatctattcattgtgtagcagcctgttgtggcggatggtgatggaaggcctgctttccagcttgaaggaaagaactgaaggattgaaggttaagcggcataaacttgtcatagcacatctcatgtgtctgataacataatgcgttgatgtgtcatatgtgcaatcagcgatcttgtactgcttaattacaatggttagaaatgtagctcttgacaaagtaatgattcaggagttctgataattgagaaaacaagacagcatcgtctaaatgtcagccgatggcttctctgactgatgagtatcaacaattttcatggaaacgaataggattacaggagtgtcaacgaatatgatatttgcggggaaattgaagaaagtttttaacaacatgccttcccagtcttgagttagagaattattgcatggcccattttctttgggggtcaaattaggtaggtggtgaatttgacaatcagcatgccgttagtgtcgaagacaagaaatgattctttgtattggtgctgaggaacaaataaatggaaggaattctactcaaaatctcaacaatctaagttgaaaggtaagatctccaaattaaacgctggggataaaaaaagcaaagttgaaagaggggtgcaaatgaaactgaaggcgcagtttcatcttctttagatgagatgctatcatccaacctgctaacggaagtgatttagatgaatattaagtatgggtatataaaacaagaaaactattagtatatgattaattgagtttttattatttcaaacttagaaaataaattaaaaaatggttttatctgatatttcaaagcaacttcgtatgagatgtaccatttaacagtttaaaaaacgtgcttacaaaaatcgagataaaatctttgaaacgaacttggccacgtgtaacaaagatttagcatgacagaatggcacaaattgaaaaaggtaggattgcaacatcgatgcgacactaacatgtcaagtgcgtcttctttttgctacctaccgtgctaaagccaaaatgtagtacaaagccctctgcatctaatgaccattaccatgcaagctaaacccatcaccatggcaacggcgtcgatgctcctccggagcctcctctgcctcgccgtgctcgccgcggccgcggccgccgctcagccgcggttgcagtgcctggagaacccgccggagctgacggccgccggcgacggcgaggccggcgtggtcgtccaaaacctgggaggattcgcggcctacgtcaccggcgccgcccactccggccgggccatcgtcctcgcctccgacgtctttggttagtagtctgtgtgtgtgcatgtatgcctgatttgcttactgatcattcactgccatcctttggtgattatcgattgattagccgttaattgttgctgttaatttggtttcttcaggatttgaagcaccattgctgaggtacaaaatcttcttttcatttcctttagcttcttgttcgttgtcatcttcgacagtaattttcttcatttcttcactctctggattataggcgcagattgtttattttattaacataacaaattaatattttgaaaaatgaactttgcaaatatctaataatgcagtagaataaataatattttttaaagcatggaccaaataatctgtagcaattatccgggggaaaatctaaagagaacagggcatgacaaatacttgacacttgaacaactctggaaagagactgatttaaaaaaaagaaaaagacagacatggcttaattgtgtaccatacctgtttttcttgtgacaatgggttcaggtcatttttagtgaactatctcctatctttctgcagtgacttttgtgagaaggataacaggtttagactttagacaccaaaaggtgcaaaagcaaataatcgtccattcgccctcaccatccatgagcttgaacaaagaatattcaacattgctatgtacatgtttcttccgtttcaaatactccctccgtttctaaatatttgacaccgttgactttttagcacatgcttaaccgtttgtcttattcaaaaaaacttttatgaaatatgtaaaactatatgtatacatgtaagtatatttaacaatgaatcaaatgataagacaataattaataattacttaatttttttgaataagacgaacgattaaacatatttaaaaaatttaacggcgtcaaataaacggagggagtagttagtatcttttttttttttggagtaaccatcaattcatacggagaatcagaagcgtatactcatttttgctattttccatattctgaccttctaatgatataaatatgttaagcggttgaaatacatcatttactatcaatgtgcaatttcattattttaactactctacttagacaacatatatgctaaaactttcatcttctgtatccctacaaagttgaagataaatctactactccttccattacaaattatttgtagttctagttttatcctaagtcaacaatttctaactttaacaatcattttttttaaaaaaaatgtatattttaatgacataagttttaatatgttttttgattcacaataagaaatacttccaaatatgcaatccacatgtatttaaattatacaaattgctagttattaataggctaaaatagaaatatttgacttgggacaaagttataacaataattaatttgaaacaaaaggagtagtactatcattgtatactgtattactgtgcataactatgttcattacatgctttctaaaacatcatttctttaggggcaaacgctgtcgtaactcaatagtcaatagtaatatctcattgctgtccttgtaaagctgatttatgaatggataaccaagcaacgatccaatttcagaaattcagtttttctgtaaaaatatcgtggattccaatggtataacagcaatgatttcttcatgtggattgtactaaggtttctgtttttgattccaattttaagtgcttcctttagcttgaaagtattgtaaaacgtcccaactggattcctttcaatacaccttacatttttactcccattctagattgcaaagacaacttaaaatcaaatttgtggttaataatgctgacaattacaggaaaatagctgacaaagttggtgaagcgggatattacgtcgtggtgccagatttcttccaagggcgaccttacaatggagacccaagtataaacattacacaatggatcatggctcactctccggtaattgttttcaccaattacatagcttattcgacgacgattatcgaggagtcaattgatattgatcagtatattcaattgaaatttcaggtgaaggcagctgaagattctaaaccgatctttgctgctctaaaaagagaagggaaatctgttgttggagttggaggttattgttggggcggtaagcaaaatcgatcagcaaaaagaaaatgtctttacatatcctacatcagtacattagtaatacatacactctaaaaaactttgtaaattcctagttaatttccatatctagacttaattcatactattatagtctaaacaacaaaacttcaattgacaggaaagttagctgtcgaggttgcgaaaaccaatgaggttggagcgattgtcatctcccatccttcatcggtgactgctgatgatatgaaaggtgaacttatctgttttggtgctattgttgcgcagtatatagatgaatatatagttaactgattcatgtacgctgtatcctagtagtccctgtttttcttattccaaaatgaccttgacacagatgtcaaatgccccattgaaatccttggagctgagaatgacgctgtaacaccaccaagattagtgtaccagtttgtgaatgccttgcgccaaagacctgaggtgagttcctgttgattttcattggcacttgatgccaaatgcatcagcatagtcccacggtagacacacacgagaaaaatctcccactgatgatgagaaattgaaagatcatgctggctctatttttctttttgaggcaatactggatctagctaattagtaacattaatgaaaagtccaaacactagcacaatgtcaataaacaagtttacaattgtttcttaaacacaaccactcaatgatctttaagaaaagaaacaagttatgaagaggctcttatggattgcatctttgttgcaggttgattactttgccaggatctttccaggagtggctcatggctttgcttgcagatataacgccagcaacccgtttgctgtcagaactgctgaacaatctcttgccttaatgcttgactggtttgagaaacacttgaaatgacattagctaatcatgcatgcaatgcaaggccagtgcaattgtttatttccatcaaaatacattgctagtgtccatgtatatcctggtgttaagtgaaacttatataaataagcactagtgtaaagtgaaagtatgtgttgaatatggtgcgaagtgaaacaaagtgtactttatgaagtgcaaaatgcaaactctttttgttccgaagcgaccattagcatggcatattaaaacatctttttgtaggagaacaaaaataatgtgtgcctctgttgccattttaactagtcgatatgttcaatcaaatgttgtatgctactcatcttaagcacagcatatattgggtacctcttgactgtttcttatggccacaaattagacagatgaaagtcgtgcttccaagaaattgctagcccttaaataggatggggacttctcctgaagctgtagaggaaacaaggaattctgattccaaccaaaatggatgggtgatgaaccatttgcgtgcaaaacacagaaaacattcccagtatttcatctcctattgtcctaagtcaacaggcaaaagatgacaaatcatccagccaggttgaacagttaaaaaaactttttttgtttgaaaaaaagctaagatttaatgtcctccagggagttaggcatatctggtctcaccggaagccagtggcgaggttgctgtagatctggccagagctgtgtatcctgcctccgccggatcgtggggatggcatcttcacatgagcatatctccacctcatcctatatatgtgcgccgccacatccagtgccaccccttggttgggttccatcgaggaggtcaagggagattcatgttgccttaagcttttgacaagggtcgaggggcagctcttccagttcatgtaggtgcagaaaaactatcacaacttccaagcatccaaggttggcgtgtgaagcttctgtctctaggtgcagcttctggtcgtcgttggcattcatgattgatcgcactctgagaaaattaaaatatattttagaaacaaaatgttgaggaaaaccatttgccatagggataacaaattattgcttacatgaatccctgagcatcataaagacccttcaaaatgctggattcttcatgcacttgggcagagctatggtatattttaccctttgaattcctggatgaatttggtcctgtcccggaggttataactaatcttgttgctagtcattaggatgcttggtattcaaatcttcagaaaattggctgaaaatattggatgtttaaatcaaacctttactgtcatagtcttgcagcgtgaataaattcatcatgttgctggctttaaaagaactcctctggtgagtgcctttcagtactttgtatttcagaaaatgctcgtgtatttgccaatgatatagacttactcctctagcattccacttataatcagtctatatactgtcatatctctagcttgccgaattctctatgcacgttcactagcctaatccacagagaatttaatttgttaagtagagtagaattaccattaaaaacaaaactacattaaatgacaaagcgttaccatgctaacaatagtatcggtagagtatgatagaaaattattcatctaccagatcatctctcactggcatccaatcaaaacttggcaatgaggttagaaattttgcatcgtacggcgacattgtagcaataagggcatatcactggcatccagtcaaaacttggcaatgaggttagaaattttgcgcgacattgtagcaataagggcatatcactggcatccagtcaaaacttggcaatgaggttagaaattttgcgtcttacggcgacattgctagcaataagggcatatcaaaacattaatgtatctcctctgctaccatatcttaatgtctagttgggtgtttcttataagattaattttccttttaagaaattaagcttctctcagattaagcaatgagttcaacagagaaaaaaaaatctaatgttagaaatttcaaaaagccaagcgctagtgtctagcgctgcctccaccgagagacccgactgtgtgcctataggtgtcacgtcctgataaattcatcccgaaataaaaatcattttctaaaaggaataatagaattaattaaaattcgaaaagaaattggcaaacattaaaatacgtacaagaaaaattcgaatgtggctcggagaatttttgttaaattcttcttggtctaaaaaggagccctcaaattttacttgaattttcagagcaccggaaataattattaaacaacaaaaacaattatcaaagtttaataaaaagaaaatctaaaaataatcctccttttcttttgggccaattttggcccaaagtcctccctctctcccctcggcccgcggccgaagtctccctttcctccctctcttcctctccctctcctcctctccctccttctcttgggcctcctctcctcccctcccggcccactccctcctccctctctctctcgggccgttcctccctcccctcccggcctgcccggcccaggccgccctgccccctcccatctgggccgtgtcccggcccagccgagcccccccaaaacggcccgtatcgtcccggtaacccccggtaaacaccccctcgataagcgcccccgtgcccattgggggccccccccccggggcgagtttttttgttcccctcgggcgggggcggtacttttgtttttcgcgaaaaccataactcggtgccttcccaaaatccgcctaaataaaaccggggattccaaaattaaataggggaaattaaaccccattgaatcctctgcaattccccccaatttcccccttgaatggcgcccccaatcgtcgggaacggtcgcgcttttcccggccaccaaccatggccgccggccgccattcccgtcgccgttccgccccctcccgagcccggctcccgcccccatcctataaaatggaaccccctctttgcgttctattgttttagccctttctcgagctcccccgtggccgcagcacccctccccgccgtcgccctctctctcccgtgccgctggacgcctccagccgcccctaccgccttgcctgagcgccgcccggtcgcgccgtcgcctcctccagcgtcgccgccacctcctccaccccggcctgccctccgtttcgcgcggtgaccgccggaggcgcgttcccgccgtcgcccttctctttcctccgcgccggccgcctccagccgcctctccctcctcgccggagcgccgtccggccgcgccgtcttctccctcggcctcgcagccacctcctctccctcggtcagccctccgtttcgcgggggaagcaccggagacgcgtcctcgccggcaaaacagtggtgttgccgccactgttccacctccggccgccactgtcgcgtttcccgtgcgccggccgacgtcgccaccacctccctcggctccgcgacgccgccctcatccccggcatcacctcctcctcacccgaatttcgccggaacaccgtcgcccgcgccggcttctccttcctcctcagcggcatctcctccggctgcccttttcgccatgcccgtgcgtcagccggcgctgccgtcccctccctcggcacggtgacgtagccctccacctcgtccacccctcggtttcgcccggaagccgccgcacatcgccgcgaacctctccatctgcctcgccggagttgttcggccgcccgtccctcctcgcccgtgcaccggtcggccacacctccaccacctccggcatcgcagcggcaaagccatcctcggcattgtttcccctccatccaaacccctccgcggtccatcatcgtcgtctccgatcgttctcgtcgtcgacgtcccgtcggtcgcccggctcgtcgtctcgcggcgccgcctccgtcatcgtcatcgcagcggcgtgtcccacgtcgtcctcgtctccgtgcagccactgccggctgccctcatcgcctcctcgccggccccggtcgtcgtcgtcgtcgtcctctcgtcgttcccggtcgttgtggcgttcgtccctccgtcgagccgttctcgtccgtcgtccgcgttcgtcaagcgagccgccgcagccccatcatcgtcttcgtcctcggctccgcgtcgtcaagcctcgtgccggccgtgtctcgccttcgttcaaggatcgccgccgaagtcgttccctcgccgtccgtctccgccgcgcccgttcgtcgttgtcgttcccacgcctcgtcgcgtggtggtaaggttccctctccctcgctgccccgtcctcgtcctttcggtgtcgcccgtgctcgttgtgcggttgtcggccccggtacccgtgtaccggtgtcggtagtcgttcacgcgtgcgggtggtgaccgtgtagtgtccgcgttagtgtgcccgctcggtagccgcgtggtttccacgtgtgcaggccgtgtggtgtctagtggagtccgtttgtcggccactcgcctcggttgacacacggggtccgcctccgttgacccgtggaccgtctctgtgtacccggtctaccgcggtcctttaggttgacatgtggggtccgcatgtcaacggcgcagccttcctgtcttttccaggctagcgtttacacatgttttatagttgcaaagcttaattataataatccgcaaatctccatacaacagcattaaacttcggatgatcatatcttggtcatacgagctccgaatcgacccgttcaagtctcttaatgtttgttataacctaaagaaccatgtgctttctttttatgtattgttattgcttctttataggcttgtagctttgcttgtgtgcttcgcgtagcttctgtcgttccggaggttccagaagcgtggttcgtggtcgtcgccgaaggttcggaaggccgttctctctgagaaaggcaagtcacatcatccttgaacatgttgaatcccagtttataaaattattttgatttaaattattgcattatcgctttatttaaattcccgcgtgatcactgttttatttagccatgcctatttacctttgttataaccttaatattattgttattgatattattaccttgttcaccctaggataaacaaaaccccaactagtgggtattctattcatggttccactagtatgaatttaggtagatgcttcgctgattaattaggcaatattaggtggttttataactttagactttgggaattctcatatcatttggacactatggaattgttggtttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggtcataaacaaaagtacacggatggagatggatgaagtcgggggtcgatggacattctctaggacaaatgaaggctacacgagctgcggcccggtagtcgagatgtcatggcacagggttggtgccctgctgctaggggctcagtcctgcctgcctgtcccgaaggttccggccgtaggtgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagtcagtgttataattcttaaaatttggtcaacaactaaaatgtggaatggttggcctaggttggcttgggacgagctgggacccagggtcgggttgccagttcggtctgaatcatcgtaggccttgggttaaggcaggttcgtgtgggttcacggccttgtttaataatactgtgtagctctaggatcgtctttataaaatggctttgggcaactaagtgacttttaaatgctgtttactgcaaaacttaacccgtatattattatccccttgtactcccttgcattaattatgcatctccggtgtggcttgctgagtactgtggttgtactcattcttgctcaatctttcccctcttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgccttttgtatcatgtttgtttggtgtaccccggcttttcctgggacggggattaatacactagcgttcgggaaaaggcaattttcccggtcgcgacaatagggcatcttttcggcagggggtcgcctgccgtggggatcttttcactgctccatttctttttcttttttttcagctggccggcagggggtcgcctgccgtgcctcagtaggggatcttttcactgcattttttttttgcagctgaaacggtagggcggatacacgccctaccgctgcccattgcagtcggggtgggtgtccctggggtggcgatggaatagaatcaaatcgagctaataaacaggtcgtgttgtctcagaatgggcgatatggtacaaaactcattaccggatggattcagtcggagccaaagaacagcgcgcagagcaacctagggctaggagtagaggtgcgtggcatacctgctctccactccacgtcgagggcgccgtcgaactggccgtgctggtgaagtttcccgccgcccggccgtcgccgtcgccgtcgccgctgacggccggatccagattctccggcagcatcaccagctggctgctcgccgccggtcttggggaagcggcggcgtcgcggagagtggagagaggtcgggagcgagcgagaagccgagaaggggaggaggaggatgacccatcgacacccatcgactcaggcaaatgcaggatgctgggccatgagtccacgatgagtccatccttctgacgacgcacgtggggccatccttctgacgacgcacgtggggctcgagcggaagctttcccaggcccagtttgctactgggctgatttatcttgtttcgttttttgagtttcactcgcatccttcaaccacaaagaggtactatattgcatccgtcaactatcaaaacaagtggaaatcgagtgtcatagttatttaaatgacggtttcgactgatttggtgtctacctaaaatacccttatggacatataaggttaacggttgatttatatcaagtttcaaaaaaaaatatgaaaacttttatttggcctccttacacagtataaaagtttgtatataagttttaatttttttcatttctattttttaaaaatataacttatttgttatatgctatataaaatattttttgtgttgttgtttttaatataaattatctttcatatgcaacataagatattttttgctattatctttcgtgtaagctatttctctatgatatacacacaaaaatattttctctgatatacacacaaaaatatatttttaaaaaataaaaaaactaaaacttatgtacatacttctttgttgtgtaaagaggccatataaaaaatttcatattttttgaaactttctaatgagataaattgattgttaaccatgtatgtctctaaggtattttgggtattttttaaaaaagaggcccatcataattgataaagtcatcagtatatagtagaaagagataatgacagtggtaaatcgttgaactgggataaactcagtagcatagaatagattatctcaactttatatacacatataaaaagtttatacgtatgtatgtaaagtatatacgtacgtacatataatataaatttttcatatgtatatacttttgatgtataaaaaatatatacacgtataccaagtttgtatctaatttaaacattcaaatctttcaactcgaaaattttaaaaaaataattatgtatagattttaaaactttagattctaagttttaactttcaaattcaagttgaaaacttccaagtcacctatttatttcattcctggttaaggacgtaggattggaacgtcgatgcgacactaaacatgtcataggtgcgtctccttttgctacctactaccgtctaaatccatgtacaaaagctgcttcagcaactatgatcagtagagctaattaattaccatggcgccgtcttcgttgctgctctgctggagcatcctctgcctcgccgtggccggcggcggcggcggcggcgctgccacctctgccgattcgctgcgcttgccgtgcctcgacaacccgccggagctgacggccgacggcgacggtgaggccggcgtggtcatcgatgacctggcaggcttcccggcctatgtcaccggcgacgtccactccggccgggccatcatcctggcctccgacatctatggttagtagtgattatcaactgattatcgagtgatcagctgttgtcgctgttaatttggtttcttcaggattcgaagcaccattgctgaggtacagtattcgtcaatttctttagagagaatcctttatatgccactgaaaattggtctgaacccttatatgccattgaaaattggctcttcccttatatgccattgatacaaatttgcacaccctctcatgtcactcccgttagttgaccgtgtgttgaccgttaattctcaaggaaaaaagacgtatttacccttctaaatatagggcatgcctaacaactcagagagggcaaatatgtcttttttacttgagagttaacggtcaactgacggtagtggcatgagagggtgcacaaatttggaccaatggcatataagggaagagccaattttcagtggcatataagggatcagaccaattttcagtggcatataagggattatctcatttcgttaacctcctcctcctctctttgtcgtcgttgtctgtcatctttctccgcaattttcttcattttctccacaaatttagtgaaagaaattaacacctgaacaactctagaaagagactgaattcgagggaaaataaacagagtaaacatgacaaataattgtatgacttaaaaggtgatattgtcatttttactcaattatccctatctttctgcagtgacatgcgtgaataatagttctcatcacccatgaggccatcatcagtgtttcaacaaataatattagacaatgctcatctttcatttcaaatagtttaatttcctgatctttttgggactaatcatggttttaaactattccctcccttcatattataggccactttgggtttgacctaagtcaaatatcgtcaagtttgataagtttataaaaaatatagaaacatctacaacatcaaattaatttcattcaacaactatcgttcaatatattaatttttctataaatttggtcgaacttagagaggtttgacctataacaaacctaaaataatttataatttgaaatggatggagtagttaccaatgcatggagaatcagaagaatatatactcattttgcaatttttccatattctatcctcccgctaatgatataaatatgtcaagcgggtttaaatatatatatcattttaatggaaaaattcatgtccacacatcgtgcatatatatcaagtgacaaatacagtgaaaattattgaaaatactgtacatgccaataatattatacctatgtgtaaagtctatgcattatactgaaataaataaaaattctgacagttttacaagtaaaaagccatcagattttgtccttagccatcagattttgtccttaggacaaacgtagtcggaactcttttttttgggcaaaaaatgtgtaaagtctatgcattatactgaaataaataaaaattctgacagctttacaagtaaaaagccatcagattttgtccttaggacaaacgcagtcggaactcttttttttttgggcaaaaaagtgtaaagtctatgcattatactgaaataaataaaaattctgccagttttacaagtaaaaagccatcagattttgtccttaggacaaacgtagttggaactcaatgaaggactgagaatgatccaatttcagtgttccactttctgtagaaatatcttgaattccaacaatacaacgacaaacccgtgatttcttcatgtggattttactaaaatttatgttttacgttccagttttaagtgcttccttgagcttcaaatagtacgacatcccagctaaatttatctcatacaaattctacttttattcccattctagattccaaaaacaatttacaagctgatgtgtggttactgatgctgacaatgacaattacagggacaatgctgacaaagttggtgaagctgggtattacgttgtggtacctgatttcttccatggacaaccttacaatggagacccaagtataaacgttacaaaatggatcacgcttcactctccggtaatttgtttcaccgtttacatagggggtgtttggatcctagagatattttttagcccaccccttttagccccaaaatagcttaaggggatccaaacaggaggaagtttacatcttgtagacacgtggtgtgactgttgtttctttttttcctctatttataactttttagggctatggtcttgtaattttttaatgctatatcaatatgaaatctcacatggttcgtttcaaaacgccaagtaataatgatcatagttgcattaaaaaaaccttttctagatgatgcttattgtggagttaattaatggatattgatcagtatattcaatttgaatttcaggtaaaagcagctgaagatgctaaatcaatttttgctgctctaaaaagggaaggcaaatctgttattggaattggaggttattgttggggtggtaagcgaaactaaccagcaaaagaaaaatgtctttacatatcatacaccagtacattaggattgcactataatttttttcgtaaattcctagttaattagattgcacagctagatttagttcatattatagtctcagcacaagttcaactggcagcaaagtttgctgtggaggtggccaaaaccaatgaagttgaagcgattgtcatctctcatccttcagaggtgattgctgatgatatgaaaggtgaacttaacttgttttgatttgatgcttaattggttgcactacatatacatgaattatctagtcattttatgtaagttgtatccaagaagcctctgttttgtttactaaattcacattgaacgcaggtgtcaaatgccccattgaaatccttggaggtcagaatgaccctataacaccaccaagtttggtggaccagtttgtgaatgtgttgcgtcaaacaactgaggtgagtttttttttttttgagaacaactgaggtgagttgctgttgggtttcattggcacttgatgccaaatgatctttaaattttgtaaaaaaaaattacaaaatagaaagcacaagaataactgaaacagagtttattcaccccccctccccaagaaaaaaaaagaaacagtaaacagagaagagataaatctcccagtgatgatgagatattaaaagatcatgccggcactaattggaagtcaacatttggaaagttgtttttgagaagaacatttgggaaatttacaataactaaagtctaaacactagtacattgcaattaaagttccatacatgtacatggccataaattcggaaaatatcctatatcttcttgacttgttctatatttgcaagaagaccctaattttttcttcaacacaaccactcaataatgtttaagaaaagaagcaaattaaaaagtgcctctaatggattgcatctttgttgcaggttgattactttgccaggatctttccaggcgtgtctcatggctttgcttgcagatataacgccagcaaccagtttgctgtcaatactgctgaacaggctcttgccttaatgcttgactggtttgagaaatacttgaaatgacaatatagatattctattaaaaaaatgacaatatagatagttatttgtgaaaatgcagaaaatcgcacttattcattttcatctaaataaattgccggtgtccatgtataagtataaccagccatgtcaatgtgattaattggctatgattttctctgaattgagcttgtcgatgtattaactgctgaattgatcttcaaattcagcggtgggaattcaacccaacgcacatgcatgtattctcaagttcaaagttaaaactaatcttcaaatttgaacgttggaacaaatgcaagctgaaagaggggacttctgcagttggagcttagaaagttggaggtgaaggcgttgttttattttatttattttagatatctgaggttttcattaagcaaataaaagcatctatatgttcgacaccaaaatgtacaatcaaccaaaaaacacactcagacacacactacaaaaagaaatcagagtagcaaaagaccttacacaactatatcttgacttaaagaaactcaagtaagactaacatatataataaacacgccatcccaatggcgtaataatttcactttggtttttgagataaaaagtaaaagctatacttttttttcttacagaactcttacaaatgctgatgtgacataccgtgattaatctagattcaaagcgccgttactgaggtataacttttgtttttccgccgtcatcctcctctctttccagtttcccttttctctagaaaattaaactgagtaaattgctgtcaataaccgtagggaaaagaaattgacgcatgaacatgctatggaagctaggatactgattaaatttctagaaaataatagagtggcacacttttttttcaattaaatggaagatgcacaagcgcacaaacctccacaaggtttcgttcaattcattttgacaaagcctgtaatttttgttcgtgtacagtggtggggacttaggataaatactgtgtgaccttgagaagctaaagctatataaaaaaaatagaacaggtttttttcccgatgattaaaaaacatgcttgatgtttgtcagtttctttttatatcaaacattaacttttggacattgtcatggttcgaggtaaactatggtatcctttgctaattcaatgctggtattaacctttttcttactgatcgaaagtgagaattcgtttctgtaacgcatgaattcatttcatttttcaattgagcaccatcaccaaaatgtttaaatggtctaaaatttttgggcaataagaaaataatattacatttggttactcattatttatgatattattttctttatcattttccccaatatttatgcgatttcaacacatatgattcgataccgccattttgtatggagcgagcgtgacaagataacaatctacatgaggtcatgagtcattgtcactattcactggaatacatgtgtaaggtgccacaattttgagtgggtagattttcccgttgtaacgcacaagcattttactataagacataaactcacaaaaccttacttttggtatgtgctttcttatcatcctcgctttccgattatccttcatcgctaaactcgacttgctttgaaagcttttgacgcacaagtttgcacttgtggttcttccttttatcttcaaaagataagccgttgttgtccttgttatctttctcatcctccttgatagatttcttgagcttgggacacgtagaattgatccgaatgtggttcaactcactacgctccaaacatcaaattggaccacgctgaaacgacaactagaaataattcgaaaggacagcatgacaaataattggagatgacaatgacaaatagttagggagtactcccccatttcatattataagttgtttgacttttttcttggttaaaattctttaaatttgattaagtttatagtaaaaattagcagcatgtacattgctacaatatttgttttgtattgaaaatgttactatttttttctacgaactcggtcaaagttaaaagaagtttgattaaaaaaaatcaaaccaattataatataaagtgtaatagtttatattatacgtaatacaaagtgtaatagtttcactttgttttttttacaagaaaaaaggggcgcaggattgcagcgtgcagctgactctaccggttaaaggcatgtacaaaagcccaagcatcatctctcactcatcagtatgcaaattaaccatatggcaactgcttcgttgagcctcctgatcctctgcctcgccgcgctcgccgcggcggccggcgccgccgccgcggctgctccgccgcgcttgcagtgctttgagcacccgccggacatgaaggccgccggcggcggcgaggccggcgtggtagtccacgacctggcgggctacgaggcctacgtcaccggcgccgcccactccgaccgggccgtcgtcctcgcctccgacgtctacggttagtacgcacatatgattgcctgagctagctaattaattaagcactgatcagttatcactacttccatttcttcattccataatgatgattatggactgatgaaccgctaatttaattttaattgctgctgcatgtgtgattgttaatttggttcaactcctcaggtttccaagcgccgttactgaggtaaattttctttgtcatcctcctctttttctagttttcttttctagcacaaatcatattatttttttattaaaatataatcgtgtgagatcttgctgtaaatatttaattataacaaatacaacggtacgatcagatcgtttatatgataaataatttatgaaaaaaatagtttaaagatacgagaaggaggctaaaataaaatatatggaaatgagatataaagtgtgtagctttgcatgcgtatggatagacacctcttgcactagccaaaaatgcaacaatgtagtaggggagagcatctaatttttcaccataaaatcgagtgtcccatttgtagccacatcgcaatcgcacagaaagaaaattgacacatgaaccgctatagaaagagactgatttaatttctatatagaaagtaatggcgtggaaaatgttcattttttatggtaaactgtttttatttcaattaaatggaagatgcaccaacacgcttgcacaagtttctcattccaattaaattctttttgacaaatcctacttttttttttcttgtacaagtcagaagcaaacacactcacgcacatacagagacacacctatgttggtgagtcctatgagtatctccaacatactatccaaattatacgaattagactttttaaacactcatatagccaactcttcatctaatttgtcaagtcaaattcattactcacttcaacatcctctaagtctgtgacaatgggtcccatatgttgaccttcccacccttcttcacccatcctctctattcttctcttcttcttctctccactccctccacaccgctgccgctccccctttctccacgctgcggccacttcctcggccgagagcagcagccagcagaaccgggaggagctgggagcctaggagcagctgccggcgatggcagagaggatgaaggggaagggaagggtgcctcgagatggccaccctccgtgtcaccaccgcggcattccctggtgcatcagctgctcgtccctagcttcctccacgtcgccgctctgtggggtgacacgtgacggagggagggtgggacggtgatggcgataagggcataaagcaacggtgacgaggatgaacgaaggcggagacggtgcgggggaggaggcagtggaggccgtgggtgcggatgccgcggagcaactgctagtccgttaccatggccacaatggcggctggtctagctggcagagggatgaattaaggagcgatggaggtgggcgctggtctaggcggcgacggggtcagggttggtggtggtctcgggggcagcaacagatggtggtggtggtggtggtggtcatcacctgcggcagcaggaatcggtgtggggcggggcagggcagcagtgggaaccggcggggacggtacttggaagaagtccggtgaggcggcggacctcgtgcgcggctacgacctctttggctggtcagtaggatacttggccacggctgcagtcggctcctaggacgacagtgttgctctggttgatggaggtagagagagaacgtgggaggaggaaaatagacgatagtattgagtgccatatttggccagctagattttttttagataagccatctagacggagagtcttttggagcacttttttttttttgctatgttggctaaaatttagcttgaagagttggatggagagtctcttggagatgctctaaggctgaattcagtgttgaaggttaggaacccttcacctccggcatataaaatggagcggcgaattagcatgtaattaattaagtagtagctaaaaaaacttaaagaatttattaatatgatttttaaagtaactttttatgtattttttttttgaaaaaaacaaatcgtttgacagtttggacaatatgcgcgtgaaaaacgagggattagcaattgggaaaatgttgttctgaacacaccctaagtccctaacacatgtatgtgtgtgtgtttttgctcttatgtgttttctctataacttcggaaaacagaacacatttgcgtgataataatgatgctgacaattacaggcaaatagctgataaagttggtgatgccggatattaattacgtcgtggtacctgatttgtttcatggagatccagcaaccacatctgtgaactttaccgaatggctcgagtctcactctccggtacaattcttctcgatcaccatcttaaaccatcgtttggataggccaaaatttcgaagtcataccccatacaaatggatggggcaactggtccattgaaacgaggctgaagtgatttgtcttacagtactcctgctccgaggaatactccatccgttcaaaaaaaaaaacgtaggatcggatttgtagtactggaaaatattaaatccgatcccaggttagttttttatgtaacgaagggagtaagtagttttggaacacgtgcagtcaatatgagctaattttaatcataaaaaaataaaatcgtttaaaatttaggttcactaccaggatgcgaaagtttcccgtgtgcctataacacccaggaaactaggtgaaacacccgggaaaaatcttcccgtgtgtcaacacccgggaatgctcacacgggagcgttgaagctttcccgacttggattcccgggtatcaagaaggcagcgctcaggaaagctctagacatcctgggtggttagagcagcacgggagaaaaatccaacgctcgggatgttcaacagaacggaaacggcaacagaatacttctcgggtgctggttcttttgcaacacccgggatgtttcagtactacagctcaacattcttcccgtgtgctaaccacacccaggaagtttcagtcctacagttcaccatcacacgggtagtagaaataataagcaatgaaatagaatcggtacaagcactcaaatattcagcaatgtaatacaatcagtgcaagtactaagcataaactgatctgtacaaatgttaataccagatatttgttttagttgcacacatacatattcaaacagccacaaccaatctatggaatacacacaaaagtaatgtttgctccttcacataggtagatttttttcgaacatcataagtaccagttcttgaataatatctgggagtccattggataggtaagaccaaaataacatgaactacatccaaaaatcattgttccagatcttgatgtttggatggatttctgtagcaatgaatcatggctggcaattggacgcacttgatctagatgatggctgaaaaattatagtgtgtcagaaggtgctgataaatattgtatagaatatattgccagataaatattgctatagcatattatgaaagtttaagagtgcacattgttagagattcatgcctagatggattaaaatcacaagcccaaagacaattaacagtacaaatgtcaagcatgccatttgtctaaccaagtggttcctacttgtcctgtacaaagagcccagttagcacaaaccaggaagaagatacataaagaactagattgaactatagctagcaactagatacatgcatcaaatgtagttagtcttacttcttaggtacctatatatgcattttacctatttagattaaactatgtgttatatcttaggcaactgtttacatattgaatgcattcagattatatgctttttcgaagatggaactatctggtaaaaaggtcattaatgttggtataagattgctcgcctaaatagacagtggggcatgttggggccgctggtcgtggaggcaaaacattagctttcatcgcagattgaagcgcctgaaatttatttacacatgacaatgcaaatagttaaatttatacatgttgatgaattttaaaattaataagtacatagaggaggcaaaactacaagttaccagctgtatcgcagatgttaagtaacatgtttcatgttggcaagccttaccatcaatgggttatttcatcaaatcaggacttgcaccatgcttttccttaacaactccaaaataagcttcctggatgataagttgggtgtttattcaaatgggaagagattaaaaagttgctgatcaaattttgtgcaagctagagtgcaactacttacaagcttacccttgacacggtcagtacaatagtcctctccatcttttccattcttccttgcttctgcataagcctcaaatatacccactggcctcttctccttcttctccttcatgaaacaaaataacaattggattattttaatctgtaaaatacatttcaagattttatgccaatatgtgaaaggtgatttaagttaccatgttcttttggaatcggtcaagtgaagcgctgccttgacggtgtgctggcccatccatcatttccctgtataccctaccttcacatgactcttttatccactcttcattacaccaatgcagttccgcacacaatttccatccttccggagtcttttgagcccaccaatacacaaattcagtgacaaaaaattcctcggattagtcaacgagtaaaaagaattcatactacaatgtccacttctgttgttctacgttcagcaaattaaaggcacaaacagtgcactttaatgaaaactagaatatctctctagtgttaagctgaaaaactaaaacaatggcaatacatcgctagtaatcagaagtacaagtcctaacaagtaaaaatctacacggccaagataactaaaatgagaagcataaaaggaagtaaatattagccatatcacaatgcattaaacatgtcaagtttttttaccttgcttatgatctggatgaccaaatcactctctgaacaaaaaaaagtgaacggatatggctgggtgggaacaacctgcaaatcatcaaaatcaagcacattatatgacagaaactgaatcttcattacatcgaacaaaactagagggaactaaactgaggaaaatcagaataaaacataaataccagtgaagccgaggagggtagaggaaggcctggagatggagtatggctcaacctggtggatgatggctgaggtggggatgagctgagtgggggaagaggaggtccaaaggggtgacggcggaggcggcgatggacggtggaggcggcgatggacggcggagacggtgggggaagaggaggattaggcagggaggtgggtggaggagttggtcggcgttggggtctggcgtgggggagttgcgtggaggagttggcctgcggcggtggagcggcggcggcttcgtgcgcaggacggtgacgccgcggagtcacgcgctggcggcgtagttagggatttctcagattggggatttctcgggagagagatggagtccgaaaaaaaaatcgggaaacaaggaataaaaaaaaaatcggcgctctggggggatggagaaaattgcatatctaccatcccataagaatggcttcgctagaataccattatgaaaacaggcttcgctggaataccatcctcaaccagagtgtcttcgccaaaataccatcctggacggaaatgcccctggctcttcttcttcctccatcccgcgcgtgaagagctcgccggcagccatggccatctccaccgccgcgccgatgctgccttgccgacggcgattggggcgctgccctcccctgccatccccacctgcgcctgtgcagctgaggtcgtcgcggaaggactccggcgacgacgcgtggatcccgccggcgcgcgtgagccggtggcgca

SEQ ID NO: 83003 - DNA, 2082 bp, Oryza sativa
atgggtctgtaactccaataggagctagcttcaactggagtaggagtttggagctgggagttggagtttggagccgtaccaaacggggccgaagatgcgttggcctgcaaggctgcagcggagaggcgcgcgagacagttcttgatggattggatcgataacaggggtcgtcgctggcgcgcagtgaggacgatgctgacgctccaaaaagatctgtcgtcgcccagtgccccttgttccatggccgctcaccccctcttcctccactgcttctcgccgcaccatccgccgccaccaccgtcgcctcgctccatggtcgccttgctccacattcgcccaccccgccctcctccaacgccggcacatggtgtggatgaaaaatgcggggagtatggcgcctgctcggagtgaagagggtggcgggctaggaggctggcggcaagcgagcggttgccccccgctgctctgcccgccgctgagctctcctatcgccgctcagcccgccaccggcctcccccgctgaagaagagcagagagaagggaaggagaaaaaaaaaaggtgcaattgacatgtgggctccatgtagttttttaattttattttttttctaattaggttgccacgtccgtgaaaccacccgtatatactgtcataggatcttgagtgtatggtttacgtgagtttagaggtatattttctaatgttgtggttaaaaatgttgtggttaaagtatcttaaaaaaaatctctgttgagggaccttcggtgaactttattccatcacaatatcacacgcgcagctgcaggcagatgaataagaaaagcgaagcagaaacataaaagagagtttgtatgactagcaaaactgcaaaagtgtcaatgtgttgtaatgaaaaaaataaattacgaaataaatcaaatccttcgataattgagatccacacaaataaagcgttgatatcctaattgatatttgcaaacaatactctaaattgaaatttagaaaccatatatgtcaaaacgacatccagagtatgatgtatgtgcaaaatgacatttgcaaattaatattatgtagcaagtttttcattaaactaccattgatattataacaaatgaatttgttaataaacacggtcatgtacttttgtttttttaatgaaaaactacagctaactaactcatgaatgaagagcaagcccgcaatttattttgacgattttttttataaagaacagcatctatgcaaaaataaagaaaacgataggtggtatcgacagaatatgctttgctttcttcaatgaaaaaattgggacggccatgtacaggccattgaggcaaatttgagacgggcctaaggggttgtttggatggtgactatactttaccacaactttggcaagctattttgaccaatttagcctagtgtttgcttgattgccacatctttatcatgccatactttttaattttgtgaccccacttgtcatagatacatatctttgccaacatttgcctaacttgtggccaagaatttcttagccacataaattgtggcatgccacaccttagctatagaactttggtaaactgaagcaagcatccaaacagcccctaaggcagacaacattgaggcgggcggcgatgggactctgacgcatactactccgacactgtactaaaattttgaacctaaaatagactagccaagatgtccatgcgttacaacgggggtatgtaaggaggacagttcattggttccactgcatgattgagtgtgtttaagttgttttttatcctatagtttttctttattataaagagatattttggaaatatttcctgagacactggtaggtaggaccagcatatcagcgagagggggagcgccaggtcagctatcaccgtgaattgtgttaattgagttcgctctctgatcagcttaatctttgtcaatggcgatgccaacgccatgacaattcttttcgttgatgtacgtggagggctgaggcgtcgaagcatatcaaggaaaggctcatgaataatacattaaggtcagtgaggttggtgaacaaaatgcta

SEQ ID NO: 83004 - DNA, 1241 bp, Oryza sativa
tgcttatatacctgatgagtacccgaccatgcatgtggattaatatattatatgcttataccatgtctgattactagtttaatcgtccacccctatatcatgcctctgcaatggatatgctctgctcatgttcttatgccacctcctcctgccaaaattagcttgagcatattcatctactagcggtcattgtccaattcaagcttttatttatgggttccccttaccgttttcggcgtggttaccggacccccgcggtaaccgccaaaaaccacacaaatttcagtttcaaaaatttgaattcaaaacaaccgtgataccgcagttttgggcgcagtttggggcggttactgcggtatttgcgcggtaaccgtgagatgtttggccgaaagaagaacaaaatgaaaaaaatgcaaaaaaaaaatgaaggaaccctgcgccgctgtgcctcaagcagggagagagagagcgcgcgcgatagagagagatgagagtactatgagatattttctctacatatgggccttaatgggccacatgaccagtgaagcttaggcccatttcattatttctttttcctatttcctaattgacttttggtattaccctcgaatttgaatttatcttactctttttcaagaaatttcttcaccataatacactacaaatcaagcactacatccatggattttttttattttttcgatttttttaaaatttttgaatttgctcaaaatttggtaatccataccgccggtaaagggctactgaaccccattggtaagcccagtaaccggttaccggcggttttgcaaacctgattactactgctttcgcaatactggcaagatactagtagtgctattactttattacacattcaagtgatgttcaggcaatttcaacctattctgtggatggcttcaagtttatttttaacagccttgcctacctgacctgagtagtactatatactgacagatttttacagttaactgtcttcttaggcttataagcaatgtcattcgaggtacacaagtctgtgttttatgcaaaggatagcactcgtggggaatgctttgttattgatcagagaaaacttcatctggatcttgacgggaacccaaccaagctgcatgaagccacctatataatgggtccaagcaccataaagtgcttggtgaagaatggcactgcagagaaaccattaatgcttaaagattatgctattctcaagaaca

SEQ ID NO: 83005 - DNA, 21511 bp, Oryza sativa
ccatatcagcagtcgcccttcaacaacattccgccaaatcattatgtaagttgattaccatctttttttttgtttggcacttaatcccattctgtttactgccactgcatgtacctgagatatgttacactgaatttattgccattaacatggacaagatagttactctagtcatttgatgttaactattaatttgaaccattgttgtagtggaatcagcaaggctctggattgtcttctacaacacaacatttaccctagcgagattcgaattgaagatgtatatgttcgagtgaagggtggaattaccacagttaaactgcttgtttatgaaggtgtgtgcctcagccttcttgtacatgtgaattttctatgcagtgaatcttacttgttaactttccgttaaactttttttataaaaaccattttggttttttgggcctaatttgttcataacatgtatgcagctcaattggcaacatcaagaaatactactgctagtaatcagaatgcacagaggatcaaactgtggaaagatgtaaaaggggttgcagacaaatgtgtagaacttgctgggcttaaaaagcagatccatcctgactgtgataggtttttgaaatatattggtgctgggaatgtcaagtggttagaggattacccggatgaatggaatgatgacaaaaaggcctgttacttgaaggcacttgtggcgtctgattctaaatatgtcagatccaagctgcaactcattggttttacatggcctgactacagtgacttcctcaacaacttgataactgatcaagtgaccagattggacataaagtacaacattttggatccttatgactacctgcgattgtgcagaaacctggtcaaacattggctctctctgccctctaatctacgggtaagttcaaatagacaaataaaaccatctacaatactggaatgattatgaatggatgcgagcatgtaccttataacacttcaaatgcaggagaagaatgatgattacgctttcttccttcgaaagatggagaagtggacaccgaggatttggtgtaacctgtatgaggccattgggtggcctccgaagtaaggtattccctcttctcatgatatatcgtctccttttacacgggtagtaaggggcgggtaaaaagacttgttgtcttctcggggtggacgatgcgtagacccggattagttgaggctacaacaaaaccataattcttttatccattttctctttcttattagccatacctgtgatagtggtttgtatgtaactcccttttctcagtttggttctgtatatttctgagttgcagcagcaacaggttttgatcgtgtcagtgccaaatgaaagaaatatcaaggttttcggagtagcagcagcttttgacagtgtgagggacagatttcgatcaaggttttctgagttgcagcaatttaagaaaacgcaatgctgatggagacacagtggacaccactattacttttctttttgttcggcagttttatactgttgaacacgaacagtatttaagtagttttaaacacaatactgttggagtagttttgtttgccgtgggcaaccgactgttgcaattagcagtgaactctatctaagaagtgcgattggatgaactctctttagccatatgtatttcccgagaaaattgtatatctaccattgcataaggttggattcgctggaaaaacatcaattaaatgggtttcattagaatatcactcaaaactaaaatattttcgtcaaaataccattccaacgaatccaatcttatgctatgctagatgtgtaattttcttgttgggcagcatatcatctagttgcattccattgttcatggcgatatctaaagtagtgaaaaatcaaagagtggaagatctaattaagctcccagatcttcatgaggcttgtataattccaagagaagctagacaccagagaagcgaaaataaacgaatcaaaataggaaaaaacacacacacagaaacacaacggcggcgcgttggctgaagccttcctgaggcggaccgccccatacggcagggtggtgcggttggccgagctagccgacggcgccgaagacgacgccgccgccgccgccgcactgtgtgtggctgtgccgcgccatatatctgagtcgaggtaacagttgacgaaggcataaataaagctgtgaggacctgttcagatcatagatgtccaaatgggcctcctggcccgacacggcctaggtcagtcgggccggcatggctcgacctacacgccgggccgggtcatacctacccacagcctaggcacagcccaaaaaaactcgggccggacgaaggcgtgacaatatatatttgcttctttatagaataagtttatttgacctcccttatctatttgggttgtgtcttataaagctgaaatatggctattctatctccctcctctctttttggacagggccttataaggctgaagtaagtctattttggttccctcaaatatttttcaaatatgagggatagagagggaggtcaggaggaagaatggaggaaagaggactaacatggggccctcattattattattttttttgatctcggggcccttatttttttttgtgtgtgaatgacaaatgggtcccactcatatttttttaattctaatacacataagtgccacatcaactccacgtggaacgaagaccgagtcaacaccgtcatgtatgtgccatgtcagtgaaatcgtcctccaaaaccgctgagggagtcaaattgcaccaatttaaatagttgggaggttgaaatatccgatattgtgattcaaggatacgaatcaaattcgatcactacttaagggagtcatagtgaacttgttcctaagcggattaagagcgtagcgccgccgcctcctactgtcgacgctcaccgtcatcgccccataagtggcctgggcggcggccagctctctgtccatttcatggaggccggagggagaacagggggcagcatcacgagaaaaatctagggggttttcggctagctacacaaggtggtggactatacaatataatctagatttgaagcttcacccttttatttggtattaggtcgctccttaatattcgcgtatgtttttggggggcagcatcacctgcagggcgcggccagttcatcgcgatagtaatggacttatttaattgaaaaatcattactcattggccattgaaaatcagcccattaaagacagtacttttgcattcccattagtctctattaagattaggcaacaaacgaagttaagcttggatttaaaatttggtgagaatgtattttatatctacacctatctaccttacaacgcagagttgccaaaggcatttgtgccacggtctcctaaatactattaaatgtgcccgacacagaattttgtacaccaccatcgtaaagctatcggcttttatataactcaaacacaaaagagagaagacccaacaacctggtccaaagaacatgcaacaaaagaacaaatttcgcactcaatgcagcttatggacaaatatcgatcactccgcacctcctccacaccccaggtcatagcttgctctggaactgcaaaaggaacatcgatttatttcattattatttttgtaaagaacactagggcctgaagttaattttcaaaagtaaatatcgttctggtttcgcccattatgcccaacagacactatcaattccgtcaaggatataatgccaggtaacaacatgcatccccaccagacctttcgacagataaaggtaattccaatcacatggcaagcaaacttggcagctataccctcaccctcctctaaatgcacttgctctaaacaaactagtactcctaatatttcaattccatggagatcagaaaaatacagaaaacaagcaacattgatatagtgattagaaaccagtcatgtcagtagttcggtacaaacggcagttagcttgcaacaactaagggaaacagacctcccccaccccccccccccccaccccaagcaaagcacagacacacatgtgcattctgtagataaaagtgccttacctgagatggtcatagcaagggagttagatatacatacttatattttagagccactaatatgaactaggaaatgaataaatgaagcaatttacttgataattttccaagaaaaaatgtttgtgttaatagctctctgctgtttcctgtcaaaaaaatcaggaaatttcttcaccccatgatagtattaaaaggcatccagtgagaaacaactgacaaagaagtatgaaaatatgaatgaagttaattgtatattacctttctttctaaaatttgtgagcttcacgactggagtagaacattcaaggaaacaatatgtgttctctagagaaaagttcccatgataatacccgttgagaaacagctgttccatcccgtcaaatattcctctgaaacaacattacaaaatcattcacggaagcactactctcaaaattttaacttcactcaacttagtgccaacaaaacagacctcaaaaccatctggagatggggtgacggaagtaagagagttgcaccaacgggggcatgaaaccgagctgttgacaggagcaattgcacatattctgataacacacgagtgtaacgctccatccaggccacattaaaggagctgtcaccaatgataacttccttaataattccaggatgtaatatgttctcatggttacacgatctcattacatttaagcaatgaacatcttctccaatgcccaaattcatgataagctctgcacaatgtcccacattatggggatatcttgctggcagtcttgaaggcatcttcaacctgccagatgcttgttgatgctttagactcagtattgcagaagtcagctcgtacttaatatctatctgcaaattgcaaaattttgtggggtgaagaggttcagcataaaaaggtatcaacattttaaaataggattgcaaatgcacccaagatgtctagcaaccggctgtttctatgtttgaccatgataggtgtttcatttcatgcctttgaacactggcaagtgtgtgaaggccacagactattcagatttcagatacagaggtttgacttaactaaccatgcagaccattgaaatccacagaaaattgactggttccaataaatgaataaggcgacatatacataatagaatatttgtaccttgttccccttatccttagcttctgattgatctgaagtaaaaataaaataaaatgctgaattagagataagattaattgattcagtcttaattatgcacatcctatttctctaagactatctaagagttaaaaaaggattatcttaacttattaccccatggctcagtacaactgtataagtagcaaaagtacaaataaaataccattttgaagagttcttaatggttcacccatgatggttattctggaagctggcgtagcaatcttctgtggtatagaaatctggaaaaaaatgccattccaacataacacatttatttatgaagcaatttgtatgaatatcatagcttggacacatacatactataaagctagaaaagaaacaaaccataaacacctgatatcctgggttaatatcatggaattataatatgctactacaagatttccctgcttgtacttcaatgtgtacatctatcaaatgttatgcagttttttttttttgaataaatcaaatgttatgcagttgctatgtcaattcctagcagcggcataattgagaagccaaattgaaacaagaagtgcaaaccataactagtatttttgagaagtgaatgattaaattttatattgcacagatgtcccagattaacatgttgggttatattcaaattctatggaagtatctagggtctgcaatatgagtctgagttggttacaaaagctgttttcgcacgtgcatactatctcattaagacagattgctcgtgtggatgaatgggtcggtgactagtacaagctaatgcactacaaaagggtaaaaagcatccaaggtcatacgaagtgaccattaaatgtatatgcactacaaacattaattctaaccagcacaggatagaggtggtctcattatagatcctggtttaggatctatagactataatcacccattgagtcaccacatggtttttttttctgcaggtcagcaatgggatctctcaatcagctgacaacaaaaactattttctttaagaagttgcaacaaaacgttttattctatgtgaagaggtacaggcagtcttgacgataatgtgagtaaacggagttggatacaaaacatgaaatttataaaggaatactgactggtatcttaatgacaacctgattgcaaagtatcccaactagtacaaggggccaggaaaaaggaagaactcgaatgcaaaccaaatgaaaaggagtttctgcaagttaagagaagtgtatggcaaaaacatctttactttttataatagtagagaagagataaaccgacacaaggcacacaagatcatcaggagaacaagacaacggcgtaacagcattgggatccaagcgaaatgacaagatttagaccacacggcacgtgaatgtttcacgatttctccgcgtggagagaaaccgatcgatacgcccgagatttctccaccagatctcatcctcatgagtacaaatcgaatctacattgacattgttgcacaaagccccaaggaaagaagaacaaaaaaggccacctgttggcatgtcacgtgtgctaggaacgcatctatactatacaagtacaaagcacaaggtagttggatctggaagagaagatcatagtcatagtgtctcaccggtgtaagccgcagggcagggcggatggagatgctggccggcggctggtcaggtcttcaaggcggaggcggaggccgccgccgccgccggcggatttttccttttcttttcccctccacctcctctgcagcagaagaggggaaatgcgaggaggccccgtccctggtcggattgagatctggttcagccgttcattcttacgatcaatggtccagatcaatttctacactgttcacacctagggatggcaattatgccaatttgcccgtttacccgtgggtaaaaaccctattagggttgggttgggtttgttctccattttatacccatgggttttttattgggtcaaaacctatgcccgatgggtaaatgggtatgggtatgggtaatcactacccatgcccgcttgcctatttacccgtgaaatctaacttacatgtaggctaggagcaaaatccactagaatacataagccgcgttctttgttttctacggtttccttttatttcccttattatttctctcccccttcctctatcgccgctagaggagagacaccacaccgagacggagaatatttgatgttaaaagtttgtagacttttttccactgcttttgttgtggcgggtaaacgggcacgcccgcgggcacaaggcgtccgtgggcgatgggcatgggcaacaatccttgcccgtcatgtagtaacaggcatacccatgggcacaaataatctcatgggcacgggtatgggtagaaattacctgtgcccgtcgcgcccgattgccatccctattcacacctgtcgtgtagtacttttgctacaatttggatttagatccaatgtagcagctacaacgtcttaactagacgaataaccgccgcgttgctgcgaaaaattaagttagatagtatgtataaataagatgaaatatgaatattaaaactaaaacaaattgatattatgaattttgagtcctaaaaatgattgagattacttagtgttaaaagagaagaaaaaaatgacaatttcaaccatagaactatcatccaatggataaataattggggtgatgtggcttaatgagagaagagagacatagtattaactacacttagtggggatgaactatataagtatataggataagggcatgtttaggaaattaagagtctgtttagggagcttaagggtctgtttggtacagctccagctccacctctcctggagctagagctcagccaaacaatttcagctccaccaaaactgggagtggagctctctcacaaaatgaactagagttgtggagctgggtttaggcagttccacaactttactccagacccaactcctagagctaaatttaggagttggagctgtaccaaataagctctaagattatgagaagcagctggttgatagccagcttctgggaatctggaaaagctgggtttctcatcttctggtttctagtttattttctgtattctacaactacaacttttggcttgccagaatctggaccaaaagctggactgtctagggagcttctgattctaggagaagctgcagcagttagaagctccctaaacaggccctagatcccctggcaaaatttacatccatgtcacatacacgtttgaacacatgcacggagtattaaatataggctaaaaaaataactaatagcatagattgcgactaatttgcgagacgaatcttttaagcctaattgctacatgatttgacaatgtggtactacagtaaacatgtgctaataacggattaattaggcttaataaattcgtctcgcggtttactgatggattttgtaattagtttttttattagtctacatgtaatacttcaaatgtgtgccgacatacacgatgtaacactgtaaaactttactcccctgcatctaaacacagcctaagttacagtccatactactactgcagcttccagtccacggacccttttcacattcaaaattaaggatccgccccttctcttactcctctgtctaaaaaaaaataatctcaatcctaagtttaaacatacatacatacatacatacatttatgtacatatatatagtatatgtatgtatatatatatacacatatacatatacatacatacatacacatatatatagatatggatactcatactctatgtagcaccaattaatttacctacctatatatatatagaactactatatggtaccttaagtgctacgtagctatatggcactccacagatcatcttttcgaccctcacccgaacgtagtaaatttttaactcgcggctcccaccagcatctccgcaccccaccgtatcctctctcacaggttcaaataggacgccactaacagatgcagcgcgccaggaagcttcgtagagcgactcacggtagtccccgcgtccggtttatctgttcaccttcgctccctcaccggtcatctcggtcaaaatattactcatcgagcgttgtttccgtttctattgctttttttaccctgttcgctctagcacgagagattcatctttctaatctacacgtggcaccatgggctaaattaactcccagcaaaattatgcttcagtaaaattttcactccctatatattaggtgctcaataaatttctccaaagtcagtaaaatttttactcccgtatacagtttggttgtgggttacactgacatggtttgggagttaaaagtttactattagtttttgaaattataatatttgatgatcaaattcagttttttttttacaatacccgtctcccacaaacaagtcattttttgggtgagttagcttttgcatacttgttaacagagatgattgtttgcattttttttgtaatttgttgttataaaaaaatgcatcccaatacgtataagtttttacatattcattagaaaccttgtttttttacatgggatgcagcttaataagcttaaaaacatggggagactatgtaaaaaattaacttggtatccttactgagtaataaattaacttggtatgacaacaaaatttttactccatatacatccacacaatctataagtataagttaatttttcgttcgcgcttgctccggacatcgacggcgacgcgttgtggaggtggccgccacggaggtcatgccatgcgcgtgggcgcggagcagcggccggatccgctgccgccttgcctaccgctcgtagtcgcccgtcacagccgcgcccgccgtcaccagtgcaggatccacactggatccgctgccacgccgcctgcatttgtgcaggatatgccccaccgcagccggatccgcgcgcgtggggcgaggagcggcgaccggatgtgccggcgtgctgcctcctcgcctcccgcctgcaatcgcccatcaccgccgtgcccgcagccatgctgtgccggatccgctgacgccgcgcacgccgccactcggcggtggaggcggaactgccgcgtctctcccgcccatagtcgcccgtcaccaccgcgcccgcagccgtaccgtgccgcgtcattatgtgaggcaaaaaattacacatctataatgtgaggaaaaaaattacacatctataaaaaggacgaagattcattttacagcttaaaaaaggcacgcagcagtatccatcaggattcactgaaggtggacgacgaccacaaacggcgtgcaaaaattacacaacaaaatcaggggcaacgcgcggatgtgctcgccgactaccgcgcacggctgcgtcggcggaaggtgacgccgacgaccaggacaggcttcctctatgcccctgattctgttgatgccgtcctcgcccgtcgcaacacaggagaggagtcagatccagcagtgcgccgtctctgtccacgagctgccacctaggctcactcccttggagcaaaccacgtcgctggtgtagggagaggttgtcgccccggtggccgatgatgctgccgactgcccccagatccggaaaaaaaggatggagattggagagtgaatgggaacaggttggattagggtgccaatagggttatatattcagtatattggtaggtaaaaaatttactatcatggatgtgggatgacgctgccttggcaggactacgtggtggtttgcgatagtgataaaattactctggatagtgagaacaaaatataataagaaaaagtatttttatgacataaacaaacaaataaaattataaaatctgtggcacgtaatagtgagcggatggttatgctaacttgaattaaaacataactagtaagctaacaccatgtagagtaaaaaaagatgtcgtctgacacgtattgaaaaaaaaaactctagttgaactaaaaatgttaaatagagttaaataattactccatatgaatagttaacaaattactattgaaaactgtcagcacatatagttggcaatcaggcggacgtgcagtagtcaaaaattaactattaggtcaacgtgggtgggttcaggatgggggtggggtgtgcgcacagttagtgggtctgatcattgtgtcaggtgttgtttaataggtagcaccttaaggtgtcatatatatatatatatatatatatatatatatatatataactactatatcgtccgagcctccatcgatctgctccggtcgtttccctcactaccgagaaacaagccatcagattcaaattgggtgacataaggtaggcatgtcacaatgcgatataggatagatctcggctctacaaaacaaatccaacggccaagattcattcatgtcatcacgggttaaaatttaactccattaaaattttaactcctgaaagtttactcccagtaaaattttaactcctgagtaaatctgcgagttaaagtttaactcgtgatgtcgtggatgaatctcagccattggatttgttttggaggaccgagattcaccctgtgtcacctggtgacatgcccaccctatgtcacccaatctgaatcccaattcccaagtcatcatagatcggcgcccacggcaggcgatcttgcatactttgtctgattgtaaaatggtgtaaatgccatgtaattttttttgtcgaactgatgcaatgcaacactatgcatgtgtattatacacgtccaattgaagacaattggacgtgttgttttttttacttttttttttctttttagaaggcgatttttacggcttttttttatcgttatttaaggacttttttgccatctgtttttggaatcggagttgcttttttgctttttaaattcttttttacggatggatcttttttttgttttttcgctgttttgtaagtcggatggattttttttggccctttttattttaggaaactattggcgttcagtttttttttttcagaaggtgattttttggcctttttatttttttagacgttttattttcgctattttttgggagtcggacttcttttccgcttttttttccggatggctttttttgtcggagacggttgaatcgggatgtgactattataaagttgtgaattttttaagtagttaaggtttttttttacgggctatgacacgggtgatcgctgttaaggaacagggacgatgcaacttaattggaacactaagcggattaggatgacgtaccaaacggaccaacaaaaacatcttcaatttttataatagtagagataggacagctctattctacacctcccccttagtataactattggaaaaagtacaccgaaggtccctcaacttgacatcgagttacaaaatcgtcccccaactgcaaaaccagatacaaagcctcccttaactaacaaaatcgtttacattagatccttcggtggttttgaccccggttttatctgacgtggcgactgagtcagcgtgggacccatgtgagcctcatatgtcagaatgccaggtcatctatctccccctcttctctccctcatttctctctctctctcacttctctccaatttgatggcgacgtggcagcggtgatggcggcgacgggcgacgcggcggcggtggggggaggagcggctcgcgggctcccacgccggccgccacccacgagacccacaaggcggcggcgcgcggccggcggcagatgcacccgccgcacgggcctgccggaggaccgggcgagcgggggcggagcgggcgacggcgcggggagcggccggctagcggagcaaacgggcggcgggcagccgcgctgcgggagaggaagatggcgccgacggggagagcgaggacgccgctgccgtcgtcgtctttggccacagatctcgcgccaccggtgggagtgtatgagcgtggggcagctatacctggccaaatgggccgtgccaagccgggccggcccgagcacagcagtactgtagccggccaaggcccggcacggcacgccagcctgtgggccgtgccagcatggcccgttatcccgtgccgtgtttgggccgacgcctcagcccgtaggccagcacggcacgacacgtttactttagcgtgccggcatggcacggcccaggcatggcacggcccaccggttcatttatttttcctacgattttctaatttttcccatatatttctcatattttttatttttttccacattttatcctatttgtaccatatattttatgatatatttcctaaattttcctcacatttatcctatatttataatgttttcctttatattatgttttttctgccttttttttcttttttcccctcaaatttcaatttttataggccacatgtactagtgggccggctaccagcccacggtccgctacagtagccgtgccggcccggcacgacccagcacctccttgggccgtgcttgggccgaggccttggcacgtgggccagcacggcacggcccgctacaggagccgtgcctaacgggccgtgccctagtgggccgtgccgtcagtgtgccatgccgtgctgggccggaccgcccgtttggcctgctataggggcagcggcgggcggagcgggcacgacgccaaagacaacttcttcccgcggcggcgccgccccagcttcttcccgcactcgcccgccgccgacaccacttcgtcgccgatgagaacggcgtgacgaacgccagggagctgaagaggtatcagtgactcgcactccttcagctgtgctgcctcgtcgacgacaaggagatcgaacgggcttgcttctggcaggtagtgcagacgggatgagctcgaagcttgtgcagactgcagagtatgcttttggtgttccggactaggaaatcttctaccgaacgcttgtcgaaaatgttcggaagttcaaagtgatcagataggtgttttagcttctgaagacactgagctctagcatccttcatctctgtactcacactatcttgcacatatgtcacgaaattctgatgccttgatgccttccagtgcagagcagaaatcagcacgagttttgtcgaaacatgatttcggcaataataaaagggggtagcgcacgagacctaaaagtggatggatgcggagacaaaagatttagagaggttcaggccctctcaatgagaggtaataccctactcctgtttggggatttgaatccgccgagcgtgtattgatctgacgatctagttgtgtcatcatgccccctagagggcctcctgcccaccttatatagggtggggggcaggattacaagatagaaaccttaaccaatacggtatcggtttcctaaatctactttacaatattatcaaaccaggactttaggccgttccgtaatatataaggaaacgtaatacccgagtcatgatctattacatattccatagatataagttatcccctatgactagtcggataaccatgccgtatgggtatggggtacccataatatccacagtagcccctgagaccttcgcagtcgaaaagataatcttctctcgaaccagaatactccaaagccgagtgcttcaatcatctttgtcatggtctcccgagtacttttaccaaatctgaagactgtggagggctggaaaataaagtcaggtgcaccgactagatgcacctaatagatgtagcccctgacaatgtggttaattgaacaaaccaagcatatagtcaaggaataaataattcaaccaaccgagtggttttgataatcgtaatcaaccaagtgacttgatatcaatatatagcatatgcggtgtgaatcctccaaataacatgatccgagtgatataccaactgctttgtaaaatatgatgagtgatatagaaaaatagctataaagaagcttgtatattgtgaataaagaaatttccaaagtattgggcatacgccatgcgcacactgctttaacagatgtgcttaagtccctagaagacacatggtttcaccacacctggaaatatatggcatatgtggtgtaaaatccgagtaaataaactcataaaggatttaccaaccgcctaaaaaaatgaccacaatatataatcagcctaagccataatattggtcaataaaaatgcacacttacgtggcaaaaagcaatgatattgtatccaatcaattgcttaaaaacccaaacagcaccatgactatataaaaaagtcagcgggccagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatgctcctgagtaataaatcttctgggtaatatagaccaagtgtagctcatatgaatagcttctgatctgaatgattatcccttatgggatactccaaaataaatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtctattggcaatagctgacgcagtcggtatggagatgaaatgaccaacatgaagacgaaattgctcatcagaagtaacggaagatgtcagtggtagtaaaaacagtgacaccaatcaaaggtaatgaagttgcataaccatggaggcgaagaaaccagtcggcaacagtcaggtcagctagcagtgaagatgtaggcgcccaacaacaacgaaagaacagtcggtgatgacaaaagcaaaccgacgatgaagacgtagacgcgcatcaacagtgatggcgaaatccaccaatcatgaagatgaagaaaataatcggcggcgacaaacgcatccaacggtaatgatgattaacggcaacagagatagccgactatgatgacgaagtttcccatcaacggcagcagagttggctatgttgatgaggcttgacaagatgttgatgaagatgacgatgtcggtgatccagtcaatagcgatgtagcagccgatgataacgatgagatcctctatcggcagttgcgtagtaggccaaccgtgaagacaaataattggaggagagttgatgttgttgcccaactcgtctaaaccgaaatatttgaagttgttgaagtagaatgtctgttccgaagcaaagatgaagataatgactcctggagttgactcattggctgattaattgatttcttcagcttgacataaaatttgtcaaattttgagccttatatttgtgtagcccccgactctttggttagttgggaaacaactgaacatagagtcgagaattatagcttcttgtcgtcgagtagtcattgcttgattgaagatatgtgttgaaggtgtccaagtagaaatcctgaatattggagaatcacttgttgtagtaaaatatcatggcattgcatgccgagatgtcgaggttcacaaagacgtcgtggttggtgaagtagtaaaacttgcgaagtaacagcaatagagtttgccagtgccgaagataataaagatgaagtcgccccaccatgatgacaaagttgcatcgccgtgatgaagtgaacacgagtcggcggcaacagaagcaaactggtagcgaagacgcgcggttgtgaagataaaagcactagtcggcggcggcataaccagtcggcaacggaagacgatgatgtccatcagtagtggtagctgtataaaccagacgtagaggtgagggcactagtcagcagcagacgagacgaccggcggtgaagaagataaggccaatcaacactggcagaatcatgcagccatggaagtgaagaaaccagtcggcagccatggcaaacgtaggcagcttgtgttgaagacactgatgcctattagtagtgacagcgatgtagccagccgtgaagaaggtagcatcagttggcgttataacaggccagccgtgcaggcggtgacaccagtcagcggcggatgcggcggccggtcggtgaagacgtagacgcccaacaacggcagcataataagtctgccgtgcaggcggaagcaccaatcggtagcggcgaaggcaagccggtcggtgaagacgtaggcgcccaacaacggcggcataataggccagccgtgcaggcgaggacaccagtcggcggcgacgaaggcaagccggtcggtgaagacgtaggcgcccaacaacggcggcataataggccagctgtgcaggcggaagcaccaatcggcagcggcgaaggcaagccggtcggtgaagacgtagacgcccaacaacggcggcataaaggccagccgtgcaggcgaggacaccagtcggcggcgacgaaggcgagccggtcggtgatgttctgactgatccattcctggagcgtaagagataagcttaaagccatgaatcccttttatgcatatctggatctggatcctgcagaacaaacatataggatgagtagtatctgatatataaatataatactcgagaaaaaaatcaagtattttaaaatatttataaatatgtatttctcctcttgtcaattttgatttccccgagcagatgactctgtacgtttaaacactctgtccgactagtcataaccatcaagcaccgggagtcggcctaggcacttcccaaacatgcatatgagtgacatgagttcgtcattaatggaacaaagtttcacggatcagaatttactactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgacaggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagcggccaatgtgggaacaaagtcgtccatcaataacaatgaagacaccagtcggcggcgacgaaggcggtcgacggtgaaagcgaagatgcccactaatggcggcataataggtcagccgtgtaagcggaaacaccagtcgacggcaacgaaggtgagccaacggtgaggatgtagacatccaacaacggcggcataataggccagccgtgtaggcggaggcaccactcggcggcgacggaggcaggccggcggtgaagtcgtagacgcccaacagcggcggcataataggctagctgtgtaggcggaggcaccactcggcggcgacggaggcaagccggcggtgaaaatgtagacgcccatcaacagcggcataatagaccagctgtgaaggcgaaggcaccggtcggcggcggacgaggcggccggtcggtgaagacgtagacgcccatcaacagcggcataataggccagctgtgaaggcgaaagcaccagtcggcggcagacgtggcggccggtcggtgaagatgacgatgacgcccatcagcggcggcggagtccaccgaccgtataggcaaaaacaccagtcggcgacgtcgaaagcgggccaatggtgaagacgtggacacccatcaatattggcgatggaataggtcagccacgaaggctagggcactaattaacgatgacggagacgaccggcaatgaaagtagaagatcatcttcggcaaaggaagatggcaagcagccggcgctgcacatcggtcagattgagcccagctttagttgtgtcctcgttggatatgtgaatacatgcgaacaagcaaatcagtttgattagaaaacaagaacaaatatgcgtgcatgctactgtatatgctcttgtatatcaattaaatagaatattcttgttggttgaccgttgtcaagcttgcatgcgagatgcatatgtgtaggcgcctggatcgtcgacagctccgtgcggctgaatcgtcggcaacggattcctactcagccgttgtactgtagacgtccgatcacaccaactccatacgtcgagcgaagcgtacgtgctagcgccacctcgcacgcagctcgcggcgcacaaccgatcgaaccgtgcggtgacagcaaacggcgtgacctgaaggagaccgttcggccgcgcatgtgccgctccagaaaaagtcgcgcgtggctaccaatcggatcggcaacgacgacgatactgcaagcaaaagcaatatcatagcagatcaatctgcatttagaaattaatctaacagagcaacagattggaacgagaaacctggcgtctctttgtagatcgatttgataagaagatgattccaatggcaacagattccactggcagatgaaaagaaaatactgaagttgaacttgattttttctcctgttctgtgtatggatcatgttgctatatatccggctccggcgacttcataaatatggaaggtggaagggcagcagcggctccaccgcggcagacttgaagccctgaaggtcaatttgatcttggcaaaatcagtctcgccgaattaatcagtcgacgtacacgccggcagccgggttgcggagtcgttggaagattaaacccggtagtgttggaaaattggctgctggtcttgccgatcaaatagagaattcggcggcaacagtgattaggtccatcgccaagattaattcttccatgtacttaacaggcatacgccttaaccactcggccaaagcgtcccggagtaggctcacgagcagtcggctacacagcgacgccaccaatccatgagccggtgatattggagattaaatcgttgaatctcgccgagattgatctttgtgactccaacaacatcggagattggttccatcacactcgtcgatgaggacctcgacgtgtcccctacctggcgcgccaactgtcgaaacatgatttcggcaataataaaagggggtagcgcacgagacctaaaagtggatggatgcggagacaaaggatttagacaggttcaggccctctcaatgagaggtaatacactactcctatttggggatttgaatccgccgagcgtgtattgatctgacgatctagttgtgtcatcatgccccctagagggcctcctgcccaccttatatagggtggggggcaggattacaagatagaaaccttaaccaatacggtatcggtttcctaaatctactttacaatattatcaaaccaggactttaggccgttccgtaatatataaggaaacgtaatacccgagtcatgatctattacatattccatagatataagttatcccctatgactagtcggataaccatgccgtatgggtatgtggtacccataatatccacaagtttcttcgatcagcggcacggtgaatgatcccatgtactctttcagcgaggagaaagttgtgggtattttcttaacctgcatcaaggcaagatcatccgcgagataatactcagattacagcgagagaacgagctggataatgcgatgtacactaccattatagtggaagagattgtgtgcaaactgcagttcatgggataaataggtactcccatgacactaattctttgccgactccgacgaccccgcccagctcgctgacctcgattccgcccactccgacctctgctttgccctcgcctccaggttcctcccctgtccggctatccgtctccctcccccttcccttcctcccctgatgccctaacccaccctccctttctccctcaggatcgagaag

SEQ ID NO: 83006 - DNA, 53215 bp, Oryza sativa
gaataagataaatggtcaaacatgtgagaaatagtcaacggcgtcatctattaaaaaacggagggagtattattttcccgttgcaatgtatgggcacctaaccagggtcaggacattttctcatgtttgtagtcatgatcaaatcgctcataaaacatatgcgtgctgtatttatactccgtgtgtgtaagctgaatgttcaaagaacatgtgcatcttaacgctttatataatattagggtagttatttacctgcagggtatagggtatattctatatatgtccggcatgaattgaattaaagcttaattgcacatatcatagaaattttttttgataataggaaaatttaaaagttattaaagataaatagaattacactgtagcgtttagcacgggcatattactagtaatagttttcaattttcattcattattattgttaatagtgctatgttagtactatactagtcaagaggtggtctaataatcttttgcattcttgttgtgtgtggttcaggttcaggttcaggggcatctctcctcttttctttcccttgccgccattagcccaagcagctatctggattctggagagttgttctctggtactagttctctagcgcacgaacaacatccgcgacgaagcgcatccatggcagtggcaccgacgagagcggaggcactgtccctcttccggtccctcctccgcacggcaaggcagttctctgactacaacatccgcgagtacacgcgccgccgcgccgcggacgccttccgtgagaaccgtgccctcggcgacacggctgccgcggcggcagcattcgcggacgggaagaagcagctggaggtggcaaagcggcaggcggtggtgtactctctgtacgccccaaaggccaagagcatcatggagatgaagttgcagtgatcgacgcgagaggtttcgtgctctcttgcttgctgtcctcttactcaggatttctttctgctctgtttctaaagttatgtgataggttcgaggaaaattggtgcaatcaaagctgagatgttatcatgtttgctggataattgccatgacatggttgctatgagttgaataaatcagtcaattccacgattttggtctcttgtgttcaacataccattacctgttaactgtggttggattggtgccgattgcagcacttcgaccagggctcctcgttgctgctggggtccctcgtcctgttgccggcttgcagccaccagtcaccgttgctggtggtggtgccttgtacctgctgctctccgtcctgatggccatggccttcgtcccactggacgagctaagagatctagtgcatctgttctgaatttttcaggacggttcatgtgtcctgtattgttctatgctatgtgttcccatttttgtttttgttgtatgctatgacattgttgctgctctgatctttttttttttctgaaataatgaagataagcttgctagtatttgctttttgggctatcgatgtggtcttaattgttgctggtcctaatccttgtggttttgtgtttcttattcatgtactgggcataattatatatatttgtctcaacttttttttttcagaaataaaatttgtacagataatttgcatgtatgaaccataagcttccattataaggaaacgttcagagctcagagtagtagctgaaactgaaacatttaatttgtcaggctaacgaaaaacgaaggtcaatctgtgtacaatgaggcagttgtggaccgactggaaagctgtgggtttgatccaatttcttctttataatacagctacagagagttctgtgccaagatttttacaggagttcatcatagatttgcctgtagataaaataccagcgacccgttggctaaatcgctaaacacaaggtcttgctttcatgctcgactggtttcttcagaataaattcctggtccatgtaaaaatttgcattaacaaccttgcaggctgaataagtactgttagccatctgcttagtttttttttcacatcttttcttatttgtggtccacagtacagataattttattttgaattctatttaagattaaatttattcatcaaaaactacgattctaaaacgtggcctgtaaagtggttctcgtaaatattctttcatgcattgcagattgagtatatcattcttcactaatctactagacgcgcgaaaccagcttataacaaacacgtctcatgtgtctgaaatggcgtcctaacgtttactgtaatatacttcaatgattcatcaggtatacaatcagcatcacaaaataatttgtatcgcttaattaattacgatgtttcgaatggtggctgtcggtaacttacagaagcatgcatgacttctgattattgttggtactagtagagaaaacaagacggcatcctcactctaaccgtgtaaaattttttttaattcagtgctaaatgtcaacagatgacatatatgccatcaatgaggaacgttcaatgctctccccaagatttataagtctggtgcagatatagttttcttaccgagggaatatatatacacttcgtcttgaaaatgtatcaaatatcactaaaaacattagaaacaaatacttttagtaatattacacatctacacgtaaagtcacatctttaaattcatgatatataaagagaaaaatacaaaattcagatagacttatagccttaaaactgttaaatatttttgttatgtctaaactataatgactatggggttaaaattttcattataggtgtgtaatactactgaaagtatatgcacaatttttttctagaatttattgtgatatttgttagttggtatacacggagtatgcacatgaatcttatatgtagatgttatgttcccatccatctattatgatatataagcatttgttggttgtttagaaaagattaaggtttataagaaaagactttggtgcatcttattaaataagggagggtaagggtgagagagttcttggcagtagtattcgtgctacaagtgattatattttgatataagttttgcaggaggaaagacctaatcatcatttcattactgtcaaatgactacatattatatgattctggtttaagaaatagcatatgacaaggaggaagcaggtagaggccgatagaaaatgcaaacgttaaaaagtatatagctgtatatctatagttggtggagatgctagctagaacactactaagaaaaccatttctgcagacgaaacccttctatttttcagacggatgtttattttgaaccgtatatacatcctcttatgaaatgcttattgctttctcgcaagtacaaaacggtacggtgtcaattaatccttggttgatatcaacggagctatggatcgattacaattaatggcgctctgatgtgtgtgaaccactataatgtgtaaattaaattgagaacattttttttctgaattacacagtgcaacacagacactcacaatgcacgcacactcatgcacccctataaacgcacgcaagcaaaccctacccctatgagaatcttcgaagactgggccgataaatcctagaaattgacgaagtcaccataggcgcctcgacagggccagtaaatcctgtcgacgggtacatcacctaccacactgaaagcacaaagtcattaaatcctagaaaatttgctcccacggggagtcaaagccaggaccttaggtactactgaggctcttgtaaccactagactagaagctcttttcctttaattaagaacatttaattcaattcaaagtaatagaaaaacacgtgtacattgtcaaaatgaaaaatataaactatagctctgatgatctcactccaagtccgtcccgtttgcctatatagttagcaacgagctgctctctcagtattactaccgaacgattaaagccacgtaaagaaaacaaaaatccaaggtatctcggtagagccaattcttgcatgagaaccatggcatgggcgttgttactcagcctcgccgtgctcgccgccgctgcggctgctgctccaacgcactcccagtgcctcgacaacccgccggacttgacagccggcggaggtgaggccggcgtggtcgtacatgacctggcaggcttcgaggcctatgtcactggtgccgtccattccaccaaggctgtcctccttgcctccgacgttttcggtgagtgcatgtctaggattatgattcagggtttaaaatttaggtccgtgtttagattcaaacttttttcttcaaactttcaattttttccgtcacattaaatgtttggatacatgtatggagcattaaatgtggacgaaaaaaaccaattacacagtttgcatgtaaatcgtgagacgaatctttcgagcctaattacgtcatgatttgacaatgtgatgctacagtaaacatttactaatgacagattaattatgcttaatagattcgtctcgcagtttacaggaggaatctgtaatttgttttgttattagtctacgtttaatacttcaaatatgtgcccatatacttaaaaaatttttggcacacgaactaaacacagcctaggttttaaattttcaaaattttggaacccccccaaaaaagtaaaaagactaaattatttcgcccaaaaatttcaaatatttttagtttgtatgaatttagtaaagcttattcaatttcggtcaaaaaaatgtttaaatttcaaataattttgttctattcaaaccctatgatgattagggatgaaaatggttcggaaagttaccggattctggacatgttttcggaaacggaaagtgccggtcggaattttttctgaaactttcagaaacgggaacgaattcggatttttttttgaaacggaaacgaatatgataaggttgctatcatcagaaactttctggaaatgaattcaaattttctctcggaatcgggaacagagtatttctcatgtacaactaattagcttcagctatctcctcttaatatttagatttatactatgtattgaggtgcttaattaaatagaaatattttttgttgtctagtactttagatttcttttggctaatgttttttttttagtttttattaggtcatgtcatacttcttatagttatagatgaatatagtttcttttctaaaaaagtaaagtgtacaactagttgtattattactattgataaaaaaaaatagaaatgtcgatttgttgttttagaaaaaaatatttaactacatctattcgtcgtcgatttgagaagttcagtttaagagctttttatattccaataaatatccataccgtatttgctccgattcgtatttgcttcattttcgtatttgattctgttttcgtatccggagtttctgattctgatttcgaaaaataaatatggaaacgaaaacgataaatgttgtttccgtaccattttcatccctagccgtgattcatgagtagcctactgatcagtcactgccatttctctatttgataaacgtttataatattggctcctgcatgcatcgttgttgatcgagttggtttcttcaggatttgaagcgcctttgctgaggtacacttcggccttattttctttatctctttgtcttgttcttccgtagttgttcttccattgccggtctacatcgttgtcatgatcatgtttcatagttgttctcgtttcctccatattttttttcccgacaacagtaccgaaaggaaatcgacaaatgaacaactaccctggaaagagactgaattttacaaatcaatagcgtggataactggtgatcttctatatatgttcttacttttaaaaaaatgataggatctttagtcaactgccaactctcttcgtctttctatagtgagtttgttacttgtgataaaatcaacataatatcaacaatattgtgtatcatccgtccattttaaatcgttatccgtgccgattgagtagcctcatatatatatccaaacatatatttatcggtttgggttcacgaaccggcacagatggtatggttccaggagcatctcacggggacttggtaattaaggtcgatgttttattctgaatttaaacaaaaaatgaatattgtgcctatccaaattatactttttccagaataaattttaataacattcaattaattacagcaataatacgtcattacatgtatagtcgttgttgattagtaatccattaagcatcgcatcgcatatgggtcattacgagtcgtgctttttgtcgttacaagaacccaacagctattttttgttgaacagcttggcaaatctctatgtcttgtagaaatgattgctcttctgtttagccctttctgtttactttgtactccctccttccaagaatatgagactatttcttttgataaaaaataagaagcaattaactcactcactatgtgacaaaaccaatgaacatgcaaccaataagttctacaatggtttcttggtttccgatcaacaatttaatttaacacatagtgactataaataggacttagatttttagagaaaccaaagaatgaaatatgtctcagatttatagaaggagagagtatagtacgaggcgatccctcgatcaatgaacatgtctttttagaaatgtccctaatgacgaagccggcaaagttgtcttgaagttccagactattgtatgatttagtattaatttacgcgtgcccaatttttttttgttcgaaccatttagcatgtcaaaaaaaatcaaactaatatatttcactataagcatttccttcaagcaagtcatctcaagtttgatattttagagaatagctctgatcaatccatttgtaatatatatgcgtcgcaaggagatatatacctcttcaacccatgagatataagtacttgttcctgaaggagaaattatgtgcaaaacatcgtaattttatctatcttgcagagagaggacaaaaaatgcaatacttttcacataataaagctctatgtgaataattaattgtgtgcgagacatacaaaataaatatagagcgaagaagagctttgaaaattcccatttcttcttaaaaaaaaactgcaaaatctcaacccgttgagcaacagggttccctgcatgctctacacttctactcaagcttgtccataattataagggggtttggtgaactgttttgaggccatatctttatcagtgccgcttcttgctgtgtggagggcgcgggctggtatatggtgggaaaacccttatcagcgatgtgttttgttcgactaatacccataggacggtataattgtgctgttttgttgcattgaattccactgaatatatcgtgaattatgatccagtagtagatccggaaacaccttaaaagcatatgtgtgataatgatgctgaaaattacaggaaaatagctgacaaagttggtcaagcaggatattatgtcgctgtacctgatttcttccacggagatccttacacattagacctgaaccttacggaatggttcagcaaacattctccggtaattcgtttcaccgtcttatgcaatttgattttatattccatagaacattaattacctagtaatcgtgatcgttcagatgaaaattctcagctcctgcacctatcaggatgcacaaattaagccgcaaattaagcaaaactatatccaaagtacttaacctatactagctagatgctaattatcaagaactcaataagttgattttgaccagtatatatgaattgatcctgcaggtaaaagcagctgaagatgctaaagcaatcttttctgatctaagaaagaaagggatatctgttatttggagttggaggttactgttggggtggtgagtgatattaatcaacataaagaagaagcacattaatttgtgcatttataattatactactacatctatcagtggtgtatcttaaaaataaaaagagcccaagtaaacttatttgctataaaaactctgtttcaatcttctaatatataatttcaatggattcagcaatgagcctgggcagccgcctgaggttgctagggacaaaaaaaatgtttgcagtcacgaataacaacatactccctccataaaaaaaaaccaatctagtattggatgagatgttttctagtccaacgaagacatgagtctgtccagattcatattctaaggatacactctgaaccttcctgatctcctctccacattgaacaaacagagatctgattcatattaaagtctctcaaaggcaagttttaactggcagggaagtttgccgtggaggtagcaaaaaccaacgaggttgaagcgattgtcaccacccatcctggattggtgactgtcgatgacattaaaggttgatattctttctttgttgctgttgctgaaatatgcatgtatcatctgatctagctatagggttgcacaggaatatatagccattgttttcttattccaaagttcggcgtgacatttcacgcagaggtcaaatgccccattgagatcattggagctcagaccgacacactgacaccacaaaatttagtgtaccagtatgttcaggccttgcgtcatagaactgatcgggtgagttcccctgttataatttcgtttacagttgatatagcaaatgcatcagcatatatagctctatttgccttgcaatttgttatcctttttgtttttcagataagataatttaatttgcacatatacatgaagcacaggattcaatagaccggaagagtgagaacacttgaactgaaaaactaattaagtctattttctgaaaggaaatgagactgtagacacacaagagaattttccacggatgatgatatgataaaagatcatgctggctatattttccttttgagggaatgctggctctaattgctggtcaacatctggcaaaagttagagctgatacaatagcataaaaatcaaaagatttactagcatattgtaaacgggaaccgagaaataacaatagtatatgattaattaaatattaactattacaaaattaaaatatatttatttaatttttaaagaaacgtatacacatatatatatatatatataaaattttctaaaaaagacaccgttcactgtttcgtggtttaaaaaatagtcacagtaaacaagtgagttgcataagcgaaacgaggaaaataactcacccaaaatctaatccacaaaagctaggccatcatttggggcactgcatgtggctttaatcctatacctattcctttctctccttttttgcaagaagaacatatttttctttaaaacattcatcaaatatttcaataacaaatctttgcaaagaaatatattattcattagcaaaaaatgaacgttagaaataaccttttgttcattaattattgaagattgattactttgccaaggtcttccaaggagtgaaccatggatttgcttgcagatataacgccagcaacccattcgaggtcaaaaaagccgagcaagctcttgatttaatggtcgattggtttcacaaacacttgaaatgaagacaaggatcagctaatcatgcatgcaaggccacgactataatttcgtcaaaataaatttccgatgtccatacgtttaaaaattgcataatgagccatgcatcagttgatgtataggttatattgttggttgtaattttttaggatatatgtaaaactcaattaaaagcaacgtgtgcgggttagtgaattattatattggctaaaaagttacatggatatataacatattttagcagctttggtaatctctgtaacatttgtatatatatattaccaaccacagactgcaattattcctatgaagtagctcccaagtcaagccatgcatgtaaccaagaaagattaatttttttaataatagattaaataaaacccggcctctacatctatagaaggatgtacacaaatatggtattacatcaccaaacacttaggcttatactctccatcccaaaatataaggcacaaccacttttctctcatgtctcataatgtaaggcgtgcatgcatgcatacattaactagtatctcttggtcctataaaatttatttgttttaaatcttatactatcatcaaacctcccaatcactcccaatcacattgcttgcattcatcaaggtgatccaactaagaaagtgattaaatgttttcttggtctttgtgttatgggtggttatgccttatattttaggatggatcgagggagtaaacaagttcaaaagcaaacaccaccataggagacaaagagacaacaaagacatccagatcaagtctcacaacaaaaaatttcaactaacaattcaatcttcctctacaattccacctagattttgaataaaattccataacagtatcaagaaagattgataagccgtttgatttcatatatcatgttccaacccatcccagctcaatcatcccctctccaatatgctactgttgacaaccagcccagtccaactaatatgtgtgagatgcttgatttagaagcaggctgtaagaatctaggggttcaatttctcagcttctgacttctaggtagattttggattttacaactatagatcttcacatgcactcacatgcattcccagttcctcagtgaacagcgtgagctagctagcagtgttcaatctttcattttcggtatttgtatcgggggtgtcaacatggcgatatttccgaaattttagaaattccagtctaaaattttgaacaaaatagtcatatttgaacaaatattgtcaaaattcacgaaaaattaaaaagtttcagtcgaaataatatcgtatgggggttccaataggaccaaaatttcggaaattttgttacgaaattttgaaccctggagctagcaacaggagcaatccatggttcccacaaataaatgaagcaacacaggtgtgtcctccactatttcagaacaagatatcttaaccccttattatcagtgtcagtttgtataaaactggcataaaagaacatcaccaccaattggtttttatcatgataaaaactaaattactagtgggttttatcatgcaccacaagtgacaattatttaaaatatttgcatccatgctcctggccatcaaattggctatagatcatcaatgcctcctctctctgtctcccatgaaacaccagtgcaatgtttcttgagaataattagggcgtgtttggttaagtgtcaacaatccgggcacatatgcttactgatcgaactcccatgtgcgcatgcgtgcactgttatattgatggatacatcgacgataaaccaagcattaacttttggcgaaccggatgcactaccaaaaagtccagcaatttggccataggcctgcagcttccaagttcttcgctttgactttgcacaataattgatgattgcgtaggtagtaaaattcacaaattttatgagggaagaaatttaaatgacccaataaccatttctctttgtaatcctgcctccgtacctatataagatggacatggagcccttaaataacatggccaaaactcgatcgtcatatcaatacaacaccagacggatacaatatctaaatatgaatagggtaatacttctcatcgagaatgcctcaacctttctaaatttgtgtccctttacttactcattttagatctcgtgataccccttcttactaccgatttatagaatcaacaaggtcaactactataaattaaacatgatgttgaactcataaccgctgggcttgtggactgtcatagactgatgtaaacctatatgcgtggaaggaattcagcctcatagaagtattctcaagttgaaatttaaaatctccaaatttcaaagagatggtccttgtttgattgtccctaagttttcacttaatctttctcaggcctccacgttttgctcaacaaggtcaactactataaattaaacatgatgttgaattcataaccgctgggcttgtggactgtcatagactgatgtaaacctatatgcgtggaaggaattcagcctcatagaaaagggcacgtattctcaagttgaaatttaaaatctccaaatttcaaagagatggtccttgtttgattgtccctaagttttcacttaatctttctcaggcctccacgttttgctcacattgcctcaaattattcggttatgaaaagagtatgaacgaatgcgggaggtcgaactacttgatgaacaagttttattttttcataattgcactattcattttgagaagatcatatatattctttttgatgagcttctttcaaaatagaataaaaaggtcaaaagtacccaaattatctaatcttcgtgtgattttgccttcagaattgaaactgaaatatattttttctgaaagtacttgattaaattagaacaaatttatgagggaggtgaatttgcccattcaccatttctttttatatttttacaagattttttaaactaaaatttcaatttttctaatgaacttaaaatatggttgaaattattcctactaaacattaaaatttaatttcaattattatcatgtttaaaaatttcaatcacttgaacattttcacaccctttgacaattaaaatcaagaagaaaaaaatatccctagtgagatttttaactttgtgttaggaggcagagatgaccttttttataagaaacaaattacaaacgtagagataataatcattttgagagagagaaatgctacctctgtttgaaaaaaataagggtacactttattttgttgggacaaactttgaccaatacttattctttcatggtataaattttagagtaagttttacaaaactacaaataatttgatcaaactatcacaaaactacatatttaaatataggtatcacaaaactacagatttaacaccaaggatattacaaaactacagatttaaaacttcattaaaaaactacatatttagtgatgaaattatcaaagaactacaaattttagagtttatatcgtagaacaattgaggttacaaaagttgtagttttgtgataaatctatgttaaatctgtagtttctgatataatacaatcaatctgtagttttgtgatagtttgatcaaaatacatacagttttgtgaaatttaatctaatttctatgatacaaagttaatgttgctaaaattttttaaaggaaacaaaatgaaaatttaggaatatttaatttaattaacagtgaaaaaaaacattgaacatgggattgattaattaaaaactgatcaatataacgaaaggcacacaaaaaaatttttctcaccttaaattcaattcaaaatgtcaacaggcagcgggaactgggtgtgacattaaacaagaaactgagggcaatgtgctacctaacctaaggctaaaggccataaacaaactacaaatgccccagcaactatcgattcgatgcctcatatgtatcgtcaaaactcgatagttggaaaaccatggcaccagcgttgctctacccgaccatcctcttcctcgcagcggccgccgtcggcgccgccgctccgccgcactcgcagtgtctcgacaacccgccggacctgacgacggccggtggcggcggcgaggccggcgtggtcgtccacgatcttggaggattcgaggcctacgtcaccggcgccgtccattccaggcggaccatcctcttggccaccgacatcttcggttagtgcatgcctgcctgagctgccagcttatctgtctttgaaatattctttgatgatatattgtggattcatttattactaaccattaattaatcttgaattcttgctgttgcatgtgagtggttgcgtggttgttaattgtgggtctctacttcaggattcgaagcgccattgctgaggtacaatcttcttcttcgtttgtataatagggaaattgctgtatgtacgataaacttgttatgattttggtacgatccagtcatgcatcgtacacttgcatgaacattagcattcaattgtcatgcaagttacaacaatagaaaggtgactatggttattttgaagggatcggatatggtttttggtcaactctctctgtcttttttatagtgatctccagttatttgtgacttgcgagaaattaagtcacacataatattcaatattactgattatatatctgcatgatttatcagtataagacttggatggcgacaggccactcctgtatcgagaatcattatgtactactccctctgttccatattataagtcatttgatatttttctcagtgaaactattttaagtttaatcaaatttatagaagaatatactaatatttttaatacaaaacaaattaacatattaccaaaatatatttaatgttaaatttaatgaaactaatttagtattgtaggtgttgctaactttttctataaatttggtcaaaactaaagaactttgagtaagaaaagagtaaaacaactaaaaatatgaaacaaagagagtagtaaatatcgatatatatgccaagatactctaacgtcctattattcctatataatacacatctatctattatattattaaaggaatagaaaaaggagcctctacgttggctcacattaatcggagaaaaagaaaaagtagaatccatataaaaatataatttagaaatagctgaaattcggaattaaaaaataaggaatatagaagaggagactagagtccatatagaaatacaatttagaaatagttgaatttcggaattaaaaaataaggaatattagaagagtagactagagtccatatagaaatacaattaggaaataactgaaattctgaattaaaaataaggaatattagaagtagagtatatagtccatatagaaatacaattaggaaataactgaaattcggaattaaaaataaggaatattagaagtagagtatagagtccatatagaaatacaattaggaaataactgaaattcagaattaaaaataaggaatattagaagtagagtatagagtccatatagaaatacaattaggaaataactgaaattcagaattaaaaataaggaatattagaagtagagtatagagtccatatagaaatacaattaggaaataactgaaattcagaattaaaaataaggaatattagaagtagagtatagagtccatatagaaatacaattaagaaaaaaatagaaatttggaattaaaaaataaggaatattagaagtagagtatagagtccatataggaatttaaaactaactaaaatttggaataaacataataaaattaaaagtagagtttagagttcgtataaagatacaatttacaaataactaaaattccaaattaagaaaaacatgggaagaagagtttaaaatcaatataggagtacaatttagaagtaactaaaattcgaaattaaaaattaaagaatactaaaagatgagtttagagtccacatagaaatacaattagaaataataaaaatttaaaaataaaaataaataatattggaagaagagcatagagtctatatagaaatacaatttacagaaaattcggaattaaaaaaaagaaaatattaaaagataagtctagagtccatataggaatatatataatttacaaataactaaagtttgatattaaaaataattaataactaacacgtatataaaatataatataaatattacccattagtagttttgtaaagttattgcaaaatttaaaattatgttctcattttaatatatttgaataatataatgaggaaacatatatgctattatatgagagaaaatataatgatactagccgcgcaatctgtgcaggccactgtgctagttttgagagtaatttcttagggttttcaatatgttatccctacatggagatgatcagcagcatagcgacatatatatattggaattgtttcatattctatcctcctacagctaatctctactacttaaaaataagtagaagacatttccgttgtccgtaccgataaaaaccacgcgaaaaaaaggtttccgcatgtaaaagaagcaaaaaaaaaaaagtgtgaaaaaagtttctgcccgattaaaaaaaatcatctgtataaaccgttatccaaaaaaaaaaaacaatgttagtgggaaaaaaagttccgtcgtcgatactggaaaaaggaaaaaacgtgcaaagaaaaggtttccatcttccgtaaaaaagagtaaaaagtagtgcgaaaatttttttgttccgattcttaaaaaaaaaacccttctcccataaaaaaggaaaaaattatagtgcgaaaaaaaaagtttcgttccgattctaaaaacaaagtccgtataaaccggtcatcagaaaaaaaaagattagtgtccgattctaaaaaaacgggttacttttccaaaaattcctaaaaaaaataggttggcagaaaaaaaatgttcctcacaccgttaaaaaaaaagtccgattctagttaaagaaactggttcgacattttcagcttttccaaaaattcctcaaagtatatttgaaaatttaaaagcaaattcaattttccccttttgaataattcttttattcattcaaattatcatatatcaaaatccacctaaacatgtcaaaatttatataaaccgcgtgaggaaaaaacatcaccatttataaaataaccgatttgaaaaaactgtctgactcaacgtgagaaaaacgccaccttttataaaagaatctggtttggcaccatgcaatgcgaaaaaactgtctaaatttagaaagaaaaaacatccaattccgtgaaaaggattcgtaacatttgtattgttcatcgtctaccacgtcggtttggtttttttaaagcgtaggtcgaattctgacatctggaactaagacaagtcttgcttcggttttttttttctgagaacgagatcaaattaatggacgtttgggttagataggatccatcgattttttccatctacacggcttctctttcctcatctattctcttgtattgatagccctgcatgtctgtgtaggcaattatcatactaccatagctactattctttataacatattatatggaaataatattaaaaataaatatgtttttaattgatatttagagaagagtgcacgtggctctattttgtgtagacttaatcatgcgaggcaatataggatttgattgatcctaattttgattgcaagaataagactgaaaagtattaattttagatttttatgcatgttgttagatgaacaatccaattcttttgggtaaagcaaaacattggtaaggttgccagcaccgaggttgggccattgatttaagatgttccagttttctttatgatatgttaaaaatattatcattgacactatgatatgacattcactgctacgggatgggtttttccgtgcggtcaaaaaaaatatccacgtgcggatgaatggcccgcacgcaacacttcgtctgcgaaagtcatgatttttgcgtgcgggtggccctcccacacgcgaaaatcggatttttccgtgcggttgcttatgtcgctcgcacagaaaaataaaaatccagaaaaaaataaaattcacaaattaccgaaccctaaccctagatccgccactccccgccgtcaccggtggccggctccaggcgggggactgtgtcgccgcgagatccgtgcggagtgcagccgccacagccggatgacggatcctggcgtgggaagggcggtgccgctcctggccgccttctcctcgtcgtcggcggcggccgcatgaggtggggagagcggcgccgctcccggctgccgcctcctcctcttcaacgccagcggcggccgccgcgccgcctccaccagcagccgcgacgggcgcctccacgtcggcgcatggcagcggcgccgcttcctcctcctcctcctcatcggcggaggcctccgcgccgccgcccgtcggatccgcgctcccctccatgccgctgcccgccggatccaccctcccgtccggctgcaccgccacagaagcccctcccctccgccagatctagggagggaaggaaggggaggggaggggagcggatcccgcgtggggaaggccggccgctcaccggatctgtgcggggatgaccgccgcccgccggatcccgtgcctgcacccccgtcgtgtggagctgaggccgatgccgaccgccgttgtcgttgccatcgcccgcgcgccaaaaggagacgaggggagaggcgtgaaagagagaggaggagagagaagagagataagaggggagggatgtgaggagaaattaaaagagataaatgaggaaaaattttgaaatgggtgggagggaaaatagggaatactattttcgcgtgcggctctcttaatagatacgcacgggaaaatcggctcattttcccgtgcggtccgtttaggaggaccgcacgagaaaatcgattttcccatacgggcaacagcccagccccggttcccctatttttccgtgcagttccacttaagaactgcatggaaataaaagggggtaacgtccacgaaaatctatcgtttagtagtgattatcatgaaaagtgtcagggttatggataagatataccctctacccttggatacacgttgtatactgatacggtatacccgcgcctatacggatatttcctatgtacgttaaggaaattcgtcacgagatagatgcggaatccacagatagaaggagtcctactcagacagaactgggtcgttactgtatcgtgtggggtccgatgtctccgagttctacttggagaccaactgacctgcggtataaaaaggaccaccccgggaggacctaagacatcaaatcttaccgccaacacatccaccacagcctacaaagccggagcctacgggagccaagtcgccgggtgatttagttgaaccaactcgactacgatctcgtcggtatcattgagttccactattccctttctaatatgtgattttcattatataatcccatatcactggattagagctattacctatcaaggggcctgaaccaatataatccctgtttcctgtttgcttgatgtcgtactacgtagatcctcatatcagcgtaccccaataccctctatatccggtctacgggtatcccccgtcgacaaaaagcatatattgttattagaatttttcacccgttataacgcacgggcatatttgctagtaatataaatataccaagaggttcaaatataccatttaatagtgtggtaatcatggtttaatatctttaactagtacttagatagcacatataattggacagcaatttaaaatgggcgagtatatgcgccatgataagaattccatattgtgcttacttaaactaaaatatgtttttcatgacacatatactattgtacatcattgtatagtgtgcacatctgcttagggacaattaatatatgtaagattgtgaacccaatgttaattcagaacttattatgtgatcttccattgccaggttgtacgtcaagctatttctccatggcttgcagaaactctgtttatctgccagtactttattttaattttacatttgaaaacaatgtaaaagcagatgtttgattataaggttgctgacaatttcaggaaaatagctgataaagttggtctagccggatattacgtcgttgtgcctgatttgttccatggacaaccctacacatttgaccagaaccgtacagaatggctcagtgctcattctccggtaattcatttcaccatattaattaatttgatctaatattcccctgtaactttaccttgaaatcgtgatatatgattgagacgatagagtaaaagaaaactcgacagctgcaccaaggatatacacaaagccacaaaacaaaactttatcccaaaaatgtaacttatgcgggatgcttataaagataatatgttaaagttctaagaaaagataatatataaacagttataaacgattcaagataataaattaaagttctaaagaaagaatatataattaatattgacaagcattttcaattgatcttgcaggtaaaagcagctgaagatgctaaaccaatctttgctgctctaagcaaggaagggaaatctattgttggagttggaggttactgttggggcggtgagtcacatctatcaatcaatataagaaaatgtagttgtaatatcctgaacttaatggtcaaaatctttgatatggaattccagaatatataattcctaaccccatatattcaacaagcagttatttaattcatattgaagtctctgaaaacaaatttgttttactgacagggaagttcgcagtggaggtagcaaaaactaacgaggttgaagcaattgtcatctcccatcctgcagcggtgactgctgatgacatgaaaggtgaactttctttcttttgttgcgctgttcgttgttacaatagaaaatagctaataattgttttcttattccaagctctccttgattaattaacagaggtcaaatggcccattgagatccttggagctcagaatgacacagttacaccaccaagattagtttaccagtttgttcatgccttgcgtcaaagaactgatcaggtgagttcctgttgattttattgacggttggtcccaaatacatccatgttttttacttctaaactccatctcgctcttcaaatacttgttactggattctatttactctctttgttctaaaataaacaaaccttagataaaataagtctttacctattacaacgaatttaaacaggcaattgttcagatttgttgaataggtaaaagctcatcctatttaatatttgtttattttaggatggaagaagtagtttttgacgttgaccattcatcctatttgcaaaaataattatattacatattaacgatgtgtgttctgccataatacaactacataagttaacttcattaatctttaaaaagttattaatctgaaaaaatgatagtcaatagcgacaagcaaaataatagtttctaaatacaagttgcatgtacaaaacacacaagctagctctcactaactgaaactgaaccagtgtttaatatgctaaaaaaattgcaactgtaaacataaaagagaattaatttttactgatgatgagatgttaaaagaccttgctagctctatttgcatttttttttgagaaagaatgctagctccaatttggaagaataagtgctataacattgcatattacttccttcgttccaaaataaaaaggcaaaatcatacctttttatgttgtagttaacaatcatctccatcttccctaaatttgtttttttcaatcctccaccccaagatctttaatcacattagatgcatgcatcgtattatattgaggtaatccaaatgagaaggtgataatattttttttcttggttttcgtgttagtggtggtttgtaccttatatttttatattttatgattgcgggaataatatattatgttttataactaaataacctcttatatatgagttattgttgcagattgattattttgccaaggtctttcaaggagtgaaccatggcttcgcttgcaggtataacgccagcaaccctttcgaggtcaaaaaagctgagcaagcacttgcgttaatgcttgactggtttcacaaacacttgaaatgaagattgctaattaatcatgctaggaagaccagtgcaattatttcatcgaaataaaactctcgttctcgatataaaagtttgcatatcaagcagccatgcatttgatgtacactattttctttaaattatatggagtgaattaatagtatgttgtcgagttgatgttcgttatttatctataaataattatacggatgtacttgtgccattgatgttcattgctggctataaattacatgtggatgtacaactcaattttcacaagggtactatatatatactttagcaaaaccatcaaatttattacaaaactgtacaattatgccacagcatcagcaacctatatatttaaatcacaatttataacaaatttccatgtcacaaagtttcaatcctagcattgttatcctgatgaaactttcagaatctctagctttgtgatatgaaaaaaaaaagtttatgtagttttgtgatatattgtatcttaaaattttcttttaaaaaataataataataaagatactgtggatttacatgtgcaatttaaaatagctttattgaaatatatataattttacaaaatttactcactttaatttatatcaacttgtaatcagtatatttctaacaattaggccatgaataattgaaagggttgaaaagctaactatatattaccccatttatttcgttgggccttgggccattcatgagtaataacaataacagtagcaaaacatacagcaatgcatggcaataataataccaattaactttctaaaaaaataataataccaattagaagtctgtacgtatgcttacaaacttgtacgtataagttcgaaacaaatttaaaatgcaaatgaaaaaatagactttgatttgcattttcctaatatgaactttaattgcgaatcagcactctcgtcgctctgcatgcgtttccagtcgagatcggccccaggcatgcggccgttctctctcatgtgtgtagctcaaaatagaaagatcatatgccgaaaataaaaatctagccaaaaacagaaagatagatcaatctagtgagagacgatggctgagcggttcccaataatgtttttgccttttgtggtggtgtaatcaacggttgggcgcactctcctcaacccgtggcccgcgggacacgtgtcaaccaagtccactactattcctgcatacgtatgtataaactttatatacgtatgtataaactttgtatatatgtgtatataaagtttatacatatgctatcgagtgggccaacgagatggtatcgacgcctcagacaaccgccggcagtgtgcctagccatggcaccgggtgatggggacgatggcgagacgaatgccaagaatgcataaaacttttactagggaagccaaacctaccccttgcaatctggcatgccgggccgctcataggccaagcagcggcacgtagacaagctagacgtagcggagaagaatattgcacggacggggatacaagtttgtctcgcggcgagttgcccccctccccccccccccgggatgatgagatagtggtgcttgaggccttatgtgcagcgagcttcgagtccaccatggcttcgttggtggtgggtgtgctcgacttcttccttgttgtcgagctcctaatactgacagccaacgccatggctcacatcgccatctatgagtgaaacatgtgggtggacaacaggcaaggctccgtgaagcacttttccaccctccaattagctagttgtcaccctaataaggtgatgtaaggaagggtgacgaaatcattgaattgttttagaatctatttctaggtccacctaggcatggcggagtactttccctcacgggctaccaatgaccgataggccactaggtgaccttcgcgctaattctacctaatggtgggggacagactcggggctctgctttaccagtcaagacatacggtactagtggaagctggatgtggacgcattacacctagtgggggctccgctgaacaccatcctccgccgcatctcctctctctagaggatgagggatctagtcaaggagtcctgcttgctgggggtcacatggctaaagaccaatgggatcactcccttacattgggcacccaatagtctctatgggaggacctaggccccttcacatcgcgtggttgataaccccttaaatctttctaccttgcagtagtgctccacttgttgtctccccattccgaccttcggtacacactgcagcgttctaagaccattatcctagtcacaatggtgatcgcggatgccaagaagatactagggagttcgctacccaggaagaaggtcgctcgcctggctcgaaagaatgcatcagtttgacggaatagtgtggccaagaggtttgggcttacactccttgccatgccttctctccatgagctagaggagaccaacaaggatggaaagcgcaaggggcatcgcggggcggacgtggtccatgctcccaagaggtccaagcagggagcaaatctttggctcctccttttgtgggcgtgcctctacaggccaagcgaccaacactgttgttgtcagagacgtcggtgaaagccttcgatcatgacatcatcgaggtcggttcgtcggtctccactatccatgcaccgaaggtggtaacggtagcggttgccatagaggccaacgagacggcctggcaagtggccctcacaggtaagggtctcgtttccttcctgttatcgtgaggctatattgttatctcttacatgcctctctcttcattttccccttcttcattgtaggttttccagggtacaggtcgtagtcgtcttcttcgaaagttgagacaatgccctcgatgccgtggtggactggagaagaggaggtggcgtcgttgccacctcaagtggagatatcaactgatatggtgatatcggaggcggatggcgtccttgatttgactccggagcaagtgattgccctctgtgggggcatatcatggaggcagctccagagggcatccatgcagaggccatcatccactcatgggatccattgcctaccatcatggggcggctcgtgcgtcccagagacttggtggcgctccggttggatgtggaggcaccgatctggtcctccctgcttggggatgacgctcgtgtattggctactatgatgagatcaatggagctaatggagctgcaatgtgtgttggcctagtaggtgcgtccgtctgtccttgtttcttgttgggtttgttttgagtaatcagagtgccttcctccttcgctcaggccatggtggtcgtcaaagcatccatcaagcgtgggggaagtgatgcagcaacacaacacgcggagaggcttcgtctagacgagattatagccttaggtacagcggaggccagtggtgcagcctcataggtggaggcaaaatggtgacggtgcaactggccctcttgcaggtggaggtgtctcggtcataggtggagaaatggttgtgggatgttcataccgaggtggcccgcctgtccccggagaagaggcgttgtcttaggagattagcatggccaagggagagtcggagactcattcgcttgatgcccgcacactagatgagaatgccgtgcatgtgccctagcggttacgtgggctttgggctccgacttcgtggattgtggatcaaaggacctacagtcccaaaggacaatgcccccatcaccgacaagatgacctggtcgatgaggtaggggcttcaccaagaaggtcatcgccacctacgaggcttggtgctcataggccaccacccatatattgtcgttgcttcaacaggagtgtaggcacatcgacccctctgtttgcttggaccccgtggtgttctccatcctaatgtagggcgctccagcacaccatccccgcgtcgtgacatgaacgacctcacccggaggattgggccctcgttgggtcacaacgttgtagtggctgagctcgccgcttacaccgaggggaaaacgaagggtgtgcccaaggtgtagggattagttaattttttttagtaaatttcataaaactacagttacttcgatcaaattatcataaaactacaaatttaaggcactgtatcacaaaactacagatttaacacaagatttgaggccaactatcacaaaactaaagatttaatactagagttatcacaaaactatatattttacaacttaaatccctaccactactgctatgttagagtgataaatgttgtagttttgtacttaacatgttgcaaaacatgtacttttgtgataatattattactaaatgtgtagtttggtgatcttccaccttaaatctgtagttctttgataaagttggtcctaaatctatagttttgtgatacaccttaaatatatagttttgtgatagttttgtcaaagtacatgtagtttagagaaatttgctctcttttttttttctgtgttccctgtttcttttatttctcttcatgtagccttctctctggcttagccttgcctactgtttggcctccagactatcctttttcttaccttctgcaattcgacataatatataggaaaaatttgctagaggacggtcaaattttctggtatttcctaacgaactcctaaaaggcgtgacatggctctaggactcctaaaagacacgtgatttactagtggacaccacagtcattatttcatcattcctgggcttaatggagggggaaaccatgagaaaaagacagttctgcccctctggctagcacgttgtatgtacattagtggctttgcttatgccacgaccttaacttgtgtcttgagccagtaccctttaacacatcgtaggcttcaccatcctcacccctccagggggtggtcatccctccggccgtcggggcctgcactgctttagcattgctgcctgtttgcacctacggttaccaaggtacatatggtttagtgtgtggcgaggtggccacgtcctccagcacaaccttcaactagaacttcgattgaagtctttcgttcaatgatgaggcacacgagccattgctctagtagctttggtgatcgaatctaggtccatcgaggcatccctagtgcatcggacctattctagatttcaagacatatgacgccgtagggaggttaggcaacatgtacggtggaatggcgaccggtcatggctcgcctgccatgggatgggtcagggtaccacgtgtttcatgggctcaggccgactaggattctagatcctagggctcttcaagcagaacactgggcgggggtccttacctactcatcatgagtagcctcatgccgagtcgggtgctgttgtggggtccttccactagggatccttaataatctagccatagcacaactctcccatgaggtcagggtggctcttacagaagtccgcctttaagggcgattcattaactagtccgtccgaaaaaccgctaatctctaaataaatgtggataattaattttaagtccaactgaggaaaactaatattctgttatatatatgtgtgtgtgtgtgtgtgtgtgtgtgtgtgtgtgttttcacatttaattaaaatacttattttagtatgattgttaacttatgtcatgtagcctctttatgaataaccatactaaaggaaatattcaattaaagtagtaactgtatgtcttattaccaaaatatagtaagaatcctataaaaaatttgtttacgtcaaaaaggcttaatatgaaaattctatctttttttaaagtttggtaccatatcaaacttcttttttgtcgacgtttgatgtctcgactacggtatttggacagtatggggatcgtcggtgctagggcatacgcgagaccgaggtaaaagagatggagacagggatttttatacaggttcgggcccctgaattgtcaggtaataaccctacatcctgttggccggagccggagttgctttttattcaccataatcacaccagtacaatatgtggggtagcctatctaattgttgtcgacatggcggtctgaaggtctgactcgtagtcgacaacagggtagccttcctccttaaatccgtgtccggcgagatcagagatagcgctttcgtatctcctgacggtatccggagacaccgtaggggaatagccatgcctatccctgaagtcgatatccggcggcgtgtcttggcgtatgtaggcttgtgtgttgtggcttctggtggacgtgtgttgattgtcatgggtgtcttccatggtctcctcaccctctcctcctaggggggcttgtatttatacccataggtgtccccttgtccaagtagaactagggaaaccaatatggatacaatccgagtagtccttgtcgtttccatgtagaactctggttgtatttccttatccggaactccctcgaggtcagtttccgtataagacatggtatgtggtggatcctgcctagatttagtcaactactattaggtatgtggtatccataaccctgatagtagcccccgacttcgatgcaaatgaacgaattcatattctcaaccgcgcgtagacattggagtaactgttatcgagctcatgtgaccgttctcggtgagtttagagataacgttggacttcctttgtcagcctcgtgcgggcaccgaaagggtttgtctaagtcaatctctgatgtcgaccgagaaagtatagagcgtacgactaagtctcacgtcttgctgtaatcgagaatttggattgaagtcaagaaattttatctcggcgggtacaccatttcttcattctctattccttgtcgagatccagcaaccgttctcgagcgatcgagaaggcgtagagtctgcgacggagccttgtcaacattggtcgtactcgccttagtcgatcttggtgtagaaccatagagacatggagtcttccacaatatcaaatagaattttcctgaaaccaatactcagaaaagaatatcaaatagaaatagcccccaagcgaatgctcaaagggtgacatgttataatatgtatggtaaattgaaaataaattaaatttactgatcaatgttttgtgtatgagcgtcttctctcttaccgacttcgatcagtcagtagagtcatacactctccctagcccccagccttgtcgtcggagaaccgttctaggaggataaggctcttggacccttgacctgccttggttgaataaacactgatcctagcccccagccgtgaagttggaaaagtcaatttccgattacacggcttggttaatacgcacggcgagaactctaacacgaccagatcttacatggtcctttgtctctgaaggatccgacaaggccttatcggctctgggcgtccccagacgaggatcccttaggttcctcggaggccttgtcaagacggcgtaaagggacagtaggataggtttcaacgctaggtgtcatcgtggtaagggatctctgggtaaaacattgggcgatattgtgtacctgctatcaacttggttgaaatagaggtagtaggagagtcgctacaccgctggtcgaggaccaggcagtagtcgtaactcgaccacttaaagtgaaagtagtgggagagaagctacgtagctggtcgaggaccaggcagtagttgtaattcgaccacttggagtggaagtagtggaaggaacgctacgtagctggtcgaggaccaggcagtagtcgtgactcgaccacttagagtggaagtggtgggaggaacgttatgtagctggtcggggaccaggcagtagtcgtgacttgaccacttaaagtggaagttgtgggagagacgctacatcactggtcgaggaccaggcagtagccgtaactcgaccactgaaagtggaagtagtcggaggaacgctacatcgctggtcgaggaccaggcagtagccgtaactcgaccactgaaagcagaagtggtgggagaaaagctacgtcgctagtcgaggaccaggcagtagtcgtaactcgaccacttgcagtggaaatagtgggagagacgctacatcgctggtcgaggaccaggcagtcgtcgtaactcgactatataaagtggaagtggtgggagaaacgctacgttgctggtcgaggaccaggcagtagtcgtaactcgaccacttgcagtggaaatagtgggagaaacgctacttcgttggtcgaggaccaggcagtagtcgtaactcgaccacttaaagcggaattggtgggagaaacgctacgtcgctggtcgaggaccaggcagtagtcgtaactcgaccacttgcagtggaaatagtgggaaaaacgctacatcactggtcgaggaccaggcagtagtcgtaactcgaccactagaagcaaatgtacgagagatcactacgatcaactggttgaaaaccggtgagtaggtgtccctcgatcatttggagtcgtggtgcgaggaccgctacgctggcgtagtcatacctcgaccatctgaagttaaggtgcgagagattgctacatactgatgcgagaaccagtgagcgagcagaattatctctcgaacaccaatggaagttgcggtgcgagagattgctgcgtactggtgcgagaaccagtgagcgagcggaattatctctcgaacaccaatggaagttgtggtgcgagagattgctgcgtactggtgtgagaaccagtgagcgagcggaattatctctcgaacaccaatggaagttgcggtgcgagagttggtttattgcaagtgtatctcatgtggccagtatgactcacgtacccaacttatagcatatccggatgtccgttcgcaatcatgtcgggtgatcaagccgacgacgttcgcgaggaattatccgttaacaaccttttctcgagtagtccagccatggccggtgctatgagataggtcgtcagtctttgttggtaggttgggtgcgataactccacaacctactcgagtgctcagttgttcctgaaaattattttctagaagacaagacatatagcagataatatcgagtatgtactcaaaaaactgcatagatcttctagtattatcaggatataacgagcagattaaatatcaggcattatgtaaaccgtaaacaagcatgatttatacagaagagaacggagcgagcccccagcattagaccgtagttggcctgacatcggaagcactcgcacaatagatattgtttaaaaaacatgctctaggtaaacataataaattatagatctgacaatatcgtatagattggaaaaataggtacgataaattgtatataaattaccgcgtacctgtgtagatatatgccaaatatatctacgaaattagtagatcaattaaattattcaacctactaattgccttactgtgtatgcttggtgaggaatagtaactccttaattgatccgattgtgtgtatggtactgttccccatgtaagcatgaaccttgtattttggtcctttaattgatctgtttgccacgtcgttggaacggccaaccaggatgctgcctagagattggattctagtgcgagcataagagaactcctccaatccgacttagaatttacacccatgtacatatcaatctggctctagatttcagctccacggcgctcgttttgttggtggagataagccgagttcggtttgaacttagccagccgatgtctcacaccagtcgatgccgcacacatggaggaatcggtgtcggattgctcttggatgccaccgacacagtagcactcctcggcgatgatggttctgatctagtcggaagatgtacttggacaggttggatctccccacagccgaagtcgtcgagtagcttgttgtcggagagtccatctcttaaacccatctcgtcgaaatcctgaagcaccaaaatccccctacctggcgcgccactgtcgacgtttgatgtctcgactacggtatttggacagtatagggatcgtcggtgctagggtatacgcgagactgaggtaaaagagatagagacatggatttttatacaggttcgggcccatgaattatcaggtaataaccctacatcctgttggccggagccggagttgctttttattcaccataatcacaccagtacaatatgtgaggtagtctatctaactgttgtcgacatggcggtctgaaggtctgactcgtagtcgacaacagggtagccttcctcctcaaatccgtgttcggcaagatcagagatagcgctttcgtatctcctgacggtatccggagacaccgtaggggaatagccatgcctatccctgaagtcgatatccggcagcgtgtcttggcgtatgtaggcttgtgtgttgtggcttctggtgggcgtgtgttgattgtcatgggtgtcttccatggtctcctcaccctctcctcctaggggggcttgtatttatacccataggtatccccttgtccaagtagaactaaggaaaccaatatggatacaatccgagtagtccttgtcgtttccatgtataactctggttgtctttccttatccggaactccctcgaggtcagtttccgtataagacatggtatgtggtggatcctgccgaaatttagtcaactactattaggtatgtgttatccataaccctgacaattttaaagagttagttttttttttcatatttagtggtggtcctatttttaagggtctgtttagatcctccaaaatggcaaaagctatgccgttttggagcactttttgccattttagatataaacactagtagcaaaagttggcaatttggcatttggcatttgctagtgtttacacccaaatttggcacctaggattaaaatagggaaattgccaaagtttggacgatctgccggttttcctctgagagggccggtctgaccgccgtatgtcggctggtcagaccgccgctagtgggccggtctgaccggtagagtccgagtcagactgttttcatcgagtctcgggtttccttgcttgggaagtcatgtttcgtgtttccatctgtttctagcccgagttgaacgtggaggagggcatgtaaagggcaagaccaacccctatataagggacaaggccggttcaattgtaagagatcaatcaactatcaatcaatcgaatcgttcttttacttttgcttctagttctagtttagtttgtccatctttgtcgatttgcgccggtccgccgccgctgtgagtgcgacacctctttgtaggtttgtcctgaaaaccttctgtttttcccacgagacgggtagttatctatcgttctatctagatcggctccgctagccggtttagtttatcaaaatccatcttagtttaacttttgctagattgaggtggttggcgactctaagattaccgcaaagcgttaggtgctgtgactgtgcttgtcaactttgtcaaaaaagttgccaacagctagtccatggtagcaaattttgccaaaaagtgctccgggaccacaccctctctctttctctctctctttagtgctaaaatggcaaaactttaagatgcatctaaacactaactagtacttttgcaatgtcaaatcttttgccaccaaaacttttgccatatatttgctattccaaatagatctaaacagaccctaaatgcatttttcttaagagatcatccatgaaaatcgatttttagatgatttcctttatgagaaccacagataaaaatcactggatctttaactgtaaaaatcatgatttttgtaagcctttccttaggaaagccacccgcaaaaacgaatttttgtggacctgccaaaaaaaaggtttttataggtggtcaatgactctgaggtgtaactattttcacatgcactatttcttttggactgcttgagaaaataaatagtgtagcgtcaaaaaaaaatgatgttttatagtgtatatatcggccggatgagaatagagatcagctggactgatatctctgcacgttaataaaaactgcagctaatctcgtccatccattttgatcactacgggttcagatccaagttgacagtacatatatgtaatatcaacaggcctctagttaattaagtaattagtataaaaatgaaaatatgaagatggttatctggccagtggccttccagtacacaactacacattagcaacagctagtggaaatactcaaataatactgctatgcccaggaaacactagtaattactacctccgtccctcatataaagtcatataaaggatattcactatttttaaaatactaatgtttgaccactcgtcttatttaaataatttgtgcaaatataaaaaagaaaagttgggcttaaaatactttagatgataataaagtaagtcataaataaaataaataataattttaaattttttttaataagacgattggtcaaacagtacaagtaaaatgttaaaatcccttatacgagttgacggagggagtaattaaatactgtcgccgttttcacgtcgctaccgttttaatttgtctgcaatataacgaattaatccggctatctgcgatatagccaatatatcatatctatgcgttatcttgttggaacgtacaggatatggccatccatgcgatatggccaaaaactctatgtacggttttgttacatcttaatcttctccgtcgtggccgatagagaccacacgtattacaagctaatcacaaatctagggatagctatattatatatttgtttatgacccatatttttcaccccaaattagtaagataagattcttttttacattgtaaatttaaaacttatacatatactacatattaaattacattatttacatattgttattttttttctaatatacgagtataaaatgttggaaatatagtcattaatcggcatattttaatccaagaaaaagaaacaatgatcatggcataagtagtgtagggtgatcttaacataaccagtagcatactatgcgcatcatgaatgtcgagaacaggaacataccagtaacgcgataacatgctagaggcatcatgtagaacaggaacaagcacatagtataggagaagattataccccgagaatggccctccgctggatggtgaggcagaattgcctccgttgttgtagtcgttcacggcacctcctcctggcgcaccagctccggatccagatccagctcctgtcggcggcggcgtaccaccttcgtcaacagaggcggcagcaactccagacatggcgatgagcagtcgtgcggaaggcactccccaaaaacctgatcacccgcctacccggtgcagatctcaggccaatctctcatgcgcgcaagagatcagaagcggggaagcgagagagcaactcaggcacggaggaggagaaactaacaccgggaaacaagcgaagaaaaacggatcagactcgcggcctccttatctatcaggagaaagaacgtggacgcgggttagtggctgcaaaaggatagcgacgtgacgtgacgtgacgcacgcacgccgccctcgccctcgccctcgcccacgcccacgcccacgccccggcccggcccggcccgcgcgcgtgtggcattctgacccccacctcaactggtcaacagggagcctctaataactccctatttaggttgagatatttctcgcttaaatcctgaggtggtattattatccttaacatttattatgggcctttgagatttaatagaataaattgggcctagcccaattattctaacaatccccaccaaatttcaaggctcataagaaatgttctcaatgttgtgcctgtttgatataccagggttttggtggagactgttaagttgaacttccacctaggaaatgagctacatcagaccacaacttaacaatggactatgccttgaattgtaagttttgtgtgatcaggtttcactcagaaccttgactggtactgggctgccgttcgcatcccctctgtttggagcatataagtcaaactccaggcctttcatgagtatctagagattgcccaaacctcatagactgtgactagcagtcgaactcatataggtgtgttccttctgagatgttctgcaggtcaacatctctgcttggaaaagccactcggatcacattaagacataagccatcctaccatgcaggaaagaagagaagcacatcatggaaatgagctcttttcaagggtctcttctctcagtcacacaatagtttgtttcaccatccaaattcacgggatctccgatcacaatggacaggtttctactattatgcaaccttaggtgggtatcaagcccatttccctcgatgcactgtctatcacattacgtggtagccccttggtaaactgatctgccagatttctagccgtttggacatagtccaatgctatcactccggagtttttctgctttctgacatatttcagtcttctcttgatgtgtctagatgacttcatgttgtcctttgaactgttcactttaataatcactgtttgattatcgcagttcattaggatagctggcactggtttttcaaccaccggcaaatccatcaggagttcacgaagccactcggcctcaactgtcgcagtatctagtgctgtaagttctgcttccattgttgacctcgttaagatggtctgcttgcaagacttccaggaaacagcgccacctccaagtgtgaacacatatccacttgtggcttttatctcatcagcatcagatatccagtttgagtcactatacccttctagtacttttggatacccggtatagtgaattccatagctcatagtgccctttagatagcgcattactctttccagagcctgccaatgatcatctcccggatttgagacaaaccggctcagcttgcttacagcaaatgagatgtcaggcctcgttgcgctagccaagtacatcaatgaaccaatgatttgagagtatctcagctgatcccttgctattcttcggtttttcctgaatagcacgctgggatcatcaggagtaggagctggcttgcagtcactatatccaaagagactcaaaaccttgtccacatagtgggattgcacaagtgtaatcccacactcatctcctctttgtagtttgatgttaagaataacatcagcctctcccaaatccttcatttcaaaattcttagacagatagtctttgacctcctcaatcacattaaggctggtcccaaagatcagtatgtcatcgacatacaagcacaagatcaccccttctcccccaccatagcgatagtatacacatttgtcagcttcgttcacaacaaagcctgcagatgtaagcgtgatgtcaaacttctcatgccattgcttaggtgcttgcttgaggccatacaaggatttcaatagtttacacaccattccctcctgaccttctagtacatacccgtctggttgatccatatagatctcctcctccagctctctgtttaggaaagctgtcttaacgtccatctgatggacgagaagaccatgagaggctgccagagcaagtagtactcgaatcgtagtcaagcgagcaactggtgaatatgtgtcgaagaaatcctcgccttccttttgggtataacccttggccacaagccttgccttgtacttttcgattgtaccattaggcctaagctttttcttgaaaacccatttgcatcctacgggcttgcacccatatggacgctcaacgacttcccaagtaccattagacataatcgagtccatttcactgcgtactgcttccttccagtagtcagcgtcaggagatgaatatgcctcttctatggttcttggggtgtcatccacgaggtatacaatgtagtcatctccaaaggattttgcaaccctttgtctcttactcttgcgagtatctacaatgttgtcctcctcaggattttcctcaggcgtttcatcattgtgttctatcggtgcaaagtgctcatggggcatgacagtttctttactagaagtgctaggtgtatatttcataggaaattcattctcaaagaatgtagcatctctggactcaaaaattgtaccagcatgcatgtcgggtactccagagtttactattaagaatctataacccacactgtggatagcataaccaagaaacacgcaatcaacggttttttgtccaagtttccgctttttgactataggtacatttaccttggccaaacagccccatgttcgtaggtatgagagatttaatttcttcctttcccattcctcgaatggtgttacttccttatgcttcattggaattttattcaggacatgacacgcagtcaaaactgcctcaccccaccattccttcgaaagccccgcagtgtctaacatggcattcaccatctcagttagagtacggttctttctttcggccaccccatttgattggggtgaatagggaggcgtcatctcatgaataattccaaactcttcgcaaaaagatgcaaactcattggaaaaatactccccacctctatcagacctcaaccgtttgattttcctttcaagttggttttctacctcagctttatagattttaaagtaatgcaatgcctcatcctttgttttcaatagatacacatagcaaaatctagtgcaatcatctatcagtgtcatgaaatatttctttccccctttagtcaacacgccgttcatttcgcacaaatcggaatgaacaagttctagaggtgccaaattcctcgcctcagatgccttgtgaggcttgcgaggttgtttcgattgaacataagtatggcacttggaacctttgaccaaagtgaattttggaattaaactcatgttagctaagcgcgtcatacaaccgaaattcacatgacagagtcgcgaatgccacacattagactcatcattctcgctaatatggttcacagcattatgattattacacatgtcattcaaagaaaagcggaacaagcctccgctgtcataaccttttccaacaaaagtcccatatttagatacgacacatttattggactcaaacacaagtctaaaaccttctctacacaatagagagccgctaactagattcttctttattgaagggacatgctgcacgttcttcagctgcacggtctttcccgaagtaaacttcagatcgaccgtaccaacaccatgaacagccgcaagcgacccgtttcccatcaacaaggaggaacctctcccgacctgataagaagaaaacagagaaatgtcagcacatacatgaatattagcaccagtatccacccaccaatcaggtgaatgaaaaacagagagaactgtaggtaatattttaccgtaccccgatgttcctccgccctcgctaatgatcatgttggcagacttcctgtctttgcgctcaggacagtccttggcccaatgcccagacttgccacacacaaagcagtctccttttgcctttcccttgcctttcttcttaaaattggttgcagccttgggtttgacatcaggcttgactttcttgttgttgtgggatgcatgagggttcttcttctgtaccatattggcactagaacctccctcaacctttttgccccggatgtcctttgccctcgccttctcctcaacacccaaagagccaatgagatcaggaacactgaactcttgtctcttgtgctttagagaagtggcaaagtccgaccaagaaggtggtagtttggcaataatgccacccgccacaaacttgtccggcaactcacagttgttgttctcaagttccttagccagcatctgaatctcatgagcttgttctactacagaacggtcatcgaccatcttgtagtcatagaactgctccatgacatacagctcactgccggcgtcagagactccgaacttggcctcgagtgcatcccacatgtccttcccagaaggcatgtgcatgtacacgtccactatgttgtcagcgagtacactgatcaatgctccacggaacaggcaatccgaagcctcgaacttagcctcttcctcaggagaaagaggtggttcacttcgtttgccccgtgaaacatagaagcactgcatcgctgtctaccacaatagtgcacgtgctttccatctcttatagtttgaaccatcaaaagcatgtggtttcagtgcagcagcaaagccaactaccgaaaatgacctatcaggtttttggattgttggaaatatagtcattaatcggcatattttaatccaagaaaaagaaacaatgatcatggcataagtagtgtagggtgatcttaacataaccagtagcatactatgcgcatcatgaatgtcgagaacaggaacataccagtaacgcgataacatgctagaggcatcatgtagaacaggaacaagcacatagtataggagaagattataccccgagaatggccctccgctggatggtgaggcagaattgcctccgttgttgtagtcgttcacggcacctcctcctggcgcaccagctcctgtcggcggcggcgtatcacctccgccaacagaggcggcagcaactctagacatggcgatgagcagtcgtgcgggaggcactccccaaaaacctgatcacccgcctacccggtgtagatctcaggccaatctctcgtgcgtgcaagagatcagaagcggggaagcgagagagcaactcaggcacggagggaatcgtgggaacgtgggttagtggctgcaaaaggatagcgacgtgacgtgacgcacgcacgccgccagccacgcctcgcccacggcccgcgcgcgcgcgcgtgtggcattctgacccccacctcaactggtcaacagggagcctctaataactccctatttaggttgagatatttctcgcttaaatcctgaggtggtattattatccttaacatttattatgggcctttgagatttaatagaataaattgggcctagcccaattattctaacataaaagaattagaattaaaaaataatttattattatcaacttaaaagagtatatagaagatatatatatatataggaaagagagtaatcacataaaaagactaaaattaagtgaaaaatatatgcatggtgtcataattttagcaatcccgtctaattttgcaggggccaaaacgcataattttcctctggagcagctatatatatgagactctacgtgctcactccatcgacactggccatccatcccgcctatgggtagcacgggagaagtaatgctggcatcgggaggaggagcggcgccggcgccggcgacgtcgcgcgacgggcggggcgccgccgcggggctggggcccgtcgcgttcaaggacgccgccgacgccgacgccatcccggtgcgccctcccacggagcacgacgccgccgtgtccgccatgccggcgcgcgtcttccacaacctgaagctgcgacagcaccaggggtactgggtgctcgacgcctgggcgcgcggcgcggtcgccatgcagcgcggcggcggcggcctcgtgccccgcgccgacggcgacgtcctcctcgccagcctccccaagtcggggacgacgtggctcaaggcgctcgcgttcgccgtcatggcgcgggcggcgcacccgccggcgagccccgaccacccgctccgccgcctcaacccgcacgactgcgtgcccctcgtcgacaggctcttcgcccccggccgcgacgcggttctcgacgagctgccgtcgccgaggctgatgtgcacgcacatgccgctgtcgctgctgccggcgacggtggccgacggtagctccggctgtaagatcatctacatttgcaggtatccgggactttgtgcgtgataaagtttgaggacactggctagcaagtactcctatatactggcttagtttattaacttacacatgacatgaggaagataaccaattgtggagtaaatggtaataaaataaagtgattgaattaataggacaaaaaaaatgatgctacatctttcgcaaaatccttatgtaggccacaatgcaaaaaattcataccgaattcaaatattaagtctaaactcaaatgtgccggatattaaaagctagatattaggcacatgaaaatttgaaaattccaaacacctaaaattatgcattaattgctaatcataaatttgtagtgccatgttaatgtgttcgattttagttcattttaactacaaaaatatattgtagtagtatatagatttactttatttttgcatttcactttgttttttttaccaattgttaattaaattatttcatggtatttgtaaaattactttaagtttaggttataatatatcattgttacacctcttatctatgaaataaggataactttgcaaacagatagatataccacagggaacaatgagaaccgtgccttcctgatgcccttattacaatattgcttgaactgtcataggtaccggttagaaactggtcataggtatcggtttccgtagtcggcacctatgcagttgcgcataggtgtcggttcttaccacctaacaccggtgtgaggaacaaataaagcaaggttgctcgacatcgagcagctactgatccccatccaagaaccattcctataagatcccctcatcacatccaataacacaattacgaaatcaacactaagatacaaaatcaatatcaaagaacaatagagaatacacagagaggagaataaaataaatcatcgcagttgctgcctctcgacaaaccggtgctgctcccgcttgatccccttaaggaggatggatccagatgatgacgttcaaggtggagatgtacaggcccggcagggtgtgcagcggcacgggaccttgcgctgctcaagcccgtgctcaccgtccaccgccgctgccccagcctacaccaccgctaggacgggttactcgtggatggcgctgcgacggggcagaagccactcttctccgtacgccgcttgtctatcctcggcattggctctgacgccggcgctgtcctcgtcgatattctcggccccggtgccaccagcgagttccacgttgacaggtccttctagcggtgctactgctgcgtggtagccggattcggcggaccccgacctccaggcggccggatctagcatggcttagaggtagtggtgaggaggaggggcagaattacttggaggggcgtcaccagggagaggaagaggaggcagaggagggaggagtggcggcggacgaagatggatgaggaggaaaggcccgtgtggtggggatgtgcaaaagatgtggacaaggagtacggggtagggagaaaagtagggagaaaatgtgaggatagatgtgtgaaagatgtggataagaaagtggcttggctccgtcaattttatgggtaatagttaattaaaaaatcagttcatataatatattataggttcttttttaattattaaccagtacctacaatatattacaatatattataggtcctagttcatttgaaaatattatgctgattttttctttagaactgacatttatattactcaaaggtgtatgttctatatttttttcatcgtgcaaatgtgagaaaatatccgtaggtaacggttttaaatgtcgaccgacacctatgaatcgatatcaataaggggtattgtagtagtgttaataattgtgatttctgtgatgaataacaatgggcagagaagaatatatagaatcatgtcgttattatatatatgtgcaaacaaaatatgatgagggggagagagagagagagaacggggagggagagagcgactggagggtattgtagtagtgttagtacagcgcaaggcgtacttgtgctagctacgtgatagaattggacaattaacgtggaagtaggtgactgggtgttgtcatatcaattaggtgtaccggatatttgttagctacaataaggacggtcgacggaatgggactgatatatgcatgggctagctcgaccaaagttgctagctactgtgtgtccttcaggtaattaatcggacagatacacaccacactttttatattatactccccccgtttcaaaatgtttgacatcgttgatttttttaagtacgtgtttaactattcgtcttattcaaaaaatttaaataagtatttattcttttcatatcatttatttcattgttaagtatactttcatatacacatatagttttacatatttcacaaaatttttaaataagacgaacggtcaaacatgtgctaaaaagtcaacggtgtcaaatattttgaaacggagggagtaagttgtttgatttttttattagttaaactctcttaagctttattaagtttataagtgtgtgtgtgtatatatatatatatatatatatatatatatatatttctaatataaaacaaacatattatcaaaatatattcaatgttaaatttaataaaactaatttaatgttataaatgtgacctaaagaaatttgactaataaaaaagtcaaactacttatatatcaaatggagggtgtatataattaaacaacctctatatatagccataatttgggcacatatattcctctttaatctctctcatcaacagaccgggagtaaatacataagatcttatacacatactctctctttctctttctgtatatgtgtgtggtatatatagatagacatgtcgatatatataatattcaatttgcggcccattatatttgtaccatgatgaagtgataattaactaagattgttaatgtaaacaagtgggatggaataataccaccattttcaaattttgcttggtgcatgtgcgaagaacctagatcactgaaagacataaaaaggcaaaaattaacaagttgcttgtgacaaatataattctcatatgatatatgttcatcgttttcatggaacacatcatgatcaacaatgttttactcctatcattcatcaaaaatccaaaccacaatttgataattgcatcgtgaataaagtattagagcacacacatcgaacactataatataatcactgcagcatgccatgtgtaattaaaaaaagagcacatcgatcgatctaaagacaaattaaagtttaacatataatgtccagccttaattgagctaggtaccccaaaatacagatatgcctcataatcttcgtccaatgcaataactagctaggtggtaaccaggtttgaactgtagttacgtagtttttcgattttgctatttgttaaaacaccattgttaagtcttattccttttttttgcaataaaaaagaaggagctgtcaaaacatataaatgtacatgtgcagggatcagaaggatgcattggtctccatgtggcacttcctgaagcgcaatgggctacaaaatctgtacgagtccttctgcgagggcacatgcttcgggggccctgtttggaatcacattctcgagtactggagggcaagcaaagcgaacccaagcagggtgctcttccttagatatgagcggctgcttcaagacccaacagacagcatcagggagctagccgagttcgtcgggcagccattcactagctccgaggaagaagctggtgttgtcacggagatcgtagagctctgtagcatggagaatctcatgagccagaaggccaacaaggaaggcgcccaaggtgtgttcatcaagttctctcacgactcgtatttccggaagggggtggcagggggttggacgagccacatgacccctgagatgggaagacgtctggatgcgattctccgggacaagtttgatgggtcaggactcactatctgaatatgcatttagttttacgtgtgtttcgtcttttaatttatgcttaacaatatatagtagtacgcaaaaaacgttggattgttttttttcttgttgaaccttttctccatgtattgaaataatggtgttgtttggaagtatagtctgtaaccttttatgcttgtaaaacggttataactttgtaatttccagggcaccaaggaaaaccctttaattgtaatttccctaattcggttaatcacaatgtagcttgtattttggtaattgttagagttactctggttactgatgtaatgggataatggactagctatctggcataaatacataatgattccccacacattgctgcaagatggctgtggatatcatttgctttggagagatgcgcatactatataaaatgctttctagaagtctatcatcaatgattactgcaccctaagacaaatttagtaaattaaggcaaactgtttcagcttacttaagaattcaactaacttcatatatatttcccaattcaagatgactaaactaactaagtgtaatgtcaacaatcaatccagtatactgttcattgaaatataagctagaaaaattcaacctctaattctttcttttgagaagaataaaggaccaggtcttcgacaatggaagcctttatgccatatccatgtacttgtttatgaagtcataaatcctataaatcctataaatcctataagtttatacaggatttataaatttaatatagattactaagtatgctagtgttattgcccaagccccatatgatgagtcatcttaagggagggagggaagtaattaattaattcacacatctgcaattaatatggagatgatatatactcctcccgtccgtgaaagggcatatagcctagtggttgcagtgatctgagtagcacccaaggtcctaacttcaaatttccatatgagcgaattttagattgagttattagagggcaagttccttatttgataggctaagttcctaatttaaaaaggctgcatatatccggttggatgcagaatccgggtaaaaaatatccttcttaaaaaaaatactcctcccgtccaaaataaaacgaacctaagactggatgtgatacattcagattcgttgtactaaaatgtgtcatatcccgtattagatttggtttttatgggatggaggaagtatatccagtattagatttggttttttatgggatggagggagtatatactgctcgcagcctacatgaagaacatgtcattgcgcctccgctgagttggggcttctatttttcccattttcactgatagctagatctaaattttcatgagctatgtttttattcttactaattgtgtggaggcaaagcagctgtttgcatactgttcgtggatttgtgtatcaaattggcatgtgtgtgttacaggatttgttctagtaatttggcacatgtaattaatttggcacatgtgcgtggatatagctaaaactgctgatttagatgacaaatcaagatgtattatggtaaaccttttttaacatgctccaaaataaatacatcaaatacaaaaatgagagagagaaaaaaatgatgatcgaagtggaacggaggaagtacggtggtaattaagctagttacaagctccagcatacgctgcaagatccctagaacacactactagaaaaccacaaattggggacatcctctatctacaaggcctttcctatccttcgtaaattcttaaattaaaaatcaacacctataacgtgccaatttttctaaaaaccaacacgtataatacaagtgcctgattttctttaataaaagcagtacaaataaagatgtcatatgtgctaggttttttggcacattattggagcagcagcaccagcggaaaaaaaatcacatagacatacgccatatctcctcgtgacctcgtccattcctttcttatatccgtctctctcaaaccctctaagcctccacctaagataatcttcatcttttctctcattgtctctcactctttactcctctccacctctcagcatcctagcctgcgacgctacgatgacaccccaacacgtaaaggcggcagcctgcctctcccagtgacacgacgattgcggcgaacaagccattaggttatcctctcaccatggccacagcctcagttcccgcagacggattcatcgtcattggcgatggcggtggcaccgatgccatatctagattgtccgagttcaggaacctctagatctgccctcctccctcccctagttatcactgtcgaccatgacgagcgacaacgagcaacagtgacctcccctcggtggggcagcatcagcatcctcccctcggccccacctccccacaagcagcggtggtggcgatccacatgactaaccaatacccctcctcccaaaaaattcccctccctgatctctcccaccaccccttatatctgactgtggtcttctggatctgagtagtggtggtgagcagtagcggcaaaggtggctttggcctccgatgggtggtggtggccttggtctccgctgggatgaggcaatggaggcatccttgtgttgatttgtaaatatttttttctttgaggggggaggtcgtgaatgttatgtgtgtaatttctgggatgattctgatacattgtcattggatttgtgagaatcttccattcagtttttgtatgtgttcttggctcgtagcatatgttcgattcgagccgatgcatcgagcattttttttattcatggaatctcaaaagcaccaatttctagaccattctccacatcagtgtcacatgaagggtgccggttgtgaatttgacaccaaagaccggttcccaactgacacaaaagtgagttcctatagtagtgacagatcgaatgtaactgcagcatttacctaaacagaggttaattacaataattaacaaaaaagatggttgcctatggtgattgacaaaaacgatgggtagcatcggaaggattttatttggtgcaccgaaaattacataggtcatagatgtacctgtttataagcataaacagttaaagttaagcctccaaacaggctaggaggctttgttttattatgaaacacatagcttgaaaactgtgactacaaattaaaagatgaaaccccggccataatggcgcatcatatggtgagccccgatccatcaaacttttctcgcataatcgaatccagatgttcgcccatcttaggagtcatgtggttcctccagtccccttccacccccttcctaaaatacgagtcgtgcgagaacttgatgtacacaccttgtatgccttctttgttggctttctggctccttagactctctaggctacatagcttgacgatctccgcaacaatgccagcttcttcctctgtgtcagagaatggctgcccgacaaattgtgcgagctctctaacggtgttcactgggtctcgaagcacctcctcatatttcaagaagagcactcggcctagatctattttgcttgccctccagtaaccaagcaagtgatcccagacaggaccagcaaacccagtgccatcacatatagactcatacacttcttggagcaacagatctggcacattgcgtttccgaaagtgccagatggagaccaatctatctttctggtccctacaaaatataacaagctagagtaaagcaatgtttcattgtcactaaagttaatactatgtgaataaatgttttggattttggtttgcaatttctctctttctaaatatacatattgtatccaggacttgcttttgcgaattcatgaaattttggacaatgtttggatcaagtatgtaagaacaatatttttttcctagggtagagatcgaggttgttgaacaagtccaacaagctaacacacgagacacggggctctttacttctcaaagggcaccatggtctagagcatcatgactcattgcaagggagacaaaataagtttgtttttcaccgaactcttgcatactaatacaaagcaaaaagactagaataccctctactttatcagtcccctacttacctaattacaattaatgcatttgtcccctactttcataaaatccaatgcaatgatgactcaaagatgaacttattttgggacatacaagagggggcaaagataattatatttcagaacagagggactagaagcttgcgacactatagaaaaacatgaactgcctctccatcgatatggatataaggaaaagggaagccaattatttgacctcatcaccttgaactcttgtaggaggataatggcaccagtgaaagacaccatctaccaatactgcaaggatgactctcagacggaggggagtgggtgtggaaggggatttctttttgctttgaaggggctcttaccaaggtcatggttgtaattgtgcgtttatcttcttgtatagaaaagagtagattctataaaaccccacctattatggttcaagttgtacaaaaccatagagattttggcatgtgacacataatctcaagtattatgtgtaaccattttaatgtgctcctatatcaagattttaaaaagtggacaaaacatttatatgatgaataaaattctcaaaaatttaaattgtaattgtagaactaaaaggtgtggttgatcaaaaatcaaaatgttcaatagtacggttttatgaaattttagaaccataatatccggtgtgatgtgccacgtatcaaaatccttatagttttacgtaacttacaccataatagtagggttttatgtactttacttatagaaaaatacaatgttaaataatgacaacaaagtaccagctaatctagatcctgcaataaccaaataggaaacatgctacatcaccatatttggtagagggtcccgttctgtcataataatactacgcagttgtatcacacatagcacagcacgtggtcatgtaccatctttcttcctaacgcttttctttgggaaataaaaaatctctatttaacggccatatggcaaaatactcatttttaagggagaaatacataccatttccaaaattagtttaaagttttcacacatgagatttgagatgagagcagctaatatttgaatctgatatgtataaatttcggctggtgtacaaaaacgaaaacgaccggatatgattcaaaactaagattccccttagtaaaataatattacctccgtcccaaaataagtgcagccgtggatatccgtgtccaacgtttgaccgtatgtcttatttgaaaattttgaaaatatttagtcacacataaaatattattcatattttatcatctaatagcaataaaaatactaattataaaaagttttcaaataagacgaacgatcaaacgttgaacgtgaatagtgcaaaactgcacttattttgggatagagggagtaccaataacaatataacgaataagggatggctagctatagctatggttatgggtacctgcaaatgtagatgatcttggtgttggagttgccgtcagccaccgccggcggcagcagcgagagcggcatgtgcgtgcacatgagcctcggcgacggcagctcgtcgagaagcgcgtcgcggccggcggcgaagagcctgtcgaggaggggcacgcagtcgtgcgggttgaggcggcggagcgggtggtcggggctcgccggcggcgggcacgcgcggcgcgccatggtggcgaacgcgagtgccttgagccacgtcgtccccgacttggggaggctggcgaggaggacgtcgccggcgcggggcacgaggccgccgcggtgcatggcgaccacgccctgcgcccagctctcgaacacccaggtccccccgtagcagcgcatcggctggccgtaggagacgcccgccggcagggcggagacggcggcggcgagctccgtcggagggcgcaccggcgtggcgtcgacgtcgacagcgtccttgaacgcgacggggcctccaccatggcgcacagctgctcttgctgccggctctcctcccttgttcgccatggcggcagcaagagcgagtatcgactcttataagaccctagtacttactatactccgtatattggtttgctgttgagaaaagatttggtatgcatggccagatggccttgacagccggatgagattctctacaatactttatttggcaggttactataggcactatctggacgagattttagcggccacagtttctccaaaaatttctagctctcgaatgatcaatattcttatccggattcttaggcccgtttagtaggactccaagctccaactcccaactttaaactctaactccagtgatagctagctcctataggagctgaagtgggtatataagtatttggctagattgattagctccacaccaacacgtcccttgttggcatttagttgaacacctggttggtgtcgccccactgcctccgccaccgcacgcgcatggccctgcctgctgccgcagccgacgctactctcgcacctcgccctgccgccgccgaccacactccaccgcccacgtgccgtctcccgccaccgttgccgctcgtggccctcgccgccactccaccaacacctgccaccaccgcctgccgctgccgacaccaacggcgccgccggtgtcaagggatgaagatggggatgagcgagaacgggagatggggtaggaaggggtagttcagtagcattttggtataaatagactaaaaaattaaagggtagtgggtcttttgcggtggagtgaagctgtggagtagcaaaaacctagctccacccccgtagtacaaatttgtggagcagctctactaactccgctccaaaaaatagagaatctataccgtttggcacagctccagctgtaggttgtgttcgtcagttggagttgaaaacactttcctcattgcacgcaaaacgaaacaacagtttagcgtatatttagttaaatattagctaaaaatttaaaaaatctaaagtagtgaaaggattcatctttccactggtggagaaaccatctttggtcggtctggcaaaatccacaatagtcccggttccaaaaagaaccgggactaaagataaaaattttgatcttgatctttagtcctggttcataccctgtcagatgtatgtcagggggccgaggatctttagtcccggttggtgtcaataaccgggactaaatatcaccattttagtcacggttggtactcttgatcattagtcccggttggtaataccaaccgggactaaaattaaacacgtagtatataatccctatcacttatcttctcatccacagttataacttagacagatcgaatctcaccccctctcctcagatctatcctctctaactctcttcctcgtcccctctcctccagctcctccccttcctcctctcctcccccttctccccttcc

SEQ ID NO: 83007 - DNA, 1475 bp, Oryza sativa
ataagataagcggccacccatgtttaaaaaagtcaatggcgtcaaacattttgggatggagggagtatttttcaagataaatctattcatataatttttacattttcaaactcaacaacttgagagttattcttgatttatattcccaaggtttaacttaatcattctaaacgattttctttacgagtgagtacggagggagtatatagcaagtgtcagatatatatatatatgatgaatccaattaagcacttgtattggtaatacaaccgtaagaaacgagaagagacgtattttacggaaagactaaattcgcgtgcgttggcgcgccgcgttttaggcccacgcccgcatatgcgtttctggcccaccagctacagtcgattccaattccgtccgaccgccagccatctgccaagtgcgtgcggttactacaggattagaaaagatcattttataattaagtagttactaaactaagataacctttctttttatattggcgggagttttttttctctttctctactattataaaaattcacgatatttttgtcgatattttggtacgtcatccgtgtatgagtgggtttttaagttcgtctgcttttggaaatacatatctatatttgagtcggtttttaagttcgtttatttttggaaatatataaggagtcgtataagaaatctctttaaaaagactcgcatgctaacttgatatgatcggactcctaactgcaactcattgttttctagaaatatatatatccaagcgaactcccatagtgaattttatcttaactaaaccatataacaataataagattaaaataaacttcatccgttgcaacgcacgggcatttttgctagtttactaaaaaattgaaaatctatacatattttttcttaactttcaaataaaatctaaaacttcctaagaaattaaaattcattaaaaatgtaaaacttccaacttgagatttgaaaactttcaagtcaaatttgaaaactttcaactcgaaatttaaaaacttccaagtcaaatttgaaaacattcaactcgaaatttgaaaactttcaagtcaaatttgaaactttcaatctgaattttaaaactttcaatttgaatattggaaacttccaacccaaaatcaaagacttccaactcaaaaattaaaaacttccaactcataattcaaaaactttcaaccaaaatttaaaaactttcaacccaaaaattaaaacttttaatttgaatttttgaaatttcaacttgaatttcaaaactttcaatccgaatcttaaaacaaatgcacctaaatttttgaaaaatttcaactcaattatttatttatttattatttcattataaaggactacttaacgctaattgttactccttgttagcgctaacatttgctctacggcactaggctgtgcggttgccagcctgccacgcgtgtatgggccgaaaa

SEQ ID NO: 83008 - DNA, 1536 bp, Oryza sativa
ctttccaaagtgtatgaactttattgtatcaagatgtgcttacaaagtgcctccaaaaatactcccctttttctcttcttcttcatcttcttcttctccctcctcctataattccttgtttttgggtgaaccctagtgtatttatacctaaataaaaaaaactcccaatcacggagtaggagcagaactcttattctctccaaagccctcgtattccataccgatgacaatgtccaaattaaactctctccccccaaagcgaagtcctatccacatcccggacaggactctgcctgcgatcgatcgatcgagctgccgcatgggccagcttcggcaggcctgctgcgctcctgcccgactgggccctaggctctgggccgacaccacgtcctcgcgcaaggcccagctgagccgccgcatacagccgagccgactgcctcgctgcttgctactgatccgatccttgctgccacatgcacaccaccatacacatgtacagacatactctagcatatacacatgtactttagcattatgtactctatttcttttactcttcaatttttctcacgtacaccggtgtttgtatgcacaatttataaattccctatgcatagtctcggttgacaagattgatcctaataaggtcatattcttttctccaacattggatgaagattaagatttttgtggcacgcttttcaaactcctaaacggtgcgtttcatacaaaaattttatatatgaaagttgctctaaaatatcatattaatctattttttttaagtttataataattaaaactcaatcaatcatatattaatactacctcgttttacgtaaaagaaaattaattttcatcttcagaagaaaagaacaccacctaaatcgcctacacataatccatcgaagaaaacaaatgttctgtgagactgtgacctaatcacacgcacagctatatatatatatatatatatatatatatatatatatatatatatatatatatatattcaaaccgaatacaaacattccaaaaccataattacgaaaatgatttcacatatggttctccttgttggtctttaattagattcgtcatgttccatgaattaatttcctcctcctcttgagccggcgccgactttgcagtttgcacggcggttggaggacggctttcctgtgcggcatcttgcgagcgagcgggttcctcatcggcgcggtggcgggattttgattggtcgtctgcgcagtgcaccgcccggcatgcatgcgtgcttgtagtagtgttcctcctttctctccggcgggcggcggccaaccggtacgtacagtacataattattgacaaggaattacaatggtatactccatttacgaaagttattttaaactacgacacggtctccaaaacacaactttaacttcttgtttctataaaaatatttattgaaaagtgatataaaaatatttattgaaaagtgacatatgtatacgtttatgaaagtactccctccatcccaaaatgtttgacgcc

SEQ ID NO: 83009 - DNA, 4265 bp, Oryza sativa
cagcccaactaccaaaagcccatcccaccctccctcccgatcacgcccggccctgcttctccagatcgtgcgcagcgccggcggccggccccgcctcccctcccgatcgcgcgccccaccagcgccgtggccggctccgcctccctccctcccacctgatcgctccttttttttcttcttctcttttctagaatcttctcttttctagaaaaaattaaaaataaattaatgaattcaagattagaacccatgatcttatggttcataacaaactctcctaaccaatttaccctatgacactatgtgatattattatttgttttctatgtatatctgttcaaattttgtgaacacaaatccattatgttactgtataaatcataccttattattattatgattcggtagtaacattatcgtagaagtacagtaacatgatatgttactgcgaaatttataggtcgttactgtgaaattactgcacttttacagttacatcatgacgaaattgcagtaaaagagaacatatgttagtacctatactactgtgaaagaaccatctggtcgggatataacttcggctgaaaaaacacaacgttgtccctcaaattatcgcacgagcaggatggccgctgcttcagctatccccgctggaacggatctgagacttgggaggatatgaacaggagagatgggaaaaggggatgaagggagaagaagggaaatttggtaatgaagggagaagaagggaaatttggtaaaaaaaattaaaaaataagatgaaagggtaagtaataccatgtatcaaataaacatgaaattgtaatggcacgtatttaatatgtgaatagtaatagtatattttaaaccatgaaagttgcaatggcatggttctaattaacccaattaaatatgccttattttttaatggtaggagtactactaatcatcttttaattaataatatttttatagattctagaaatataggagattaatgtgtccagccgtccaggatacttgttccaatttccggttcaaccataatatattgtatttatctgaagattttaaaaattatttgtgtttctttcttatttttccttcctagctccttttctacttggcccaagcgcgcgtcatttgggctgtacagcgcagcttgggcgtccactttttctagcctaacaacaagagagagaaaatgttaagtgtcgacaaatcttttcataagcatcacaaatcagcaacattatttatcactggccaacatttccaagcctaacagcaagaaaaaaaaggagaaaaaactgtagaaaattatgttcatatgcatcagaaatcggcaacattgatcatcattggccacctttcccggcctaatagcaggattctgttcatatgccatattgccatcacaaatcagcatcattaatccaaatttgccgtcatgcatcacaaatcagcgagtataatgcaacaatcaagtattgttgttcacttttgagtcatatggtatccgctaccatcttaaccagcacatatcctacaaaagccatatggcatccactaccaccttattaagtaatagttaactaataatccatccgtttcagattacaagatgttaaaaactgcttcaaatttaactaagtttgtagaaaaaataataacatttttaacccaagataaatttattataaaaattcaattattgatttaatgaaactaatttggtattataaatattactatatttttctataaacttaattaaacttaaagtagtttgactttgactaaagtcaaaatgtcttataacctgaaacggagggagtattacataaactgatgaaaaaaaagtggaactaagactccactgtggtgataagtccaatagctcgggcaatttctatcttttttctgatgtagtcatcataaaaccgcggtttatccctctacaaataaaagaaatctcaattagtaaactactccctacgtcccaaaataagtgtagttttacactattcacgtttaacgtttgattgttcgtcttatttgaaatttttttatgattagtatttttattgctattagatgataaaacatgaatagtactttatgtgtgactaaatatttttaaatatttcacaaattttttaaataagacggatggttaaacgttgggcacggatatccacggctgcacttattttgagacggaggtagtactaaactttttttaaaaaagtaagcatgcatgcatagagaacttcatatagtacagtaccagcttcttaactgcctctgcaatcagcccgagaacttcatcctctgcaacctgacaagtgggatgttagacataacaacatctaccagtataaatatataatggattgcacttgcatgtcagatacataagactacttacttcctccgtaatgcaagccgtgcaagtatgaaactggaaaggggaaaaaacgatgaaatgaataagcataaaacaaggcaattagataccacattataaatttgcaggtcatcaatgaacaacacaactaaattacctccgcttcccattgagagcagtcattgatctccagtacatatttcattttttgttgccgtaccggaaacctgttcagttcgtagacttccttcattgcatctctgaaactcatctggacatacatagttaaagagaaaacacgggcatcactgagcaaatacaacatttataaacatacgaaataaaccattatatatttacattacataaattttagttgtgcagctggggtatagtgttgatattgtactgaccttttgcttggtgacccgctgccaaatctcaaaatacacaccatctagctccttaaaaaaacaaacatcatagttcatgctagataccaattcctgaattgcatgagtaattcaactgttagatatatacaaaaccaccaaaatcaaattaaatagtgtgcaacttaagtatcatacatggaagccaagataagctaacttggcagtaatcttggggaatccggtggctatcttaactgcttggtagagtcctctgttgcttacttttccccactacatacagagttatcatggtgatacaatacatgcagatacaaaatttgtttatacaaataatacttgccttaagagatggccgctcaagtaacacataatcttccatccactgtttcataataaaaggaggctattagtacggtagtcaatgttttaaaaacgttacaaagttttaacacttgattaacttaatctatatatgatgcatagttgcatgtataccttaagtttctttgataattcaacatagtatttcgcatactgtttttcaacatcatatgtattaaaatacatatgatatctatcccaattggcatacatgcaaccctacaaaaagaaaaggggggaaaaatcacatgattgagaaaataatatttacaaagatatgtaatatatagcaatactcgtgcgcacacatacataatttttaatgactagacgttgatagtcaacaagtgcagcaagcttgcagtactcagggtggaagtaccaaacaaatgtgtaatcaaagcacttgagaacctcccagaggacctcgtcatcaacagaatcaagtgtgccatcattttcaaagcacataaggacctcctccaactgcttagacatgtcaaaagggtattgctctatcattgtatcatgatccagcttactcccagtcctaggcacttgttgtaacaactgcaacagtaagggcctgtttggcacagctccagctccagctccacccctcctggagctggagctcagccaaacagtttcagctccaccaaaactgggagtggagttgggtggagctctctcacaaaatgtactagagttgtggagctgggtttaggcagctccacaactccactccagactcaactcctggagttatatttaggagttggagctgtaccaaacaggccctaagatcacttacgagattatattgaatattgcaaattcaaacaggaggttaatcatatataacaacacctatatatacgaataaaagtatatgcaacatatataaaatgtacagaatatactagaatgcatggcttatatatgatgattaattaattaatatatagatagagcatggatgaaactaaccttgtagtacttcacacgatacagttcatggagttcatttgaagcatcgagctgatcgaaattcaatt

SEQ ID NO: 83010 - DNA, 18305 bp, Oryza sativa
tttgtcttacgtattttctattgagaaaatttgaaccgtgccacacaaattttgcaaaatttgtgatatgccactccgacccacatgtcattgactcatgtgggtcctacatgtctttgagatacgggtggcatatctaaaattttgcaaaattagggtggcatggttccaacaaacccttttctatttgtcgcacaaggaacacacactatttagacatgcctacaaatctagaacaaattgaatgaaatacagatcacaccggcaaccatgcagtagaaaatataagcttttcccagtactgcagtaatataaaataaaatatttttccctttcaatcggacaaattgctacaaccaccgttcttggatttgttgattacatgtagaataagttttcacatgatgtgagaatcagaaagtttgacaagatgcatactgtacaaccaagtttgctggttagacccaaagcaaaccgttacatcgactccggcaaactatcatgctcatgttcctataattttctcaaatttgttcaatcttccgtcactgctcaaatttgttcaatctgagaacactgaaaagatgcatgtaactgaacatgtagagcacggacgggggcagataccggggatagggtatcgaagtggtcgcctacgacaggcggtgattactggcgacgatctacttcattgtagcagacatgagtcctatttatagtactcatagcttacttagaaaatgattagagacacataaaaagtagaatttgccgcacatatacctctgatgaactcaatgtagcagctctgagtcctctttgttcatattcgaggaaggaatcaacaagtactgcaatgttaaacaacccgacagatcaaatgccaaagtaagaatgcacggattcttaatacaggcaatatctgataaaagcctaaaatgcgagtcatgttatgtacactctgtcatcaatttaaataataaaactatccttctcataggtatatgttctcgattattacgtaatttgactatacattaacagattaatcttgcagtggtgagcatatgttacatacatgtaaggaccttgttttgttatgttcaagactcacgttgcttctgatatcggtcaatacttggagtatgtagcaacatgaggaatttatacaaaagatttattacttaatactcactatttgtaatacaatttcatattgcatgaaaattggtgtagataaatcaagaagtacaaaacgcatggtttccaattctttacaagcataagaaaattaataagcaaaccaataaatatgttgcacatccccactgttaatgaaaccatatttctgaaaaaaaaaagacagtttaagctatgcaatgcctcatgcgtgtagaaatcagaggctgagttaaatcaacatgtaatctacaaaattgttctcatggtcgtttttacatactggaaactggatccatccctcccctcaacagcatttaatcgaacacctaccagcctaccgggcacaatacaatacatgcgtagagaagtcatgatcattggttgatcatccaagaagtcacaatcaataagaaacaacgatagcagaccatattcctagggcattatgacttcccttactccacatcaaagattccatttttttcataaacctgggcttcaactgaagatttgatatttagctgttaccgaatgaccaaacatgtaaccccaaaaaacctagttgctccagatagttcatatttatcttttcaattgtttttacagctcacattattgttgtttggtactacctctatttcaggttataaaactttctagcattgctcatattcatatagatgttaataaatctaggtgcatatatatatctagattcattaacatatatataaatacagacaatgttagaaagtcttataatgtgaaatagaggaagtactttggtttccaagtcccaagtgcaaaggtccccagattcataaaataaatatttgtttgtagtggcagcttcctaggagggctaggaatacaaaattgccagcttcgatttcctattttttgtgattaacagtgaacacaattcattcctcatgtgttgctatcacaagttcacaaaatttgttgcactgaaaatgcaaatcatgttgtgttaagaatatgctcaatgttgctctacagagagacttcgccattacctggctagcggcgtgggggcgaggaggcgcgacgcggaccagacggcaggtaatcgacgacgacttgatggcggtgtgaccgagaccggcggccaccaacggatcctgtggcgacgcgcgaggtggggcggcacggcgcgacggttggcgggggctcggtcaccgcgacgacaaacccgcggtgggcgatcggtggcaagcgcgatggccggtggctacgcggtggaggagccaccgggattcacctaggagctgccgggattggggaagtgggagggggagggagcagggcgcggatctacagtgtagtggcccgtgtcaggcgacaccgatgacttttggcaaaacctataacggaattgtttatccgtatattataacaccatgatttaagcatataagcatgctatgacaccaatagatatgttatgacaccaacgaattgattttctggatccgtcagagggagggctggggatgacgacccgcgggatccggcgcgagatgctccatggcgaccagggcgaggaggcaaggcgtcacagcgtcaatctgacgagggcaaaaggacgaggcggcagcttcaacggcgactggttgacgcggcatggttagggttacggagggagcgcataaatgaggggagtagggaaggcgcaagctgtgcggaagggagaggggaggtggaggcgatcgtgagcgttggattttacagagatgatctgaaccgttgagtgatgaatataagagtgtttgagtgaaagatgagtaaaacaagttggtgaattattattaaaaatatggtagatagatgtgaaattttttgtatttgcttttttttttgcaaaatataattatctgttatatgttatatataatatttttctgtgttgttatttttaatgtaacatatttcgtatcctatacaaaatatttttttgctactatcttttgcataagcaatttctcactcatataccacacaaaaataacttttctttacaaaaataaaaacacaaacaaaacttgaaacttaaatagaaattcccattctgtgtaaagaggctacataaaaaaatcatatattttttaaaatttataatggaataaatcaattgttaaggtattttgggtttttttaaaaaaattcctagcccaataacatattataaaacaattaatagctctttccgatatatattataaaaagggacaatgtcaatagcatcatttaactgggatatacttaatgggtacaaattaattctgaaatgcatgacatcaacatagtcaaattagttgcctcaaatttttagcccgtatttgatctgtttatccaaaaactataatcaatcaaaatacatatattaaccttgccattttcattcttcttcattttttcttcccgtattttctatttgttttgtgatttctcattgggacaggacgactttaattccatctccctttttcttaggtagaattgtttttctctagtttgtgttggagaatttatccatttcagctcattccagtcggttatagaaggcgctgcgttgcacaccttttttttttggtctttttctcgtttaagttggaatagtttaatgaaaaaggctagatacgtgtcaacaccgtaatgggctgccatcccaaccaatcagctggcagtatttttttccagcttggagataaagtgattagaccaaccgacatctaaagcacatactcatctaaaatcctctatctgatcttttctattagttgcagttgacattcaaagttttacatagcactgtaaagcacgcgagtttatgtagcttgaattgaaaacagttaacgattttttcaacttcatctttgctttgttaggtgtgtgcaaaactttcgtacatctcaactctagccttatatggatgttcgcatggagctctcaattttgtttgctgatctacttggcagatgcttgagtacaatattcagttattgatttgtggttcggtccttatttgtacagtaacctttttttttatcatgatttgtgttaacaacgcttcaaatcgccgcaccggccgcgcggcgtggcgccgcacaatcccttatagtagcgacgacgaaacacattaggatgcaaacaaaatagcttgtttggttgcctgaccacaagaggagtggcaatagtgattatatgtgatttccagcaaaaggccaagtgagagaaagattgaaatataatcatgtcagcgatagatgtaccacaaatagcagaaactaggaaggtagcccgcgcgtatgcgcgggcacttatttaatgttgcttaaatttttgttacaaatgtttacatgtagatgatatttttaaaatagatcttgattatattttaaacatgttttcgttaatatctagtttggacatattacttgaaaccgtacaaccttaaatttatgagaacatgtgtcacgataatggaatatttgagttgtttcatatctatttgtactatatgtgattttttaacctagataaagggttttttaaatactaccacgataatctccagagcaccatattattggttatattttgataaatatctataattttgagtttggtttttttaacgcttattattcataatcacatgagacatatttactaattaatttggagaatgaatctattttcccaaacttatttacaataactaatttattaaagtatactttatagtcatgccaatagggttactttatagtcatgccaatagggtatatgacatccgtccatcaaatttgcctgatgtgttggaattcctcatctataaaaaatatatcatgagtaatttattatgcatgttacttgattgttcatttgttgtcaaaactatttgacaaagagaaaacatatatatgaccataaatctcatgattgattaagtggttgtattctatcaagataattggcttgaaatatttttcatatttttttacatctgtgtaacattcatgttgcccacttatcagatactaatgaaataattctaaagattcaaaaaaaattgaaaaccttaatctcaaacgaattaaaattaaattagatctacttaaaaatacacaactaaattgtgttgttttcatttattttacatatgtagaattaaattagcattgtatagtcttcaagtgatatttgacacctgaaatatgataagatttttttttaaaataggaaaaagtacaaattatccacataagcccgaaaaccggacatctttcaccctcaactattaataggacgaactagaaaatgagcgtgcccgttggcacgctagctagtttatagcatgtgtatattttcttttagaaataataggtttaaaatgattatttaaagtttttttttcaaattttatgtttgtaaaagtaagttagaatagtaaaattatcctaatttgtggtcttatcatgccgaacagaatatttacgttaagaaattattaaagatcatatatattagtgaaaaatgtgtttttattaatattcaacacgattgttataaacttgcaagtcatatagtttgtataattagtccgaaatacatatctaaaataaatgtgtcttcggttacctgtttctttatactggttttatttagaggatggggcatcgacatggtaaagatacttatcttgttttcatatatccagttattctaatgcagctcagctggttaggttccgtgcctatacgggttcaggtcaatagacttagaacgagttctttgcattttaccactatttgttgtttcaatgataggcaacctaccgatctttatcaatccaaatatatgtctgacggcctagtcttaaaaggtgctcgtgtgtatatcatctaaattgtgtttcacaaacaaaaaatatagcaaaattattgtcgttacttacccatgttccaaaataaatggattcctttgtggtggaaccaacccacccgggttcaaatcctagatttgacacgggtgttcgtatttatggctaattattctttcagtggtaggcgacgtacccgtcgacagcgaagcgcctgtggtgacttcgtcaatctcaagatatgccggcccagtcttctggaggtgctcataagggtagggtatgcgtgtgtgcattcatagggtgagtgtgcgcacgttgtgagcgcctacgtttgtactgtgtttctaaaaaaaaaatggattcctagcatccagaaaaagtataaggtgaggattaaaaaagaaaaaaaatgttctgaattaataggaaaatagtgctgaacttgtcggttaacagagaatacatcggttcatctaatttcactttttattctttccattctatagaattttaggtattttcctcgtttgaagtaaacattctagattgtatttatctggaggctttcgattgtcctaacacaatccttgctgctgctatatttttttccatttaatttcactattttttctaattttctagaaacacatgatgctaacatgaagtgactttccctcattcgagtaattgtggttgattgcataatcctattatttttattttttctcattttctttttattactattattttgttctatactggctctgtacacttcagtccttcacgctgtttttcttcccttttcttttgaacgaacgtacttagcgccgcgtgaagaggccatgcaccagtattgcggactgtggtacatattgcggaaaaggccgtggggcgccagggccagggccaggcccagggtcgcacagcctagctagatgcaaaacccaccccgcatacgcacgcaggcaaacgtttacgtttttttttccgatctctttcgatgcgaatacttcacccatcacacgtggcagcttttcagtgagctctaaccaaatttgtagggtgccacgcggcccaatgaaaaacaagagcctagacctagaaatcggtattagagattggcctcagataagtattcatgtaagtcgcatgcaaaggggaaaattatcttgcattgcaaatttatgcaaagagcatgtttggttgccagaccacaaggcattaatctgggaatgagtgcataaaaaaaaggaacaaacagcaaggaaaataaaagaacaagattagataaatctgttcataagcatcacaaataagcagcattaaccatcactcgccaccttttctagccaaatagcaagaaaaattagatcaagtattgacaaatctgttcataagcatcacaaatcagtaacaatattcatcattgaccacatttccgagcctaatagcaaggaaaaaaaaagaaaaaaactgtagaaaatcctgttcatatgcatcagaaatcagcaacattaatcctcattggccacctttccagacagcaggattctgttcatatgccatcagaaatcagcatcattaatccaaatttgccatcatgcatcacaaatcagcgagcatcatgcaacaatcaagtattgttgttcactacaaaagacatgtggtgccactaccaccttaacaagcagctaaccaatatcctacaaaaaacatacggtgtccactaccaccttaaccagcaaatatcatacaaaagccacatcgtgtccactaccaacttaaccaatagttaaccaatattacataaacagatgaaaaaaaaaagtgaaactaagcctcttctgtggtgatcagtccaatagcttgggcaatgtttatcttctttttgatgtagtcatcatagaaccgcggtttatccctctacaaataaaatgaatctcaatcagtaaaaagctaaacagtttttaaaaagcaagcatgcatgcatagacaacttcatatagtacactaccagcttcttaactgcgtctgcaattagccccagaacttgatcctctgcaacctgacaggtaagtgggatgttagacaaaacaacatctaccagtataaatatataatggattgcacttgcatgtcagatatataacacaatacttacttcctctgtaatgcaagccgtacaagtatgaaactggaaagggaaaaaagaaggtgagatgaatgacaagataatgagaataccacattataattttgcagatcatcagtgaacaacacaactaaattacctccgcttcccattgagagcagtcattgatctccagtacatatttcattttttgttgtcgtactggaaacctgttcagttcatagacttccttcattgcatctctgaaactcatctggacatatatagttaaagagaaaacacgggcattactaagcaaatacaacatttataaacatacaaaataaactattatatatttacattatataaattttagttgtgcagctggggtatagtgttaatattgtgctgaccttttgcttggtaacccgctgccaaatctcaaaatatacatcatctagctccttaaaaaaacaaacatcatagttcatgctagatacaaattcctgaattgtataaataattcaactattagatatatacaagaccactaaaatcaaattaactagtgtgcaacttaagtatcatacatggaagccaagataagctaacctggcagtaatcttggggaatccagtagctatcttaactgcttggtaaagtcctctgttgcttactcttccccactacatatagaattattatggtgatacaatacatgaagatgcaaaattattctatacaataatacttgccttaagagatggccgctcaagtaacacataatcttccatccactgtttcataatacaaggaagctattagtcagtagtcaatgctttaaaagcgttacaaaattttaacacttgattaacttgatataaatatgatgcaacaagcatatataccttaagtttctttgataattcaccataatatttcacatactgtttttcaacatcatatgtattaaaatacatatgatatttatcccaattggcatacatgcaaccctaaaaaaagaaaaggggaaaatcacatggttgagaaaataatatttacaaagatatatataacagtactcatgcatcaagaacatatatatgatcacatacatcatttttaatgactagacgttgatagtcaacaagtgcagcaagcttgcaatactcagggtggaagtaccaaacaaatatgtaatcaaagcacttaagaacctcccagaggacctcatcatcaacagaatcaagtgtgccatcattttcaaagcatataaggacctcctccagctgcttagacatgtcaaaagggtattgatttatcatttcatcatggtccagcttactcctagttccagacacttgctgtaacgactgtaacaggaggtcaatcatatatatcagtattgtatcttatctcctaacaactgtaacaataagatcactcatgagataatgttagatgcaaatgcaaacaggaggtcaatcatatatatcagtattgtatcttatctccctgaaatgtttgaggttaagcacattttagagaaaataaaggttgcagcattttttaaatttcattgagtaaattgcagtttgggtcatgtatttttacccttgttgcagcttggacagggtcttagtcatgattttcaatttggactacacaaccttgccatttgtttcactctgatcttatccaacagactctatccttatccctagggccttgacccctcggcccactacccatgacagcaccaccccctcatcgtctccaagtcaggcagcccatcaccgttgtccctctctttgctgctattatcatctctcccaacctgttcttgttatgctatcaacgaacaggaggaggtaaaagtacgacacttcccaaactccagtcaccctatccaatctggagggaggagcagatcatcacaggttcagcagcgctaccggtgctcaagctgagatggagtgcatggtggtagagctgaagttgctgctgcttgagcttgggtgtgggagcagtacgacagcgcttggaataggcaatgtttcttgagctcgagtatgtaggttgctttcaccagggagctcaatcccaaacacaatttttttttgacgggtcagccgaaaatggaccaaccgaaattgtattaagaggagaagaaattcagtactgttaaaaaacggcactagactgtcaaaaaggggcaaacgcaacaagccgtcaaacgacagtgtgccattgccccaaaaaaggaaaaaaaaccaggagctgcaaggaaataatcgctctgcttgaacactcctgcttctctccaaaccaggacctcttctcttactgctctgtagagctgtgcggcggtgcagttttgtgctaaaaaaatatcatattgctctctttccacaccagccagcacacaagcatggagaagatgaagacttcagtatgctaatgaccaaattaaactaatcgtatcacctcacttggcatgctaattttagctatcaatacaagagagggcatggtagtgctcaagctcacgtatagtggcttcagctcaacgaagaagagaagagagcggagattgaggaaaaaccggtccaatctgaaacttgtataaaattgtctagtccaaagtgaaaatattactttgcccctagtccaatgtgtaactctggtaataagaggtagcccaatgtgcaattcactcaatttcatttgtaggatgtgtcaccgaggaagcacggatactcaatccactctataagctagtgatcattgattgatatatggatagagtgtgaatgaatgaaactaaccttgtaatacttcacacgatacagttcatggagttcattttgagcatcgagctgattgaaatccaattgagtagaagtatcaacaggagagtcttgttcttgaggcagctggcgcaagtaaccacggaacttgtcagtgctaatatcttctcccaaacccaattcattcagctcctgagtgagaaggttggcttcctccacatttttctccatggtagcatcattgcattcggttgcgattgcaactggaacgctgtaatcttgttcggtatcatcatcctggtctgcaggactgttgagggccttagaaaaacggaagctttttttcctcctaggtggaacccatgtcttcttcttcttggcctgcttgttgtgtggcgccgccttctcttgggaaggaccagagaggccagaaagccccgggacacacgaatccattacatcatcatcatcgtcatcaagttcacctagcaccgcgaaacgacgaccttttggagtggtcgagtcaataccagcggatacgtcgacgatgtcgttgatggttgacacggccaaacggcgcagatttggagtcgtcttcttctctgaggcgccgatggccggcatgttcttcccgctcgggggcggcggcccgcggctggacccgcggtgcttgggcggcatctctccaaacccaaactagatcgatctggaacccagggagcgggagcgggagcgggagaggcggcggcggcggaggaggaggggaggggaggtggggcgaagaagacgattggtttgggagctcaaatcgccaagggtgcccaggtcgggatcgggtcgggttgggttcgtttgggaataagcgagattttttttagatcccttaaccccaaaaccagaaatacgtgcccctcaactcttacaaaccgttcacgggaggttcctcggcagtatttttgcccggttttgctgacgtggcatcctagtcagcaaaaataattttaaaaaatacgtggggtccacatgtcagctgcacactcttttcttcttctcctcttttctcttctctcttctcttcttcagtgacttcagtgagggagaccggcggcgggcggagcccgctcgaggccgagcagcagccgccgctgccgccgccctccgtgtccgggcctggcggggaggggacggggagagccacaacaccgccgccgtcgcgtcgtgtccggacctggcggggaggggacggggagccacgacaacaaatcgggtgaagctaaatgaccaatggtctaccattcgagcgattaactgacggcaattacagcgaagcgctcgatcggatcggagtccggtcagtacccgccggcgccgctgctccatccgccgcggccggcggcgcccatctgtttgctgccgatcgccaccgaaggcagctggttggcgttggtcaaatactgccggacggggtcatccgtcggcggcccggcgagcgccaccggcggcggcagcggccgtgatgacgtactgctgcatgaccagcacggacgccatcttggagaactcggaggagacgaggaggtcgccgatggggccgagctccggcgactccatccactcggcgagccccgacgtcagcggcgagctcgcctcgccggggtggcggccgacggtgtacagctcgtgcgcgttgtcgagctggctgcggatggcggcgagcgtctcctcgctgttggccaccacctgctcgacgtagaggatggcatcgctgccgaggttgcgcgaccggaactcgttgaggtactcctcgtccatctgccgctcgctcttggcgacctcggggacgacgttgatggcgcgggagtgggcggcgggcatcggcggctgcggcggcgagaccgccggcgccgtgtaccccggcgggatgaagcggacgatggtgaggcacacgcccgggttctcgaccatccgccacgcgtacgcgagcccctcccggtcgtcgggcccgccgaagaagaggagcgcgacgtagtgcacggcggccatcctcgccgcggcggcgctgaggccgcggtcgacgaggatgccgacggagcatggcgccgacgcgaggatgctctcgttgaagccccggagcgacgcattgatgggctccatgccgcgtccaccgtctgctgcttgtggaacgggagcacgatgagcgagacgtgcttgtcctccgccaggacgcacacgtcctcgtgcatcgtctggtaaggcgacaccgccgtcagcgccgctcgcccggtcccaagcccctctgctcctccgagccgctcgcccgccgctccgccgcctcgctccgccgctgccgctcccctctgcggcaaatataaagacgaaagaggaggagagaaaaagggatgctgagtaggatctgacctcatatttttgtcacttacatgtgggtcccacgtactttttttaattttttttgctgactagtatgccacgtcagcaaaaccgggcaaaaatactgccgagggacctcccgtgaacggtttgtgagagttgaggggcacacatttctggttttggggtttagggacctcaaaaaatctcgctatcaaattaagggacctctggtgaacttattccgttcgtttgctctctctcccatatagctggccaaatgggccgtgctctgtcgggcccgcccaagcacgatgctacagtaaccgacacggcacagcacgggcccgtgagcttatgggccgtgctcgggcgtgccgtgcctgggccgacgcctaagcccgtgggccagcacggcccgacgcgtggcccggcacagcacgagaggccgaagccatcgggccgcatgccgcagcctgtagcgccgtccccagccaccaaccgcagcgcagcccgagattagttaaaactcgctccttttttacagcatgcaagcgtgcatggttagtttgtgtggcatgcacaggaaccgaataggcagtgcatgcgtgcatccaccccaactaacatgcatcataattgcttcttgaattaattctcccttagtattgctgcataaatgacctcggcgacgtcaaaaacatgcatgcactgatgcacccaaccaacatgcattccttttcttttcgcatatttttttggtcaaaatctcccgttcttatgcacgcttgcgtcgccgccgtgcgcccgtgccgcatcgggcgagccgcggctccaatctttcgcctccacgcgtcgcgcgccaggcgggcggtagacgacggcgcgactttcgacctcccgcgtgccttcgggccggcgccggcccacgtgccactaatgggcccgtgccggcacggcacggcacgacgtccccttgggccgtgcttgggccggagggacggcacgtgggctggcacggcacggcccgctatggaaccgtgcctaatgggccgtgcttttggtgggcccgtaccgcgctgggccgggccgcccattcggcctactatacttgggaccttctagtgctgtacggtattccagttgtaattaaaaaaaaagtatatccgaggtctttatcttgtcaccaaattatacaaaatcatctctcaacgaaaaaaatcagacatatcggactcttcaatttacagaactggttttttggttgaggaatgattttgtattttggtgacaagaggggtctcatatgtcctttttgctattccagttctagcatcccctatatgagtactatacagcccatgcattgcttttattttctttctttttttatataatacaagaaaaaaaatatccgcacagaggagaaaaaggttgatgagagagtgtgtgatcaataaaagccgagtgaggtaacaacgtggaatgtgagacgtcaataaaagttgagcgaggcagcaagcagacttgatgcgtgagttgaacaatataccaagaaaaagaaaaaagaaaagaaaacgaatgacatgcagacgaccaaggtaaaaagcatgcaagtgattattgaaaaaaatatatgaattttcgaagtacataatacctccgagttatgtaataaccatttacttcgttataaattgatttataatagtgtcatatattaaaaaggggaaaagtataattaaaactagggagagtatatttctatatataagaatatatagagatatggaagagatagatatatacagatatatattcttataagaatatataagaatatctcaagttggaagatgaaactatcgctaaacattaccatatatcaaatatttattttgctatatttttgtatcattttcctcttactctacgtatagcaccatggtccatgtttttttttccaacttattaatatgtgccttttctcatatcacattagattttattttactttttccctctttgacgtcctggccttgaatttttttattttagatttttttaataaataattttaataatatacctcctaggaacttattttaaaaaataaatctttttgccacgccacttaagctggtgcggccaaactaagcagccacaccaccgctcttggcgttggcaaggtcaaacaggcactgacgtggtgggggtgaggttggtgggggtgaggttgggcttgccatgccatcccatctagcatagttgggggaaatataccctagccgtcgccgccgccgctttctttctccttcctctatcgtgttcttgcgctctctctctctctctctgcgcgaagtaaccgacgccccctcctcaaatccattcaaaatccagtgttcttgcttcgatgtgaagcccttttgagtgggaacccaacccgtaaggtatatatctttttttggtttcttttctcttgtttttgcatgtatttgtaatgtctaggattgtatgtaatgttgttggaatatgtggtaatgaggttcatgggatggatcggaatagatcggggtgtattatggagtagttctcatttctgttagtgatatttaagtggaaaatacctttttagttcgaatgatatggttaaaagtggggttagacatgggagagcacggacacattttttttaggtttttgtgatcatgtagggatgataaggtcatgcatccagtgatttttttggtgtataagttgtcggcttctgccttcgtatcgttctataatgagtatttgatttgcatgtgaatattgtgcatgtagatggatcgtgtggtccgtgtatattctggtggaaccgttagtgcaaatggaaaatttgatgagatgaaagtaggtgttttagtgtttgcgagcagtcctacgtgggcacaattatgtgatcgggttcgttctaaaatggaacatgtcgtacctacgaacgtgatgagaatggaagggcagtatgttgcaaggtttggatcaggggaacattttgtgatgatgccaatgtcatgtgagttggagtgatcgacgtatgttacatatgtttcaagttcacaagttcgttctatggatgtggtggttacaacttgtgcaaatcgaagtacagtagatctagtatccttagattgtggtcattccttggaaacagagcatgaactgatagtggagcatgagggcaagttttatagtaggggtagttgtcacatctaattttatccatgtaagataagaggtgatatatacaatacaccacatctacaccacctctatcattttaacccaaattatttttttatttgtttgtccaatcccctctttctttcatctcatttttctttgggtttgtgtggaggttgcccttgcatgaggggtggctcaccttctctttcctcaattattacttccacctcatcatccaatcctacatggcatttttaggggcaacacattaagagcaagtttaatagtatagccaattactagctccaaatcatctatagccaatataatagctaattcatacaatagttgcttactatactattaatatctggtcatacctgttatacacacattacatcttggagactgtgctgcagctggctacagatctgtagcccgctgctcttctctcttccttttctctttaaaatatgtttatagctggcttatagcctgctattgtacctgctcgcatcatagtacttgtcctgaggagactttgacacaggatcccccattagcggagatagctggacctggtaacgagggtgtaatactgttggtagaacctagtagtgtctcaaacaacaatgacactataatttgtgctggcacggtttatatgcaaaattttgaattgcatgggcacaaagtgattatcgagttttatactggagatgaggtttatttcaaaatgaaaacaaatatatcgattttttttcatctatagcaaagtacgggatttcaggtacacgttgacaaattttacataaggagctagcctgggagtttttagtttttaaaaatgaccgtattgtgtcaaaatagtttggtactccctccatctttttttatatgacaaccgtatacaaatcaaaacgtgtattaatattgggtctatctaaaaatctgtcacaagtttttgagaaaatactttcaaatataacattagtgtaactacattgtgattgtagcgtaactatattgtataactatataaaatttgtatataagttgcttgcaactaatagaacattttcatagctcagttggtagcatgcgtgtggagcataaaatttatagttcagttcttagtaggtgggacagatggttgacgccgagatggttgaaaaaaactagttaattaaatgttcattctaaaatacttaagaactgaactttataggcagcaatgcttgatgcagcaacaaacgacactccgatcttggtttgagtatgtcattcaggagtataaagttcctgcatttcaatggagcataacattttaagaagcacttttttttgctggccggccgaaacgaccaattttattaagattggaagaatttttaagaagcaattgtctttgaattcaggtctctgaatgaatttccatgaaattgcattgtaggtgagacaacgaagtttggcatgaaccggaggatggggtatgcccacatgggcgacggccttgtttggatcctccgggctattaaatagctatccggattcttgttatttagaagtattaaacgtagattactgacaaaatcaattccataacccctaggctattttgtgagacgaatctaacaaggtatattaatct

SEQ ID NO: 83011 - DNA, 3213 bp, Oryza sativa
  unsure (1)..(3213): unsure at all n locations
gactaacttatcacattggaaatacaattagaaaagacatttccttaagatgccatgtattcttgattactatatccacttgcaaagcaatgtgcagtagtagcacataaacatagttatgcctgaagaaataagtatcatcaaactagaggaggaacaagtcattccataacacaacatggcactggacaatctacacagatgaaggatagagcaacatgagaaatactgacactccaagagatgctgtcaactctgctatcctaagaaagtcaaaacattcaataatcctgaaacagaaccaccatcacaagaccatatatccgagtgtcaaccaacaaccagacaaggtccaataagaaaatccattcccaaccaacaccaaatctaacccaaccttactgtcaaggccgtacaacagcaagtacaggataatggcagctgaacaactgaatctagcagacctgcaccagatccattccacccccaatctaatcagtaccaatcagtttgcttttcagtcaaccaaccaaaaaagaaaatgtcacacagacttgtacaattggcacaagcacattattatccagaagaaacgtcaaaatagagtgatatggtggatgaccttgcggagagggtggtcggtggggaggaagctgccgatggtcttgccgtagacctcgcacgtggagaagtggatgagacgcttgttgttctcagagcagtacttgacctgtgcacatcacacacgtccatcaacaattctgcactagtggtagaaaagaagaagaagaacgctggagtggagaagaggagggattaccacagggagcgcgtcgatgaagttgctgtagatggtgtcgagggggcgcgtgttgtagtcggccggcgtgcagatcgccgccaggttgatcgtctacgcagatccggaatcaaggcgtgttatcagaaatgaaatgagattgaaattgagagcaggagggagagagagggagagaccagatcggccatcttgatgaggccctcgagcctggagtcgttcttgatgttgaggcggtggaaggagatgcggccatggaggtggggaggggcggggtcnacgaggtggcggatcttgtcgcagtagacgtcgacggcgtagacgacgtgggcggtctcggccatgagcttctcgcagaggtgggagccgatgaagccgccggcgccgatcatgcagatggtgaggggcgcgatggggttgccgtccagatccaccctcccggcggcggaggcggcgggcggcgacgacgacgacgacatcctcccttggtccgcggatccggaatgcgcgtggaagatggattggattcgattattgcggaggaagggaggcgctggatttggnggttacgaggcgaggcgatgtcggtggcggtggttttctttttctctcctatttaagagcgcccacactctctcttctcctcttgtctctctcgagtctcgactttgaagaaggaagggaaaggattgaggggatggacaagaggtggcccactcctcccatcgagatccggtggttggtgggcctgcatgggcctctcttcctttttcaccatttccttcttttcttttttttccctaactcatttacgcctattcattttggatgaattttaaaggattttaatttcttttaggattaattcctacgaaagctatttgattattaggaatgtagatataggaaaaccaaagaaaaaatttctcctacaagatgtagagggaaaacatatattttgttcccgtccactctaaccttttgggaaaatcctatggattcaagtttgcatgtattcctatttctccattttttaatatnnttctaattggtatntaaaaanatttttcttttcaaaaaaacccggaaaaatttagacactaatgaattttttccctttaaattcttacctctactgcttaaaagcggagcattcgtctgttccaaaccaaatatacatcaaattcattcatttgttataccaataaattcaatgtttgtttctacacgcgaacatatattgctagttatattactattcatacacgcataaattagcatcatgtgtgttgttttaacgtacgcgggaagcggtaaatctcgaccacactgtatgtataatatttatggatattatttgcgtactgttgtatatagtactatagtgtgatgccgttgtctgttacctcaacccaaatgtcacagcagcactttggtctctgtcacgttggcaacctacttaacctagtaggggatgtagatgtgatcccttttaaaataacgaatcataaaaggtagtccaaattcattataccttctaggagggtcaaatttctttctaagttaattttttttacacagagggagtgctttcttcatcatcaccacacacatatacatacgtgtagtgtactggtcagtaccattatgtaattaaaaataactcttctttttcagtaactcccttttcgtttaccttccagtctttaagttgttggtggtgtaatattgttatcgtcactcatatatctcatcataaatcactactacaaaaatagttttcgctggtagttaaattgggttttcgttgaccagcgaaaatcgagtttcgcaaacggatatgctaagataaccaagcggcaagctaaagagaactgccagtgaaaacaattttagaataaaaaaaattcaaaatcggtgccatcggcccccataaccccaaacaatgccagccggtcggaatacgatagggtattgtacgatccgttgtaaaaaaaaaaaaagtatgtttgcaaatatagtttgaaacatcaaatatatggctagtcggcaattttgctgatcctatgaccgacgaaccgacgcaacggaaaaaaaaacaatgaaagctttccgtttcaaaataaatcaatctagcacatgatgtcacgcatactaatactatgaatcaaaatctggacaacaactctagcatcgagagtcactaactttaactactttctccgtttcaggttataagactttctagcattgcccatattcatatatatgttaatgattctaaatatatatatatatatatatatttatatatatatatatatatatatatatatgtatgtgtgtgtctagattcattaacatttatatgaatatggataatgctagaaatgtct

SEQ ID NO: 83012 - DNA, 2058 bp, Oryza sativa
tcggttttaaagcgaaaaatttaggaaacatccaagctaatttctgacctcattcgaaggcctgggggcgatgtcacgcccaattgtacctttttcatttggattttcatgattatttttcgtattaaagccctgatagtaaaacgtacacactactggttagtgtttgagtgaagaggaaaataaatgattgagaagatacgtaaaataaggttagccattagcatataattaatcgagtatcaactattttaaattttaaaatggattaatattatttttaaagtaacatttctatatatttttttaaaaaaacacatcatttagtaatttggaaaatatgcgcacaaaaaataaaaggtttgctccctcaatctccctgaacaaacgcagatacatcttaagtggaaaacaaaaggagatcggatgtattctggcttccagctatcaagaaacaaagagcttaacatactaatgatggacctgccctttcatgcagttttttttttcacagtacgcaatcagtatgagtttgagaacaatgcacagtactttctcaagaaattttgaactaatccaaattatcagttcatgacaatgggaacccacctggatactgtgatagcacgagaaaagctcaggcacacggcatgcgcatggaacaaacaagttaccacaaattagtcggtcatatgaatcacaactaccaagtagtgaaatttgcagattttgcttctaacagcctactactagttgctgtactaaactcaaagaacttaactcacaaccattatagcttccagcccataatttccttgaacaatcatctatactgaacaagaacatctctcaccgacgaagcaataagaaagaatgacacaggatgagcaaccaaaggtacaaatgaatacatcgactctgccacagatatggtggataaccccttgccggcttacacaggaggaaacctaaaagttggtagggatctaggagtgactagatgcacaaaaaggattacttgagtatacgtattccacttccaaacgattatagccactgacagtgctctacaagagccaacatcaccatctatggattggagcgtgttgtctaactcgacgctgaagcctgtgacatttgccttttgatagcttctttgtaagtcttgtgctggtaggtcaatgttgtctccagcaaatccttgagaggggtcttcggattccaacctagaacagttgaatcaatatttggttattatgaaccactggttacccaactagtacaacatagacataacaggttattgaagacagtaaataccaagctgcttgttgattatggtcatgtcaggaatcctcttatcactatcatcatatccttcaccatagaactgcttcgaactcacgtcaatcataggttcatccagtggtggctctcctgagacatttgcatagacctgtacaggacaaccatgtaagacttagggcatgagtaacagaaacgctcaaagaaacattgccacgctaatgatgtacctctgtcatcatttcagccaattgcctaacagtgacttcattgttaggattcccgacattgaagatttgaccattggcacgagcaggattttccttttgacataaagtacacatttcagttcaactaacaaggtaaatctagcataagagcaaaggaagtaaagataaacagagaaaacatacaatcatcaagtgaacagcttcaatggcatccttaatgtaaacaaaagttctctgggactggccaccatcaacaagtttcaggggctcccgacgcaggagattctgcaaattcattggcgacatacatcttatgagaaaaacgaccataacgaaatggaggtatattattctcagaaagggactggttgacatacgttactgaaacatgccaaaacccgaggaacaccctcactaggaccatcaacaccaggaataaagtccattcttggtccaatccaattgaaaggtctcacaattgtgaactcaaggccattttctgctccttcagctggttaaagct

SEQ ID NO: 83013 - DNA, 726 bp, Oryza sativa
ctcaaaatctcttatattatgggacggagggagtataaatttaaccatttatcttatttatttatttttataaatatcatttattttattgttactcgttttatcatcaaataaactataatcttaatttatacttttacatatttatactaaatttttaaataagacaaatgattgaactttattcagaataaaagtcaaatgacattatatatgttaggacgaatcacacgcacaaacattgctttagcccttgattgatttaagattcgattcgagggcacgtatcagttgttggtcgccctatgctcgatcggctactcgcagtctcgctctcgctctcatcaccatcaggcgtgccgcgttcatagcgactggaacaggcacgacaagacgagccggggaaaggggcttggtttctcaagtggcaaggaagcggcatataccaaactctgttaggaaactataagcgaacaaacgataaaaaacaatagatcaatcatagaagacacgagatttaacgtagaaaaccctttcaaagtagaagagaaaaaaaccacggacgccagccagcaaaatatcttcactatatctggggtgaagttgcaacgccgcacggcggtttacaagaggtatatatatggtaaaaccctaaaagggatgtcgatctcttaattaattgagaggttcctgcccttcctttctttacgctgcaatgacgcaagg

SEQ ID NO: 83014 - DNA, 725 bp, Oryza sativa
agcccttgacttcagtggtacagtagttcatcactgatcatcaaagaagacttggtataggcccattaaactcaactgaggcctatcccgggagagtgaaaaaatggcatctaccatgagttctaccagtataacccgaacggatcagtctggggtaacatagtttggggccactcggtctcgacagatctcatcaactggatccgtcttgaacctgcaatagaaggaaatactccgagcgacataaacggttgttggactggttcagcaacaatcctcactggtgatcaaccggttatcatatataccggtgccgacacggagaagcgtcaggttcaaaacattgtgctaccaaagaaccggtctgatccttacctgagggaatggaccaagccaaaaaacaaccctttgatcgaaccggtcggtccgggtttgaactcaaaccaattcagagatccgacaaccggttggataggaccggatgggctatggagaatagcagttggggctgagctgaatggctacagtgcagcacttttgtacaagagcaaagactttatgcagtggactagagtagatcacccattgtattcttctaatgcatccaacatgtgggagtgcccggatttctttgcagtatttgctggcaagaacaatggactggacctctttgcaactttcccaaatgcgcccagcatggtcttaaaagagcttggattcctgta

SEQ ID NO: 83015 - DNA, 829 bp, Oryza sativa
  unsure (1)..(829): unsure at all n locations
ctcccgcacattaggaacccncgttattctcctcttgctttaacaaattcacagccaataaaanaaagcaatggttgagctagtaggagctccgcttgatccggtaaatgagcgaaaaaaaaaattttttaattttccccaaaaattttcccttaatttccaatgtggtctaatgctcctaccctacctcgatcattgttctccttccgagaggctaagcggtggacttattaaacctgattggagccatgtttgaaaacacaacatagatttttctttttaaaaaaaaaaaagattttgatgccaatgagaaagggagatattagctttgaatctccctagccatctatacatagaatattctatgttatatggttttgaatagaatattctatgttatatggttttgaagtactaagttgaataaggatcaatatttaccaattcaagtactatgtacacttacgaaacaattcaaagcaacttactatcatagaggttctattttatagatatcgtgaagtatatttaataggaacacactgtctggcaccgtttgtaaaaaaaaaaatcctctatatctatccttgtgaatactggcacactgaaatttcagtttaagaatttatacactgataatccaaattacaaccacaagttgtggcgattttgtgggacccaagggaaaaaatttttttttttttgggggttttgttttcatcccaactaggtgttgaccatgggtcaacaatctcccatggtgcccgtggccgtggtgtacgcaacttgtccgtagncgcgaccccgacccgacccgaccagactgtga

SEQ ID NO: 83016 - DNA, 1344 bp, Oryza sativa
tgccaaatgattgagaagcgtgctttcagtcttcagtctatgagagtattagttattgatgaggtgattcttgagtcctaaatcaaacttttttgcagtataagctcagtctgctaatgcaatatctgactctgtatatttgcaaagagcccaagaggctatttgaagtttggaactcatttagttgatttttttcaagacagaatacctaatgtactcattgctgtttgataggttgattttatttttgggtcgtcaaagcaagtaagctctcttcgcaaaatattaacatcttattcagcagcttccagtcgtcagaccatatttgctagcgcatcgattcctcagcacaatcgctttgtgcatgactgtgtgcaacataagtggactaaggttgcacttctttatctatatggcttgaacgtacactattattattgaatgaaaagatggacctttttgacctcatgtttgcatattctgtcttatctgtgtgcagactgatgtggttcatgttcatgtcaaccctgtacaacccatgccctctcacctccagcacaaatatgcggtgggcatataaatttctttttatgataatcttacattctaaatgccttcaatcatttcctacaactgtggaacttaatacctgtcttgaacatagtaaataggcgtgtttcagttggggcctaaaacctaaacccacaggcacgggcattccttgcataagctcattaaacagcatgcatgtgattatggcaaaagtttagtccttttacaaagcattgcacatcttcttttagttttcagtgatctcatgagtctcttttacttttctgttcctgaaaaatcttgcgagtatgggtgactaacccccttgctcctgaaaaatatcttttgacctgatttttgttcttgctgattatggtaattttttaattaatgtacagatctgcagtaagaaggaaaggttgcatgttttactatccttgcttgagaaggatgcaccaaagtcagggattatatttgttgctgaacaggtattgctacttgtggattccatttactccatggcatgttgattatagtgttgctccagggtgatgggatgtgccaatttaggggttagaaattattctagagggaccaaccggccaagggacctcatgatggaccatttatgctatcctatatgcaaatacaaaatgttacttatcatagatagtctttatctgctggtatggaataattttcatttttggtacgattgaagatttaatatctgattctgtttcaatgggaatcaccagctagtccattagctgatattctttatttttatcg

SEQ ID NO: 83017 - DNA, 3233 bp, Oryza sativa
acaggagtgctcagatcaaactgtgtagcggttcttgagacctttgtccatcttttttgcatcgtcctacaaccaaaaagggcacgaataagaaacagttattcatccaggcatataatgtaacaaagctaaggactactcacatgaacaatgaacccaatcgagtccttgtaatccagaaattctttccactgcttcccaatgcttatctgatgaagaaagagaaacaattatgttcagcttatctgacctacctaggcgaatcaaatataataatgatgtgatgaggaaccaaaaaacttgccacaagatgcatatattgcagcagtcatacaaaacgctaaaatggcaagaaaatactacaagagataacgcggacaatatagcacgaaaggaacaccaagatagaacagaacttaacgtttcaatataaaccttggttaaaatagctgcacaatgtatatagcatgatcttggccaaaataatgaaaatccccctatgacaaacttcacctggaagtttaagcaagtgcacccaaatgttgcaatcttttcaggaatatatctcttcagctatgcattgtgtatatgcagattgagagcattccacatgtacagagcaacatttggacaggctcaagacataaatagctccagataaccagatcatgccattattaatacatagtggtatttgacagcaatgacatgtaaaagtttgaatttaatgatgttgaaaactatgtggttattatctgcaggtaacaaataaattagcagcacatatcttagaaatagtacctgagcagcttcattggcagcatttttagtccagatagctattctttcctgcttgccacgcacactaacaactgctccacaaatttcatccccataatcgaattgttcgccaatcattgccaataactaagcacaggataaggtaaagaattagggagatatttgtataaaggataactgtgcaaataagtgattcaaataatgcttacagtatgcaaccacattgtgtcggactttcctctgccacagctgaaggtccatttacctccattagcacagataggatcttcccattttggctcgattttattcttaaagcaatggaagtcagctcccacaaccaacttgcttgggtgatggatattgttataaaggctgaaataccacattcaaccttattagactaaaggaatacatgaaaagatagaaggaaaaaaaatactgaagcaaattgccaaaaaataataatatttaagcgagctgttagcagaaagaaagaagccctgaagcacatgcattgatataatttgcgacaaatgacacatgttataaactgtcgagagaactcaggacgacacatgtgtcaacatacgtggactatctcagatctctgaacatgtatcaactcaggatgctcaaattactcataaaaaaatagagccacagagaattaacattctttttataaatgtcagatacataaaattcaaaatcaccaaacagaacaaaacaccatcagccaatcaccttccaagttctaatactacatggaaagtaaaagatgacaaatattcggccagaaaaaaaaaaagaaggatcatacgcattttagaaggatctgattcatgtcctttcatgatgacaatggaaaaagatatgtttatattaaatataatatctgacttagacaaaataacctagaactgaaaatagaagaacgccaataaataactggcttatgatgcagccagaaagatgtcaaaaggcacaacagcacaatgatacagcaagatcaacaaatatttctgacatgaaacatgaagggtgccaaaagcataattatgacagcaggactgtaaacaaatgcttaagtgtgaacaagcagaacacttggacacaatttgcaacacatatgcatgaagagaaaccaaagaacacccaactctgcacctcaaatgtaatgcactacaatgtaggataacacataatattgatttccccaaccatgccaagaaatcacaatcggcgtaccgacatttcaacaaacaaactctgcacaccgatttaaccacagttaggcttattaaaataaaggcataacaaatcatgtggcctgcactaagaattcaattctacagttgaccatggaataagtatttgagtttggtacttctcacttgagacgttttcttccagggtatcaatcactcaagacaaattttcctcaagacatgttgttcatctaagaacattatgatgatagcatatacagattatcaccctatactaagtaaagtttccatcaaaatagataaacaaagaaaagcatccatccacagcatgaaacataaactgatcgatgaagatgtgaaatattattctgcttaaagaaaaacactataattcacgaaaagagtgtactcctcctcaaaacaattctgcctaatctgcaaccaagtcaaaaaaaaaaaaaactagatccacattagatctcagtcctacacatgaagcctatgacatggacaaagtaaagtgggcatgagtggcaagcctaacgcatgtaatcgaatcgggttaaacagctagatggggaatctacaatactgattcatgaaggcaagggatggagaggttgtggaggggaaaagaagaggagggggggtgggaaacctccagaagtcctcgacggtggagaaggtgtggatggggcggatggagcttccccaggttgcctgcttggactttccctgcgggttgtcgaaccagaaggtccaggcgtgctcgagcgggtgcggcgcggcggggttggcctgcggcggcgcgtggccggagtcgtcgtcggcgatctccccctcctccctctcgtcagcgtcgtcggccctgccgcggccggacgacggcggccttccggcggacggcggcctcgtctcgtgctcctccgccatggatgcgggcggcggtgagggtttctgtgttgcgccttaattagctaggtcgaggtcggtgctcttcccctctcgcttctccgtctctatatctccctctccactcgtgtagtatagaagaagaacttgtattgtaccggatgcgttgggcttatcaggcccatgggcccaaataaggactatttaggaattttttttatttataattttttttattaaaagttttacaaaaataattttccattttgaaaattaacgggctgcagg

SEQ ID NO: 83018 - DNA, 736 bp, Oryza sativa
  unsure (1)..(736): unsure at all n locations
gcggccccattagttnctcgttggtacagtagttcatcaaatggatccatggcgtgcgtcatgttgggggcgaagaccatggcgacgttgcggctgcccatcttgttgctccgctcctccctcgccacgtccgccatcagctgcaccgcccagtccagcagcgccgccttcgccgccggcagccgcgcgcacagcctcgcgcagtcgtcggcggactggcaccgcgtcacctccgccgccggcagcgagtccagcatcccgccggggagctcgcggaaccaggccttgatgagccccgccaggcagtgcacgtccacgccgccctccgggagcacgccggagttgagctgctcccggaccgcctgctcctgggcgtcgtcggcggcgatgcggaagatgccctccgccttcagcccgccctgctcgtagagccgccgctgcatcaggaggaggatgcatattgcctgatacagatccaaactgtcattgttgcttctgggacattggagctgaataaggaagcatgttgcttgtttacctcactgttgttcaacttaataatgtttttttttgataaaggaagcttttattaatctcagacgattacatcaagttgatagaaccatactaagaaaactcccggcctctgcataactaggatgcacacaggccaaacacacaaacccacaaaaagagttgtaacaagagaagggaagcagtaaaaatcagggagcac

SEQ ID NO: 83019 - DNA, 1660 bp, Oryza sativa
tgtgcactctctctaggacccagtaccagctttcagtgttctcgctctctacaaatgcgaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcttcaaccgatgtaaatgtatgtaggtcatagtaagtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttctttcatgcacctcacttcatacacataatttgttgacttgaccaccctaaactctctctgcaatgaaactgcccaatgcttcaccgcctccttcatctcatccttatgagcataccttgcaccctcaattacctcgttctccttatactcccagggtacatgatcaccctctgatataacaagaccagagaagtcctcatttgcccaatcagtggccattacatcaccttcctcatcggatgatgcgtcgtcctccgcttgctcattatccgaatcttccctctccatttcatcaacaattataccgactctctccccctcatccgccatgcccatggcctgctcctcccttggttgattttcctcattttgcatcgatggtccaacaacatcccctgcattgctaggaccctccacatcttcggtttgcattgaaacatttgtatctttctcttgtaccgacacaaatataacgaggggccatgaccgttcaaaagccatttccacataccgtctccaagcagcagtgctgtccatcggcattagttcccaaaaataaccttctattgcacgactcactacaacagatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaagtaggttacattctccagatcaaactaaactacatcttacaattaacactactgtctatgtctcaattcatactattatattctatgctctggatctacacatatgtgctgtgtgctacagatctgctaaaatatatggaactaaaactaaaacgcaaca

SEQ ID NO: 83020 - DNA, 658 bp, Oryza sativa
tgcagcccgtctaaatttgaccattcgtcttatttaaaaaattttaaaaaaaaattaaaaacacaagtcacgagtaaagtactattaaagctttatcatcttataacaataaaaatactaattataaaaaaaaattaaataagacgaacgattaaagttggacgcggaaactcatggctgcacttattttgggacagaggtagtaaacaaaaataaaaataaaaatatagcgtctctgctaagtgtcaattcctctacctcaaagcttttggttcccaacaactgatgtagctttcttggtgggtcttgttgtctactcatttcatgcttgataccatctggagacagtatttataccccaattattcttacaataaacacaatttagaatctttttaatggtgtatagtactcccttcgtttcacaatgtaagtcattctagcattttccacattcatattgatactaatgaatatatatatatatatatatatatatatatatatatatatatatatatatatatatatatatatatatataatatgactagcattttccacattcatattgatgctaatgaatatatatatatatatatatatatatatatatattatatatatatatatatatatatatatatatatatatata

SEQ ID NO: 83021 - DNA, 6221 bp, Oryza sativa
taattcccccccccccacttaattgcacgcgggggcggcgggatgcggcggattcggcggcggcggcggcggcgctcggcgcgggcggggcggcgagagcggcgggaggacggggatgacgggtgggccccacccgtaagcgagggtggcgggcaggcccgcccgtcagcggcacgcacgcggggagagaccgaatgggctgcgggggagaggagagagaggaagggagatgggtcggattcggcccatccgaggggagagagattttagggtttttctttttataaaaaccttttcaactttttttatttcttaataattattatttgtgctctgaaaatttaagtaaaatttgagggctctttttagaccaaggagaatttaacaaaaattctccgggtcacattcgaatttttcttgtacgcattttaatgtttgccaatttctttttgaattttaattaattttattattccttttagagaatgatttttatttcgggatgaatttattaggacgtgacaaatttgatcccaaaaataataaaaaccgtgggtcctacatgtcggtctcacatagaaaataataataaaaatagtgggacccacgtgggcctgagggcactcaaccgaggccgtagaaaccagaggagaactggagaaaaacaagatgccacgcctacgctcccggcacgggacgaacccgagaaacaaaggagagagagacctatccactcctccatgcggcatcgcacctcacttcccagccactacttaccagttgccaccaccactaccacccacaccgaactaacctcgccgtggaaaccaaacccccgcgcccgaccaccacctccctcctcccacctcttcttctggccccaccgcgcgccgcggcagacctcggcacggcgcgcgtggccgtaccatgccgtgacggccggaacccgccaccgccttgatcgccgcgcatatgcaccccatggccgtggcagtggccgccggaacagccgccgtctcatgcccgcgcctcgtccccgagcgtatccccctctccgcctccgtcgccgtcacatgtggccgtggctgcggggtggcggtgagggcgcatggccaaagcgcaacgcgtcgcggagagaagctatgcgacgaccacgacggccatggtggatgccagtgcggcggctggtcgcagcagcgccgaggagcggcaacacgggaaggggtcgtggagtggagtagccagaaggaggtggtgagggcgaggagctcgcccgccgccgctcctcctctgctccgccccgccggcccgcgcccgcccgctcgtccacgcctcgccgccgaggtgctgtcccgctcgtcggcctccccgcgcgctcgccggcctcccccgagggagcacccaagatagagaggagttagctcgagccgccgcagccagggccacctccccccgccgattcctcttccgccctcaaccgccggagccgtgcctctgccgctgcgcgccgctccctcctttggccgccggccgccgcgtgccgctgcctctccgtcgcctggagagagaggagaggagagagatgaagacaggggagatggggagagaggaagaagaagatgaagggtgaggatgacatgtggggcccacgtggggcccactattccggatcgaattgccacgtaagcgctacgtcaatgccacgccagatgaagacctgagtcaaattaagccacataggcgccacgtcagccaaaaccacccttaaaaccacaaggacctaatctgcaccggttttaatagttgagggacccagtgtgtctggttttctggttgagggacgaaaatcggattcggattcgtcgacaagttaagagacctcatatgaacttatttcttccttgtttggttcgacctcgatcggggttgagtgggctgtggcggtgaaatcgagcccaaatcgacagttgcagcatggtccaaagcgagcccaaaatcaacaagaaggccggcccaaaggctgaggcccatggacagctgcagccatcaaagccgccccaccaacacaactccccacgaggccccgagcatatcatcgccttcgccgcaaagtcccaacactagcggcgaccggcgaggactccggcggcgacgtgggtgggactgagaagcgccgccgctgacaccagcgagacgaggcggcgacctccgttgacggtaacctacctaccaacctcgccattcctctccaaactgttgtgctgctgtctagatctcccacactacactagttactcctcgtagatctcggctacctggctcaagatccggggtcagatccgggtccggggattttctttgtgccctatggctgtattttggcgtctgtggctgatgacagcgtgtgttctcgagtgcggatgcaatctgagttatataggcaaatggccttgtcaactcgggcagcggcattgctttgctcagtgtgtttgaatgtgctgaaattcatgtagtaggctgtaggctgtgcatttcttgatttgcgtcttgcataattcactggtggattttctaaacctaacaagtttaaaattagaccattcaaccaaagacaggaggaataagtgaagctgttgtagtcacagcttatggccgatccaaaatttgttaggaatgtgaatatgtgatgctacaaacatatccttgtaagctaccatgctatttatcatgttccatcatggtgattggtgagcactcatgaaaaattcagatccaaacctagtgttacatgtggatttgtgctctgcaatctatcgccagtaataaaatggttgagtgatccagctactacaaaatcacattgcatactttttttttttgtagattatgcatcctggttttgggtggtgggttcctgatgtcaggaatataaatttagcctgctgatttaggtagcactgccggtgcacactttggtttttgaatacttgtagtcttccagcttcttgtagaactggtacaatgtgggccgtatataagaagggctgtcaactagcacatgctcactaattagtctaaacatttatgtttttattcattcaggtcaggtgcaatcatagaagtagttaatgacaatactttagttgttctaatattatttatgtatggactcaaattaacatgcaaaacatatgagattagtggcatgcattctttttcttaatagtggaaaatacgagataatgataactgtgaagctctgttagtactcttcattactctatttgagtggcagcatatctcatgctagccataaagcaagttctagacgtattctgttgttaattacttgtagctatataacccaacctagtcattccagcttatgtctcttagagatcatgtttattagcacctcaagatttcctctgcacagtatagtaactatcgaaaaagatattatttctttgtttttaattgacaaccttcacgtgctacttatttttgcagagtaaatctataggaaatggctgacggtgaggatatccagcctcttgtctgtgacaatggcactggaatggtcaaggtcaggaacttcatcttttaaaccatctatcatctccaagactccaactgcatttttaccaatttgaattccttaaaattttgcaggctgggtttgctggagatgatgcaccaagggctgtttttcctagcattgttggtcgtcctcgccacactggtgtcatggtagggatggggcagaaggatgcatatgttggtgacgaagcacagtccaagagaggtattctcacgttgaagtacccaattgagcatggtattgtaagcaactgggatgacatggagaagatctggcatcacactttctataatgagcttcgtgttgcacctgaggagcaccctgtgttgctcactgaagctcccttgaaccccaaagccaacagggagaaaatgacacagattatgtttgagacgttcaatgttcctgccatgtatgttgcaatccaagcagtgctttcactctatgctagtggccgaacaacaggtatgtgatgttttacttaacttctttctttccaatttcttggttcttttgcatctatagattcatttagatgagagctcggatgattaagaactattcttatacatttttaatgttggtcagtaggtgttagaattatattatctatgctcaataatagtcgtgcaattatttaatgttggtcagtgcatatggctaatgctgttttaatcaacaggtattgttctggactcgggtgatggtgtgagccatactgttcccatctatgaaggatatgcacttcctcatgcaatccttcgtctggatcttgctggccgtgacctcacggattctcttatgaagatcctcactgaaaggggttactcgttcacaacctctgccgagcgggaaattgtgagggacatcaaggaaaagcttgcatatgttgcacttgattatgagcaagagctggaaactgccaagaacagctcttcaattgagaagagctatgagctgcctgatggccaggtgattaccattggctcagagaggtttaggtgccctgaggtcctcttccaaccatccatgattggtatggagtccgctggaatccatgaaacaacctacaattccatcatgaagtgcgacgtagatatcaggaaggacctgtatggcaacgtagtgctgagtggaggcacaacaatgttccctggcatcgccgaccgtatgagcaaggagatcactgcccttgctccaagcagcatgaagatcaaggttgtcgctccacctgaacgcaagtacagtgtctggataggagggtctatcctggcttctctcagcaccttccagcaggtaagtccttatcattacagcttcttagatgctcaccagaattagttcataactacttcataaccaatccattttgtttatttgtccacaccaagttgtattttaatggttttgctaatgcacatgtgatttgtttgcttggcattgataaaaacagatgtggatatcgaaggatgagtatgatgaatctggcccagcaattgttcacaggaagtgcttctgagtttctcatgctgccctgtgcgtcggtttgtactagaggagaaatagttgcctttatgcagccataaactgcctgtgaattgtacgtcactctcttatgtggttggttgctccagatatcgttgtactatgttcttagctctgtgactgtgaggtcacctctggaacttctctggcttggttggttggatggagttgtgatagctgatagccctggtgttgtttggggtacaaactcatgtggaattttgaactatatatatccgtgtctggtcatctggtgacatgtttgatgcgtttctagtatacctaccaaagtgacaaggcattttgtcccggatggttttcgcattcttattctaagggccgtatagattacctttctttaccagacttctagttttttttttttgaaaaaagaacttttttatctgtatttcgtaaactctaaaactttttaatgttccctccatttgataaatcattttgatttatttttatagtcaaatttctttagttttgatcaaatttatagaaaaataacaacatctatacgaccaaattagtttcgttaaatataacattataatatattttgataatatgttcattttgagttaaaaatattgctatatttttctatatatttgactaaactttgaaatgtttgaataagaaaaaaattaaaacgacttataatataaaacaatatatagtaattcattggttcgtgtcctcgagtaattatcataaattcaatttcatccattatcctattttagactactctaagcatcctttggaacgaaggaaggaatttgaagaaaaaatatgggaaataaaccgatatacccatgaaatcgtatgggcccttagcaatttggtggacgaataccgccctgttaagtataagaggattaacacttaaagaggcaacgtgattagagcgttggctgcgtgattagctggtgttggttctagaagcagggcagcttaagaaggttgtacacgtgggcaaccgcccatctccttctcccttgtaatccgttggtttgattcgattcgctttcccactagccgagccccatcgatcgtattcgcg

SEQ ID NO: 83022 - DNA, 587 bp, Oryza sativa
gatcctctccccggacaactcctcgaggatcttcctgatcccttcgatgggggtgtcgtcgtagttcaacgggtcaacggagagaagcttcatcacgtagcgctagcgccttcccctacctcaagaaccccctcccgatgctggacatcgctgacggatcgtttggctccggcgccgcggcgatgtgctaggactgcggtaaccaagcaaagaaagactgtggccaccaacattgccgcacgtgttgcaaaagccgcggcttcggttgctccatccacgtcaagagcacctaggtgcccaccgctcgccgccgtgagcaccaacagctcactggctcatccccgtcttcccccgcaaccgcctctaccacagccaccgcttccgcctctgcctccaagaagccttgccttctcacctcccaaacgacgacgtcgcacaccttcacctccgatgccaccacgcccgcagctttgacaccacctccagccatcaagtaaaacgccattgataccagcgcatgttcatcaatacatacgcgcaattcggcatgtttgtctcctacgaatctacaaacagctcaaattatt

SEQ ID NO: 83023 - DNA, 582 bp, Oryza sativa
ttcctgcagccctattcataactcataagttggattttatctttctctattatttgaggatgttatttcgcgaagttgtatatttatgttatatatatgaattttcaactttttttaagattttctcatgataattggaataatgtttgaacaaagagattaaatttgtgtgcaacatgcgcacctatgcaactccatcaactggtgcaagctggctagcatacgagattagatcttaatcaccatcctgctcgtgcattaagtagtaacaactacactaagcactagtactaactgcactgtacctgtgcaccatgcaacctggctaaaaaaatgtcgttttgacatgagctaaatactaaaaatcaaagaagacaacgtaaatccaagcctgctactagccaacaagaaaacaagaaaacggtcgggtaatcatgtcgcggtggaccgtggacgaacaccagctgctagcttcaccttcacacggtggcttccggcgagtggccgacgccgacgagccggggcggggaggccggtagcgtgtataacggcgtctcgggctccggcttctactcgccctcg

SEQ ID NO: 83024 - DNA, 25622 bp, Oryza sativa
  unsure (1)..(25622): unsure at all n locations
ccagcagacaagggatgagacgatcccagaagcctgggaacatctgcaagaatacgtggccgcatgtcctcaccatggaatggacgactggctcattctgcagagtttctataatggacttactccctcatcccgggatcacctgaacgctgctactgggggtgccttcttctcaaaaccagttagaggggccattgatcttatttagaagatggtatcaaatatggatgttggtaattcttaacgtcattactagaaatataattcccagcaatggcgcagaaatactcctggtatattgtggtcacatatttcatccgcaagcgcactgatataccattgtagcatttcacctgagagtattccaagggtatcgtatttgtttaatcccgtgggaagattataatagagagaatcatagtaataatttatatgttacttgcaataaccaaagtctaagcaggggttaatattcaaagggtagagtgacacacaagcataagactactcactatcatattaaattatctgagctaagtggaaagaaaatagaaaagaatctatttctatacttctaagggtatcgtatttgtttaatcccgtgggaagattataatagagagaatcgtagtaataatttatatgttacttgcaataaccaaagtctaagcaggggttaatattcaaagggtagagtgacacacaagcataagactactcactatcaaattaaattatttgagctaagtggaaagaaaatagaaaataatctatttctatacttctagtatacatattatacatacatcctagcaataagattaactagctaatatcctctttctcatgccctcctggtactttgagaagccgcccctaactgccgagtttcttacgatagctcgtcatgactatacaaccggagctaaatacggaggaataccctccccaggaaattaactaaggattatatacatgcgcggacgaatacccgtactgagctgtcaccatcagcagcccacctctcttccacagcatataaacccaaataatgatacccagtaattagggatgaaaacggttggaaatggtcggaaacggtacattattttattatttttttcgaaaacgaacggaaacggtcgggaaatttccatatttatgaattcatctatttattgtcaacttcaatgccacactgacagaaattaaaaaaaacttaaatttgaaaacggtaacatcggtaaaaatattattattatattagttttgcggaaacggtatctgtacggtcgggaaatttccgtaccgttttcacccctaccagtaatctagacaccacgcctaaattactagatactactctaatatcctcatcatgacttagagtaattgcataagcaaacattatacctgtaccattgcatctcctggataagctagcagtttaatcaacataactcatatataaagtaaaattggtattcatatactcggaaagtattataataccagagttggatacagaagaatattctaaataaagtacaagtcttacataagaacaaaggagagctactagagccatacccgaactcttccgaagacttctggactcagacttctattctattcctactccactagcttgagaatactaaactaagcttgagagagtatgaaagagcttgcttgaggtgtgtggagaaagtgagaagaggagctccttaaataggctgccaatgacggttgtggcaattggaatggtcagaattgcccaatttttattcaacttttattccggaagttttcaaatgagtcacatttcttactgagtcaaaaaattagactaaaatatatgactaaacatactcaagatcaagatcgtgcaaagtgtgtgtgtgatatatggtggaaatgaaatctgaaaaataaagaaaatgcttctcctttgtgcttacttccttctcccaaaatccttctttttcaaacaaggaaagggcatggctacattattttctctcctttttttcatcatcacgctcatgcttgagagagcataactttattattttcataaccaagcctttccctccctcttttctcttttttttgaaaggttttcctttttaggagaagaaagcacataaaagcatggagaatttatttttggtggtagtatggaaatggaatggatagatgcttgctcccagtgtaggagtttagcatgtgcatatatgttggtgtatgatcttgatcatagagcatgagaagtatttacacaagtcacaagaatttgataaagttcaacggaattgcaagtaaccaaaatatatatggcttaatcaatatggaatatttttggctctagtaggaatttatatcaaatgaggaacttcataagttatcattttgaaaaataaaacatccggaattcgagtcaaacttagaacaggatcaaagcaactcttatttactatctcatatctcgcaacaacttagacttagatcagcaaatacagctcatttacctcaggttccaagataattgttggctactcatattcaatttttgagagagtacttacccatgaacccatacatgagagatataaaacatagcaactattcatcagttcaacaaagagaactaagttgtcttacctagcataataaaatctaacctatctttttggtattttctattttgcaaatttttatgttgtttttaggtttataaatgcaattggaaagggaaatatgcaatgtgatacaagttaccttagtggggggagagacatctccctcccaagcttggcttttgctcagggtccttgataaggattgaacccctggaagcggaagtacgcttgaaggtcatcgtgctgttgctgcatcatgttgttgatgttggtgaactgagcatcagcattctgttgccattcttgtgtttgtgctatgtgttcctcaaggttgtgttggttctctcccgtctgcatatcaagggtatccattttcctagtgatttcacccaagtcacaacgagaggaacttgagcgccattcactgggagatggaggcataccacttgatttgggggactggttgttccagactccccactgtatgtcatgaggcgcctgccaccggctctcgctggcactttcccagctcgagactccaatgctatggcgtggagcttgggtctatccgggtgcatccccagttggctcccaaacagcctcatacatctgtacgggtgttgaggacgttgaaccttcatgttcattccttgccatgttgtgtgtcttcctgtatgtgcacgagattcttctatggtatgcaggggaatagttagttcatgacagttgtacaaatgatatcccgcgttaggcaacgtgatttcatttgtacaaccagggaagaagtatatcaaagatctatctactccaggtttaagaatatgccctttcactagataactctcatcaacacagggacgagcggttggaatataagcaatttggtcattggtaaataacccctagtccctttgctatacgagtaatcaaggaagtgcactcaacaagagcagtaaatcttatactctctaaccattaccttatcatacatttcagaggagcaacgttaatcttcctaaccatggcaaacatgataaacatgataatcaattcatcctctctgataggtctaagatcacctctaggaaacaaagtcatagaaatccatttgtgcataagcctaagtgtaggattagggatatcattagtcctaggtttcttgcaaattggagcaccagaaatgtcttctcgaaatctttttttctcaaactcggaaattcctttccgaagatcgattttactgcaatcgtaaaaaccaagaagtgtacttaatcctttccatgaaagtgtatattcatcatggaaaaagcgaaaggaaattacatcttctatttctttcaaagtgcttagaaattgcaaagtaagcaaacgagaaccacgctcatctaccacaacaaatatctgccatccaacagctttccaaatagcacgaaagtcagtatccatacctatctttttcagcagcgccggagcgtatactcgcgtgtgagcatactcccggtctttcagcatgtagtaggcttgtctttcccgatcaccgacaaggtcgaggtcagcgtcgctcaagagacgttacgaaacgtcagcatcctccattgagacatcgatggatgaacgattgctagcctcatcatgatgacttgatggagagccgtgtaacttcttgaacagacggaatagttgtctcttcattctgcacaaaggaacaagaacggactaactcggcgggggttagaataacaagagtttcacccgctgtcatgccccgattttcgttcgggattaaaaatcattaaataatgcattttgtagaaattaaataaaatttaaagcaaattaatcaagtgaaataacgggagaattaaagttttcccctaaaaatcattggccgagaatatttggtaatattataatgatacaaagttcatttaatcaatttaaataaaaagaaaaataaataaattctctctttctctccctcccctcccttttgggctcggcccagttttccctccctcgggccggcctccctccttccctcctcccttctcccttttcggcccgctcggcctctctcccttgaaaagtctacatcgccccctcctggtctcccctctcactcaggctgacagatgggtcatccccaacctcaggcctacaattgtcgttgccgccatggccgcccgagccgccccacgtcgccgcttcccccacccacctcctccaccccacgcgctcttgcctggctgtgggacctcgccgcccacgtccccgctgtcctcacccactccgtcccatgaaaaccaccaccgcttccccgcgacgattccacccacgttgtgccggttactgcccctctcggccccgatcccgccgctccgagcccatataaatgatccccggagcatcctctctcttttccccatttttcccgaacctgtcacactctccctcgctctcgcaacaccgcgtcgcgcgccgccgctcgtcggcgtgctccagctgccggctcccgccgtgttggccgtcgccgcaccgcgccgagccgcacctcggcatccggtctgcctccccgtatccctatcggaaccacctccgcaccgtgtacccaagccatcaccgccgttcgctgcctccggccgccctccaccgccgcttcaaccaccgccactgctcgctgcttgcaccattggcttcgctgtcgcaagagcaaggccgaccgccggagcaccactttcgtcatcgacccaaggccgccgcctcatttgccgcctccggtcgcagattcccgcagttcctgacctcctcgcggtgcgccgtcgcttccctcggccacgcaaggaagagaagaccctcggccaccacctcctcgccgccaggagccgccgtaatgtctccccgctgagtcccgccgcaaacgccgtgctcggccagtgttcctcgccgtgccgcgacgcctctccctcctctaacccctcatctttgctcccctcggccgcacctccgccgcggtaaggagtcgctggagcgccatctccgaccccaacccgagaagcgccgccaccaatcctcgtcgtcggtcgcctccccgtcttcgcctcaccgtccccgtcctctcgatgagccccctctcccttccccgcctcctcccgtgtgcgccgccaccgcccgctgccggcgaccatcaggcgccgccgccctgctcgcccgtggccgcccggcccctttgccgtgccatgcctgcccgtggtcgcccaatcggccgccctagccgatctgggccatccacgtggcctccctatgccacctcgtgtgggtgccctcgtggcaccacgtcggcgccacctccgctcagccgttcgtcgtggccgccacgtgtctgccacgtggtgcaccgcgagccggtgcgcgcgtggacttggtccacggtgcacccgccacccgtgagtcaccgatgggtggggcccgcttgtcggcaccaacccttccccctcggctgacgccaacaattatttaataattgtgcaaaaaaatcgatattaattatagaaattcatttaaatggctcaaaacttctaaaattcatatctaattcatacgaactccatattgagccattcaacttgcaaaattcatctaaaattgagctctatatgttttataattgccatgtactgtttcatgtactgtttgcttggtttttattagagtttttcctcgttttgcgtgccagcgagtagattctgccgtttcggaagatcgtagttgtgtggaaaagagttcagaaggttgttgtgaagaagcaaggcaagtcacacattccccttgagcattttgagcctaatttacaaattttttatcatttgcaaataaacatggattgttttgctaattacatgggatcagggtttacctatatgctcgcttgttccatgtttacttgatatctgtcctttgtcaacctcgggaaataaatcgactagctcatgttacttatgtgacctagtagaaattttatgcttagccatgcttaattaccactagctcagttgatgggataattatagtattagactttctagtatcatgacaagctgcgtgctcgagacaaccggccatgtttcattggtcaagattatccaactaaaatgcaacttattggtgggctatgggtgcatggttttgctagtcgcacccatggcaattataggcgattaaggacatgtgagtccaaggccttgacggtgccttgtagccttttctcgtggtcatccaagcgtttcatgaggaggtccagcttggcagcaagcatctccgtctccttgacggtgtgcatgccttgctaacgggtctggagtcgttcctcgctccagcccatattggagaccattttctctataagatcgatggctactcgaaccgtttttgagaaaaaagctcctctagatgccgctccaggtggtcgcgagacgtaggagtgagtccatcacgaaggacattggttttgctcagtggtatgaattttgataggaatgccgtaggaatgcccaggtgttgatcgtggcatggttggcataaaaccattgcttcgttttcccaaggagggaaaatggaaacaatcgcagcctgacggcgttcggactgacacccttcatggtatacatgctgcagatctccaggaactgttgtagatgggcattggcatcctctttaggcttgctgcagaacgggctagcctgcgccatcatgattaggctggacttcagatcgaaatctacgtctcccatgttgatttacagcccagtatccacgctgtcagcagaaggagcagtgaattcacggagagttttgtcagccatagtcttgaaagttggtagcgctggtatggctggtttctttgtcaggagaattttctgcggagtgatgactcgcggcttgacgctctgaaagaaagcctctggattttccttgaagttttccggcaagttgaaaccagtcatgcactaccctgcttccacaataaaagtgaaaacaaccaaggttagcctgcaaaggacagtggttatacagaggtaaatataaagtattagtaatggtaatctctttataaatcttccccagcaacggcgccagaaattcttgttggtatttcttaatgtcattactagaaatataattcccagcaatggctcagaaatactccttgtatattatggctacagatttcatttgcaagcgcacagatataccattgtagcatttcacccaagagttttccaagagtatcatatttgtttaatcccgtgggaagaacaaaccgcaggccatggtcaaggcattagacttgcacatcacttgcgaggtctgcgggaacgctggcattcggcaaatgattgtcccaggacctgtgaagaagcaaagttcatggggaacaatggctatcatccacaaggaggccaatggtggaatcaggcccgcccattctacctaggaggcaacaacagcaacaacaataacggtaatttcaacaaaaagcttgctacttacgataaaacccttgaaaatataaatgtcaagctagaaggattctcttctgctttccaaaaccagctgagtttcaacaaaatgatagaaactcagctggcgcagctagccacgctagtacctgctaaggaatcaggaaggattccggggcaacccgaaccttccatagaaaatgtgaaggcgatcaccacgaggggaggaaaatccacttgggatccgctataccctaaccatgtagggaccaagcaagccactgaggaagcatagtcttctgatacgactgaaatagaagaggtggcacagctctacaagaccatgccgtaggagtgctgcgacaccttgctattgccttttcctcaaaggcagaagaagccctccatggacgagcaatatgctcgtttcatggatgtcatctagaagatacacatgaacatacggtcgctcatgggtgcaatgcgagtgccaacatacggtcgctatctgaaggacatcctgaataacaagaggctactgcttaccacggggatgtcaagttaacagaggagtgtagtaatgttatactccactggctcctggaaaagaagaaggatccgggttgtaccacaatctcatgctcaattgggacgcaacactggaccaggccttatgtgatcttggagcaagtgccagcgtcgtgccaaaggacattttcgagaagctgaattacacggtgttggtgccaacaccaatgaggctccgactggccgactcctctgtccgctacccagcgggcatcgccgaggatatgctagtgaagatttgggatttcttcatctaggtagacttcgtcgtgcttgacatggactcagataaggaaacatctctgatccttggacgtcgattcttaaccactgcgaaagccagtattgatgtgggagttagtagcatccggttccacaatgctctatggtcaagatcaggtatgggccgaatcctcaaaacatcaaggacgttgaggtcaagccaccaaagacggatagctagatcgctttcatgaagaacttcctgaaaaaaagaagcaaccaagaccaggccccgtccgaagaagacgctggtaaaacctggtgtacatgccaagcagcctgtgagaccggctcccaagaagccgccggccacacctaagaccaaaaaggtgtggtgggtcaaggaaaatacatccgctgcaccaccttcggagacggatgaaaaatcttcacgttgaacagctggaggtatggtcctactcatcggacctaaaatcgacgactccctcgccaataggtaaagttggtatgtatctcatattttctgagcaacatgaaagtaaaatttgtggcattcatcaatgtgactcccacacatgaagccattggaatccaacggctgaatgtggggccagtggttcggccgaaccaggcgagcaacagttaggttcctcccttttgacgccaatggctagtgggtcccacctcacagttacagctatttgatatacactacataaggggtatggccgagagaaggggttcataccattttcaactcatttccactcctcaacttttcttttgctctcaagctagttcaagctttgtctcatgttttagaatcctacatttgcatatacaagtcactttagtgcaaggctaactggtgggcagatcatcttgtgctaacttaacccccgctcgagtttgctttgtgctcttgctcttttccagtcatgaagagatggctctcctgtctgttcaagggatccggctcagaatctagccgccatcaagatgagtcaagtgatcggtcatccgccgacgtgtcgatggaggatacggacgcagtaccgcaactctagagaactccaataagtccaaaaatcatgttttggtgctttttgaactttttcgtacagctggaaaacatcgcacccacatgtgccaatatatgccaatattagcattaattgacaaaaattcgccgcgcgagtcacggagtgattttttgacacggacgtttccaatacacttcaatatgtgcaaaaatcatgtcttggtgctttttgaactttttcgttccagtgaaaaacatcacacccacgtgtgccaatattggcattaattgacaaaagttcaccgcgcgaatcacggagtcattttttgccacgaacgcacccaatacactcaaataagtccaaaaatcatgttttggtgctttttgaactttttcgttccggtgaaaaacatcgcacccacgtatgccaatattggcattaattgacaaaagtttttcgcgcgagtcatgaagtgttttttgccacgagcgcacccaatacactccaacatgtccaaaaatcatgttttggtaccttttgaactttttcgttccggtgaaaaacattgcacccacgtgtgccaatactggcattaattgactaaagttcgtcgcgcgagtcactaagtgatttttttgccacgaacgcaccctatacactccaataagtccaaaaatcatgttttggtgctttttgaactttttcattctggtgaaaaacatcgcacccacgtgtgccaatattagcattaattgacaaaagttcgccgcgggagtcacgaagtgattttttgccacgagcgcaaccaatacactccaataagtccaaaaatcatgttttggtgctttttgaaatttttcattccggtgaaaaccatcgcacccacatgtgcaaatatatgcaaatattagcattagttgacaaaagttccccacacgagtcacggagtaatttttcgacacagacgcacccaatacactccaatatgttcgaaaaatcatgttttggtgctttttaaactttttctttccggtgaaaaacatcgcatccacatgtgccaatatctaccaatattagcattaattgacaaaagttcccacgcaagtcacggagtgatttgttgacacagacgcatccaatacactccaatatgtcgtccaaaaatcatgttttggtgtttttcaaaactttttcgttccagtgaaaaacatcacacccacatgtgccaatatatgtcgataatataactaattgacaatagctcgccgcacaagtcacgaattgattttttgccatgaacgcacccaatacactataataagtccaaaaatcgtattttggagctttttgaacgtttttgttccggtgaaaaacatagcacccacgtgtgccaatattagcattaattgataaatgttcgccgtgcgagtcacgaaatgatattttgccatgaatgcacccaatatactccaataagtccaaaaatcatgttttggttctttttgaactttttcgttccggtgaaaaacatcgcacccacatgtgtcactattggcattaattgacaaaagttcacagataagtcacgaagtgttttttgccacgaatgctcccaatacactccaataagtccaaaaatcatgttttggtaatttttaaactttttcgttccaatgaaaaatattgcacacacatatgccaatatatgccaatattatcaataatcgacaaacgttcgccgcgggattcacaaagtgattttttggcacgaacgcaccccatacactccaataagtccaaaaatcgtgttttggtgctttttgaattttttcgttccggtgaaaaacattgtacccatgtgtgccaatattggaattaattgtcaaaatttcgcgagtcacgaagtgattttttgccatgagtgcatccaatattagcattaattgacaaaagttcgctgcgggagtcatgaagttattttttgccacgaacacacccgatacactgcaataagtccaaaaatcatgttttggtaatttttgaactttttcgttccagtgaaaaacattggacacagatgtgccaatatatgccaatattatcattaatcgacaaaagttcgccgcgggatttacgaagtgatcttttggcacgaacacaccccatacactccaataagtccaaaaatcatgtttaggtgccttttgaactttttcgttccggtgaaaaatattttacccacgtgtgccaatattggcattaattgactaaagttcgctgcgtgagtcactaagtgattttttgccacgaaagcacccaatacactccaataagtccaaaaatcatgtttggtgcttttcatacaaattgacagaagatcgccgcgcgagtcacgaagtgattttttgccatgagcgcatccaatacactccaataagaccaaaaatattgttttggtgccttttcagctttctcgttccggtgaaaaacatcgcacccaaatgtgctaatttatgcgaatattataattaattgacaaaagttcaccgcggaagtcatgaagtgattttttgccacgaacgcacccaatacactccaatatgtccaaaaatcatgtttttgtgctttttgaactttcttgtccggtgaaaaacattgcacccacgtgtgccaatattggcattaattgactaaagttcgctgcacgagccactaagtgattttttgccacgaaagcacccaatacactctaataagtccaaaaatcatgtttggtgcttttcgtactaattgacataagatcgccgcacaagtcacgaactgattttttgccacaaacgcacccaatacactccaatatatccaaaaatcatgttttggtacattttgatctttttcattccggtgaaaaacattgcacccacgtttgccaatatatgccaatattagcattaattgacaaaagttcgccgcgggagtcatgaagttattttttgccacgaacgcacccaatacacattaataagtccaaaaatcatgttttggtgttttttgaacnnnnnnnnnnnnnnnnnnnnnnnnnnnnnnacgtgtgccaaaattggctttaattgataaatgttcgccgcacgagtcatgaagtgatactttgccacgaccactaatggttgctcttctctagcatgaaaagtggacatgttcaattcattaatggcacactcatcttgattaattgcagcaccattaaaattacctttggttctctcttcggatgatgtaggtgcatcagtcttctcttcttccttcgtgagtgttgtagatgtcgaaattataagcacataatgatttaatttattccataaataaataatgacattgcagatgtaaactagattgaatgcatcattagatctacacatgactaagcagtaaaacatgaacagatcaaatatgcgcaacatgtcgaaccggttgctcggcaggaactactcgcggttgcgggcgtcgacgaaggcgcgcaacacgcgagcggagaggaaggcgagccgtcgcggacaaacagggagcagtcgcgcgaagcgcttcccaaaaaccttattgccgccttctcccagtgtaggacgtcgaaggcagaggttccagagacctgctctcctgatcgcaggtgcacgcctgcgagcgggatggagtagttaacagcgacggcgcagcacagaggaggaggcaaaccctagattgatttcgtgtgtgttgcgtgaaggcggcggctcggtttatatagagataggtcgcttgatcagggcgcccgcacaatctccactccgcgtaaccgaaccggataagtcgcgcgtaacttatccggactccacgccgttttcacgcaccagatttttcggaatgtttctaaaacaaaagaaatccgaatttcccgcagcaaaacaaaactgcaaaaggaggctgcatctgcgcaagggtgaagagccaattttgcagaccattcgacgcgtacgtcgtgcacgcgcgccgcctaccctgccaggccaggccaggccaggcgagcgagcgcgcgcatgtgctttccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgaatgtgccttagcccatatattaattccaacaatcccccaccaaatctcaaaatcccactgagatttgcctttttccaatgtattgttaatataccagcggttcgatggagaccgattaaggttgaacatccacctagaactccaagctacacttactcacaacttgaacaatggactacgccttgaattgcaagtcttgtgcaagcaagtttcactcagagtcttatctggtactagaccgtctgtagactacccctcgggtggagcgtataagtcaaactcctaggtctttagtaagcttcctagaagattcacccaaaatttccatagactgcgaccaacagtcaagcttacaaaggtgagttctttcaagaatgctctgcaggacagcatcttcgctaattaaagccaacataactcattaaggcatagccaacctgccttgcagctcacgagagtacatgcatcttcacttagagagggtatagatcggtactctcctctagtttactaatggtttgttcttcccaggttctaattcacgggatctccgatcacatagactgggttaccaccatagtataactcacatgggtctcaaacccatctccttcgatgcattatctatcacatttcgtgatagtcccttcgtgaagggatctgccaggtttctagctgtttggatgtaatccaacattataactccggagtttctcaatttcctgacagacttcaatcgtcttttcacatgtctagacgatttcatattatccttagaactattcattttgacaattaccgtttgattgtcaaagttcataaggatagccggcaccggtttttcaacaataggcagatccattaatagatcacgcagccattctgcctcaacagtagcagtatccagtgccgtcagttctgcttccatggttgacctcgtcaaaatggtctgtttgcaagacctccacgaaacagtaccaccacctagtgtgaagacatatccactcgtggctttaatctcatccagatcagagatccagttagaatcactataaccctccagtaccgcaggatacccagtatagtgaagccctaattccatagtacctttcagatagcgcattactcgctcaagcgcacgccagtgatcatctcccggattagaggtaaaccggctcaacttgctcacggcaaaggagatatcaggcctagttgcactagccaggtacatcagcgagccaatgatttgggagtattccagtagattcctagcaattcttttgttcttgcgaagcaacaagctaggatcataatgtgttggagaaggcttactatcaatgtagccaaagcgattcaagatcttctccacataatgggactgcaaaagtgtaatcccattctcacctctaattagcttaatgtttaagataacatcaactactcccaaatccttcatatcaaaattttgagacaagaatgatttaacctcatttatcatctcaaggtttgtcccaaatatcagtatgtcgtcaacatacaagcacataataactccctcacccccaccatggcgatagtacacacatttgtttgcctcattgactgcaaagcctgcagatgtcaatgttttgtcaaatttctcatgccattgcttaggagcttgtttcagaccatacaaagacttcaacaatttgcacattttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaataggtgagtaagtgtcaaagaaatcttcgccttctttctgagtatagcccttagcaacaaccgagccttgtactttttaatagtaccgtcaagcctaagcttcttcttgaacacccacttgcaccccacaggtttacacccatagggtcgctctgtcacctcccaagtcccgttagcgataatggaatccatttcactacggacagcctccttccagtagtctgcattaggagatgcatatgcttctgaaattgacttaggagtgtcatccacgaggtacacagtgaaatcatcaccaaaggacttagccgtcctttgtctcttactccttcgagaagcttcactgacatcctcctcagtgacatgttcatgtgtatgttcagtttgttctggtggtgtgattgaactgggaattacttcagagggttggctcgaactactatgtgtatccttcattgggaaaaagctttcaaagaaggtagcatcacgagactccataattgtaccaacatgcatgtcaggtacctcagatttaactattaaaaatctataggcaatgctgtgatgagcatatcccagtaagacacactccacagtcttaggtccatgtttgcgcttcttcgttattggtacattgactttcgccaagcacccccatgtgcgcaaataagaaagtgatggttttctcccaatccatatctcatatggtgttttgtccttatttctgttaggaactatgtttaacacatgatttgaggtcaacaatgcctccccccaccatgccttaggtagtcccgcggtgtccaacatggcattcaccaagtcagtcagtgtgcggttcttcttttcagcaatcccattagactcgagagaatagggaggcgtcctctcatatataatgccatgttcttcacagaataagtcaaactcgtttgagaaaaactctccaccacgatcagacctaagcttttttatctttctgtcaagttgattttcaacttctgccttataaattttaaaatagtctagagcctcgtctttcgttttcaacaagtacacatagaaaaatctagtagcatcatcaatcaacgtcatgaaatatcgttttccacccttcgtcaacaccccattcatttcacaaagatctgaatgtaggagttctagtggtgccaagtttctctcctcggcaatcttgtgaggcttgcgaggttgcttcgattgcacacaactatggcacttagaacctttgacaatggaaaacttaggaattaaacacatgctggaaagccgagacatcaagccaaaattaatatgacataaacgtgagtgccaaacattagcctcatcatccacactgccacaaatatggttcacagacttattgcagaaatcagaaagggaaaagcgaaacaggcctccgcactcataacctttaccaataaaatatctatgtttacacatgactactttattagactcaaaaaacaacttaaatccgtctctagtcagacaggagccactaacaagattcctgtctatagaagggacatgctgcacgttcttcagctgcacgatctttcccgaggtaaacatcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagactgattaattgaaaaaacagtaggaaaattaccatacccacttccatctccagtattgccaatggtcacattagtagacttagaagtctgccctgcaggtgccttcatccccttgcgctgtggacacttcctagctagatgaccaggttgcccacacacaaagcaagtcctctcatgttggttaggattgttgttgttcttcttctgcttcttgaagttggtggtctgttgagctttgtatttccccttgctcttgttcttggccttgtgcacaacattggcactgcactgcccaccatcgcccttagacgcggtgtctttttcccgagctttctcctcaacatcaagagacgctatcaacccctcaacggagtattcctgtctcttgtgtttgagtgcagtaccgaaacctctccaagatggaggtagtttcgcaataatacacccggccacaaatttgtctggtaagacacacttaaggagttcaagttccttagccatggtttgtatctcatgagcctgttcgactacagaacggttgtcagccatcttgtagtcatgaaactgctgcatgatatatagatcattgctagcatcagtagcaccgaatttagtattcagtgcatcccacaactccttagcgtcggtcatatgcatatacacctcgaccagacgatcgccaagccactaagaatgcatcccacaaagagagtagtggcctcatcaaattctttctgctgatcagcattaagaacgcccataggcttgtcagtactcacccagaagcatttcatagctgtcagccacagagtgaccctgatctgccatctcttaaagtgcacaccggtgaatttatccggcctcagcgcatcggcaaaaccagccatagtaaaatcaccgcgcctataataaggtttttggattgtcgaaattataagcacaaaatgatttaatttattccataaataaatcatgacattgaagatgtaaactagattgaatgcatcattagatctacacatgtaaactaagcagtaaaacatgaacagatcaaatatgcgcaacatgtcgaacacataccgaggtggcggaaagatcggttgctcggcaggaactactcgtggttgcgggcgtcgacgaaggcgcgcagcacgcgagcggagaggaaggcgagccgtcgcggacgaacagggagcagtctcgcgaagcgcttcccaaaaaccttattgccgccttctcccggtgcaggacgtcgaaggcagaggttccggagacttgctctcccgatcgcaggtgcacgcctgcgagcaggatggagtagttaacagcgacggcgcagtacagaggaggaggcaaaccctagattgatttcgtgtgtgttgcgtgaaggcggcggctcggtttatatagagataggtcgcttgatcagggcgcccgcacgatctccactccgcgtaaccgaaccggataagtcgcgcgtaacttatccggactccacgctgttttcacgcaccggatttttcggaatgtttctaaaacaaaacaaatccgaatttcccgcagcaaaacaaaactgcaaaaggaggctgcatctgcgcaagggtgaagagccaattttgcagaccattcgacgcgtacgtcgtgcacgcgcgccgcctaccctgccaggccaggccaggccaggcgagcgagcgcgcgcatgtgctttccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgaatgggccttagcccatatattaattccaacagtagatggcatctcgatcatattgcacttctcctcatggtgaatattctgagctcccttcaaaatgtcagtaataggaggcacaagcatagctcgtttctcccttgggttctttaaaatattgctctcaacactgcaagcaagcatgaacaagtggcctatatgaatatatgtcacgttaataagcccagcttgaatatcagaattaagccctctaaaagatctagtcattttgttctcattgctttcttttaaaccactataagtgatacaaattttaaagttatgaaagtactcccgcatggttttgtcaccttgttttagttgctctaatttctcaaggagagtacgtttataatacgaaaacacaaaatttttcctcatcattgttttgcattcatcccaagtttcaagcttattgccaacagtataccaccaaaaagatgcagaaccggtacatttattattagcagccttaatcatttgagcattagagaaatcatactcatcaaattgtttgtctactgctagcagcagaatcatacttaccatcaaaaactggcaatttagattctacccttgcaagatcattatcatgtacctcatatgtgatgcatgaagaagtcgctatatctcgttgatggtgaagatgttgatgttgagcatgaccatctcgtttccccttgcgcaatcctgccatggttagtagcaaacaagaaacatacacaagaatatgcacgctcctaccaactactaggtagtggcagctgaaatatcatacacacttaagcttttcaccaagctcttacaagtacttaccaaagcaagcggaatggtgacgtacaccgactcaaccaagcaccccaatggagtttggatgtatcgatgccttggcaaacacttgttgtacgactgcaatcaaatctgtggagctctgggtaggcttaaatatgtaacaaaggaatagcaaatgctcaatctagaaaatacaaagttgaatgatcgttcaaagtcaagtaccgtgctcgtcctaggctagaatgtactagagacgcgagcctagacacaaacgatacgacaaaatagcactaggaacaatttatgcacaactctgatatatgaaagcaaactcaaagatacaactgatttttctcttttccttctttcttctttcttatttttcttttctttttcttttctttttttggtgcggcttttttttctttgtttttttacgcacctttctaccttttctcactttttttatgatttttttttaccaaaaacagacttaaggacctcaatgcaagattacagggactcaaatgtaaatataatatatacagggactcaagtgtaaaagtctagaccaaaaaaagaactatacaaaaatggaatgtggaatttatgccggttccgtttttccaaacagatctcgaaaccgacaccaaacaaaaattcaccaagctgtctaacaaatcacggtaccaattgaaaccgagacgagatgagaaggatggagtcggactttcctagtcacggtggtgatgggtgcggtaggtggaagggttcagcctgcccccccacgagtggaaaccgaatccaatcaaaaaaaactttccttttgttttctttcctttttttttcctttcaccccaccgaatccaaacagatctgctatattcgtttttgcaaacagatttccaatgcgacactcgaaaaagaaaatcaccaatgtatctatatgggaagccatgtcatagatgcaaactgagagaaaagggaggagtcgaactcactcggcctgttaatgtgaagggcaccacgaccgaataaaaggaaaagtcgcatgcaaggaaaccgaatccggttaagatagaaaccgatccaatctactaccaaaaactgatctaatctaatatcgtccttccttcttcctcacacgcaacatcacaggcgtaccatcacggcacagccactgaacagaagctatgcaactcaagaactcaaaaactaaccgacagaaacttctgaaaactacaaaaatagtaccgtggcaccaagccgattccattttcgtaggtctcgacgacaacagagacacggaggcgacgacgactatggtataaaacatgaccagaactcgaaactctaaacgaactagatgctaagaccggcaactacgactcgacgatgcaacagaaaactcaacaaagcaaaaattgaaatggacaatgcaatggcacaagtatggctaggtataggatacaattttttttgtatggcaattttctggttataggaagataaaaactcaccgagcaatgaaagctctgataccacctgatgaaccctgagctccactcgagttactcaaggctgttgttggcccgatctttcagagagttgatgataactccgatttgggagaaacattgacaacccgactataaccatactagacgttgttgtgttgcgccttagcgatcgatacacctctccgtgggttgttgatcttgccggtgtagatcaaccgtattcctataagcaaatcgaataaacaatcaagaacaagataaagccaataattgcaaataggaattgactacaaatgataagttggggttccgtaacgagtaaacaggcgatctaaccgatcacgggattacacggcaaagtagcaaagctaaactttaatctaaacaaaacccaagtaaccctgaaggggtacctacctaactataggggtgggaggacgatcaaggggtgccaatggtcgttctccacctggttggggcacaccgcacatgggccccacttgggccgaggtctcaaacanagttacaagccctaggcccaatacaggtgatgcaacaccttgtttatgtgattgcggccaaatgacatggaaattggcgacgaggctacatccattggaaagagggctccgagagctttctatcaagtactcacgggctgaaaacggaggtcgtatgtagattcggcggccgtttgaagtcaacagagtagcaggtggccgaatcggattccagcacttggaggacttcatcttgatatctccttgttcatccatgatgtgagcaatggttgtatccgtccgtagtagtcatggtcacattatcatccttgcccgtgaggggcttgttggaggcatgtcacgagggccttcggctgggtctactaaaaccacaaggaccatgaggtgttggctaagtccaagaggcaaagccataaggaaaagcagctgggcaaaactagatgatgtagaccgaagggtttgccaccaagcccactatcctgacgagccatcactacgggcgaaggccgtaaagcgaagcaggagggttttgcttgagttagaagcggcttcggcagagggcttgggagacaccgcgccccatggaggccttgcgccattaatgggctggcccaaggagttcacttaatagcccgtaaacacaaaggacactgtgtagcctcactaaagtccctatcgtaagggtatccatataaattctcctgtacaaactaaaccctatagggtatgagcctgtattaagactataaatagccccctagggccgtgtaatgggggatcctaaaaaattatcttatcgattaatatattgcttttactattccaacaatctaccgagtgaaccacgtctttcgacgtgacgcggttgtcttttgacaacaagcatgtacctcactcatgtagcatttgcagttacataagtaattaaactataactagagctatcatatatgtaggtgccctcttcttttttgttgttagaaaagaaaggaatttaaaggcaagtaagtataatgttatatctttatggttgtataatagtgagattttcacgaactggatatgtaaatttgccagcttacaatgaatttactgaagttggggtagataaagaagtgaaatattgcaaacaaatcgaggaaccatacatcaagttagagaataacaaattaaattgtagatgaaattcacctagtctagttgttgcgatagattaactcttagctttagcaaaataatccaaaaattgcttttaattggctgtcaaagtattacctaattttacccaacccaattcactgtaagcggaagtacgattgaaggtcatcgtgctgttgttgcatcatgttgttgaagttggcgaactgagcatcagcattctgttgccattcttgtgtttgtgctatgtattccgtgaggttgtactacatctctcccgtctgcacatcaagggtgttcattctccttgtgatttcacccaagttccaacaagaggaactcgagcgccatacacttggagatgaaggtattccacttgatctgggaggttggttgtccccccattgtatgtcatgaggtgcatgccaccggtcctctctggtgcttgcccagcttgagacctcgatgctgtggcgtggagcttgggtccatccgggtgcatccccaattggttcccaacctacctcatatatttgcatgggtgttgatgatgatgaactttctcgttcatttcttgccatgctgcgcgtgtccctgtatgctccacctgcacgagattcttctttggtctgcaagggaatggttagttcacagcagttgtacaaatgataccccacattcggcaatgggatttcatttgtacaaccggggaaaaagtatatcaaagatccatctactccatgtttcaaaatatgccctttcactaaataagtctcatcaatacacggacgagcggctgagataaaagcaatttggtcactaacaacccctagcccttttgctatccgagtaattagagaagtgcactcaacaggagcagagaaccttatactttctaatcattgtcttatcatacatttcacaggagcaactttgatttttctaaccatggcaaacatgataatcaattcattccccctaatgggtctaagatcacctctaggaaacaaagtcatagcaatccacttgagcatgagcctaagtgtaggattatggatatcattcgttctaggtttcttgcaaattggagcaccagaaatatctttgttggtatttcttaacggcattactgatcgataacgaccgtcaacaatcttcccaaaacctattttccttgaacctagaaattcctttctggagatcgattttaaaggaatcgtgaaaaccaagaagtgtactcaatcctttccatgtaagtgtatactttttatggaaaaagcgaaaggaaattccatcttctatttctttcaaagtgcacagaaattgcaaagtaagaaaatgagaaccaggctcatctaccatagcaaatctctgccaaccaatagctttccaaatagcacgaaaataaccatccatacctatctttttcagcagctccggagcgtattctcgcatgtgagcatactcccggtcactcagcatgtagtaggcttgtctttcccgatcactgacaagatcgaggtcggtgtcgttcaggagacgtcgcagagctttggcgtcctccatcgagacatcaactgacgaacgagcactagactcatcatgatgacttgacgaagagccggaccccttgaacaaacgagacaatcgcctcctcattctgcacaacggagcaagaacggactaactcggcgggggtcagaatagcaagagtttcacccgccgattagtttcaccaaagcaacttgtatatatgcaactaagaatttgaatttgagggacactatcaaaccttgaatgaacttgagagcaaacattggagagggaatgaaaatgtgttgaaatggggtgg

SEQ ID NO: 83025 - DNA, 658 bp, Oryza sativa
aatctcatcccactgaggaaggtggagggggtgggtgaaaagtgtccagacctgtgatgacatcagacagcctctgagctactgcagagaccccctatacctatggaccacttgatttggtgacattttcaaaatatatccaaaatctgactatttctcaccacccccagcactgccatgtgccccaggccaccaccttctctccccacagggctccccgctgctgctgtggcccctcccaggctattctccacatggtagccaaagtgaacttctatgaacttctacaaacagatcatgcaactcctcccccagaaacccccaagccttctcttcccactctgtgaaatggccaaagcctttaccacatggatgaagtcctctaagacctgggcctcgccgacttcactgacctcaccttgcaccactcccattgcctggaagcccctcaaagacacagagcacactcccttccgtgggatttgcacttgaagttccctctgcctggaacttgcctgtcttcctcctttgcttccttcaggtctctgctcacatgtcatgctattatcaaggacgtccctgacaccctgtatgacagcactgtcctgcagaaccatctatgatatggaaatgcgtcataacctgagctttcaataca

SEQ ID NO: 83026 - DNA, 17026 bp, Oryza sativa
  unsure (1)..(17026): unsure at all n locations
gttgggttcgcccggccaaggtcaacctcgtccaacccctcctccgtcgaggttcgccgccggagcccaaccccgtcgtgcgccggggagtgacgccatggccgccgcctttctgccggcgccctcgccctctcgcactctcctctctccctctaacccctctccttttgttcgttaggaggttccggagctcgtcccgccgtcgccatcgtcctccgtcgctcgccgtcgtcgatcgttgtcggtgaggtctctcctcctctttctctctctcccgcaccgtttagccgtcgcgccgccgcttagccgcgtagctgccgcttcgccgagacgccgccgctctccgccgccggtcggtcgccgccggccgccgtcttgcgccgctgccgcatgcgcgccgcgccgtcgcgcgccatggccgccgggccggtttgcgccgtgcccgcgcgcaccggccacgagctcccgccgccgtccgatctacccttggctagattggggccatcggttcggctgtcgcgtggccgccgagaggtgcgccgctcctccccggtccgtggacccgatccgccgtggaccgccctccccgagtcactgccatgcgggtcccgcttgccggcgccccttcctccctctcccgagccgctgaccggtggggcccgcttgccggcgccgcgccccgccttgatgacgtcagccctggaatatattgcgcaataaatgatttaaggttttttcttgtatagtaataaacacagtgattcttttaaattcatnctaattaatcgaagttccccttaaccccattcaagtctcagtaaatcaagaaaaatgtgtagaatccattaaaaatggttttgtttcctgtttcagtagtcttatagcctgtttgcaatgtttgccttgtatgtcgctagattccggctctcccgacgctccggtgtacttcgagatagtcgccgaggttcctccagcagcagagcaaggcaagtcatgcttgtcacttgaatatgttgatcctatattgcaaatgctctattgttttctttcaaatattgcattgttttataatgatactatgggttgtttacctattgtcgtagccatgctgttgatgtaccatgtttctttgtcaacttggggttctaacatgattagagttaggactagggattgcttagccatgcctagttcaactagttcacattggggaaaatcctattaatgtttagactgttggttctaatagttttgttggattagtgacaccgctttggtgttggttaattaaaataaatcacatggtgggctgtgggtgcatggttttgctggtcgcacccatggcagttaaggaccggttcgcgggatgccctggaagaacttatcgtacttaccacaagccagcgtgggcaacggctgggcttgtagtgtagctctcctctagtcgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcgaagggtcctgtcacggcctctttccgatatgtcgtggtggcatgtcggcgcacggaaacgtgtcgtggggctgtgtcttgtggatacagttgtacacctctgatcagagtaaaactattcgaatagccgtgcccgcggttatgggcggtcaaccagattcaccgtgattagtctcaccctagtgtaatcttttgaatttggataatttaggtggatggttgggcctgtcgcaatgtgggttagcgttggacagtggatagttgatactaattaattattacaactgtttaaatctttcaacttctgtttataaatgctcgctttatgcaaatgaaccacttcagctcttctttgatgattccctgcatcatacccctattccggtatgacttgctgagtacagtgggtagtactcagtcttgctctacttttcccaaccccagagttcgagttcgggtcagatgaaggtttctccgaggagtaggcttcgtccgtgccgtcgaggatgcctgtggagtggtgttcctgctgcagttttagtcaaggcttagctcctgttgtctttcttttcttccgctgcatttatgtaagacttttatgatgtttgtaagacgtggatctgaatgtcaacattgtcgtttgtgtacccaggctggtcctggacggggaatttaatgcacattctgcttgaaattctattcgggaatttctgggcgtgacaacagtgtagtgcatgactggtttcaacttgccaaaaaactttaaggaaaatccagaagctttcttccggagcgtcaagccgcaagtcgtcgctccgcagaaaactctaccgacaaagaaaccagccataccagctccaccgaccttcaagactatggctgacaagaccctctatgaattcgctgctccctctactgacaatgtggacattgggctgcagatcaacatgggagatgtggatttcgatctgaagtccagcctcatcacgatggcgcaggctagcccgttctgcggcatgcctaacgaggatgccaatgctcatttgcagtagttcctggagatctgtagcacgtacaccatgaagggtgtcagttcggacaccgtcaggctgcggctgtttccgttttccctcctcgggaaggcgaagcagtggttttatgccaaccgtgctactatcaacacctgggacagatgctctacgacattcctctcgaagttctttccgatgggcaaaaccaacgcccttcatggaagaattccaagtttccagcagacaagggacgagtccattcctaaagcatgggaacaaattcaggaatacgtggccgcctgtcctcatcatgggatggacgactggctgatcctgcagaacttctacaatggactcactcccatgtcccgtgaccacctggacgcggcagctggaggagccttcttctctaagatggttcgaggagccattgatctaatagagaagatggtctccaatatgggttggagcgaggaacgactccaaacccgtcggcgatgcatgtacaccgtcaaggagacagaaatgcttgctaccaagctggacctcctcaggaagcaattggacgatcacgacaaacggtcacaaggcaccgtcaaagccttggacttacacgtcacgtgtgaggtctacggcagcacaggtcattctgggaataactgcctggaaacccgtgaagaggtgatgtacatgggcaacaacaacaacaacgggtatcgtccacaaggagtcaggggtggaaccagccatgcccatactatcaaggaggtaacaataacggtaatttttctaaccaaccctccttgaaggatatcgtctttgcgcaagctaaaaccactgatgctttaagcaaaaagctagctgccaatgacaaggtcatagaaaacattaatgtcaaactagatggcttcgcttctgcttttcaaaactagctgagctttaataagatgatagaaacccagctagctcaattgacttcattagtacctgcaaatgaatctgggaggattctggggcagcccgactcctccattgaaaatgtcaaggcgatcacaacaaggggaggtaagtccactcgtgatccgccatatcctaacactaggagctaacggtatctccaaggaagcgccatctagaaatttggctgacgaagaggttcagccagagaagactgccgacgagtgatactcacagacaggaagaatagggtattggggtacgttggagcagggatctacgtagtacgacatcaaaacagacaaaagacaaggattatactagttcagaccccttatcaggtaatagccctagtctagtttatatgggattgatgacgatgagaacagattacaaagagagtaatcgaacaggtgataccgatgagatcgtagtcgagggattcgacaagatctccccggcgagttggctccgtggactccggcttcgtgaactttggtgggtgtgttggcgaagagatgcgatgtcctttgcctctcccatggggtcccttttatatcgtgggataccttgaccctcaagtaagacttggagatatgtaaaccgacacgatatactagagattttaccctctccgagtaggacttctgcaattccttaacttcgtggagatattttccataatttgaggcgaattcctaacggcgtatacggaaaccaaccgtatacgtgaaggtataccttatcggtatattccataagtcgtaggatagagggtatgcttatccgtaaccctgacagtagcccccgacttcaatttaaatgaattatgtgctcgcacgcgacttctcctgatggagcgttgtcgtactcgttggatcgatctcggttatataaccgtagagacatagagttatcgataacgctttcagggagcctatatgtgcgggttttgaatttaaattgaagtctgaacaacggtccccaatgggcctcagaaattttcggcgaaaatctctcccctttcctcgaaatacgaaccatcagatagtgcgcctatttaatgggattttgggatccatttcgagtccgtttgccaaaaactctcactgttccccagcttccccggactctccgtctccccaatctcctacaccctccatcagcgatcttcttccggcaatctcccccaatggcggacctcgagcaatcttcctccgatgccgccgcgctaaagaagctgtacaccggaggagccgtccctccaaggcaaaccatggcgagggaggtaggaggtactgtcccttctcccgttttaggtcgtatggtagcggtagaggatttcatctgatgtggctttctacctcctccttccgaattcctcttgctgatattaaacttctacgacatttctcttttgcacctaaaccccaactccatcgcttttctgagcatatttgttcatctttgcgaggcctacattggggtagtgcctttccttataaaaagcgaaagcgctggacattaagttgtcgcgtaagtttctatccactatgattttacaattgcattaattgaggcagaagaatgactatagcctcctcggttgtacatattcctaaatggcttattagaaaataaaaattaatttatagataaaacttatatatatttgtttatagcgacttaaaagccaacgctacaaagaaattgcgttgaaaatatcataaaattaacttcataattgacgtttgctttggtttattaggcaaatcgatgaggctccttgttgactaccaatatacgtggaataatggaatattgttaggatgcttccctaaccacaagtgtacgttcaggttaattttgtgagggaaaagttttgcttagtctccataattttcttattttagaaacctttcgaatatttgaaatttgatgaagattttatggaaacaaaatatccatggagctaacagaaatttaaaattaatatttcagactatcgacaacgagacacttataatgagttaatccatgtagttaatagaacattaaaatccactcctaacagaaaataagatccagaaagtattttgttgtcatgctacttttgatgaaatggcgagtcaaaaggataaaagtataacgagaacaattattggcgctagaaatcgcgggaaaatatttttggcggcaagccaaagtgtatttcgcgccaaaagggcaaagcgatataaaccaaactcgccaatccaggaggcgagagagactgagagcgagagatggaaccgtctgtgagaagggagcgcggcgccgtcaagaagccgacgatctcgtcgccgttcgacgccgtcagtgaggatctcctccgactccctaacatggcgtcactcgtcaacgccgccctcgcctgcaagcgctggcgccgcgcggcttccgaccccgccattttccggcgcttcttcccgctccgccgccccccgctcatcggcttcatcctgaccgaccgcggcgactccgtcccctacagctgccccaaccactacttcgtcagcgccaccacccgtaagcccaacctggcgtccgccgccgccgattgcgacatcttcttcgaagacgtccctgatatcgattcgggcgagcaacgcggcggtggctacttcgacgagtggcgcctccgcggctgcgacggcggtcgcctcctcctgtcccgcggctgcggcgggtttgactcgccgtctacgatcccctcgcgcggactgccatcttcttctccgccgcaaaacttccatgggtcgttcctcaaggtcaggtacgcgattgtcgtcgacgacgccgacgcctcgttccgggtcatcggcatcgacggcgacatgttcttcgccgtcttctcctccagcaccggtaaatgggccttgttcgaccacacggcagacctgtacgaattcacccgcagcgacggcatgcccgccggccggttcgtgtactggcggtccaacaacaagaagtgcaggtactacgacaacgacgagcggatcttactgctcgacgtagccaccatggagtggacggtcaccgtggcgccgtttccggtggggtagtcgtactgcatcgccgacttggcggagcacggccggctgtgcctcgtgtccagcaaggaacaaaaccttcagctctgggtccgcagcggcagcagcaatggtggatggagatctcgctgttggatcagttcgggtacttgaagaagctgcggcgtgaggagtggatgaagagggtgcgtgtcctggcagcaaaggctggttatgtctacatggagttctggtccatcaggaagcccaattcctatcttctcgtcctcaacctgaacaccatgaagctggacatcatttgcaacgatgcggacgagcctttcaggggtcctgcacttccattcttcttccgtttggcacctctggcaccaagcccggatgataccaacgatcttcacgttccatctgcatctgcttgatggagtagtaggtaatgttctgtctaatttgtttgtcagattgctccgaaaccaaacctgctcaaccggatcaaagcactaagttctggggattttttttagcaaacgcactgaattcgggactgagatttggtttcggagctctatgttcaaaactcattttccaaaagttatttgatattcttttagggaatgcgcataggcagtcgcaccatttgtattaagagttcataggagagtttagataacatccaacaacccaaaaaacataaaattatttgatatttgtcctgaacctaatactctaatagtacttcagtgcttggttgctgacggctgagcatggcatcccttttaggagaacaatgcctgatttccttagaaatagttctggcttcctctcttggatgacttcggtgtgtagatgtagttacgacactaggcaggcgtcaggccccatacattgtcttacgactttacggagacctgtctatttggcggctaagaaatacggagtaagatgccaattgaacataaattgccttcaaatattagtctgacgctttacgaattcattttcttcttatagtcatggaacattttgctttgacaggtggacagcgataaagtcgtggctggcttcgtcctgcggtcgaaagagtgaatgctatatatcttctggaatttagctggcatatacgtccattgatcttttggtttcggtctgttggatagggtagtgttggcttaatgttgtctaatcttttggctattagatggagaactgttagctgtcttgttaagttggtaaccccagccttttatgttgccttaaaactcctattcagctttcaatagaagctggggtgatatccctttatcaaaaaaggaagtgcttaaccatttcacttttatgattggataacatttggcaactaggtccatcttctctttggggattagcttgtccaagcaatgatcaacgtatttgaaagtattcagttttgctagcttgtggctatggtaaaagagaatttctatgatatgccgtcaacaaagactagtcccttttgttccatctatgcaagtgcaccgttaaatgcccttatgtgcttggaaatgttcaatcagtgttgtgagtgtaagacaactgtcaaatgttcaggcactgagctgagcagcaggtaattgattttttgtctaggttataggttaaaagttcagttcgtagtctttagttggccgcaacagaatttttttttaacagaacacatttcagctctgttggttttaacgaatatacctgcttaacttgtttgatatgcccaacagaaaatactgacatgttacaatcatttttgcgttttcttgcaagttgcaaatagttcagcataattaagctagtaccattttgacaaggaagcgcacttgacaaaatttgggcttatctgtctttagaaacaattttgtagtctgaaacttgcgtggaattgacagccatcacaccgtgcagtcgcgccaggaaagttgcataaacatccagcccattttattgcaaaaacaccatccagcccattttaacactgctagagcgaaattgctacccccactcttcccttttgtcttcccacttcgaactatcctaagaagctgctcaagtcggactcagcttatagccacgtgtggagcgcgacctgtctggtatagtggactacaatccatacataaaggaataagccgtgtcaacgactcacatgagttaggtggtgtttttttgggggataagcttatttaacacctctcaaatattacgtttatctaaaacacatcctccaactttaaaatcggatatccaacacccttcaactgtttaacatttcaatttactcccatcatctaaactaggtggtttttactgatgtggtaattcagtcagcaaaataatatagaactgtggaacctatttgtcagaccaagccttctctttctctcttcctttctcaatctctcctctccctcatgacgcacgggattacaatacgagtgccgccagcttggcaccaaaagcctccctgtggtctggagggttgccaacgtgctccttctcgacgaccgccagagttggaatcctcccgagggataccgccgtccaaaaagaaagatggatttagcaagcttgagctcgaggccaccctgttgacacagtcttctccaacatcagcaagggagggcactgtatttgggactcagggatcgagcgccatgccctattgatcccgttttctccgacctcgacagccatgcctcgagcccaccgtgtcgtgacagtgcgactagggcccagtgtcggggtagccatccagaccctacctacatcaccgccccgtcgatctcgacaccaccgccggatatacgccaccacgccgtcggcaccacatccctgtcctcttctccgcctttggttccttgtctctgactagaggcattgacgattgggcagaagtcatcttctccgttgtgcccacggaacccctccatggtcgcttgtcgctgcctctacctagtcctctgctgatttcaacccatcgtcgctcgatcacacaacaggagagaggaggtagggagctcaacggggatggagtaagggaggaggcggaggacgaggggagagagagcttgctaggagctgttgctcgtgtattatggagcttgtcgagagaggtagtagaggggagggtggggcgggggggaggaatagagagcatgggactaactagtgggatcgcatattgacgtggactacttgttgaggtggcatccatcgtggcttccaattataccaaaaatagccccaaaaatcatgctagggtgtaaaatatacgatattggtagtttaggagtgacatatacccggtttcgcagtttagagaacacaaaagtagagggggaataaaatgtacttatcaattttttaaacagaattaatgagtaatagggtgaaccgtaataattggcatagtttatgcaactttgaaaaacgaacccgaatattctcaacgatattattttcaccaaaaataaactgcagtcgagcatgtatacatggctcagaccaaacatcagttattttatatctaaatcttgattttttttctagaaaaaaagcggactaaaaaaaacatgattaataaaataactagccgttaacgccttcaattccagaatccccatcccaaacgtctcaaaacctcgtcaagaacctgaaaccaaaaattctctctcgcctcgcgcgaaatctcccgtcgatccaccgcggggacaagctctagatctctctcctacgatccaccacgcggagaagctctcgatctctctccttcgatcgatagtttcgtcgcgctaagtcggtggtgatctgatctccgcgttctttcgggggagtttcttgctaggtttttctgggccgagctcgcccatggaggcgccgggctccggctcggtcccaacggcgaagcgccgccggctcgtgccacggcctccgccggtgccgcttgaggtggccggcgcgaggggcccgtacatgccgccgctatgtattaaatccaagaacccgtccgcgaaatgctacgtgagttgctgcaaatgactccccttttcttagcttcttcccccaagttgaattcttggatggatttccgtccgctcgttcgggcctgatggaatgtgtggaaggaatccgttgatgccgcaattatggatgttttaggacttaggaggttctcgatgtcgttcttgataatccgagagatagatttgctctgactcaattttagatgattcgctgattcttgatgtctgcagagccaattatattggtctttgttggcttgttttagatgttgaaattttgtagaggaatctgtgatccgtgccccaatcctggaatgaggaaatgttaatgatgtgggaatataattgatcatgcatgattctttttagagtgcaaaagaaattcgaaatcttggtgattttgtcctatactcaatctgttttttggccaaaaattttgtcaaaagaaaatagtcagtgtaacttgttcagaaccaagttcattcgtcagttgcatcaatattcatcatcaatgttcgaagaaacctagcacaatagtcgagtggaagacaatgccaagtttgccaacattagttacataatccatgccaagcataaatcacagaatctagataacctttagtaatcgatattattcctggacctcaataatatgtttttgaagtaatatactgaatacgctgttcttttgttaaacatgacagtgagaattgctcgtaggtcccaatcctgattttcctttgtattcctcaattttggggttgtcctttcacataaaaatcggtatgaatcagtccagtgttctgttaagcttttttgtggacaaatcgattgtgtgcaataaaaaaacaggtacaaactgttcttgatgttttgacaccaacagtatttctcttcagtgaagtactgaaattttcagtcatgtaggaattgttttcttcttgtgtcacaaattcaatcttgtctcttcaatatttgaactttcaacatagtaatcattgaagtatagttgatagtgcaatggtgcttagacttgtgactagtgttattattttgtattagatcttcaaagtggtaagatgactaatttgtatttctatatttatggtgacagggtgacagattcatacctgataggtcagcaatggacatggatatggcatatttcctcctgacagaacctaagaaggagaaggaaaatactgacatgctatcaccagctgaagaagcttacaagaggcttcttgccgagaaactcctgaacaacagaagccggattcttgcattcaggaacaaaccaccagaacctgaaggaattgtgcaacagctattatatgaaactttgacttccagtcagacaaagcctgctaggaagtgtagacacataccccaggtatgcaaattaatttgttgcttcaaacatatttttaggattttttttaatatacatcattcttagcttagcttaaattttcagtcttctgagaggacgttagatgcccctgggattgttgatgacttctatcttaacatattggactggggatgcaaaaatgtgatgtccattgcgcttgggaacaccttgtacctctggaattcagctgatggatctattatggaccttgtaacaattgacgaagatgatggtcccatcactagtgttagctggtcttgtgatgggcagtggattgccgttggcctcaactcttctgacattcagctgtgggacaccagctctaatcgcatggtcagttatctagagttctagacacttgctctgtattgtaagcagattaacttgtactgatagatatgcatatgtataaatgtggcagctgagaacacttcatggtgtacaccaatcaagggttggttcactggcctggaacaagaacatactgacaactggtggaatggatggaaacattgtaaacaatgatgtcaggatgagatcccatgttgttcatatatatcgagggcatgaggatgaggtatgtgggttgagatggtcaggaagtggccagcaattggcaagtggtggcaacgacaacctggtgcacatatgggatgtatcaatggcatcttctaatctatctctaggtcataaccggtggcttcatagatttggcgatcatttagctgcagtgaaggcccttgcatggtgtccgttccagagcaatttgcttgcatctggtggtggtggagatgatcggtgcatcaggttttggaatacacacactggtttatgtttgaattctgttgatactggatcacaggtgtgcggactactctggaataagaatgaaaaggagctgctaagtgctcacggatatgtacagaattcacttgcattgtggaaatacccttcaatggttaaattggcagaacttgaagaccacactgctcgtgttctttgcctggctcaggtatatctctttctattgtggtatagtaatgatgagtaattgcttatgatttgtttgctgatttcgtttttatgctatatggttgcagagccctgatggatttacagtagcctctgttgcagcagatgagactctaaggttatggaaaatttttgaaacttctgaagatgccaaacccgtattcaagacagtaaacactggaatgtttaacagtttcagccatatcagatgaggtatgctcaattgtactccgcatcgactgtatgttgtgaatcgctgaatcctaaaagggtatcgaaaatatgtatgttctgattggactttcgaaaataagtttacaattgatgaatattctttattagttcttttcattcgttaatcacaaaagcaagtatgctaattgtttaaggattttgtgccaggtgaaaaatgccattttagtgtagatattgacagcaaatcctatctgatttgttttcagcatttcttttcacaacaataaccgtgatgttttccatactttcaaaagattgttataataaaacatttacattgttttccacatacatactgtctgttttatctgtgacattcttttgtcgtattttgttgagagcaataagtcttgtttgtatattggtttcttcgtaagaaaattgtactagtaagttttaccagagtccacaaggatgttttatctgcaattactgttgcactataatgaatttataatcaattattgatacagtttgtccttgtcttccaggataatgtgagagttggaccgtggggaactgactgttcatattttcaggatctcatagcattagttgtaaccatggtcaccggtacgaaaggtggagaactggacatgccagagcttcatgtgtatatatacgtttcatttttttttgcatctggatgataaatgttttctggccggcctactttcttttctgtgctaggctgacaagaaactgtaattggccatttcttttatttgctaggctcacagaaactgtaatcaaaagcaaccgttcatttcatgttggtgtattggttcttgatgccatcatgctactgatttgtttggcaatagatactgccttcgttccataaagaacgagcatagtactccctccgtcatattttaagcgcaaccatgaatctctgtgtccaattttaaccgtatgttttatttaattttttaaaaaaaattaaaacataagttatgcacaaggtattatttatattttatcatctaataacaataaaaatactaatcataaaaaaaatttaaataaaacgggcgatcaaagttggacacgtaaactcatcgctgcgcttaaaatgggacgaaggtagtacaagatatgacacattgatacatcgtaatactatatatgtatgtatgttcagatttatggactaagggagtatgtaataatatctggatgctagtatcttttcctatgtgcagtagagatgttgctatgtttatttctgagcgtgattgtattgcaccagacacatttgcgcgagaatgtttcgtttagatattaccctatgtttgagagtagttttgacatttttttacttgttcatttacaaagaaaaaattcggttccagtgtgctgttactgttgttcacacatttgatcgttagttaatttgagaccacgtacaccgtgagatactgaggttgggcaggaaatagctttcactggtgctgactttctcgaccatagatagatatcagtatccctttcatcttgattgtttctatctacgtaaactgcggcaaaattttattaatcctacttaccacaacgattgtgacgacacatgcatctaccaatctgttggcgttcgacgtaaccagtgactgagtacgtacgtacgtacgtagtgatcgatcagggggcaaaataaaagtgtgtgtgcatatatatatatatatatatatatatatatatatatatatatatatatatatatatatatatatatatataggtaaattaactggtgctacatggagtattggctccaagattcaaattaagtatatacccaatttaaatgagtgtgaattttttttaaatgtttagatatgaacattaacttctttactaacaagttcaaacaagattgaactgagtttaaactttttttttggttagattttggttctaggtatataacatccaaacatataattcgttaggtatgtaataatgaattgtgaaataaagttgagtttgagttgttttgttgttaggtatttgtatgaatcaaattcatatacctagatatcgacttacaatttgtaaatttttaaaaatttgagagaatttgtgtgttttataccttagagcccgggcaccatggagtcccatatgggcatcctatatatatatatatatatatatatatatatatatatatatatatatatatatatatatatatatatatatagcaaatctattctacacccctcccctagaataactattctacaccccctctcccatggaccactcccacctcccccactcttcctagggcccaaatcccccctcccacctcagtcaaagactggtcaaagccccctcccaccggtcaaacccgcccattgactccctcccccgcccacctctttgctgttcatgtctcgcagaaattccgcagtaacataatggtcatcgtgcagtaacatgacaactttctcgcagttacaatattgaaaaatagtcaagatggatctagttttgttaagcactattttacgaacatcatggtgcagacggattagaaaaatactatataacatgagagatattgctctctaaagattgagatttaccctttttttttaagctctcgtctctttagaacagcgttgtaacacaacattcaatgtgcagtaacatgattactttccgcagtaacaacattataaaagcatttttgtctcgatcatcgtgtagtaataggactattgtctcgttgcaatctcgttttaaagcattatggtaaaaatggttctaaaaaataatatgcaatgtgagagatattattttttacagattagaattctaaaagtttatttgtactaagctttgctactatgtatctttgtatggacaaagagaagtacttttagcactttgtgttaacttgtgaccatacacatatacttttttagcacttatattttgcacaaagattggatttaaaaatttaactatgcacaagcagtggtactgtggtaataccattactaccatatgttctttgttactacaatttcatcacgatgttactgtagaatgtgcagtaacggcttataaatttcgcagtatatcgtgttactgcacttttacgataatgtaactaccgaatcatagtaacaagatatgattcgtacagtaacataatgggcttgtgttcataaaatttgggcttgtgttcacaaaatttgaacagatatatagagaaagcaaagaatgatctcaaatcatatagtgtcatagggtgaattggttaggagagtttgctttgaacaataagatcatgagttctagtcttgaattcaccaattttttttaatttttctagaaaatagaaggaaaaatgagagatgggagagagatcgggatggggaagaagagaaaaagcgaaggaaaaaacggagagagagatggatgaagcggagaagggagagagagagagatcgggatcgagagggcagtggggccgggcgtgcaaaaacggaggagagagatataggtaggaggcggggcgggcgcgcccgtgcgcgattgggagagatgcagggccgggcgtgatcgggagggag

SEQ ID NO: 83027 - DNA, 2557 bp, Oryza sativa
atgcttccttgtaccaacatttgtctgcacagcaactactccaccttcctggaaagaaaatttacattgtaatgtagcagataagtgaagtttatttgaaacaaaacattcgatgataaagcatttgattggcaacaaagataccttattgtgacttgctaaagaatcagatacatggtcattagtatcagcatcatggctgttccatctaatattttgcttctcaggagagctctctaatacgtgagcttctgcatcacaagggtgagaactagcgtgagagatttcctgtttcaggccacttatgttctgaccttgagatgcacaagcagtttgaacaagagataggccaacatcttgaaatgcatcgagcatttcagtctcatctaattctgaaagcctatcagtctcatccagatcactttcagaggatccacaagaatgttctagctcctcaagaaaacactgtttccgagcttctttcacatgtagagcagcttctaaggaagctgtagctagtttatcagactgagaatcaagaagtatcatttccgcaataaccatggcttcagaggcagcgattgatagttcaactgcatcattcacatccgcgctacggagtttccgaacatcaacctttcgtccagacagttgctgtcttctatgtccttttgaatcacatgttttattgatttcctcgctagacattttacaaatttctcgaaggtctttggcttccgattgattttgcggcactgtcttgatctcttgtgcttggtcatcaatacaaaagccacctaacacatctttgcatgtaacagagtttagaccattggcttgagttgaggatagttttgaagtactttctgaagaaagatgcagagagaaaggcactacctgtagagtgtagagagcaaatattcaatgtgttatgacttaatataagaataagaatatttgacaatgaatacaattacacaaaaggatgtctaacagcatgacacagttacaatattcaggagacattagcatagtacattgaatgcaaagatgtatatacagtatatatggctacatgcatcatttgaacaaattaggttaatgacaggaaacaatttgtaacttctgtccttgcaaaggaaacatgagttttactagtttcttagtagacaaccttgttgcttacaattaagctcttctagaacactttcatgtccatggtgatttgcatccagaatttaggcagtcccagtaaggaatatcattcctaaaacttacattgccattgctaggagtagttccagtaggcgtgccctcatcccccgacaagtgcaagctaaacccactgcaactagcagcattcaccatggtgttcagacaactatgttgctcttgtgcagggcctccgataaacgcgcaattctgcaactcaagaaagaacatcagtcattggatcatagccagctgcacaccaagaaacatgggtatatacatcagatattcagatcggattcagcacatctcgtttcctactaattattattggcttgtggtgcccaggcaagatggcattactaaaatagaaacaaagcatgaactaaaaccccaccagattgttgctactaaccaaagagaaaaaggacctcaccacacaagacggcgacgaaacggcggcgctgtccttcccgtgctcgccaaccgccagcggccgatgcggctgtagccattgagggagaaaggcaatgtcctgaacaaatcaacgcgactccactaggttattcgaagaggaggaggagaaggaagcatcccacccagttcgttccttatacagaccaacgcactcagccgctccgaccacaaatgcagcggcgcgcgcgcgagaccgggggagggagaatgggggagagctgggaggaggggcgcggttacctcggagaagcgcggggagtggtagccgcaggccgacatggcggcgggaagtcgccggctcgccgccgccgccgccgccacggggaggaggggatgggggcgcgacgctcttcctccccctctttcttttgtttttctttaatttatttaatccgaaaattaaggattcgcgccagaaatcacagcgaaggcgggcagccgggcatttcggggagggattccacagcgctggctgacaggtgggccccattgttgtaagttgtcgcatccgaacttcttacggtgcaggtgcaaatttatcgaccgtctgttctatttgaaattttgtgattggaattctttttttatttaataggcgataaaacataaatagtaatttatgcgtgacttattttttaaatttgttttataaatttttcaaataagacgaacgattaaattttgggcacataaacccgtaactgcgtttaaaatgggccagagagagcagtttactaggtctaccatttttaaccacacaaggaaatttggcaatttctttcttcacataaattatgaatgttagtattacttagaactgtacgcaataacaccatatttacatggccaattatttagacagaagagg

SEQ ID NO: 83028 - DNA, 841 bp, Oryza sativa
taatagtatttacctgtagagatcgagaaagagaggtttatatcaggagattgggcacaaacatttggcagtattttggtgcttagtgattgatgtacatggaagatatctctttgtgcgatggcaacattacaaggttgctagtcaaaaataggtggcaaattagacttatgatcttaactcataagtaatggtgtaataagatgcagaaaagaaagataatggtattcctacggcagatggtgtatatgcctctaattccaaatgtaggtcattttagttttttcaactcttttctaaatatatgttggtttgaaacttctgcgtgtttttttatttcttccatgtttgtcctcacaagatcgatagtacccctctgataaataaatagatccctttttttccaatgtagtataaacgaagggcaacaaagttattcaagctattttcttaattcatgtgtgcaaatctataacaacttatatttgaaacgaaggctactaattcaagagatatcacgccgagagtaccttgggcgacccttgcaatttccttggcaaatcctgtggatacaaacttgttctcggtatcaataacaagaagtgaaattccagccttgtatattttgccagccacctcaagtatctcatccttggaaaagataaatatatcgtatcagctttagagtgattgatacatgcttttaagaatgcaacttggaagtagtttacgtacatcatatcagcttcagagtgatggtcacaggtttccagtttaaataaatacttttcatatcattactaccatgtgatattagatacgagttgtacctttaattctt

SEQ ID NO: 83029 - DNA, 1026 bp, Oryza sativa
tggcagttgagcactgtcgctgttgattttcgtatatgaaattttgagtatttttatgtctaaataaatttggcatggatacccgtgctttgctgcagaatatatgaatgaatatgtgttatatgttataggaataatatatgtatatctttaaataatgtgaaaatgatgtaaagataataatttgacattgtttgtatattgagttctaaaaatagaacaaaattgtaaatgatatgtcatatttgcgtgatacttaaaatactctagataataattgctagtgagtaatgatatggcttactcacatgttaagttttacaagttattaataagcatcaattttatagtaagatgggatacaggctccctctgttacataaagtcctaatcatatcttaatttttaccactcctatagtcctattctgtaacgctccgcttttcgtgagacgttaaaaactaattcggcaaaatcctaattgcgaaaatttcgttctttgagtgttgagtctaagctgtgccaaagatctcaatctaaatccctcccttgtctcgataccctgttgcaaagatcgtctcctcaaaatttccatcccaatatagtcccgaagctcgattccttctattcggaatcccctcctggaaccccatccgtgaactttgtcgaatgcccgaaacctaactccgtccaaggattcacccttcgcgtcataagctctctccttggttccttcaaaccgattctcaaattcgatttcaacctctcaggtgttgattcatctatcttctgcctgtataggtgcatcaatctacccttgtgatccttctcgaacttctgacccaagtctgaatatgcaaatcgagatcacttccacccttgaactcaaaatcccaagattcaatccctttcgccctgagtgctccccaaaatgagttccgttccgaattaatctcgaagtccgaacccttctatttgggcttctctccaaaatccttacccacatatctcgttgagtagtcaaac

SEQ ID NO: 83030 - DNA, 1575 bp, Oryza sativa
gagagaagactaggccggaagttcaatttcctgtgagtacacatgctctatattttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcaaaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcacggcggttcaagaacaactcatgggattcatcaacgaagaaatccttaatcccaagggtgaattctactacgacggaaacacaattcaccggtccttagcttctgagctagcagcgagtactactacgtcgaaatgatagctagctagctaggacatataatggattgtaattaatacatgactacatatgtttctatatgcatgtgtacacattttctataatgtaaatatattttggtcatatatatatatctatatacatatgcattaatttgcataacatatatatgtgtataaatacatatatattatgcatgtatatacatataatataatataatatatatatatatatacatatatatatatatgtatgcatatatatgtattgaaacatatatatgcatggtttatatatatatatatatatataaactatatatatatataaaccatgcagcaacagggccatgcaaaaaaaaaaatggtcagctcgatctttactcccggatatttcacccgggactaaagatagcgatctttagtcccggattggtactcccggtttggaaaccgggactaaaggggggttacgaaccgggactacaaagggtttctccaccagtggggattcctccatgcttgcaattcaactaatttaagcattgtgttggagaaagcccaacaaatcaatgccacaggtcttggtgttaaggatgaggggtatgcatgttaaaatggttgggagctatgatcatcacaaggtatgaagtggtaatttgactcccctccttgcccaatgacgaggacaggatttgaacccaggtcagtgttaaggatttgcatatacttaccattgcacaacagttagttttttttttctcttactcttgcctaatactccctccgtattttaatgtatgacgccgttgacttttcgactaacgtttgaccattcgtattattcaaaattttcgtataaatatgaaaacatttatatcatggttaaataacatttgatgatgaatctagtcacaataaaataaatgacaattgcataaatttttttaataagatgaatggtcaaatgttggataaaaagtcaacagcgtcatacattaaaatatggaggtagtatcattttaatttcttctgccatagggtcgcgaagacccttgatgcttggatgttgggcgccaatgctaaggcctatggcaatgagg

SEQ ID NO: 83031 - DNA, 13846 bp, Oryza sativa
cgacgcggcaagggcctcatcgaggcccgactgcgagaggacggccacggcgcctgatgtctgctaggctttcctcgccagcagcacgatgctgtcctgggcgaggtcgacgcggtcgttggagagcaaggtcgtgagggctaacacggcgcccgcggcgatggccgtgctctggttggccgcgctctggagcagcccgtacaggatgaccatggcgttcttctggctgtgggtgtgcgccgtcccagatgagctggaccagcgtcttgatcgcctccaggatgcgtccgagttattcgatgagaggtagaagaggatggccaccgcgttgtgctgctccttggccttggcaccgacgctgatcacgtcgatgacgaggccgacttctccgacctccacgatggtcatttggttcccattttttttaaaatagtaattaataacccaaaaattaaatgatagtaaatcaaaggtttaatttactcttataaaaataaggacgctatgtacaacagtgtccatggacgttgttcccgagaacgtcaacagtgtacgtccagatcaggacgctgtttgtaatggcgtccatcccattggagccgaaccagcctacggtagggaagcctccactcgcgtcgcgtctcgctgattcttgtcgggtcgtcgtcctcaacgctgctcgccaaggaaggcctccgctgcgtctcgctcggttagcataagcgccctaagccgtcaggttaatacttcatatccgatcctgccgtccgatatgattcgacctatgcatcctaattttttagcgcacttcttcaaattaaatggccagctcgatcctgcaaatggcttctcttttttttccctaacgaatcgcagatggctactcttggttcgatactaataagaaatacaaatttgtacgtacatgtgtgcctgcaacgagctgcttcgtttatttatccagaatgtcctattgattgctccgtaaaagctagaagacctggttaataatgtactcaatgttagagcaaacagatcaaggatgcaagtaacgctaatgcatgctgcagtgctgcacataacggagaattgggaacccaaaagttgaaaacagcgtccccttccggacgttctcaagaacagcgtccacgtctggacgctctggtagatagcgtcgttcttacttttataaatccagccagcgatttactaattatttaatttataggatattaggccccctttgattcaaaggaaattcataggaattttagaggatttcattcctatagaaatttttcctacaaagccctttgaatcaaaggaatgaatcctatggaatcctatgaaattcctatggaatgcctcttcccatacaagttttgaaggaattttaacaagaggtagaacctcatggaagaaattctttgattctttatctctcctcaaattcctgtgttttttctatggtccaatcaaacggtcattcctatgtttttcatgtgttttgcaatcctctgttttacacttacatttctgtcagaatcctatgtttttcctattcctctgttttttttaattactatacataaaaaaaatcagtatttggttcattccctcactttgccataccatgctttagctagtcatgtcactgtttcttatgtgtgtgtttgtttcgttgccacaattgtatcctgcaatactttcttagccttaggtccaacatgtcatacttccagttttagagctaactatgccacacctatggccaactattttctacccacacacttttgcttcatgccacaatatgcctaactatgccacaatactcccagttgtggcatcattaggcatcatccaaacatcccctcatccttccaaattactagggtcgttcactgcacttgacttgttctaataccttggaatgccatacagtagatacctttagttttggacttggaggcattgtgaacacaggagtagctcttcctctttcaagcagtagttggtactactacacaagtcgcacagggcactggtggagaaaccatctttcgtcggtcggccgatttccacagtagtcccggatgcaataaaaaccggggctaaagatgttctttagtcccggttcaaaagggcaacgggcatatttgatctttagtcccggtttgtgttaccaaccgggactaaagatgatctttagtcccggttcgaatgctgtcagggtctgtcaggccctcccggtatctttagtcccggttgataacaccaaccgggactaaagatggtaactttagtcccggttggtaataccaaccgggactaaagatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttgtcatactacatttgcacctatgttttgtacactttttttgtctccaaaatgtagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttattacttaacaaatagtttttaagaattatttggtgtaatattttatgatttttgtatgaataaagatatcttataattattgtatgactgtcattattgtaagaataattatttgtgtacggtttttttgactcatgtagatggatcggcaatggatgtacgctgaccggcggtcgaaagagtttattgacggcgtgcactattttttgagagtggccgaagctaacaggaaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcaatttgttggatttgaaggaaatcaaacgggcgaggaggaaatagctgctgatggtaacgacgttgcggatgatcttgttcagatgttgcaggacgccagggaggactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccgtggggaaacaaattgcccgagacaacgtacgaggttaagaagatagtctgcccgttaggactggaagttcataagattcacgcatgtccgaacgattgtatcctatatcgcggtgaggagtatgaagacctagaagcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctccccccctggctatgcatgaagaggaagtacataatgatgccgattattattcaaggccccaagcaacctggtaacgacatcgacgtgtacctaagaccactggtcgaggatcttaaacagttgtggaagaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggaggaaacagaaagtacgtatcttaagcactgtaggaaggttgtatacatgggtcatcgtcgattctttgcagcaaaccacccggtacggaagaaaggcaagcacttcgaacataaggccgaccaccgtacgaagcctaaacatcgcagcgggaaaacagtgtttgctatggttaaagatcttaaagtagtgtttggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagagtcatgactgtcacgtgttgatgacacaactgctaccagttgtaataaggggtatccttccagacaatgtccgggcaacaataacaaagcaatgtgcattcatgaacgcaatttcgcataaggtcatcgatccggatagattagatgcccttcagaatgaagtggtgcaatgtctcgtcagttttgagttgatatttccaccttcatttttcaatataatgacgcatctgctttgtcaccttgtgaaagagatccgtattctcggtcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaattatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttatctgcgaggggaccgtctgggtcgatcgcgactgtcgaaacatgatttcggcaataataaaagggggtagcgcacgagacctaaaagtggatggatgcggagacaaaggatttagacaggttcaggccctctcaatgagaggtaataccctactcctgtttggggatttgaatccgccgagtgtgtattgatctgacgatcaggttgtctcatgcccctagagggggctccctgcccgccttatataggttggggggcagggttacaagatagaaaccttaaccaatacggtatcggtttcctaaatctactttacaatcttatcaaaccaggactttaggccgttccataatatacagggaaacgtaatacccaagtcatgatctgttacatattccatacatatatgttatcccctattactagtcggataaccatgccgtgtggatacggggtacccataatctccacagtagcccctgaaaccttcacagtcgaaaatataatcttctctcgaactagattactccaaagccgagtgcttcaatcatcttcgccatggtctcccgagtacttttaccaaatctgaagactgtggagggctgaaaaataaagtcaggtatatcgaatagatgcacctaataggtgtagcccccgactatgtggttaattgaaccaaccaaacatatagtcaaggaataaataatctaaccaaccgagtggttttgataattgtagtcaaccaagcgacttaatattaatatgtagcatatgcggtgtgaatccctgaataatatgatccaagtgatataccgactgctttgtaaaatatgatgagtgtaacctaaagttggctacatcattgaaaattcacatagcaaaatagctataaagaagcttgtatgttgtgaataaagaaatttccaaagtattgggcatacgccatgcgcacactgctttaacagacgtgctttagtccctaaaagacacatggtttcaccacacctggaaatatatggcatatgtggtgtaaaatccgagtaaataaactcataaaggatttaccaaccgcctagaaaatgaccacaatatataatcagcctaagccataatattggtcaataaaaatgcacacttacgtggcgaaaagcagtgatattatatccaatcaattgcttaaaaacccaaacagcaccttgatttatataaaaaaagtcagcgggacagctatataaagctttactgtttgacaccttttaagatgcattataccaactcctaaaaagttaagtaactgtggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaatagatcttccaggtattatagaccaaatgtagctcatatgaatagcttctgatctgaatgattatcccttctgggatactccaaaatagatgtaacaattgaatcccgactggcgcaagtattcagttgataacccttacggggaataataaatagtccagtctttgagcatagaaaatagacccatgatcacgaattcatattgcatatatccagagcaagtccaaattgaaggtatgatacttgtgtttgagctaataagcccctgagcatatagcttgtccttctgtcgtagtcacaattgtccattgatggtagctgacgcatttggcatagagacaagacgaccaacatagagataatattgcccaccagaggtggcaaaaatattggtggtagtggagatagtgataccaatcaaaagtaatgaagtcgcatagtcatagaggcgaagaaaccagtcggcagcaaacaagttagccaacagtaaagatgaaggcgtccagcaacagcgacagaattgtgtagccatggtggtgaaataatcagtcggtgatagacgagccagcagtcggtgacgatgataacaagccgacaatgaagacgtagacgcacaccaacagcaatggcgaaatccactaatcatgaagatgaagaaaatagtcggcgacgacaaacgcaactgacatgatgaagatgacgatgtcggcgatccagtcaatagcagtgtcgcaaccaatgataatgacaaagacgctcatcagcatttgcatagtaggtcaaccgtgaaggtgaaataataagtcggcgaaaacataatcatccattagcaacagcagagatgtcagggtcgatgaagcagaggtgctggtgatgatgtcagtggcaataatccatcaaattaatgttataactgttgtagatgcttcacttggaggagagttgatgttgttgcccaactcgtctaaaccgaaatatttgaagttgttgaagtagaatgtctgctccgaatcaaagatgaagataatgactcctggagttgactcgttggttgatgaattgatttcttcagcttgacataaaatttgtcaaattttgagccttgtatttgtgtagcccccgactctttgattagttgggaaacaactgaacatagagtcgagaactatagcttcttgtcgtcgaatagttattgcttgattgaagatatgtgttgaagatgtccaagtagaaatccgaagataataaagatgaagtcgctccaccatgatgacaaagttatgttgccgtgatgaagtgaaccggtagtgaagacgcgcagttgtgaagataaaagcaccagttggcggcggcataaccagtcggcgacggaagacgatgatgtccatcagtagtggtagaatcatgcagccatggaagtgcagaaaccagtcggcagccatggcaaacgtaggcagcttgtgttgaagatactgatgcctattagtagtgacagcgatgtaaccagccgtgaagaagatagcatgagttggcgctataacaggccagccgtgcaggcggtgacaccagtcagcggcggatgcggcggccggtcggtgaagacgtagacgcccaacaacggcagcataataggccagccgtgcaggcggaaacaccagtcggcggcggacgaggcggccggtcggtgaagacgtagacgcccaacaacggcagcataataggctagccgtgcaggcggaaacaccagtcggcggcggacgaggcggccggtcggtgaagacatagacgcccaacaacggcggcataaaggccagccgtgcaggcggaaacaccagtcggcggcggacgaggcggccggtcggtgaagacgtagacgcccaacaacggcagcaaaataggccagccgtgcaggcggaaacaccagtcggcggcggacgaggcggccggtcggtgaagacgtagacgcccaacaacggcggcataaaggccagccgtgcaggcggaaacaccagtcggcggcggacgaggcggccggtcggtgaagacatagacgcccaacaacggcggcataaaggccagccgtgcaggcggaaacaccagtcggcggcggacgaggcggccggtcggtgaagacgtagacgcccaacaacggcagcaaaataagtcagccgtgcaggcggaagcaccagtcggcggcggacgaggcggccggtcggtgaagacgtagacgcccaacaacggcggcataataggccagccgtgcaggcggaaacaccagtcggcgacggtcgaagcgagccggtggtaatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactccttacgtttaaacactctgcccgactaatcatagccaccaagcactgggagtcggcctaagcacttcccaaacatgcatatgagtgacatgagttcgtcattaatggaacaaagtttcacggatcagagtttactactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccgttagcaaaccaaacggaaagcataggaagatagaactccgtaactcgataggtacttttgtactcagattatgtcacaagcaatcaagataaatattatgaaaattgtttaaaaaatacgatataacatctatagcccccgactcactagtcaacggcgaaccagttgatgtagtgaggcaaaggaaaagacaaaatatcatataaagaataaaataaatgatgacttagctttgtcgtattccctcgatgacagcagaagtagccgatgtgggaataaagcagtccatcaatggtgacaaaaacaccagtcggcaccagtggaaccaagctagtggtgtaggtgatgaagcccattaacagcggcggagtccgccaaccgtataggcaaaaacaccagtcagtggcggcagaggccagccggtcggcaaagacgtggacacccatgaacggtggtgtgaccaaccaaccgtataggcgaggacaccactcggcggcgacggaggcaggccggcggtgaagtcgtagacgcccaacagcggcggcataataggccagccgtgtaggcggaggcaccactcggcggcgacggaggcaggccggcggtgaagtagtagacgcccaacagcggcggcataataggccagccgtgtaggcggaggcaccactcggcggcgacggaggcacgccggcggtgaagtcgtagacgcccaacagcggcggcataataggccagccgtgtaggcggaggtaccactcggcggcgacggaggcaggccggcggtgaagtcgtagacgcccaacagcggcggcataataggccagccgtgtaggcggagttaccactcggcggcgacggaggcgggccggcggtgaagtcgtagacgcccaacagcggcggcataataggccagccgtgtaggcggagggaccactcggcggcgacggaggcgggccggcggtgaagtcgtagacgcccaacagcggcggcataacaggccagccgtgtaggcggaggcaccactcggcggcgacggaggcaggccggcggtgaagtcgtagacgcccaacagcggcggcataacaggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataattagtgatcaaataataattagtgatctgtgaattaattctaatttatataagaaaatttagaacgataaacctggtttgtgatccaattttgattcaaggcctgtcaatggatgaaccgtagcatgcagccgtgtagacatgtaatcgtcggtagcacatgcatggattagtttggagaccactttgtgcatgtaatagctgatttgtgtatggattaatttccttgaccacagatttgaccaggtatatttaatttgtatcctggactttgtgtcttgccgtacgtatccgagtagtattgacttggtgatgtacaggctcaaccgacggtgatcttcgcatgatttcggcggcggctgcttgctgattgcttcaaatcatgccctggtgacgaaaccgacggaccaacagacatggcagcattgtagcgacggatttgatctcactgacagaggtaaaattgacgataacaagctggttgtagatcgattcgatcggtgattaatctcctggttgattgaccagatccagatagaatttttggcgacgaagaccctgcccttttgttgagaagatcacggccaaagatgccggcacaaagttccatcgcacttctcgacggaaaactcgacgcaacccctacctggcgcgccaactgtcgaaacatgatttcggcaataataaaagggggtagcgcacgagacctaaaagtggatggatgcggagacaaaggatttagataggttcaggccctctcaatgagaggtaataccctactcctgtttggggatttgaatccgccgagtgtgtattgatctgacgatcaggttgtctcatgcccctagagggggctccctgcccgccttatataggttggggggcagggttacaagatagaaaccttaaccaatacggtatcggtttcctaaatctactttacaatcttatcaaaccaggactttaggccgttccataatatacagggaaacgtaatacccaagtcatgatctgttacatattccatacatatatgttatcccctattactagtcggataaccatgccgtgtggatacggggtacccataatctccacagcgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgatcttaacaaggttggatactcggacgaaccttttgtccttgccaatgatgtaaagcaagtctttttcgtgaaggacatgtctagcaaaggaaagaagggcagagggcctgatgagcctaagcgtcaagtggttctctcaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgtatatgctagttatatgtgatacttacaatttttaaaagttttaaatcacacaggtggcaatttcatatgtatgttaattagagtttttaacatttaatttactagcatgcatatgctaattataattgactagaggatttttaaaagttttaaatcacgcaagtggcattttatatgttaattagagttttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatgttaattagagtttttagcatttaatttaatataattcctacgctaagtatatatgatgattacaatttttattaattttaaatcatgcagtatgtacatacatatcttaattagagtttttaccaatataataatatcattcatatatatgctaagtatatatatatatattggaatttttattaattataagtcatatatttgcttattacgatttatccacttaatttattacagacaaaaataatttttcgaagtaattgtcattaatctttagtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggt

SEQ ID NO: 83032 - DNA, 15998 bp, Oryza sativa
aacgaacgtgaacgagcgaacgaacgtgaacgagtgaacgaacgaggatgaacgttaacgtgaaatgcaaaatatatatatatatatatatatatatatatatatatatatatatatacatatatattacttggcatttatcctaatacatctgtttgtatcttgtagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatgtaagattgtgtagtgttctaatattatttgagttttaatataagattactttatttgtaattagacttagtatgtaattattgactacggaagtggtgcgacaagtagcaattgactattgtagtcttaattagacttagcatatacgcacgaaacacttagcatacatgactattttagtcttagcatgtaatattatttgaatatatatattagattactttatttgtaattagacttagtatataattattgactacggaagtggtgcgacaagtagcaattgactattgtagtcttaattagacttagcatatacgcacgaaacacttagcatacatgactattttagtcttagcatgtaatattatttgaatatatatataagattactttatttgtaattagacttagtatataattattgactacggaagtggtgcgacaagtagcaattgactattgtagtcttaattagacttagcatatacgcacgaaacacttagcatacatgactattttagtcttagcatgtaatattatttgagttttaatataagattactttatttgtaattagacttagtatataattattgactacggaagtggtgcgacaagtagcaattgactattgtagtcttaattacacttagcatatacgcacgaaacacttagcagacatgactattttagtcttagcatgtaatattatttgagttttaatataagattactttatttgagattagacttagtatataattatttactacggaaatggtgcgacaagtagcaattgactattgttgtcttaattagacttagcatatatgcacgaaacacttagcatacatgactattttagtcttagcatgtaatattatttgagttttaatataagattactttatttgtaattagacttagtatataattatttactagctagggttgtataatatacgtcacctagacttagcttatatcacgatttgtaattagacttagcacgtaaggttgtgtatggttctaatgtacgacatttacagttagcatacatgacttagattgttaaaacataaatgtctcgtgacttagcagatgtttcttgtatgaacagatggctgaccgcgatgaggaacagatattgtacgatacaatcgcggagggaagcagccagtactggaatgaagaagaggggaacgaggatccaaaccagtacttgaacgaggaaggaaacgtggagagggatgcggaggggaaccagcaggggcacgtggaaagggatgtggaggggaaccaggaggaggaggctagtggtagtcaatcctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggaggagatggaggctagcttgattgagaggggtatcgaaccggcaacagccaattggccggaacgatcgaagttctggtactatgctcacggtggaacgctcaacccagctgatggctcactggtcttcggcgttcagatacgagaggctgcgcaacgactaacagatgcagtggaagcctcctctcagggcacgttccgacccgacagagatagggacgagctgacactcgccctgcagactccagagcatccaggacgaacacgagggaaaggggtgattccttggaagattggtttcaaggaggacatccacacgtacaggagtcggatgaggagcaagagagataccgaggcgaagattgcagacctagagttccgggtatcgagctacgaactccacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcgcagagcatggacgccatgcaaacacaggacgaatcgacctgtcccgttgatgacatcactcagcggacaccatgtgagctgcatattcctttcaagaacttatcaataaaggtaagatttagccattccgctagttgctgcttatgtatgttgattactaataaataatctctcacaacatgaaggtggtgtcgggcatggccatcccaacggacccttcaggtacttaccactgcaggccgattccagcaggatactcgaaggtcgaagttgagttggtcgaaggcgcgtacgaggacctcgagctggattaccctggaggagacggtgagacgcatctacgagacacaagccatgccattattctatggcacaggcggtacatcatcctccctgggcgacaagcggcgtctcgtgcaccatctcctccggctccgccatctcctcctcaggatcctgcaccgtctcctcctcatgctccgccagcaccgtctccacctcaggctccagcaccgactcctcctcaggatcctgcaccgtctcctcctcgtgctcctacacctactcccccgcaagctcctcttccggcaccttcaaagtcaagggcccccccagctgcaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagccgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagataatcggagcgaggatcagggacacggacttcttgcaaggagatgacattctctggatcaatttcacacatatctacgaactataccagctggacgccgtcgacgtctctattatgagttgctggattttgtaagtatatcgttcagttagatttcttactatacgtctcctttaattaattaggtccttgtatataagtagactatagaaaataatatactcccttttatcgttgtagaatggagattcaaagggcccgacggcggagggttttcgatactggattcatcgaccctcggaaagtaaacgtcacaatgctcgaccaatatccacaagaaacagaggacaatctcgtccatctcctgaaggcccagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcaattggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaaataacttgtgcggctattacgtgtgcgagtattgccactgccttgcaaaccaaatcatcaccacaagagagctcgatgtacgtacaaataaattcaaaatttcagtacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttggtcatatatatatctatatacatatgcatttgcataacatatatatgtataaatacatatatatatgtatgcatatatatgtattgaaacatatatatgcatggtttatatatatatatatatatatatttatatatatatatatatatatatatatatatatatatatatatatatatatatatatatatataaaccatgcagcaacagggccatgaaaaaaaaaaaaaggtcagctcgatctttagtcccggttatttcacccgggactaaagatagcgatctttagtcccggattggtactcccggtttggaaaccgggactaaatgggggttacgaaccgggactacaaagggtttctccaccagtgaagtctataagtggcatgaatatggtccgtcatctttggtccatttccttgatcagcaagctgcgcagtgtgatctgggttggcatgattttgcctgtttccatggatcccaagatcggcagtctttggacatttgggaggccatccttgggtgactattgaacgaatatatcagatccatggagctacaccattcccggtgcctcctagttctacgcaagttgttcaaacatggacatacagggcagggcctacaaaactaaaatgcatgatatttataggttaagagaagctgtgctccatctcacactgacaagcacttgtgttgagcctccaaattttcggccatttgtctatctcaagataattttctataattctggtgcagtgcactatttatcatttatcggtgccgtgcacttggatcgacaaaggacacgatataaatgataggtgatgtaattaagtagggtagcatgacaaaattatatacagcggcggagccacctccaaggcaggtctgctggccacccaaactccgctgctaccgtctccactacaacacccgacagcgcctatgaaaattagttggtcactaaaaaacgctattagtgaacctaactcaatggtgtcactggctccgccattgattatataggatctccgtgatctggtttgcctaaaaccggcacctatgaggcgttttccatgtaaatgagccttttgacgggataaaaattaagaactagcacctataactactcattggtgtcggtttaaaaaaaccggcaacaataattctaccaagtcataggtgccggttcatctaataaatttacacctatatatgtcatatatgtgtcggttcttgaagaaaggatcacctatggacttacatgtattttctatctatctttttcatatgaagacagatgaagatagactttatacaaatttttaaatcttgacgagatctaccactttgtagttgactactctttcattcgaggtgttttccatctcctaaaatgtgttgtaatttcttagatctatttagataaacgaaattttaaaaattataaatgtctgggatggcgacaaaatatactccctccggctccataattcttgacgttttgacaatgccgaggtactgttactttcctattttgtaatctgaacactgacctctatattcctttacactcacatccttttctattcatgtatttttccaagaatgctcacgatcgagcatccaacgcaacgctcccatcgaacacctccacaagaatcccagccatttatccaagatgtgatccgacggttgagttgcgggaaacacttggatgcgagtgtcccatatcctgacctcgatggctccacgcaggcaacaacaaccctctcctcgatgccagagtcactgcttctgcagccgccgccgccaaaagatcctccctcctccccactggctcccttctccctcctccacaatcatcttcatcccctctaatagactttaagggagctgcatggtggggagatccaacttgtcatcaaggtggcactgacgtgtcagcgtgctggtggcgagcaggggaaggcgaggaagtagaagaacaagagggttgatgtttggaggcttcgccgtggaagaggaggtggaggaggcatgtttatgaggaaatggcatttggtggatccagttgctggagtgaaggaagaagtatattcagccaatggagtaggggaagaagatgattgtaggttttgttgcaattatattgtttatttctgttgcatcttgttctgtttgtgtgtttcattcttttcttataatgttgcacatgatgtgcagtgtatttttttcttgatgctacacacaatagaacctgatgttgtcatcaatgatgttaaaggctgaaacatttttttgttgagctatgatacatatgaaacactttttgttgaaatattttttagtaagtcatgaaacatttaaaatatttttctatacggtgaaacactgtctgaacttttgattaggatcagacatctgatccctagtatttttcctatctgcatttttccatcctataatccgaacgattaatttttttttttggaaaattttttgctacaggacatcgtaacttcgcggtttagctttaggacaccgtacgaagtaacttttaggggaagacactctcaaaacttggatattttcttgtggacgccgcacctattaaaataataatttccgggtgaggaggagagagaaatcacgtgaaatatcaaaaatgtccttgggcccacgtgtcaacactcctatctctcttctctctccctctggcaccggcaatagggaacggcagcagcggcatcactccaaatctaaccggtgcaactccagcggcgtcaccctggacccagatgatggttgctgcccttgccctcatggcgagctccctaacgcgtgccgccgtccatcagctcagccacgaccatctccgcgccgccgcgacccttgctgcagtcggccgcctcgggacctcgtcgccgcacagctccaagctgcctttcaatagtccctatgtcctcccctctcctttaattgagccgtcatcgaccatagccatgtcatcgtcgccgtcccgaacccactgctgccaccggctatggtgctcgccgcctctagccaccctcggccacgccattgcctctagaaggtgagggagggccaactctagctgtccgggccttcggccgagccacccccttctctgcccttcaccggtgagctcgtgccaagccgtcgcgcacgctcaccgtctcatagagatgcggcgctggaaggaggggatagagggaagagagatagaagagctgacatgtgggccaagggcagttttgacatttcatgcaatttctctctcttcctcatctggacattattattttaatgatgcggtattcaccagcaaatatctaatttttgatagtgttttcccccaaaagtctattcgcgtagtgtcctaaactaaaactccgcgtcctaaaactaaaaccacaaagtcacgttgttagcaaaatttgcctctttttttttccacaaaatttgccgcaaactaaaactaggatgtatttggatggagggcttggataggatatggccacccaaattttggaggtgtttggatggtgggcaacactgggatatggccaccacctaaggaatatttcctctagatgctggctccgtgcatccggccgattcggccggacggggtggcccaggaccgcgtgaatcgtgcacccctcacctcctccccatccttttctccttttttttatgagagatttgataatttatcacttatttaagtgggttttgattatttgacatcctagtccactttcatatacttagatagtcctacatgtcatcctcacaagtactccctccgtattttaatgtatgacgccgttgattttttgacaaacatttgacctttcgtcttatttaaaaaatttatgtaattataatttattttattatgacttgatttatcatcaaatattctttaagcatgatgtaagtatttttatatttgcataaaaattttgaataagacggatggttaaacgttggtcaaaaagtcaacggtgttatacgttaaaatatgataacatggagagagtatcaattaaagcatttgggcaacggaaaaaaaggtgtcaaattatcaaaattttccttttttctcctctcttctcaccggttcaccagtgccaaaccctacctctcctccctcctctgtttcggcggcgcatcaggcggcgtggagggcggactggtaggcggtgccgggccgggggtggttcggcggagcgggtggcggcgccggggccgggcggcaggtgtcggcggcgcaggcggtgggtgtcggcggcgcgggcgctgtctcctggcggcgcgggcggcgactccaggcgaccccttcctcgtacccccgatctcggaaaagaggattataaggtaaaagcacacacaaatctaacaccactacagcgataaaccccccaaaccccaccaccacgccgccgccgccgccgccggagaagatgatggtgccgctggatccgtcatccaagcccacctcccagcgccgcatcgcggagggggacaccgtcgtggtgtacgagcgccacgacgccatgcgcgccgtcgccgtgcgcccgggggccgtgctccagaaccgattcggcgtcttccgccacgacgactggatcggccgccccttcggctgcaaggtccacagcgccgcctccgccggcggcggaggggctcgcgggggcaaggggaagggcggcgggttcgtccacctccttgcgcccacccctgagctgtggacgctcgtgctcagccaccggacgcagatcctctacctcgccgacatcagcctcgtcgtctcctacctcgagctcgtccccgggtgcctcgtactcgagtccggcaccgggagcggctccctcaccacctcgctcgcccgcgccgtcgccccgcacggccgcgtctgcaccttcgatttccacgaccaaagggccgcctccgcaaggtactaatttttttctcttatggactgtaatatttgtttttctgatggaagaatcgatcacctgataaaaatatttaggccgaattttggggagaaaaataaacagctgtgtctaatttatatatattatcttagcattctgcatacatttttttttcttatggactaatatttttcttatggaagaatcgatcacttatagaatatttaggccgaattttggggagaaaaataaacagatgtgactaatttatagatattatcttagcattctgcatacattttttttcttatggactaatatttttcttatggaagaatcgatcacttgatagaatatttaggccgaattttggggagaaaaataaaccactgtgactaatgtatagatacttatcttagcattctgcatagagaaggtagattggtgataattcacaagcaatattatcctttggtggtttccctgcctgatatgattgtcacaaatcagaatcacctgtgcacttttgcacacacattagcttggagttgtccaagctttttgatgtgagatcgttttctgttgtggtggtaatgcacgataaagtgatttgtgtggcaccacctagctggttgtatggagctattttgcagtaatgcacaataaaagtattttgtgtgatatgctgttatagaaaatgactttacagataggatagggccatagggatgatttctcaacttatgtctttgcagcacctgtaagatactaggatgatatgatcgacagggttcacccccttttcaactccacttgaagcataacactaatgtgaaatgcagattacactacagagaaaagtttacttggactaaaaattgttattgtcactcaacatggcacagcagatagagaacttatataacatgaaagagaagattttcagaaccgtgaatccatgattgtccaatacttctccatagacatatcattttgatggatattttcctttttgcaattgcgatttggtttccatttgtaaatagggaagattttgagaggaatgacctgaccagcataatcacagtcgcagttcgggacatacaaggacaagggttccctgaggaacacactggtgctgccgatgctgtgttcttggacttaccccagccttggcttgcaataccttctgcggggactatgctaaagcaagatggagttttatgctccttctcaccctgcattgagcaagtgcagcgggcttgcgaagctatgagatcatgtttcacaggttcaatgcatgctcagaatttttttctgtcagaaattgagggcgtattataactgtttttcatgattcatgggagcaaatgaccccattatactcatagattgattgtggtaccaatttgcacatctgggattgaaagtttgattattttgccttgtgttgctttggagtaattttgggagagaactttacatatttatttcgagttgtagcaaacttgtttagtttgtagtttgtaccttgatagctgtttggatgacagaccttaagttagctgcttcgacaaacagtatttaaagtttcttgtttgagtatgaaagttgtaaagattttgctacagcttacaatttgatgttttgtgggatccatttaacttaggagtcattttcatcaccattcaattttattagtgggtagtcttattcagacttataatttgatgatgcgactctagttctatcatattggagttacagaatggtgacatttagaccctgaaaaattatatcccattttgaatataaattatctacagttgactttactaaacactaaactatttctgaatacataaccatagatttgaaaatattgaccaataggtaatacaagtaaacattatcctgagttaacccacaaaagtgggggctgaacaaaagttctattttaacatttccgtgttataatgcagatattagaacctttgaaattcttcttcgcacctatgaagtacgagaaggtggtttgaagggtgccacaaccaatgaagagtctaatgcagtgcctcttgctcagaaaaaaagaaaacttcttgctgctgcagaaactttagatgttaagcagaattctagtgttatggttaggccttgtagcactgctagaggacacactggctacctgacatttgcgaggcttcgtgtgcatggaaactaaactgatcctccatacaggtgagtaggtatacaagagtagggatcaaaattatgtcctgtttaagacctataaattgatacaaactgccaatttatttctacctagccacacttttattactcttttagcgtagtgcttttgtgttgagttgtaactgtttgctcttgctctgtaacttgatagggaaacttgtggactcacaccttcataatagaaggaaattgagtgtgcaaccccatgttcaggtattctctcaagattgatttggagatgatcattctttttctgaaatactgttatggccatttgctgccattgctgatagtcaaccagggtcacctgtactgaactgcatttacctgtacgtcgagctgtgggccttgcatttgttgtaatggtgtagaagtatttcccagagttcctttttaggagtacttgaggaagtattgggaggagtacttgaggaggtattgggaggtataagatgccatacttcctgaaggacagtaaaaacgctcttgtttaacctggccaagtgggctgggcatgtttggatttcacgtttccatgcgttgccagaaaaggaattcaaatatctatcttttttaataaatgtgttttcacaggttgccgaaaaaaggtgtggtatgtttctgtttgattgattagcaccgcctaacctctttttcctaaaccatgtaatacagttaatttaagtcctattggatgaaacaaataaaccagagcggtgaatgtacgaatatacttagacaaagtcaaataagagacatgttgccattgcataagtttaggtgatatcgccatccaagtgattgagtagttgatatagatcacacctaaaattctaaaatagactagttatgccattagcctccatgcacaagccataaataacttgactagatggccagctaattgattagtaaactatttatataggactgttgttttaaaaaaaatacagattttgttgtagtacatggcgactttttgtttacttcctgaacatcttaaaagtgaatatttggaggaacacactcttaaaaaaacatgattattcgctactttccagtcgcataaacctagacgttaattatgatgttttagactaggttgaagttaaacttttataattttgattataaatgacttcaaaaatacttagtttaaaggcactagaacaacaaatatagttgtatatatatcatagaaaaacatagtcaaagatatatttccgagactgttattgtgcaacacgtcaaggataccatggacattaaaatatatatttatgattaaataggagagtgtattcttcctacatcaaaattcgcacaaaaagagaactctaagttgcagtgtttccctatcaagtatcaatcgcgagctgcataacttatatagtgataaggagaaaccgatggggatttaaaggcttgatgcgatgacgctcttgcaggagaaaccgatggctctcccgcgtgtctcgcgtgacgctataaacaaaccgaatatacaatgcgagcaacgcagctataaaagttggcgaacgacatgtagcatgcattccaagcagagccagaacagtgcgtgacaccgtaatgccgccggagaagcaggacgcaacgatggcgaggcgacagcgccacgccgtgatgatcccgtacccggcgcagggccacatcacgccgatgatgaagctggccaagctgctccacgcgcgtggcttccacgtcaccttcgtcaacaccgagttcaaccaccgccgcatgctcgcctcccggggcgccgccgcgctcgacggcggcgtgccggggttccgcttcgccgccatccccgacggcctcccgccgtccgacgccgacgccacccaggacatccccgcgctctgccgctccaccatgaccacctgcctcccccacgtcgtcgccctcctcgccgagctcaatgacccgacctccggtgtgccgccggtcacgtgcgtcgtggcggacgccatcatgtcgttcgcgtacgacgcggcgaggcggatcggcgtgccgtgcaccgcgctgtgcacgccgagcgcctgcggcttcgtggggtacagccactaccggcagctcgtggagcgcggcctcgtgccgctcaaggacgcggcgcagctcgccgacgggtacctcgacacggtggtggacggcgcgcgcggcatgtgcgacggcgtccagctgcgcgacttccccagcttcatccgcaccacggaccgcggcgacatcatgctcaacttcatcatgcgcgaggccgagcggctcaccctccccgacgccgtcatcctcaacaccttcgacgacctcgagcggccggcgctggacgccatgcgcgccatcctcccaccggtctacaccgtcgggccgctccacctccacgttcgccacgtcgtccccaagggcagcccgctggacacagccatcggctcgaacctctggaaggagcagggcggcctcctcgagtggctcgacggccggccgccgcgctccgtcgtgtacgtcaactacggcagcatcgccgtgatgacgaacgagcagctcctggagttcgcctggggcctcgcccacagcggctacccattcctctggaacgtgcgccccgacctcgtcaagggcgacgccgccgtgctgccgccggagttcctcgccgccgtggagggccgcggcatgctgacgacatggtgcccgcaggagcaggtgatcgagcaccccgcggtgggtgtgttcctgacgcactccgggtggaactcgacgctggagagcctcgccgcgggcgtgccgatgctgagctggccgttcttcgcggagcagcagacgaactgccggtacaagcgcacggagtggggcgtcgggatggagatcggcggcgaggtggagcggagcgacgtggccgccacgatacgggaggccatggagggggagaaagggcgggagatgcggcgtcgcgcggcggagtggaaggagatggccacgagggtgacgctgcccggtggaaccgcggatatcaacttgacaaggcttatcgacgaggtgctgctcagtggtgggaagaagcgtcaagctttggacgcccgtgactgaatctaaaagtttacgataatattgtgttggcatgtttatattgaaaaggttttcttaaaaattaatttgaatcgtatataatcttacaaaatagcagcagtccagacatccaatggtccacagtgaggaagcactagaagtgcgtggttatgtagctccattcactaggtttaaaatcgtattgtcgacaattcgacctattcatttatatttgttatttaatgaggtttatgggatttatctggatctatctttgtaagtgtgtaaagggacacacttacggccagcaagtatcactactagagaaactatctttcgtgggttgcctaaatacctcaatagccccgattcatcaaaaaaaaccgggactagaaatcatttttagtctcggtttaaaactaaatgatctttagtcccggttcattcattgtca

SEQ ID NO: 83033 - DNA, 2350 bp, Oryza sativa
cctacataagaaggtgtggtgaggtcctaattcagggaaaatacatgattatagtttgctgatcaattatgaatggatgcatggagccaaatctcacatggataagataagatgttaggtctaatgagaattggaggcaccttgcaaccaactgtcacattgaagatcagagtgatatcacagtgctgttgggcgagcagaggaacaaacttgcgtgcttgttccttgagattctttccctacacgactctctatgcgagatgttatttccacgcacatttctgaacaagctgcgcctatcttcttcacagcttctcacttctggatatcagctaccaatactgtccccctcctgttccacgtacatttggtttttcgcattagcttccagtttgttttaggcagaagattgaaacgcttgacctcgttaatcaatttgcaaatggaggaatcttgtgagaatttcatgggaattgaactaattcctatatgaactagctgcaaattttctgtgagccaaagagccttaaacaaagggcaagtgggtgtttgtatccaaatttattaatggcgtatagatttcagaaatttggtgtagtcaatcgatagatcaccaaatttgtatttgtatccaaattcattaatggttacacatgatataaggcaaaatttggttataccacaggtgaagaggccggttctggaaaataacactaaaggttctgtccacaggtgtccatcttctatgctaacagagttagctgagaaaaagaaaagaaaaaaaaccttcaggctacacctgctgctaccgttgacagagttctatataacgcggaatgcagaaaaaaggccttctgggtacttcggaatcggagaaatttttggagaattcaatccgaaatagtttaaaatgtaaacaaattttgaccaaatttgagttaattttagttaattcacagaaaatttaaaaaatctattgtggggattgaaattttaaaccgaaatatgaaaccttgcgattgacaacgataactatgacctcgagtcaacccgccgtttgaccgccacacatcttctgtgctagccagtagccactagctgccatcccttctacctccggatcagtcgaccccatcactgccgtgcccatgatattcgctcaaacagagccaattaatcaactgaactttgaagctgaaaattcagaattgtttgggagcacaaagggacataacaaacttatgagcaggcagaatgtgctcaatgggtgaaactcgacgttggagatcctctatgccggcttgcctgtgctcagctggccggtcctcttttgccaagctactaactacaagtaaaagtgcatgaaattggggtttcatatcctatactataatgactctaccattaatataagcactgacgtgtgggataataaaaaggtgaaaaccatataccagtgactataatggtgaggatcctcacccagagtgggttattgggatggagattggcagtgaggtttagcggtaggggcagcagatgcggtacaagcagcagaatggaaggagatgcatgtgcgggctatatatgcgacatgtgggtcccatagtgccacttgacctgacattcgtttttcgataatgtttatggatttaccattgatctatatatttaagatataaaggggcgcacttactagtgtggctgccatgtgagttcgtggtagtatgcgtacacgtcttttgtgtaatggaaaaagaaaatatggatcgcttgatgtggttgttggagtcatatatgactcaagccttcaaccagacatgttcagctataaataggatgcatcacttcgacacttactgtcgtatattgaggatcaatagtgtagaaaccaagcttagacaccatcaaaactctgagaaatgaaaaggaaatgtcatggtctgcataggagggtgaggttctactttaaaagaaaataaggcagtagtttgcccatcaattatatataaatgtatatactcggaaccatatctcaaacagatcacttaaaagactccaggccttgactgataagaattggaggcaccaggaactaaagttcagttcattgtgacattgggtgtcagaccacacaggtgttgggcaagcgaaggcataaaacaagagagtataagaacacaagttgggaatatatagtataaagcacaagttccagcactccgaattctcgaaccagtgtgttcagaaaagtgcataccaatgaccacaagggggtaggatgtagatcccattctaacgacatatcccatgaattgcatatactcccctacatgatgaagcattgaag

SEQ ID NO: 83034 - DNA, 10140 bp, Oryza sativa
ggtatgttcagactatttatacatagatgtggaaataagtgatggacatcgagttatgcagtgtagatgatttttttagtgtattaataatatataatttattttagtggtactaattcagtttcatttattaaaaaggcacatagctttaagacaataacaacaggggagtttatatatgaccacgacaaaatgatttttatttaaataagagagactacgatacattcccgtgtgaatgcgcgggctacattccttgttattatataaatttttaaataagatgagtacttatatggatcggatgtccaaaattcaatgccatactggagtagatcttgcgcccatgcatgaggacgatcccatcgatcgtatcacatcacatgataatgcactggaatcctattccatcactctaatgatcataattaatgcgctcttgatcaaaggcgaacagtaccgtggcaacgtcccctctttaagctgaactcattgctctgtacaattggccttcgaaattgcaaagtttaaaaaactgagcaatttcggacattggagtatcagaccactactcagtgaaatgcaggctgcggtacaaggagatttccaggagtatccgggatattatcataaacaaatatgttgctaaatactccctccgtactcgtaaaagaagtcgtttaggacagcgacacggtctccaaaacataactttgacttcttatttctataaaaatatttattgaaaagtgatatatgtatacttttatgaaagtatttttcaagaaaaatccattcatataacttttacattttaaacttaacaatttgagagttattcatgatttatatttccaaggtttgacttaaacattgtcctaaacgacttcctttacgagtacgcggggagtatttctataaacttagctaaagttaaaaggaggttgactaaggcagcgttcgagagggcgagagagtgagtttgtttgttttgttttccacgcgcacgtttcccaaactactaaacggtatattttttgcaaaaaatttctataggaaagttgctttaaaaaatcatattaatccatttttgaaatttaaaatagttaatacttaattaatcatgagttaatagctcacctcgtttgcgtatcttcccaatctcctcaatccccttctcctcaaacacaccctaagaaaataatcaaaattaacatcatttaatatgaaacgacgagggagtatataatataataataaattcgcgacgagggagtatataatataataataaattcgaaatgctaaatgtcattgtacaaaaatttaggggcaatattttacagattttagactgttggattggcgccaagattcgtgcccgcgctttttctcccccaaccccgacgagctctcactcttctccggtgccggcgatgcccccaactccgacaggggacatatatatggattaggatttggggttggattgttagagtaggagtggggatgtggcgggggaagaaggtagttccccaaggtttagagggatgggcgtgggcagcggtgggcggtaaggcaccaatggtggcactagagccatagggatggcaggaggcggtgggccaacgttagcggccgggcaaataacgagactggttagaaggcaacagccgatgatgccgtatctggcgaccgggagccaccagagacggggaagacggcgaaacaagggactcggcgacgttgccttgggaaagagagaggaggagggggagaaggccgaccaaggtgggagagggggctcatcggtgctgttgaccccttctgaccagctggagaggtagcggaggagcaggagacagagccgaaggttttgcgtgagcgcacgaaagcggcggcgatgggcgggattgaggaagacaaagagaaaaaaagatttgggtatatatgtttgcatgaatctcaaagcgatccaatggtatatatttgcaagatttaagagggtctcagtcaaaatccataatgactgtcctatgataaatttcggaagttattctcataaagctattttggtcatttaaacaaaattgtaaagtattaatgaaggctaatcggacggtgatggtaaattatagaagttaaacaaagccaattgcatatcgtagaacgtgataaagtcagtgatggatcatagatatatgataaactcaatagcatataatgtattctcacatctccagctttgtctccacatgataccatacgcatggcacacttgatacaatgagacgcccctactattcgggacaaaagtcacaaaactcgatgctctctccagtctcacctggtcccacgcgaaaaaccatgtggccacccatgtccatacataaaacaactccgccatgcgccccacgcgtgcatctcctgctataaaaacgaacatctccacagtacacgagtgctcattgccttccaagcacagcagctcatcactgagctgaccagagagagccggagatgggatcgacggcgacggcgaggcggcagcaccacgccgtgatggtgccgtacccggcgcagggccacgtcacgccgatgctgaagctggccaagctgctccacgcgcgcggcttccacgtcaccttcgtcaacaccgagttcaaccaccgccgcctcctcgccacccgtggcgccgccgcgctcgacggcgtcgtccccgggttccgcttcgccgccatccccgacggcctcccgccctccgaccccgacgccacccaggacatccccgcgctctgctactccaccatgaccacctgcctcccccacctcgacgcgctcctcgccacgatcaacgccgacgccgccgcggcgccgccggtgacgtgcgtcgtctgcgacggcgtcatgtcgttcgcgtacgacgcggcgaggcggatcggcgtgccgtgcgccgcgctgtggacggccagcgcgtgcgggctcatggggtaccgccactaccggcatctcgtggagcggggcctcgtgccgctcagggacgcggcgcagctcaccgacgggtacctcgacacggtggtcgacggcgcgcgcggcatgtgcgacggcgtccggctccgcgacctcccgagcttcatccgcaccacggaccgcggggacaccatgctcaacttcctcatgcgcgagtgcgagcgcctctccctccccgacgccatcatcgtcaacaccttcgacgacctcgagcgccaggcgctcgacgaaatgcccagggtcctcccgccgcccgtctacgccgtcggcccgctcctcctccaggtccgccgcgccgtccccgcgggctcccagctcgacgtcgccgtcggcgccaacctctggaaggagcagggcggccttctcgagtggctcgacggccggccgccgcgctccgtcgtgtacgtcaactacggcagcatcgccgtgatgacgaacgagcagctcctcgagttcgcctggggcctcgctcacagcggctacccgttcctctggaacgtgcgccccgacctcgtcaagggcgacgccgccatgctgccgccggagttcctcgccgccgtggagggccgcgggctgctgacgacgtggtgcccgcaggagcaggtgatcgaacaccctgcggtgggcgtgttcctgacgcactccgggtggaactcgacgctggagagcctcgccgcgggcgtgccgatgctgagctggccgttcttcgcggagcagcagacgaactgccggtacaagcggacggagtggggcgtcgggatggagatcggcggcgaggcgcggcgaggggaggtggcggcgctgatacgggaggccatggagggggagaagggggcggagatgcgacggcgcgcggcggggtggaaggaggcggcggcgagggcggcgcggccgggtgggcccgcggagtgtgggctggatcggctcatccacgaggtgctcctcgctggtgggaacaagggtggtcaaaggctaagctagctagccgtttgacgcacgtgactgtgggaattaataatgtgtggacatgtgtatttgaattccatgtgaaattcgaaatgattcgtcaaacaatttaatttatgtagaaattcctacgaaattgccttgttccaaaacatcgtgagctaggagctcgagaaatggatcttttttttttacaaacatagacgattaaaacacacgtacacttactccgacgaacgcatgtacgcacgctctactctaatagttagcacatttgaaagattttaacgatatatatttagattcacgaattccctataaacacatcggtatcaacgggcatgtcactttctactaaaggaataattagatgcatggttggaaatttcggactagacccctctgatacgatattatttcagccgaaaatttttattttttttaaatttttcgtgaattttggtaatatttgttcgaattcaactaaattttgttcaaaaatgtcggaaatttcggtgaggtccaatcaaattagctaaaccgaagtttaaccctgattagatgtaaatacgagcacacttaatataaaacacatgttactttcagtgacgaattcccactacaggatgatacacatttagaggcgagctaatcagcctcaaaatcccaaaaaatccgcctcagaatatgtattgaggccaacattcactgcctcggatactcctgcctcaaaatagtatattgagccaggcataagagttggcctctaaaaggtgtatttgaggctaaccatgtatgcctcagaatttgattgaggcataccgcatgcctcaatgctagggtacgctaccgaggctattactgctgcctcaaaacaaattgaggcaactgtaacctgcctcaatgtaggatgcatcaaattaattatatttcctagattattattgtgggaaatacacattttcatcatcatgaaaacatgaaaacttgacaattgaaacaataagaaattaaatagtatccaaatcacttcattcatatattagcagtacatccaatcatacatgtccaataaataatacatagcatctcatccgtcacttagactataacaacattctggtggtcttaatataggcattaaagtgaactaatatgtctgaactccaattcatatgtggcatttacaagtgttgagacaatcaactactcaaaagtgtagatatataattactgctcatgtttgagctatctcttctaagaagttctcgccaattttctatagttgaacatgatcgacaatcatcaccgtttgagagaaactcgagcacctggagtgtaaatatgtaaaattcagttaacacaaacaaacaatgtcactatctttatttaaataaagaacataaaatatgatcatgagcatggaaattgagtttactaccaaagaaaaattgacaaaacaatccaaagtatagcaggaactaattatacagagaaggaaatgctagagacctatgattaaacattttgaacagaagtacatttctatgtaaaatagactgcacctattgaggttttaaagtatatggcaatccaaattacaatagcatttctatcttttgcatacttatattttgctcaatgaaatttccagaataaaaatgatgtaaatactctatatatacccaacataaatggcacatatacctgtttttgtcacttccccattgcactgaggtgacacttcttcaacatttcaaattgatatttaccatgttagacttgctatgtaaactaagcaataaaacaaagaagccaagaaaggaacatactagttgggatggccatgcaatgcaatgaccaatagcgtctctaatatagttcaaatttctatgcggccggaacaattcagcatctccacatataagactgtctatcactactttgtagcactcccttcccagcattgttcctccgaccatttctaaggggtcttgactttgaatagtagctcttgcaacacggttatatggacgaacaattctcttaagaaagacatcccttccaacctatttcaaaatgtagccacatcagattttattacagagtagaaagtagaatagttgctactgttttgtagtaataaaaaagaactaaccacattttcacaagctaatgctgcccttttgaccttagcatgtttagttgttcccacattggccccttcaattttagtaggcttgttgttattgtacctggctatatgcttctgtaccccctgttacacaatagaagatgttactgttgtcaacctattagcatgcattaagcaacagaaatgcatggtggtaatatagtgcgttccaaataaataccatatatccatatacaaacttcagcagcattttgagtgatcacagttggaactttagagcgtttacttgtggcatgattgcttgttgtttctccacaacgttttttttgtcattcttggttgcttggtacaattgtgattgtccacatctttttctaccccctgttgtacattacatgtagcatcaacccttctcaatgaatcctacaagacttaagatatgttacagtttgacttgaaaaatgaagtaaaatcgatgttattcagctcaccttcgtaacatgcatattttgattaacttgcgattctctggcaactcctggttgcacctatattcaacaaaaaataaataagtctatactaattccaaataatactagtgcattgacttgaaaaatatgaagcaaagtcatcgttattcactcaccatcccatcatgtctgttatgattaagctgagattcttcaacaattcttggttgtacctgtattttaaaaaataattcttaatgccgcaaacaatactggtgcattgacttgagcaagataaagtaaagtcgaagttattgttagtgcatcgtactaagcacaactactatctgttcgagaagagcttgagcaggggacaaacaaagaagaataaagcaaccaactagctaggagaagaataaagcaacaagcaagctagatggctacctgcatttcattcaccaaaaatcatattttaaactaacatgcaccagcttctagactattctagaccatgttctaactttaggactattctagaagtacttcagacgaaggaaatgaattagtttccattagctcaccttcctagcatgtttgttcagactaagctgcaattctctagcaattcttggttgtatctgtattcaacaaaggaaaaaaaaaccattagatgaaactagactagcacattgagttgaaaaatatggagaaaagtaaatgtcattgaagttaccttcatagcaggcctcttctgatttagttgcaatgcttcaacaattcttggttgtatctaaaatcaaggaaaaaagatagaagtttatagttcctgaataataataccagtacaattgaggttatgcaaaatgaactatgatcttttatattgtttgaggcagatgagcatgagtgctcctcaattggcttgttcaaggaatgcctttgttcaggagaagtatgcttcatagctttaaattctgccattttctctgcaagtcgtctctccattcgttcttccattctttcttccagctgttgcatcccttcttttaaagcacatactttttgttccgctctatgtcttgcttctctctccaactataagcttgttctttctgttgatttagttcctggcaaaccaagacttaatataaaacacatgttactttcagtgacgaattcgatcctcgattcgttattatgccatttagttttatgacgtttggtaggaggattgtgttgcttagtgacaaaaatgagatgttcgtcattgagaccaaagacaaattgacatgaactaatccaatgatatatcatgacaaatgtttttctataagagaccaaccgggacaaatatttttttataagagaccaaccggcaaatgtcttaagttcatgattgaaagcaccatggcctgaatttgtaagctgtcaaaaattacttaatgtttttagaatttataataatgtgcaaaaatgaattaagtttaatgaagtaaacaggagaataaaaaattattaataaatcacggtgcgagttatttttcctaaattatccataaactaaaatactatatgaaattttagtggaattttcaaagctatattataattttagtaatacatgaattatttatgtaatttttggtgttcctacccttcgccctctctagtaggtttggtacttcctccgtttcacaatgtaaatcattgtagcattttccacattcatattgatgttaatgaatctagacatatatatctatctagattcattaacatcaatatgaatgtgagaaatactagaatgacttatattgtgaaacggagggagtaggtttttagtgttactacacatctagattgcagtgtagaccaacctgcatagtccaaacatcaaaattgagcacagttgaaattcagcgtcactaaaccaattttgccacagaacaagatactacatacagtaccacatggtgacaagaattgaacacaattccttcagcttagtcaagacgtccataagaggattgtgcataggtgagttctaggcaaaaggaactgaatctgagatatatacaggaatctatatgcagggcacatatttcataacttggattagtcggtcacaccatccagaacggctcttgcggttttaggcaaaatggaactgaaatatgaacaggcagaatagctccaagatggcatctatatagacagacactgcacagatttcgccatccagaactcagctctttcttggtccgtaaaatactgattacgaccatgttaagtagaggatcatcttcattaatttgatggacacctccagatgaacaaagaaaagatatatactgattcagagcgatgcaaccttgtaggctgttcctgtaatagaagaaaaaagtgttcagcgccatttagcgtgctaggtttaatgtctcttgtttacatgaatatgtgtaggtaagctatgaacatgtggaatcatatcataactgtctatgcgctgaaaatcgaataacttacatcgggtggaacgagtccacgatttataggcttgtgtgttgcaatttgcaactgaaggactgaggcttttctgcaaagaggttatgtgctgtggctgacgggagctgccctgtgtacaccgtgctaactttttcgggctcaaggtggcaattttcctagccgcttacgcgcacgagaagtgagccggtggtttcggtggaaatgcatccgatttcatttagcacggtattgtatttctcttggatgacgaaagaatggctgcttgcagctttgtgaacatcctggaatggctgtccaagacttccttcatcacttcggtcttctagcctggttgaatgagcagcgactcaaaattgaagaaactttttttttgcagtaggatttgacagaattgatgaacaaaaaaaggagcatcagcaacaaaagagtgtaatgggggaaggatccgaaacaaagcaacgatagtttgattaattgattgatatatatttgtggagatgtcaaaacaacaaggcagcaatacaaataagtcaactttagggttttagtatagtccctgaaaaccagaaaattgcaaatcaataatcaatttttggctgtctgaagaggctggtagtcataagatctgattttgaaggtcaggttaattttcagacttctgtgagaacgactatgaaagttcagaattggaaattcgacttcttcctgaccagaactgcatccaagcataggacatacggaaggtgcaaagtagatattttacatacatgtcgggggatgcatcggggttgtagtcttgctcctacaggatagcagctgaattataaaggagcaagtgaacacaaataattgcacaccacatgcccccatggacatacctcagcaatgaactcccatttttcatccttaagagattgccgtacaacatcaccatgatcatacacaatctgggtttcaaacaaaagaaagagaatatctaaatatgaagtcaag

SEQ ID NO: 83035 - DNA, 6749 bp, Oryza sativa
ggatgcgatgtttaacataaatttaatatatttgtaagcctcaagccccctaccccgttggatcctcatgcaaagaagaaaaagaagaaaaagatgccctccaccatttctggatttgcttcacatgatatttttttatacgtcgtactaatttatactattcttaaaaataatgtttaaattataccaatatattataaattaaacgacaacttaattacaaaaagtattatcaaacatacatactgtatctctgtgcctctgcaatctcgcaaagacgtggtatggaactagaaggaaactgcaacaacgcatggtttgaaatggttcttcacctttggcctttttcttaaaccagccagctcgccagttatttccaagcctgtggacagttcgtcgccaacgaccaacttgcagaaaatactcgagtaacaattaaacaattagaatgtttcaaagaggctagattactcccgatgcctcctaattctatgcaagttgtccagaaaagatgtacattaaaacctacaagttgcatgatattttccaggtcgagaattagctagtttgtgcgtagcgacatgcacttgatcattcgaattgctggtcttttgtgtatatatgtatgtgtctctctgtgtgtgagagagactgagcatctatatatctaccaattagcaaacatatttttcacattttgggagggagaaagtcgaaagcaacgaacagatagccaaactcaccatgcagcaagcagcaatgcctgattttttttatcaaggttattttttgttagaaatgccatatatgactttgctggtcgtatatacagaaataattcattgcatgccgttcagatagcctagcagttttgctgtagaccaaaagatggaataagctgtataaaaccacttttgtacttagtacgtatatcaagcaaggtgagcaaaataatgaattgaaagacatcttgtacgggtaaaaatcaggagagaactcactaactagggcaagttgtcaatagattcaagagtctctataacactgggtgatcttgttcgattgagcactcttaacagcaaagttgggtaactatccctctcggttaaggctgcgagacctctttatttcttgattgcctgcagcctgcgtgctgtctggatgtggtacgtagagccactatttggcgtagacggtcataatcatgtatgtactcatgtacatatcatgaaacaaatgtgtaggacaattcctgatgccgcctaatcatattagagtaatgtaactttaactttttaatttagggctgggattaatatcgcaagaacattatattctatctccataggttttagtagtacgagtttctctagaccttttttttgttttttttttgtttttgtcaatgaaagtgttccctgaattttggtgcaggtgttcatcggctccatatatataaaatgtttgctggctaaggaagatagaagtttcattaagtctatttatgtattgcagcaccaggtagatggagaaagtttaaataaggtagtatttccagataggtccgtatcataaaataagttgtgtgagaggaccataaaaagaccattttcatgactagaactatggtctacaaatgatagctagccttattaattatgtcttggcatttgtcccatgtgtagtctcgaatagcaagaactaaaccaaccagaggagtgaatggttgaagtacccaaaaactaaaacttttaccggaattaaaaattacccttaaatctgatgtagatagctctgatcggagttgacccgctggtctgatcgacacactttgatttttacaccatgtagtgtgatgagcgttcccaagagcatctgtgactggccattcttgacgttttctgtgatgatcagcgctcctagaaaatcaaagtggctatccatacgatgtttccttagaaaatgaatcttgttgcagaggcttaaaaagttcataaaaaactacatccatggacaagatgagatagctagctgtcacggttttaagtgtgtaggatatatgttacttcctccatgtttgaaatttacaacatgatacattttgcatttcaccggtgattcgtgtccaaataaataggacaatgcattatgatttagttcgtaagactctaagtatctaaccaacaatgtttgtaaaatttctgtataatgtttacaacaatagcaagatgcataaaatcaccgaggggcacctatgtgtcacctttgtccatggcagtgttttctagatccatatgttatgctcggccatttttccagtttatagagtatgattttagtcatccagagaattatgccagaattccatattacttccaatcctatactagctagttatgtccaaacaaataaagatggatacatcagaggatgccagtgtattggtttattagaaaattatagaggaatgtgtacattgcaaaaggccctccaacttgttaagaagctagccatttgtttatattcactctttgtatatttatatatatactgcatggtatttattctccaatatattatagagaagatctttatatgaactacgaaggctgcagcttcccgtaaattttaaaaaaaagtttcataaagatggatatacaaagaaggtgcatgtgtattgcatgacatgagcatttcattgcaagaacagagtatttcagagtacacaattcattcttgagatagaccagccatattaatcgtcttttctactttcagtattcacatcttaatctttttttgtttctcattttgtatattgaagttgaatataatttttggtgcagtggtgtctggtacatgttactatactctagattgtcaagttgtttagaattttgtcacaaccatttagattaaatttaagagtcaggattagaacactctcacaaagaacccatgaaaaggctatcgctgtctgacattgcttcgtgttataatccagccctatgttttgagtttgcagcaaaatataatttgcattctactggatatttatcaactcaatgccactagtaggtgcccttagttagagcatagcacatgtacattgtaaaaggcccttgaacttttgaagtgtttctttacactgcttgctgtttatataacagtacaacatagaaaattattcatatgccctggaaaggttgccacctgcctcaaattaatgacacattcaataaagctgtacacaaaaaaattacaggacacatttcgcaagaaaagagtggttaaaaggtgtggtttcgtagaaaccacgccttttaaccaatgatatctggaataacaaatgaactgcttaacctttcttggaaagcagaatttcatcaattgaatctaaatatcgagacattatgtgcagcataaaatttaataaatgtgtattactcgaagtgtattatcgtcaatccaaaaggaactcactctcctttcctaaacttatgatctttgtcatgccagttttcttatactgtgtcccctcattacccctttgtctctcccttgctgctaaaaataatgaagtcttgaagatatatgaattttggggaaataatggctgttgagatcaaattagctttggtagtaactatgatctctttctgtaaacaacaaggtaggtgctaagtcatcaggactaaaaatgttcagccaatgatcaatccaggggcattgctatcgctcctctattattacctgcagagactaacacggccaaacctgacacatttctctgtattgttgtcccttctttgcagttagactgcgaggtggctgcgtatcttgatagcctgatgtgagcctgctgcctggatgtaatacgtagagccactgtttggcaatgggtcaatttcttatatatatatgttgctacatccaaccttcctcaatggaggctcatcaggacagtagcaatgcgtcctagtaaattgctatgccatagctgccatgtaggcttgggaactctaaaagacactatacccacagtgcaagtgtggcaagtgtggtttaaaaaatttataacgggacctacagataatataaaaaatctcacccctcccacacccccccacccccacctaatcctctcacgtccccatgtccagggcggccatggcggcgtgctccggccagcgcggcggagctcggtggcaccggcggacgggtggagggacccatgcggcgatgagcaacagatccggcagcatccagcggtgcggccgaagacgccggcggcgccaagcggcgtggtggaagacggctgcgtcaacgacaccgtcgtcgacggtggaggcacagcaccgaagctgcgcggccgcggaccctgccaacgccattggcgcgcgaggtggggggcgagcttctggagctccgcccagaagacggcggcagcaccgagcggcggatctcgggaggcttcccgagccccacgcagcgacggcgagctccacctagaagatggcggcggcgccgagcggcggatctcgggtggcttccccgagcccaaggcagcgacggtgagatccccgagcgcctctactccggcgagcatccgacgagcaccacgcagcggcggcccctactttggtgagccccacgccccgagtgcccctactccagcgtgccttttttttttactccagcgtgcctcctttcttttgctttctcgtttctcgtggaggtgcccctttttttggacaaaagttgttgaggttcgtgtggccaaacttgatcacgcgaagctgggttgggaacggtccccactcccctctctactccacgcaagcgatttgcctacgtggctctacattgtcacacgccacgtctttgcattgtaaatggccttagcttgacccttgctgaggaaggatgatgagagaaacgtgtaggacattatttcctgatgcctcctaatcattattaaattatgttctaatctaaactttctcagagctgagattgatatgtcaagcagattctacgacaaaggatttcagtaggtactggtctctaaacttttgttgtctttttgtcagcaaggtgttggctgaattttggtgcaggcatgcatatgtatatatacagtctctctatgcatatatagggaacaacggatgttaatttaatgctatgacagtgtttagttccctttaaacttccaaaaatttcatcacatcaaatatttgaatatatatatagagcgtaatgtggatgaaaaaaaaaaaccaactgcatagtttacatgtaaattacgagacgaatcttttgagcctaattacgtcatgatttgataatgtggtgctacattaaacatttgctaatgatagattaattaggcttaatagattcatctcacagtttacgggtggaatctataatttgttttattattagtctatatttaatacttcaaatatgtatccgtatacgtcaaacaaattttgccaaagaacaaaacacggcctatctatattttgcagcatgaggtatatggggaaattttaaacaaggtagaatttcagacaactccgcatcctaagatgagttgtgtgagagaataatagaaatgccattttcataactacaactatagtgtacactgtacatatagtagacaaattaatttgggacaatttcgttgttgccccctactttgatgatgtctaatattgattttcgttcttacccctacttttttttaaatgaatcaaccgttttcctctgttctgttaattcttgctaatggtgttaaatgcggggtgtaaaaagataagtatacccttcaatactttcccgtacttttgacataatcagatctattgatgccatagcaataatttagtttgtcaaaattttgtaaaagttagctaaaatttgggttaaatttgaaagtggtgtacaaaagtaccggaaaatatctaagggtatacttgtccttttcacctcacatttaacaccgttagcaagaattaatgaaataggggcaaatggcttattcgtttaaaaaaaatagctatttggtcgtgcgttgcacgactttagaagcctttataaaaagcccaaaatatatacacactataagtatgataattactgtgtctactttaaatttgaacttttttgtaaaatcataggatcgacatgataaaaaaatagttaaatctagatgaacatatattttgaacgaaaagttcagacgttatattcaagatcaggcctctttgttttggttcctcaacaatgctcattctaaaattaaaatataatttcacaatgacttaaacatatatctatactggaaacagacatataaagcaaggccttgcgaattatcaaaaataattcatgcaagataaaatcttggaaaaattcatgaaagtactaatcaatataatcaaatcactgtaatttttacctaattttatatgtacatttgttacatcaaataaatcggtcaaagtagtcaaacagtggattagttataaaccttaatcagctaaaacctaccatcaccaaaatgtgcattacactgaatacaagtgtataatggaactaatttattcgaataccaggttaattataatgaataaatataatttttgtagaatttatttcctcagtttaaaccaactaaaaattcatctgcctccatccaccctattttagcatgcccacaaattaaactacagatt

SEQ ID NO: 83036 - DNA, 830 bp, Oryza sativa
atgtaggggtaagaacgaaattgcccccaattaattttggcttggtatttctcccgtatagtgttgagcgctcccaatagcaaatacatgcgtgacaatttttacaatatatgcagtacaaactcaacttgggtggaacttctctaaccgcttctgtaccgccggtctgaccggtgtccggtctaacctaagtttgactgcttctgtaccgccggtctgaccggtgtccggtttgactggagtcttaccgcttctgtaccgctggtctgaccggtgtccggtctgaccgccaattagtagcggtcggaccggcagtacctcggcggtcggaccggcagtacctcggcggtcagaccggcttcagacatattttttttctaaaaattctcaaattatttttgcactcggatatatgcctattcgatctacttgtcgtgtcttagtactggattcctaaatttttattatctaaccccagtattgaggcttcgacttttgcttgtgtgtaggctttggtggcaaggaaggggagcgtgtgtatcgtggattccggttgttcacagcgcatgccccgtgataaaaattggttctcctccctcgaacaggcatccaagactagtgccgttttggctacaggtttggtcaaggtaaatgacaagtttgaattgaaaaacgtagctttggttgaggtcttaaattataatttgctttcagtttcacaaattgttgatgaaaattttgaggttcactttaagaaaactagaagtaaagtatttgattcttgtggtgattctgtgctaaatatttctcgctatggaagagtgtttaaa

SEQ ID NO: 83037 - DNA, 1278 bp, Oryza sativa
cactccggggaagacgaagcagcagtggatgtcgaaagaaaatgagaaaaacagagggccttgatgaaaaaaaacaagtgtggccagtgtcacacacggtgcgcgtgagaaaaggcatggtgcgggccagctcagctgtgcacgtggcatgccacatcggcgcgaccgcggtcaaacggcattttggaccggcgatggtacatttagcaagtttagtggcctaattacacgatttgcaagttaatggacctggatgacatccacccgcaagtttaagggccgctactgtattttactcttagagaaactatctaggagtgacaaaagcatcagcttccgaatttaattctgccctttaatgttagatgttttttttaactaagcttctgtctattatatcaattccctatgtacatggattgacaacagcgacatggtatggttgattttttacagtgagacttactccggtccatcaaaaagtaccggtttagaaccctttgtagtcccggttttccaaccgggactacgaatccgggactaaagatcgctatctttagtcccggttcaaataaccaggactaaagatcaatctttagtcccggttgtaaaagggagaatcttaccaaccggaactaaagaggggaagcgacagttcctcgagatcttttttttattttattgttgatttgctaatggctagtgttaatccctgtattttctcccgaatcaaatgggatgcacatccccaaatcaacatcccaaatattaagttacttatacacacagatcaaatacatcacaaatcctacacacagatcaaatacatcacaaatcctaaaaaactacacacaaataaaatacatcacagattatacaaattatacatcatatctcagatccatgcgatgcaatgaatcacaaaatctaaaaaattatacatccagtgaaacacaaattacaaaaaaaaaaagaaaagcaaacgagccggcgcccggccgccgccggccgcatgctcgccgccaccgcccgccgcccgcctgcccgcgtgcgcccgccgccacgcacgcggccgcgccgccaccacccgccgcccgcctgcccgccgccgccggcctcatgcccgccgcctcctccccccgcgaggccgtgccaccgccgctcgctgccggccggctgatggaagacggagtagaggggaggaggaagggccggctgatgggagggaggagaggggaggaggagaagatgaaggggaggaggggaggaagagagggg

SEQ ID NO: 83038 - DNA, 930 bp, Oryza sativa
ctgctcctgagttgcagtgcatggtggattgtgctatcgcctggtgattaatttgacgttcacgtccttctctctccttggttctctctccttcatattagaatataatgatataaaatgttttagaggaatgagcctattgtaactgccctaaggactgcactcgtttctggctatccattttgatgatgaacgttcagatttgtttctacagtaataacatggacagaaaagctgaccaacggccagtctgtgttgtttgctccaaaaccacaaggtactatacgtactgtggcaatacattatgatttactcggtaacaactaagtatctaatcacaatgtgcgtgtaaaatttctcagtactgtttccaatcatagcttgcataggctgtgcgtcttggtgacaaatatgtgcaaccgttgtaaatagcagtgttaatttctagatcactaacattgtttggccattttataagtttcattggtttagctgcatttctagtgccccaaatagaccacagaacagcaataaaattcttcatatcattaattcctatggttacacgaaacccctcgcgagtgaggaggaatactccacccatattgaaagtactatcaactacattccaaacaataaagcaaatgggcatttgggaaacaaggattgatgtacaagaagatgaatacgtattgcatgacacgaatattttctagcaagtatagggcatttgtagcagagccttgagatgtttgacaacattcaatctgcctatatttcgtctttcgtaaagttggatatgcccgtactgcttgactcgtttgattgaaagaacagagtattgcttgctgctcctctggatccgccagtgtcgagagagagagagagaggaggaggaaattaaagccccgaccctagtcatctactcgg

SEQ ID NO: 83039 - DNA, 7811 bp, Oryza sativa
  unsure (1)..(7811): unsure at all n locations
ctcatgcattaactgatgaatcgtggattaacgccatgcatgaagaacttgaaaattttgagagaaacaaagtttggactttagttgaaccaccttctggacataatattattggaaccaagtgggttttcaaaaataaacaaaatgaggatggtttgattgtgacaaataaagctagacttggttctcaaggttttacccaagtggagggtttggattttggtgaaacttttgctcctgttgctagaattgaggcaattagacttttgttagcttttgctatttcaaaaggttttaaattgtatcaaatggatgtgaaaagtgcttttctaaatggttttatataggaggaagtttatgtcaaacaaccaccaggttttgaaaatcctgattttcccaaccatgtttttaaattgtctaaagctttgtatggcttgaaacaagcaactagagcatggtatgataggcttaagaattttttgcttgcgaaatgttttacaattggaaaggttgacaaaacacttttagttcttaagcatggtgataatcaactgttcgttcagatttatgtggatgatatcatctttggttgttcaacttacgctttggttgtggagtttgctgagactatgcgcagggagtttaagataagcatgatgagtgagttatcatactttttgggattgcaaattaagcaaacacctcaaggtacatttgtgcatcaaacgaagtacaatgttaacatcaattggttctacagctgtgttggatcctgatgaagatggtgaagctgtaactaacaacatgattgaatctttatcgtatctgattgcttctaggccagacatacagtttgctgtgtgtttgtgtgcacgctttcaagcttctcctcatgcttcacatcgtcaagcggttaagcgaataatgaagtatttgaatcatacacttaagtttggaatttagtattctacttcatcttctatatgcttgagtggatattccgatgctgattttactagttgtagaattgataggaaaagtactagtggatcggaacatgtcattttcttggtactgtaggatcgtaaagggcctttacaaccccaaaagctagccattgagatgaagggctcccccacttatatcttaggtcatttgcccttccacattcaatatgggactattcaacaatttcgcccttcacacattggtgccccttagcccttcaccaccccttcactgtatacaggccccacagggccacggtccatcagatatacaggccccgcaggcacccacagtccatcgggccttcacacactgtgtccatcgggccagagatgttaaactagccaggctctgataccaattataggatcgtaaagggcctttcccaccccaaaagctaaccattaaggtgaggggctcccccacttatatcttaggtccttttcccttctacaactaatgtggactattcaacaaaactcgtgtaaaccacaaccaagatcttaactacttaaaaaattaataactttccatttgtcacttaatttttcgtccatatacatgctaatttttcatccatatactcaattttttttgtccttcgtgcttgtgtgtccgccttgctcacgatccccttcatcccctacgcaaccttcgtccgtctctctgtgagaaacggatcgaatagaatacaagtatggacacatgaacaaatcaacccaacttccccatccaaaacccaatcatatgaacaaatcggatcaaaaacatcttgaaaaaatcaagaagaaaataaagagaaatcgagtcggagaagagataaaatcaagtgcacactgatcctaaataaggggaaatcacactatcgtctgggttggaggctaactgggagtggcctcgctcgatccgcgtcaccagcacccaatccgggattgatccgtgtcacccctgtccgatccgatcctctccaatgtccacagtttcgcctgttcttcagaactccaaccaaaaccaacgagctccaagccaccagatccggccacaagatatcgaggtcagctaaatctggaaggtatgaaaattaaggaggcgggagagaggagagctcgaggaaattactgaatccgaaagctaaaggcattgccgccgcaataatcttcctcctcttctcctgatcattaccggcgtcttcttcctcacaggctgtaccaccgcctccctgcacaagctccaagaatcccatgcaccttcggcattttctcctccctccagctgccatatcggctggccacgagtccaaagtcaccaggcaatgatgagcagatggatacattaggggcggcgggctgagcggaatatcggcggcgatgagggtgaggaaagaccgaaagaggacgagggagaaagaaccgctcacgtggataaattattgggggtgcgattatgtttcttttttcattttttctattttctaaccactcacgcggatcacgatcggatgggggcagcgagctgaggggaatgagagcagcgaggaaacaacacttatttttttcttttctctaactgcttacacagataattatgacatataacaatttcattcggttgatatctgtgtagaacattagcttgattcatcgatttgtacttttcaaaaatatctttttttttcatgattgcatgtataagagtacatctaactgattgattcaaatgttgatataatattttatatggtattgtagagataacctcacctaactaaataaagaggagagatcatacacaaatccgcaaaaccaaccaaacaaaatatcttctgaaccgtctctcttatggaagcaaccaaacaaaatattacattagccaaacaaaataaattcaagcaacaaaacagaggaggaatgtttatcctcttagccatgtcaaactcaggctgtatgagggagataagctagactaaggagatgcgagcaacctaacacatggggaggatagggtagctttgttgatgcatgcctatggttcttcatttaaggatgttctggccgagtattgttacacgaacttatatcctaccctactttaaacatatggattttttcaatcgtcacgctttattttgttcatcgcctacatgaaccccgctgaatcgcccgattgagtcaatcatttcattttttttccatacgtgtttaaattcatgcattgtgtgatataaaatgaaaaattaaaaaaaataaaaaaaggtaaagggagatgagttttgtatttgcctttagaaaaattaaaaaaaataaaaaaaggtaaagggagatgagttttgtatttgcctttagtatattcttgtgcatggtagcaatacttgttagataatatggaactagactttgtatgcattttttactttatatgaacttttgatattgtttttgatagtgtaacgtttcatatagatagagtagaaaattacaagtctatattcctggagggctatagcccaaagggaaataaaaacaaccatgccacacatctacaaccaaatcctgcatgcttcgtatattctcgaaaatactttatgcttgagcaatattattaagaatggagaagttgtaccgatcaaattatcaccaattatatagaacatccatttggaatggcctgctgactgagtcagtgtggagattatgggtaccccatacccacacggcatggttatccgactagttataggggataacttatatctatgtaatatgtaacagatcatgacttgggtgttacgtttccttgtatattacggaacggcgtaaagtcctgatttgggaaaccgataccgtattggttaaggtttctatcttgtaatcctgctccccatcctatataaggtgggcaggaggccctctagggggcagatatgagacaacctgatcatcagatcaatacacacccggcggattcaaatccccaaacaggagtagggtattacctctcattgagagggcctgaacctgtctaaatcctttgtctccacatccatccacttttaggtctcgtgcgctaccccttttattattgccgaaatcatgtttcgacagttggcgcgccaggtaggggttgcgtcgagttttccgtcgagaagtgcgatggaactctgtgccggcatcatcggtgctactcttgtctttggccgtgatcctctcaacaaaagggcagggtcttcgtcgccaaaaattctatctggatctggtttatcgttctaaattttcttatataaattagaattaattcacagatcactaattattatttgatctattattttatacatgtaccgccggccgccttcgtcgctgccgattggtttcatcgcctccacagttggtgtgcgccgctgccgttgcnnnnnnnnnnnnnnnnnnnnnnnccggcctgcctccgtcgccgccgactggtgtcctcgcctatacggtcggttggtcacaccaccgttgatgggcatcgtcatctacaccgccggcctgcctccgtcgccgccgactggtgtcatcgcctatacggttggtcggtcacaccaccgttcatgggcgtccatgtcttcaccgaccggctggccttcgccgccgccgactggtgcctccgcctacacggctggcctattatgccgccgctgttgggcgtccacgacttcaccgccggcctgcctccgtcgccgccgactggtgtcttcgtctatatggttggttggtcacaccaccgttgttgggcgtctacgtcttcaccaccggcatgcctccgttgccgccgagtggtgcctccgcctacacggctggcctattatgccgccgctgttgggcgtccacgacttcaccgccggcctgcctccgtcgccgccgactggtgtcctcgcctatacggtcggttggtcacaccaccgttgatgggcatcgtcatctacaccgccggcctgcctccgtcgccgccgactggtgtcatcgcctatacggttggtcggtcacaccaccgttcatgggcgtccacgtcttcaccgaccggctggccttcgtcgactggtgttttcgcctgcacggctggcctattatgccgccgttgttggatgtctacatcttcaccgttggatcaccttcgttgccgtcgactggtgtttccgcttacacggctggcctattatgccgccgttagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctagagatgttatatcatatttttcataatatttatcttgattgcttgcgacataatctgagtacaaaagtacctatcgagttatggagttctatcttcctatgctttccgtttggtttgccaatggatagttgcctttaggccgattcctagcacccgggggctcgttggatggaccgagtaacgcaaggtgctaagtattattcggaataaatcaaaagcatagagataagataatttattttctgctcttaataattgcaaaagtacccgagtagtaaactccgatccgtgaaactttgttccattaatgacgaactcatgtcactcatatgcatgtttgggaagtgcttaggccgactcccagtgcttggtggctatgactagtcgggcagagtgtttaaacgtaatgagtcatctgctcggagaaatcaaaattaacaagagaagacatacgtatttataaactgcttgattttttctcgagtattatatttatatcagatactactcatcctatatgtttgttctgcaggatccagatccagatatgcataaaagggattcatggctttaagcatatctcttatgctccaggaatggatcagtcagaacatcaccaccggctcgcctcgaccgccgccgactggcgtttccgcctgcacggctggcctattatgccgccgttgttgggcgtctacgtcttcaccgaccggcttgccttcgccgccgccgactggtgtgtccgcctgcacggctggcctattatgccgccgttgttgggcgtctacgtcttcaccgaccggcttgccttcgccgccgccgactggtgtgtccgcctgcacggctggcctattatgccgccgttgttgggcgtctacgtcttcaccgaccggcctgccttcgccgctgccgactggtgtttccgcctgcacggctggcctttatgctgccgttgttgggcgtctacgtcttcaccgaccggccgcctcgtcagccgccgactggtgtttccgcctgcacggctggcctattatgccaccgttgttgggcgtctacgtcttcaccgaccggccgcctcgtccgccgccgattggtgtcttcgcctatacggttggttggtcacaccaccgttgttgggcgtctacgtcttcaccgaccggcctgccttcgtcgccgccgactggtgtctccgcctgcacggctggcctttatgctgccgttgttgggcgtctacgtcttcaccgaccggccgcctcgtcggccgccgactggtgtttccgcctgcacggctggcctattatgccaccgttgttgggcgtctacgtcttcaccgaccggccgcctcgtccgccgccgactggtgtttccgcctgcacggctggcctattatgccgccgttgttgggcgtctacgtcttcaccgaccggccgcctcgtccgccgccgactggtgtttccgcctgcacggctggcctattatgccaccgttgttgggcgtctacgtcttcaccgaccggccgccgcatccgccgctgactggtgtcaccgcctgcacggctggcctgttataacgccaactgatgctatcttcttcacggctggctacatcgctgtcactactaataggcatcagtatcttcaacacaagctgcctacgtttgccatggctgccgactagtttcttcacttccatggctgcatgattctgccagtgttgattggcctattatgccgctgttgttgggcatctacatcttcatcgccggtcgtctcgtctgctgctgactagtgcccttacctctacgtctggtttatacagctaccactactgatggacatcatcgtctttcgtcgccgactggttatgctgtcgccgactagtgcttttattttcacaactgcgcgtcttcgctaccagcttgcttctattgccgccgactcgtgttcacttcatcacggcgatgcaactttgtcatcatggtggagcgacttcatctttattatcttcgtcactggcaaactctattgctgctacttcgcaagttttgcttcttcaccaaccatgacgtctttgtgaacctcgacatctcggcatgcgatgccgtgttattttactacaacaagtggctctccaatattcaggatttctacttggacatcttcaacacatatcttcaatcaagcaatgactattcgatgacaagaagctacagttctcgactctatgtttagttgtttcccaactaatcaaagagtcgggggctacacaaatacaaggctcaaaatttgacaaattttatgtcaagctgaagaaatcaattcatcaacccacgagtcaactccaggagtcattatcttcatctttgcttcagagc

SEQ ID NO: 83040 - DNA, 2508 bp, Oryza sativa
attttcctaggagatagagaagggtaaaattatcttcagttctaggtacgtaggtaccacatcggtaccatatctcagtacattatttacgtgttcttttttaagatttacattttcttcttaagaacgtattcgctttgtaagcctccatgacgtgatttacatgctttgtagaattcattcactaacaacaaattatatgttttaggaattaaataactaattctataataccatacacctagatttcaatattgacccgaactcaaccatcttccaaatttacctcacgtttggctgatgtgcttcgccttgccattgtcgagttgatctcatctcctattcaattctcaaccataccaacacttctcccatttttttccctggtgaaccaatgcaaacactagaacaagaacgaagtgatgtgtaaagaagattcaacctgattttttgtcatgtgtagatctaatcgatgcctaaatcaatgcctccgaatatttacattttaagtattcgattcaacgtaatgccaatatttcactagttaattactctactgccattggttacaataatttttcttacatacctttctcctctcttgatcaatggtccacattaccccacctctcgataactctaaatagctcgtaaacactgtaaaacctctcatatcttacgtacaaaatgatccgtaactgtttgatgatcagcaatggcacacaaagatacacgaggcaagaataaagaaggaatataatcaaagaggtaaattttgatacccaggctcctaacattttcgctaaatggtgcattcttatttacaaattttcagcgctgtcacacagtcacacactaacacgcaggaccttgcagtagactgcagtctgccagctaagacgacgttggtcaaacatccaagacaaatcagtcttctacatggtacatggatagcaaggccagcaaaagaacaaaacacaaatcgtaaggtaaaaacatggtggaattccggacacctcccactcttagagcaggttgtcagattctcagagattgcaggtaagatcagtatcatatcattcccaggctacaaccctacaactgtgaatggccttgctcaagattaccatttggcagctgctgctatgtactcagcgatcccagcagcaaatatgaccgactatttatgcatcctttaattccttttcaagtacttctcgcattgtctttgcggcaattttcaggtagcaatatggacacgcagatactgtccttggttttgcacaggatatcagttattattatttctcattgtagaaacatcttgtaaccattgtgtgaattgtcggtacacacaccagtccaatagctaagaagatgccaaagagccaagtaacatctcaacaaaagtgtcatggtctcatggatcacagtaaaagaatgtaaattgtcatagaaggtaaaaccaccttgtcctactgagtccaactgagagatcattgctcaagcattatagctccacatggccgttttttagctagaaaacgagttttggggccaccattttctattgccattacttttaaattatttacctgtaaaaacttttagcgattaacattgccattattttcaatttccactactctccgtttcgaatgataatatacggcactcgaaggagaaatatagctgtaattgaacggtgacaaatgtctatgtttggcagctagttagaaccgccaagaatatatttaaatttagcggctgttttttgaccgccaaagaaatcatttggcctctaagaaaatttacggattcttcattcttatagtgaactggtactcacaacaactttaatctatccacagttgtatgaaaataacttgcttgacagatggcacaatacgcgaacaagaattaaacaacaataactatgcgatggcttaaagcaactgtaatagaggtggccagtacacttctactttatccgtatcatcatactttattttattggtttactcacagtttatcttacctttttctctgtacttttattagaaattacagagagcctactgcacgagggaaagttcatccagttattacatctcctccaacttttcacctctatctcaatggtgttccaagctgccaccccaagttttactgcatatgttcattgcgggctattgacatcttgcatggagctatgctaggattccagattccatggatggatatactactatgtaagaatatgtgtatgaaatttattagcgaggagcagagtttcgaactcagatcaagtgcaactagcttttctaataatggaatagaatatcctggcatttgctcaacaaattacagccaattattacaacgtaacactcaaaacgagtgtagttcacataaataaaacaagacaccaacaggtagcttggtcaatagtacaactaactaacggcatagaaatgaccacgtcggattattgcagctaatacaaag

SEQ ID NO: 83041 - DNA, 716 bp, Oryza sativa
  unsure (1)..(716): unsure at all n locations
cggcgccttgatagattgtannnnnnnnnnnnnnnnnnnnnnnnnnnnnnnnnnnnnnnnnnnnnnnnnnnnnnnnnnnacgaggtactttaattttatggtcctaaagtactatattttctagtgcaaacctaacctcataggttaattggaaattttggtaccttcaaattttgcacgaggcactttaatttttcattacaggcttgggactcaagcacatctaagttttacatggaccatgttgaaagttcttgtaattgcaaatcctgaagcagcgtagagaacaacttgctcgttggactcgagcaagatcactggatatatgttccctgtggtgatggttctaccggatacaatccgattgattgacaaaccgatcatcttattacaaggggcactgctttgctctctagcccaaattaaattaaatgaactgcatcccgcttgttcgtcatagccctcttctaattaaacaaatacaaacagcttaacacgagtcccttcggaagtaaattgaggctagagataaatagcattgtcctggcatcaatgtgaccagccgtatgaaatgctagcttttgtgaggtctgcgccaagttaggatcatcgcacaaaccaatcgaacccgctcttcactgaggcagatgagtggaacaagcaccatcgctacattgtcgtgcacccagaatgatcttgagccggacttgatgtgt

SEQ ID NO: 83042 - DNA, 1631 bp, Oryza sativa
  unsure (1)..(1631): unsure at all n locations
ggtatgtttgggaagttttgattcgattagctacagctanttctagatttaaaagtaccataaccatttaagcttttttgatggattaaaacgaagctaagctttccctaagaagactctctagttagctcctaaccagcgtgtcaacttcatttccacttcaataaaaaagaaaacattttcatttccacttgtttgatgttgcctcattttcagttttgcacagcacttgatttcaaagcatttcatgtgcattactgcattatactttcctgctgaattcaacattggatgcccgtcctgaagtggccgggaggtctcaaatcatgaacatgagatctgcagagatgcagacatgcagtgcagctaatctggtgaccacaacaaattcggagaaagtggaccacacaaatgacacaagtcttgaaaacaggtctccaattctccacggcaagcaaaagaatcagaaaatgtgaatttcatttgaatttactcataaatcgtcatgcattaagtatatgcctgcctgcctgagtacaaggaacggactcatccgcaggcttaaactgttccatatcccaaaatgttacagcctccaaagctcaaatcgaaaccagcccatctgttatctatatgactattggctaaactacatgtaattcaagtattcactttttgttcaaaaggaattcaagttttcatccatagctcaatcagaagaggtactttgatagcacgtacttgggagcaggcctcctgtctcccatccagtgctgcatatgcaccccaatggcgtccaggtgttgcccgctccggccatggaagcccacaaccttcccttccgtcttcgccgacgagaagtatgccccgaactcctctccgaatggcccgtacttccctcggttgctgatgaaggtgatcgacctcagaaccctgggcccttcctccctgttggtgttgtagtagccgtatacgcatgtcaggacctcgtgtgggtagtccagtttaatctgcaagtgcatttggagagaggttattgtttgacatgccaccgaagaatgatgaacagatcctatattgttgttgtatgtttcatgaattttattccttgacaacggaacttgattgataatagcactcagtactcaccctatgggttatgtggccactggttccatgccttgcagaccagacggattggtcacccctgtcgtactcgatctgtatcgagccgataaaggtgcctctcatcacatagacttgcttcacaccagtgtagacaccatcatcccatggccggcctccttcgccaccccatggccctggccccattggaactggttctttcaccatgctataaggaacctggaaaacggttacaagttagctctgcagccacatacttatgttatgattcagacaagaattgtagctacctcattgtatgtttcactccttgattgtgcaagcatgtcgtagcgcaaagaggggttcatctcaatcggtgatctactactaactcgcggggcaagcaagttacctttcttgacatggaccccgatgccatcaatgtaccatccttncctaccatggaatcctactatccttccatcagaaaaactggtggagaa

SEQ ID NO: 83043 - DNA, 1372 bp, Oryza sativa
  unsure (1)..(1372): unsure at all n locations
aggtgccgagaacaacgacgcccggaaaccagccactatcgcaagctggcagccgcataaacggttcaagagacctgaaagcacccagggaactcgattcgctgacctactggatccaattcacaattcacgcacatgaaaagaaaagaagtcttttcccaaccactgatattctccttttccggacctcccatgcctgactgactttgcatgattccctgcattaacgatgtagaattaaagaagcaatcgatatagaataaaacaagaaacatattttacaatatcaattctacatcagaaatgttattttcctcgttttttttcacgcgtgtctcattgtatgtctgtggatggaattggtccggcgtgaagagagattaaggggcaaggccgtggacaagaaatgcagaatctttagcagaaatacaataacttgcaggattcttgattcctcttatgagatgtgggcggtgatcgattgtcacttcactcggttcttgattttactaagtggccgcactaagaacataaaataaataaaagaaaaatggaaccaaagaatagatttgtttcccgaatccatagcatcgcaccatggcaaattggcaatgccatcaaatttactcttcctcccccattagcaaatcgcaaccacacctctatgccttctagcccgcaaacgctaaccatgcgaaaacgaatctggtgagtttttttttttttgttcctcacctttatgaactggaggacatttggacatcggcgcgggcgtcgccgcagcggaatcgcgcgctcgaaagcaaagcggcggtcgacggtgtgaaccgatcggagaggccgccacgccaccggtggcgtaaatccggcgccatagcccataggtttccccctcttgcggctgagcggcggcgccgacgactccatccgcggcgacgattttggggaggatggaaggggaagaagacgagccagtctactttacaggagggtcatttttgtaaaaaaagttactagtaggatctaagcagaaggggggctactttgtaaaatgtagggcaccagccattgtccgttgcgaattgtgatcgggtcagtatgggctatgctgtaatatttaggatcatacaggggggctactatgtaaatatatgggctattgtgcaaaagttagagttggtaggatccaagtaggggctattttgtaaaagttagggtccccgtcccgtcgccgccggtgagctccgccgactgaactcggcggagacgagcacctccannnnnnnnnnnnnnnnnnnnnnnnnnnnnnnnnnnnnnnnnnnnnnnnnnnnnnnnnnnnnnngttntacaaaatcagaaaacaaaagctcgg

SEQ ID NO: 83044 - DNA, 6212 bp, Oryza sativa
attctcggccttctgcctttttcatataccaaccagctgttggcaagctagttccaagctcgcgaatagttggccatcaacgacaaactttccagtcatttctcgagtttcagctgaacagtccaagtgactcagagtgtgtatcaattgaacaaccggagtgactcaaagaggctagatcactcctgatgcctcctaattctacgcataaaatattgtatagcagagcctataagttgcatgatacatttccaaggttgaggataattagctagcccgtacccagtgacaggcacattaggattgctgtccttttgtctatatatctaccaatagcacatagcactatatattgtcccacatatgcatgtattgccatggaccacatagtatttagaaatatttaccctaaagtaatattaagaatattttcaataatctagtatttatgatactttatatagtactttccactattcttttgacacattgttaaattaaaccagtacaacacgtttttagcaagcacatgtaacttatcagtcccagtcccactaatgtagtatgaattcatttacaactttcattgcatcacaccaatttgctagtaaatttgttcccaatgattactccatcaagtacaaccaaatatgcatgttcgagctagaaggctcttaatttagcactaacctttgtttgatctccatatataatttgatattttacacaacgcgtttaataaccctctcaaaattaacctagacgcggcctcagtgattagtgatgtgtgatggctcctggacctacaaatccacaatgaggaggatggctcttgttagcttggacttacgtccctccagtgcagaaacaagcaggaaatgcgacatggtgcgtgttatctttgtgccggcaaggtttaaatttgccccctactggtttggaacggttcatccactctgcgcatttttcatgacccccaagcttggtattttaggttccgtcgagatgagggagcttgcttaatttcatgcgcatcttcaggatttaattttaacaggcgtttcaagagagtcttgcagatgtcaattggatggatgtggctatgctattcccgatgccacctaattcgacacaagttgtccaaacatggatgtagagaaactatatatactccctccatctaatttcggtagtcatattttatcttggcacaatgaccaaggataagtaattgtactttatcatccattttaacatgctactagttattcctcgtaaacaagcgattcattaatagtaaagttctcgatgctcatatagccaatcttgtgtggaaaagtagagaatcacacattcaatctgataaagtcattaagaggataggtggctggattgaaatatgcctatcaaaaaataaatctttaagatttggaaatattcctatcaaaatagatagagtatttcaatgttaattagagaaagagtaaaatacagtagcggcccttaaacttgcgggcggatgtcatccaggtccactaacttgcaaattgtgtaattaggccactaaactttctaaatgtaccatcgccggtccaaaatgccgtttgaccgcggtcgcgccaacgtggcatgccacgtgcatagctgagctggcccgcaccgtgcgtgacacaccgcccacgccttgtcgtttttcatccaggtccctctctttttctcatttggtttccaccactgcttcttcttccccggagcgcccaaaatctgagcggcgactagggatgcgattgagggcaaggtttggcggcggagcaggtcgcggcaggttcggcggcggagcaggtctcggcagggttcggcgacggagtatgtcatggcagggttcactactagaaaaatcatttgttgctacgaaaaaaatcgtggcatcaatactaaaattgtggcaatagatccatgttgccacaattttaaaatcgttgctagccgtggtaataaatagcgtcgtaataggttattgcaacgatttttattttgtggtaataaatttagatgttgccacggaatggatgtggcaaaaagtcatattgcaacacttcacgtcgttgtaataaaaattattgccaccactccatatgtggcattagttttatgtaccaaactaaaagtttaaatattaatctatcatcctatctattttatctatttattttttttgatattgtgtcttggctaggattcgaacccaagacctatccttcacacatgctctcctttaccaactcacctacgcatcaattctgttgaaaatgcatatcgttccatttgagcctacgtaactgagatttgaatcatagatttgaatatctaaaagatttcaaatgaaaaggttatcacctataaaattgtagatctcgttgagagctataatttccatataaaatttgtctcaatccgtgttcatatgaaaaaattaagttaaattatgagacaacaatttttttattgcaacgaatttgttgatcgtggcaacaaaaaatagtgaaaaaaagtaccatgtactatgtaaattgccacaaaaattaaaattgtggcgatagaacatgttttttgcaacaatacgattttttgtggtgatatctcattttctattgcaacaaaactactaaataaaacaacgattgtagatcgttgcaataaaatataattatttaccacggaaaaattatcattgcaatagtacaatatattgctacgaattattttttatagtaataatttggtggcaatagctcaattatcttgtagtggttcttcggcggagtaggtctcggcgggcttcggcggcagaggcgatggcaggctcgagctccagtaggagcacaacacggtcggcgaccgaaatatccaggcaaggtaaaacctttccatctcccattcggtacctggagagtagtttgttgaagtcagttggtttattcattttgaatgtgcagaatggtggatgcaaattatggcagtggtatgaaccagggacaacgctgtatttgcagcaggttttgaatgatttagtcagcactgttcgtgaagtgaagacagagaactctgaaattagagcatcccttgccaactcaagagctgtgattgatggacttgtcactgaacgcaatgtctatgaagcaaagagcatgggacaaaaagaggaatgtggctcatttgctgaaatggcctgtagaatcaagatgttagaagagagtagatgatttatgttgtcagtaattgttggttttgtagtagtcatatttgcactattgcttcttaggtagataccaaagtttgatggatatggatgtattggtgctggtgtgttttgtgtcagctaataaggcacttgagtgaccttttgtgtatgctgaatctgaaccatgtatgaaaaatgtatgctaaatgctattatgtgaagctgaaatatgagattttgttctgaaaatcgacatctctaattttttttcagcagacaactgttattttgttctagcttatgaaatgtcttgtaaaacgtcatctagaaatagcaaacatgcatcatgcattacaggcagtaatttcccatattcatcacaataccaaatttctggcatttagtagtatttctagtactacattcagtgaacacatgtctggcatcacaaaattcccatgttctatcataaaatagccgcaagtttggcagcacaaaatcaagcaagcatgcccatgaaatccatacagggttcaaattttggcataacaaattactactagcactaaaggaccatcaaacatatggtctaacacatatcacttgtttgtagcagtagctttcttcccgggagctctgttctttgaagtagtagcagcaactcctgaaactcctttagttgtacacttccttttgttggccctagattttccctcttttgttgctgtggtcataggggtagatactacagctggctagtttgaaaggatgtactggttatctgggagaggaccatgtgtagtttccatttgactcacttgtgatgattcctcaaacatctgtgcaaccataggattaggaacttgtgatagtaattggtcatatgcagactgagattgggtcagcacctacaagtttacaaaggtaattaagatagagttataatagggtagtgataatagagtgataagatagagtattgtttcattacctctgctggttcttgctcagattcatgccactcttctgtagaacttgcagctgggatcctacttgtcttcagtttgggtctgagtccagcctttctcagtgggcaccctttcttgttatgtccaggctctttgcagtaagagcagtgcatctccacaccatgcttggacattttagacccattttttccctgtacctcatgtggtgctttcctcctagacttaggtggtctgccaacctttttctcatatattggaggcttcacttctggcccattcacctgagcccacttagtcatatcattgcagggccaaatgttaaatgcatatgcagggtggaagaactgactcagcactaattctctcactccttaagcatgagatagcatggttacaagggatgcctgtcagatcccatctcctgcagtcacaatgtttagcactaaggtcaacaatgtactaaaaattcctatcttccacctgaaaaatccctttcccggctggcaaaacataacatgtgtttgccatatctgcatttttcagtactttcaatatcatttgctaattggactaactttgcaaaccctccaagtgtcatcttatcatttgctctaaaagtttcaatgtacttctcagatagccatttagcagtacaccttttcagcacccattccttctgacatttatgctccccaagatatgtcttcaccatcattgacttggacctgctatcaaatgatgcatataagttccatgggcaaccctcaacacaatgggccctaagtcttttttgctcattcctaggcatcttgatgtccactctagccttcaaactgtactctgttatggcctttctaagtacttctactgaaggaaacaccatgccaaccttaaaaactgggttcttaacatcctctgccatgaaagccttaaactttaatctcacttcaccatcatcatctgaatctgggagctgcaaatcttcatcatcagtggaaacttcctccccatcagaatttctaactactatttctttccccttcaactgactgcccttagctttcttccaaaactttgccttgcagtcagataagtcttcaacacccacatcaacattgtcaacatacaagtcatcatttgcatctgatatatcatagtcactatccataaaatctgggtcatcttctaagctaccatcactgtcactgtcatcttatttgtttggcaccttcctatcagcagttgacatcttcctaggactaagcaccttaggcaattcactaataggattagctactacatcatcccaatctacacctgcaattgtgtcaccctgatcaaagtagataataaaattcttaaccttgtgcacaactgatttcatcacttcaaagtcagccctagtagatataaccctaaggccatcttcaagagtctttccagggagcaaccaataagccttaaaatctggagtcatatcatacccaagcatagctaaaaattcatccaaacaaacaatatcccatgttcttgcttcacagtggtcaatccaatttatcgtttgatctacatatgccctattgctaccctgaccaacaaaaaaaccaccatggtgtacctcagcggtgaatttaccatcatcaagacctgcattgcaatcctaattagcggtattactctcatgttctagcctactcgagaacaatgtcaggataatcatcctacaggaaaaaataacatctttttgcataatcaaacgccatattcctttgtatctatctaccaacatcaatcagtgcatgctaaccttgcagattaatggatgaaaatttgaaattacactcactgtacaacggaggcccttccccttccaagcggaaaatcatgccgcctccccgcgattatggccagcgggaggccgcaacagccaatctcgcctctttgtgctttcgctggaaccctatttctcggcgatcactccc

SEQ ID NO: 83045 - DNA, 709 bp, Oryza sativa
  unsure (1)..(709): unsure at all n locations
gcgcgcatgnaattctcnttccnnnnnnnnnnnnnnnnnnnnnnnnnnnnnnnnnnnnnnnnnnnnnnnnnnnnntaaacggctaaactaatttcggtgctttctctcagggaccattttgaatattacgcgttattatttggacctacctgcaaatatctccttgtctttccgccatcagctttcccctcctaaacctctccccattccctcgcaaaaccctcgtctcctccacactctgctcttctcgcaaaccctaatcccacgcgcggccaccttccatggggcgctcgacctccctcaccgaggcggaggcggggatcacctgcttcgcctccttcctcccgggctttcgcggcgttctcaagcaccgctacttcgactttatcgttcacgaagtcgcccgcgacgganttcgtcgccgcctcaccttctttgatcttcccgacgaggtaagcttagccctctcgaccccgatttcgcgggttccttccgggatcccccgatttttttcattgcgctagctcagcttcgccgtgtatcgcaatgcgtggatgtgagtgaggaagacaaagggngcccgtccgcgaccggaccactcggaggcccttaagtcgtcctgcgctcttggcgatgcgaatgcgacccgttgaagggcttcctcagaagcgtccccgggcctgagctattatttcccgtattcttcgcg

SEQ ID NO: 83046 - DNA, 749 bp, Oryza sativa
  unsure (1)..(749): unsure at all n locations
tcctttttaatgaagggacggtcaaagttaccaagtttacttcggaaccatgctgccagtgcaaagttgaaaaatatggtcagtgcacttcatccttctacagctatcagtttaagttgaatcatgatgcagtttgataattttttgatacgggctacccttgacctttttcttcaggcgtgttacctttggtagtttaatatggtgaacttctcttttcccattcctccttatgctaactggtgtacttgacaggcatttcgcaggctgtagaaggtgacttagtttatagcaaagagccccctcctggagaagcaacttcagttgatacttcagaaccttgcgatgaccaaataaattcatctgatattgatctatgttgtgagacacttccagaagaaacaatccagtctgtgaaggtctgtaatttgcagcaaacaatgcggtgtacatgctcatgcacaaaaagttcctaatcatgcactgtcatttctcgtgtagatagttgattctgaagatttattgaagggtgtctacacatttgaagatgttgtccttcctttgcctgggtatttaccattccacatccataacttcaattttcatactgaatcacattgagaaatatatatggtgtgcttatttctgtaaacatgcagttcgcaagcattatttcctggaaacggaannnnnnnnnnnnnnnnnnnnnnngntgtgtgcacangtgcnagtgactttcagttgagcag

SEQ ID NO: 83047 - DNA, 22647 bp, Oryza sativa
aagatcaatccatctttactcccgggtggtatcaccaaccgggactaaagtggtaatcttctagttctggttggtagtataaaccgggactaaagatcctcgacccccggacatacatctgacaggagatgaatcgggactaaaaatcatctttagtcccggttggtgtactaaagatcaaaatttttttaactgagactaaaaatcgtttttattcccggtttttaatggaaccgggactattgtgggatttggtcgaccgaccaaaaatggtttctccaccagcgatggtatcaaattgtttccgattattagatatagaatgggcattgttagattcaacgatcggaaacgatctgatactgtgaggtaccggtacattaagacttttttttttaccggagtaaatctcttatacactacactaacacatgcaagtgctcccccaggtcattagtataaaactaaaaaggtgccacagcaacctgtactgttctgttgactggtttcactgcttgcctcaagtggttatgggtgatgaaccaagtgctaaatgagcgtgcaaccttcgaattgattaaaacatttcgctttgatttgtatgggccatgtgaacaaagaactggattgagcatcatcccatgggggccgctgggctaatatgacaatggagagcaataggaatgcaagcagccagcgggcggcctgcatgctagcttaagctatggagccacattaatactatgtaccaatttcttcgaaccggtatctattggtacttaaaggtaccgctttttaattcttttttcaccttgtgaatgtgggaaacggtcaattggtgccggttttaaatgaatcggcatctataagccgtcacttattaaggtttttgtagtagtcgaaggagatttggagattaaggagagaataaaggagggagggaagaatataataagtgaggtgcgttatctcggtcttttcaggtctctttacactccggctatgaaaattgattttgcaggcatacgcttaatttgccaattagtctacttaagaatttgtccacaaaactcgatattcgcaagaggttaataaccatggaaacttggtgtttttggaagcagctataagcggttatttttctcgtccgcctgcaaaataaaagggacgtgttgtaaaaaaaaaaaacttttttcaagtattgtgggaggctaggagtattttgtgcacacggtcgccaattctatgttttactcttcctacctttcaagcaaaagtacattatttttccatttgagatgaagtagaaaaattaggagaaagtaatgtgaccgaaaagaaaaatacgagggagaaaaaaagagagaagaaaaataacttttgacggtattggtttagtcgtgcaagcccttgtgggaaatccaattgaaacgacattaagacgaaaacagttcgtacatctttctttgtttcattcatctcagaattaccattcactagtactgccatcccattctcgacgggcagatgcatgatataacttaagacaatatcagttgattgtgatgagctagatcgaggcgcgcatcaaactgtcaagcatgtagaagccttatttcctggagctaaaccatgagtcccaatgcctcccaatactaaactagccccttctttcttgttacctaggcgccatcatatggctaccagtgccgcttgcaaatatgcatggatgactatatatttgatgattattttctcagtaaagacatccaacttatattataagtactatccctatctgatattgcctcgtactccctccgtcccaaaaaaagacaaaccctgagtttccgtgtccaacgtttgaccgtccgtcttatttaaaaaaaatataaaaaaaattaaaaagacaagttacgcataaagtattaatcatgttttatcatctaacaataatgaaaatactaattataaaaaacatcatataaaacggatagtcaaacgttagacacggaaactcagattgtctttttttttttttaggacggagggagtacgtgtttcaatctatagccatatttgtaagaagtaaactgctactgtcctgcgtgggctatatgcttttgcaggctgcagccagcgtcaatgctccaagtttgctgcatatgtaatatactttgcatatttctggtgctttatcaactcaataccatgcatgtacatagtgaaaggcctgcaaacttttgaagtatttgcttcagctgcgtattatttatgctccaatatgtttagctctgcgtgtacgtccattatagacgtagagaccgggtttaattttaacacaaattttaatgcttcctccgtttcaaaatgtctgacaccgttgactttttaagcacatgtttgaccgttcgtcttatttaaaaaaaatttatgaaatatgtaaaactatatgtatacatgaaagtatatttaacaatgaatcaaatgatatgaaaagaataaataattactttaattttttatacaaaacgaatggtcaaacacgtactaaaaagttaacggtgtcaaacattttgaaacggagggagtatatctctatgcaatgcagagtattatagtcagaccaaaaagaagctcactcccctttgctaaactttttcacgtttgccatgctaaatttcctagtatacgcgagctcgctctctaactcttagcaacttcttgctgctaaaaataatgaagcctccaagtactcaaatatgtgccgctgctctcctctattgcccgcagaaactagcatgaccaaacctagtactagatttctctgcaatatcgtccctttcatggagtagttccagctcacacaggcctctgcgtctcttgaccacatacaaccagcctgctgtcttggatgaggtatgtaggccgtattagggagaagtttggaaaaagttggtagtttgaaaaaaaaaagttaggagtttatgtgtgtaagaaagttttggatgtgatgtgatgtgatggaaagttgggagttggaggaattttcatgtgactaaacagggccgtagagccaatgttgggcacacagggtcataatcatgtacatatagctatattccctctacaccagagatgacacatatctactcttagtacggaccttcatccaacaagactcattaactcttaccaaggaagtatcatgaaacaggcgtgtaggacaattcctgatgcctcttaatcataattacctttctcaggactaagattaatctctcaaccatattctaagaccaaagatttcagtaggtgctctactctctgtacttatttggttctttttgtcagcaagctggtcttctctgaattttggtgcaggcgtgcagccactccatatatatttgcttgttggctgcctaaggaagatggaaagttcattaaggctatctatgtattgcagcatcaggtatacaggagaaagattaagagaaaatcccctatatacccatgaaagttcacctaatcccttctataccttgaattttgctcaatcccttacatacccctgaattttagtttggatcccttccatgccctttccgctagttgaccgttagttcaccgttaaattcttttgaaaaagtccattttgccctttgctatgaagaaacataataaattaatgaagtatattgttggaatgtaaaaatttattgaatgggactattatatttatgagtatgtgatgcaccatattatttgtgacaaatttacttttacatatgatataaaaagttgatacttatttattattagttattaaaagttcttttatgtagcatatgtgttttcatagtaatacaacagatttgtttattacttcagaacacatatgctaaaaaaaatcttttaataactaataaataagtattaattttttatgtcatatctaaaagtatatttatcgcaaataatatggtgcataactatctcataaatataatagtctcatataacaaatttctatgctccaacaatatactctattaatttatatgcttctttgtactatagggtaaaatggactttttcataagaatttaacggtcaactaacggtcaactagcggaaagggcatggaagagatccaaactaaaattcaagggtatgtaagggattgagcaaaattcagaggtacagaagggattatgtgaactttcaaggatacggagattttctcaaagattaaacaaggcagtaatttcagacatcctaaaatgaattgtgtgagaggacgataaaaacgccatttcgatccatgactcgaactaccagccatatagtgatgagcgctctcaaaattatgcaaatatatatacaacgttttcttggtaaatgcaactcgatgcctcccaaaattacaatagatctggttaatgcagcaacatagcgcatgcaaagtctacttgacaagctgagagaactattaaggttttgtgtaggctatctatcactattttgacgtttgattttgccttgatatttacagcataacacactttgcatttcactggtaattcatatccaacgcatgtggcaatacattttattggaagactactgtggcaatacattatgatttagtccgtaagaacctaagtgtctaatgaacaatgtgcgtgtaaaatttctcagtactgtttacaatcatagcaatgcataggttgcacgtcttggtgacaaatatgagcaaccgttctaaacaacggtgtttctagaccactaacattgtttggccattttaccagattctagagtatgctgtatctaacatccagagaactgttataaaaccggccccgatagcacatcgagaaccaaacattaaaaaaacgtcatgggagatccaaacacgatgatgacaccgagacacgatatttgttagcgaggttcagccgaagcctacatccctaggacactgattacgggcgctcctccccgatccgacatattacagagtatcagaattacaatgtctcacggccggacgctgccggtagctgctccctctcgatatgctaagtcgtcatgcggttataacagatctgtccctctatttaagagagattctaagatagagtgtggctcttattcttttctgaacacgtaatataactctaagttctaaaccgtaaccgactttgtaaacatatttgacgcaaactctaacaagaactatataacagaatttagaatcctccgaatcctaagcttgttaaggtctgtaaacaattaaagatcgatatatcagaggatgccccttagtatacccaatttattagcaagaggccagcgcatacgtgcatggtgaaaggcctcagtttttttttaaacaaactggccctttgtttatactgcttacaatctattctccaatatatttgtggataaaaaaactttatacaccttacaaaggttgccacttcccttcaattcatttgtttatatatactggccttttgtttatactgcttaattactatttattctttgtactgcgcaccacttgcagtccaggttaccaaacattctcattcctggttcccagatgtacctataccttgtgttgtaaatcttatttgtgacttaatttaacaggaacgaccccgcattgcaaatttcctgctttttcctgtgatttctgcaaagttgcccaagaggaaatccggaaacttaacaatcatattttgccgttttcataggtttagctgcatttctagttatccaaatacaccacagaacagcaatcaaattcttcatatccttcttatggttacgaaaccagccccccacgagtgatgacgaatatgctccacccataatgaaagtactatcaactacattccaaattaacaattaagcaaataggcattttagaaacaaggatcgatgtacaagaagatgaatacgtattgcatgacacgaacattttctagcaagtacatagggcatttatagcagagccataagacgtttgacggcattcaatctgcatatattgtgtctttcgtaaagttgtatatgcacgtactgtatgactcgtttgattgcaagaatagagtattgcttgctgatcctctcaatccgccggcatcgagagagagagagataggaggaaattaaagcctgaccctagtcatctactcactgatgccacgggaaggggggaggggtcaccgtcattgccaggggtcgccagcgtcttggagaggggaagaaagccccagctagccttgtcaagctaagaggataaacaagaaggctgggaaagagcatctcgtcctgtttctagaggacgaagttgaccaagaaggaagaagcaggttaacggaaatcttgacggcgatgacatggttttaatttggcaaaaatattttaacaattatatgtacccaattggtgcctcgcaacgcgatcattgtaagagggggatgcagccagaaacgaaacagcaagcatgcatggtttgaaatggttcttcgcgtgctgcctctttcatggaccaacgagctgcaggcaagctatttccatgctctcgaatagttggccatcaactacgaacttcccagtcatttcttgagtttcaactgaacaatcggagcgattcaaagccttgagtagtgactcaaagaggctagagtagactagtcctgatgcctcctaattctacgcaagttgttgataaaagattgtatagcagaaccaatgagttgcatgatacatttccaaggttgaggataattagctagctcgtgcctattgacagtcacattaggattgctggccttttgtctatatatctaccaatagcacatagcactatataatgtcccacatatgcatgtattgccatggaccacaaaatagttatgataagtacttttcacttttcttgggacacattgttaaattataccagtgcaacactttttttagcaagcacatgtaacttatcagtccctctaatgtactatgaattcatttacaaattacaactttcattgcatcgcaccaatttgctggtaaatttgttcgctatgattactccatcaagtacgaccaaatatgcatgttcgagctagaaggctcttaatttagcttttacctttgtttgatctccatatgtaatttgatgttttacacaaattaacctagacgcggcctgatcagtgattagtgatgtgtgatggctcctggacctacaaatccacaacgaggaggatggctcttgttagcttggacatacatagatccctccagtgcagaattcatccaagaaacaaagcaggaaatgagacatggtgcgcgtcctctgtgtcccgacaaggtttaaatttgccccctactggtttgaaatggctcatccactctgcgcatttttcatgacccccaagctaggtatttcaggttgcatcgagatgatgaagcttgtttcatgctcatctacagcatttttacaggcgatccattagagccttgcagatgtcaattggatggatggggctatgccactcccgatgccacctaattctacacaagtcatccaaacatggatgcagagaagggctaaccaaatgtgcatcatatatatatttcaatgttaattagagaaactatctaggagagatagaagcttgagcttccgaatttaattctggcctttggtttgtcttttgttttaaaagaactaagcttctgtctattatatcgattccctatgtacatggattggcaacaacgacatggtatggttgattttatacaccctactacagaaacggtttttacatgcgggtgaaagagatttttgcatgcggttagcacaaccgcatgcgccaaaaggtacgtcaaaatcggttttttcacatgcaaaaaccggccgcatgcaaaaataaatttggcgaaaaaaataaaaaacaaaaaacccacaaaccctatcacgctgcccaccgtcggagcgccggatccgccgccccaccacccgccatcgtcgccggggtcagatcagccgcccccacctccagtagtcatcgctgcccccggatcgactgtccccaccaccggatcgattgtccccaccgcccacagtcgtcactagtcgtcgccagggttagaccagccgcccgcagttgtcggcgaggccggatccgcctcccgcggtcatcgccggcaccggatcggccaccctcactatccgccggtgccacatccatcggccccgccgcctgcggttgtcgctagcgccggatcagccacccctgcctcctgcagtcgtcgctggcgccgcatccgccaccccctctgtcctccgtcgtcaccgacgacggatccgcacaagggagggtccccagtgcctgatccatgcggggtggcaccgcccgaggcggccgagccgccaacttgatcccgctcggtgatccaatgagtgaggctttcaaagaactacaacctttcaagtagtttgtcacccaccaactcagtaaccaccacacaagcatcagcaacgcttggcctccacccaaccacaccagcgcccctccgtcggcctacttttgaacaaccgcaacaccccacaagctcgcttcatcccaccgttcatcccatgagaactagcctaggcctcctccgtcccgccacccgtcggcctccttgccatgttcaaccaaaggagaacctgtgactggacagcgttgcttcggcctcctgagcttccctcgctgaccagtagtctgctcaactcaaccgaaaaccccgacgaagaaggggaggagctccaggaaaggggagggtgctgaccggaatggggaagacgacccaccaccgccagctccctttccactaccgcctctcccttgcgcactgtcaccagggcagcatcgctgaatccgaccgttgcacgaggtctccagccgtgccggcaccaccacaaccttcaggcatcggtgccccagcctcccaatggctgtgcctactcaccactggccttgatgccacccactgccattgctgcgcgaggcgccgccgtcgccactagtcacggcggctttgaagcctcccggtgcagtctctgcgcgagggccccgctaccggccgcgacagcattgaagccacccactgccatcactcatggcctcttcaccatgctgacaattgtcgctggcctcgacagtctccaactgccacgggttgttccgaccagatccgacgcgataacgctagatccacacgtggggtgcccggatccggccacaccggcaccggatccactactctccatgcgccgagtcaccatcctcatgctaaggcaggtcgccactggggagaggcctcaccaccaccctcccggctggccgcttggttctccagcagaacactccggtggcggcgatgggagggacaggaaggaagcgaggcagcaatggggctagggttcgcccccccttgccacccacgtgagaggacagcgtggcgtctcgatcttgcacgcccgcctttctctttcatccaagccaatcggggaagcccattcatgctatttttttgaagtcgacagcatcgtcaataggaaggtaccaagccggtgataggagcattggtgcccgtgcacaaccgtctacatattaatcgatgatatttctttctcatagtgctatctccccgccacctaggtataaattccaaaaaaatgcattgataggagcattgtttcgttattgtacttgccattaagataaagattaagtacgggcacgcaaaatgataaagctattaacgcattaattgagttttaattctttcaaaacctgaaaggatttatttgatattttagagcaacttcaatatagaaaaattttcacacgaaatacaccgtttatcagtttgaaaagcatgctgataaaaaatgaatctgtataatcgaaaaaaaacagggcagtccatgtacactaatttgtcagatatgtcataattaaagtatttctaccattctttgaaggcccatgatcgatcaagaaagctagcagtagttaattttctgagcaatttagcatccatgatgttggatggtaaaattgctctaattttctcgttaattccatagagtcgaaggccgcgaagaactttgcacgtttaaaatctaccagttgttcaacaaggccgaaataacaattcaattaatgttttactttgcacatagcaactaataccataaaaattaacctaggcccttccacaccattattgagctatgagcctatgatgacatgtactcctacatatccaccattagagcaagtataatagtgagctataagcctactataaacttatgtggaggagagatgtaacaaaaagttaagggtgttggctctcatgcaagagctagcttaacacaagctccaagacaaatataattaatatataagttagagatagagatatgagaagaaaattatagccaaccttatagctaatctattagagcaagtataatagtgagttataagcctactataaacttaggtggaggagagagatagtgaaaaattaagaatattggctctcatgcaagaactagcttatcacaagctccaaggcaaatacattaaatgtaataagtgagagatagagagaggagaagaaaattgtagccaaccttgtagctaatctattatatatgttgactttaagatggactaatagtaggaaatgggctatattattatccttgctcttatatgtgctgggtttaagattgactaatagtaggaactgaactctattattatccttgctctttatatgatttcgctagcatagatatccaggcttgcagcgctgaactcgggaacatgtacaggaatgcaatgaggcacgacgtgtgcctcaacaggccgaacactatcttgctatggtttcaactgtttcatcgtttccttgcattttatattatattacccgcaacctatgcagtctagattctgccaatgatgaggcttgtttcgatgttgccaaacatatggccatccagttgcatttcaccggcgattcttgggtaactggtgaaaggaccaatctgagttatggggctacgacactcctgatgcctcccaattctacacaatctgcccaagcatggatataatccggagtagcaagttttcattggcagcaacatgtttgctcctgccctctctttagttatgaagtcttatagagatcgtgatgacagctcccaatcctattgactatgctatactttatccggttaagttctcctagattgataggagtaactgaattacctttcaaggctagagttatgcatggtctatttatatattgcttcgactagctagagtactcatcaaagaaagaagtaaaaatatcataaatcaatagcatgcggtaagttcctatatatgcattcccttgattaagtatatttagaattttcaggccccatattttctcttatgcttatacttatcagtcgaatttgaattttcaaccttaaatttagagtgatttgaaggtttttttcatcaaagtttattttttagcctttgcttttagatcgttcagaacacatatataaaaagttttattcacaatttatttttcatttgcaagtatgtcatttggctttttcctcgaataagcgaaacaatggactgatgacaccttgcaagacaaagggaaaatatatagtgcaaacccacacatatagtgtaaacctaaaaactaccgtagtatccacgtcacctcatgtttaaatatgggagtaaaaattttagtcaaggtcgtaacgtgaacaaatctcatacgtctatttttaaatcatatgataggttacaggtttgcactacatcttataaaccgatttcagggtccgatcccagacgttccattgggccacgtgtcatcgtgtgttgcgctcagtcgagattctcggaaggagaaggtgccacgtattcgcacccctcacacagccgttagatgagaaatcaacgttagaggagggggtgatagcaactcgatttacgtggactgctccgcctggacatgcaccacctgggggagggagaggcgacgccggcggagggggatggaagcccccttgcgcctcctcgatgtgctcgagccggccgcctcctcgcttcaggggatgtcgatcgagggcgagagtggaggggagaggaggctgagctcggcaaggagctgacgctgatagccagcgacggatggagcagttgaccggcgggtggatttgctcgtcatcgccgccatcctgcgccgcgggaggttgctcccactggtccctgtgcctgccgctcatgcgctcctgatggttcattcccgtctctgcttgtggacttgtgattatgggattggaaacgaatggtcgtggcctggtggaaaacgctgctcgttcctaacatgcgcagcagtagtactctgatctgcgttccttttcctttttttttcttttctcatttaaggctgcattaagatgacaaatatagtactatctatatataaaaaagacatatcagatgcccctatattacttataacctattggttgccctaataactcaaagttaaagctaaaattaaaattttcaaacttaattttgaagttgattttaagatattttcaacgttgtttctatttcagtattaacttttaagtcactaacatacatctataaaagctttaattaaaaaattatttttattttaaataagccgttttgatttattagggaatatggataaccgatgagtacattaatctatgttcgacagtgtgagaaggtgaaaagaaaatcttgctttccgcacgcatgctacccgaaccgattgatgacgtatgttttctcaaaagaaaaatttataggaaatttacataaagaacatatccattttcttgatttaaaatattaatcatcattaatcatacgctaatgacttaattttgtgtatcatatcatggttctcttttctcatttactcaaacacactttaagtggtagttattttgggataaattttaaacctaaaagggagaattttttgaacgcatggagtaaattagaatgcaaagtgggctcgcagggtatctatgtaattaattttctcatctatgggttccatagtaaaaaaaatgataaatcgtgtgatttttgcaaataaaaataatagtaaaattcaccttgggctacttttttttatcaccggcgtttcaaagcactttgaatcaccctttaactaattttttcacttttgatcagatacttttaccttagcattttgtaccatccttagttgttttatccatatacatctaaactgtcatatatcaaagaaacaatctatatacaatcaagggagtttattgacgaataagagcataagtactcaaggtcattcatatgcatgaaaagagagtaacaaaggcaatattacccgatccaaagtgaaaacatttggttaaaggatgatcaaatgccaaatatcggtaataaaagatgacccaaagtaaaatttactccaaaaaatttttctagaaaagtgatcttacaagcatattaatccattttcatgtttgaaataattaatacccattaattatacgctgatgacttatctcattttgtgcatcttatcattcttctcttttctccttcactcaaataagcactattatttattttaggataatttttaatttggtgatggagggagtaaactagaatgtgaatatcgaagatttgttaattatatcgaagatttgctaaatggtattgcatgtgaagcgtttacatagttggccaaataaaacattctgcatactaccacattaatattttctacttgcttatattttttgccagtttttatttatctaagtgtaatatgtttgtcaagaaataaacatttccagaattttttcccaaatggaaatattcccaaacagaatttttttcaaaaagaaatatcacaaatatcaccgattattgtcgcttcgttcatttttactccatctcatatatataagaaatcaagctaattctaaataactctacaacatttttatatcctaaaaagtataaatattcacaaggtatttttagttggtgcgccaaaggcgcacccattttctagtattttcctgacatagagtcatgcttcgatagaaatgatattaattacagttcacaaatgttcttccccctgttgtatgcccttgcccttggtgtaagcaacaatggttgaaatgtttatacataatgatggactctatggggtagataattaatctcaaacaacaaagtaggtatataatcgtccaacaatgtaaaaatgtggaaggagaaaatcatgaatttaggctgaggctagtttgcttcccacagtatcagcgacaaacgcatatcgtgccttgcgcatgatctgtgacaagatctcactggtattgtgttttttcttcgaaaataagtactccctccggtttcattttaattgacgctttggacaatggcacgctctacaaaatatacctttgaccttatttttctattataatatataaataaataaatacatgcttatgttttgaaacaaatctttatatgtttttctagtttctttaaactaaatatttttaaagttattgatggttaaaattataaaagtttaacctcaaccttgtctaaaacgtcaattaatatagaaggagtactatgtaaatgacaaaatggccaataattaatcacgcctcaccataataaccagcaaattttcattggcagcaacatgttctgttgctccggtatgatagaatccaaagtggctacgatagaattccagactcctgcaagtactatactttgtctttcatccaagccaattgggatgcccattcacgctattttttttccaagtcgataacaccatcaatagataggcgccaacccggcgataggagcattgctgcccgtgcacaaccgtctgcatattaatcgatgacgtttctctctcattgtactctctctctccgccacctagatataaaatccaacacaaggttactattagccggtgattatttgttattgtacttgctcttaagacgaagattaagtacgggcacgtaaaataataaagtcattaacgtatgattaattaaactttatttactacaaacctgagaggatttatttgatattttagaacaacttctatatagaaagttttcataggaaatacattgtttattagtttgaaaagtatgctaataaaaatcgagatggaatctgtatcttaatcgaaaaataacagggcagtccttatacacttatttgtcagatacttcctctgttttattttttaagactttctagcattgcccatcctagaaagttttataacctgaaacagagggagtatgtcataattaaagtatttctaccattctttgattaagagagctagcggtagttacttttctgagcaattttaccatccaacatttggcactttcaggtatcacattttgcacactaaaattcggtacacctgaagatagtacgtcctaagtatcttgaggtacaaaattttacactagaaagtatctcaagataccaaaaatttgtggtacctcgagttacgaaatgttggattgtaaaattctatatttttctcgttaattccatcgggtccaaggacacgaagaagtttgcacgttataaatctaccagttgttcaacaaggccgatataacaattcaatgtttatacacatagggcccgtttagttccctaaaatattttcccaaaaacatcacatcaaatctttggacacatgcataaagtattaaatatagataaaaagaaaaactaattgcacagttatgggagaaatcgcgagacgaatcttttaagcctaattagtccgtgattagccttaagtgctacagtaacccacaagtgctaatgacggcttaattagtctcaaaagattcgtctcgtggtttccaggcgagttctgaaattagttttttcattcgtgtccgaaaaccccttccgacatccggtcaaacattcgatgtgacacttaaaaatttccttttctccaactaaacacacccatagcaagtactacctccgtcccaaaataactgcagccgtggaaatacgtgtccaacgtttgaccgtccgtcttatttgaaaaatttataattttttttaaaaaaattagccacacataaagtactattcatattttatcatctaataacaataaaaataataattataaaaaaatttcaaataaaacgaacggtcaaacgttggagatgaatagtgcaaaactgcacttattttgggacggagggagtaataccataaaaattaaccttaggccctaccacaccattagagcaatgatgacatgtactcctacacctacatatccaccaatagggtgattttgccagcattgatagcttgcagcgctgaactcggaaacatgtgcaagcaagcaacgaggcgcgacgtgtgtgcctcaacggttggaacggtttcgtcgtcttcgtgcattttatattacccaacctaggcagtttagattctgccagggcccaggatgatgatgcttgtttcgatgttgccaaacatatggccatccagttgcatttcaccggcgattcttgtgtgactggtgaaaggaccaatccgagttatgggccgggctatccaactcctgatgcctcctaattctactcaatctgttcaaacatggatataaaccagaatagcacattccatggcagcaagtagcaacatgttctgttgctccactccagccctttctatagttatgaagtcttatacagaacgtgatgacagcattcctcattccagacacctcccaatcctatttgactacatatgcctatatactttatccggttcagttccaagattgatcggagtaattaaattacctttcaagattagagtaatccatggtctaataatatattgcttggactagctagactcatcaaagagaagtaaaaatagcatataccaatagcatgggggtatgattctatatattactggtggagaaactgtttttactcccgatttataactctcctatagttccggtttcctaaccgggactacgaatccgggactaatgatcgctatctttagtcccgggcgaaataaccgggagtaaagatctatctttagtcccggttgataacaccaaccaggactaaagagagggataccaaccgggactaaagagaggatagggacaatcccggatggtctttttttttttgttactttcttattttctcccgaatcggatggcatgcacatcccaaatcaaaccccaaatcccaaataaagtaacatctcaaatccacatcacaaatcccaaatccacatcacaaatcttaaagttacttatacacacaaatctaaaacatcacaaatcctaaaaaaatttacacacaaatcaaatacatcacagattatacatctcaaatccatacaatgaatcacaaaattacatctcagtgaatcacaaaatatcaaaaaaaaagagatggtcgtctgggccgcacgcctatgcgtccgtccgtccaccgcgtccgcgtggcgcgacctcatcagcggcctcatccgtctccaggggagggaggaggaagggaaaggaaggagtagcggcctcatccgtctccaggggagggaggaggaagggaaggggaaggaaggaggaagaggaggagaggggagggggggagaagagaggaggatcgatctgtgggtgaggaagtggttgtgattgtgaaggagaggataaggaataaggattatatgctatgttgaattttagtcccggttgatatttccaaccgggactaaagatctaaatgatctttactcccggttggtactaccaaccagaactaaagtggtaatctttagtcccggttggtagtatccaccgggagtaaagatcctcggccccctgacatgcctctgacagaggatgaaccgggactaaaaatcatctttagtctcggttaccaaccgggattaaagatcaaaatttttttaaccgggactaaaaatcgtttttaatcccggtttttaatgaaaccaggattattgtagaatttggtcgaccgaccaaagatgattttttcaccagtgtatgcatcccttgattaagtatatctagaattttcatgatgcgaaggagtcatatctttcctaaggagacaatggactgatgacacctcgcaggacacacaagggaaaatatacggtgcaagccccctatacagtgtaaacctaaaaactacagtagtatccaaaaatgaaagactgtgatttgtccacgtcacctcatggttaaatctgggagtaaaaattttagtcaaggtaacatgaacaaatctcaaacgtccatttttagatcatatggtaggtgacaagtttgcactaaatatttttctgacatattatcatgcttcgatagaaatgataataattaaagttcacaaatgttcttccccctgttgaatgttgatgcccttggtgtaagcaacaatggttgaaatgtttatacataatgatggactctatgggtaaataattaatctcagacaacaaagtaagtatataatcgtccaacaaattaaagtaaaaatgtggaaggagaaaataatggatttaggccgaggcttgtcattcgcatgatatgtgacaaaatctcactaatgtcgtgctgatccaacctctatttttcgtcagaaacaagtactatgtaaatgacaaaatgaccatgaatcacgcctcaccataaccaagcaaattttcattggcagcaacatattctgttgctccggtcctctccttagcgacgaagtctagcaatctaatgtggctatgatagaattccagacacctccaagtcctattgacactatactatgctttatctccacttcagtctcgagattgacaggaaattaaaatttctatcaaagcctagagtaatgcatggtgtatgtatatattgcttcacctagctagtccaatcaaagagggaagtaatagcatatgtcaatagtaattgaaatatttgaagtactatttgtgtgattctgtctagtggtttttgcacatgcaaagtgtactatggcttggtcggattgacaagcacgcctctgaaggtaaagcacatacattttcttgtttgatccacttttgtgttgaatactagtggatccctagttttatgcttagagcaagaataataatcactgccatctcacttagccatgctctaaaagctcacctgtataatgggttggctataagctgactgatacattacctaattgaaacatctaagcaattaatatatgcatatgcaaagcatccgttgtggctacatctctatggccatttcagtgaacaccatttcatcagtcaaagtatatcccgatgaataacagattaacataatactgagaaacaaagatggctgattaattcgagctctatagcatagattgcctccaagcaacattattcatcttaatacctagatgacaaataacttatgacaaatagcatgtcgggtcccaaaactaatgattcagtaaccgacatgtttagactatatcaagctctggatcagtagattgatacaggttcaacaatctggatattcattgcatacattttaacatggctccaaaggagatgttattataaaataataggacatatcaagtttgtggctaactattacattagaagctataggttgacccaattctaatattttgctatagacttaaaccaactaactatactagacttgaagacttggtttaaagggaactaacttatatgattgaactcccggcttcggcaagaacatcgaattgactctgaaagaaggggttgaagtaagggtgagtacaacgtactcagcaagctattatattaatcaataatgaatggatgaaatggtagtatttgagtagagctaagtttacttgcagaaggctaggaatatagaggaagaaagcctgtaatgttttagatgcaataatatttaataaagtttgaaattaagtttctaaccaaataccatatgagtcccaatgctcaaatccgtgagcacggctattcgaataaattcatttatactttactgcagtaaatgtacgctttacccacagcccacgacttgccgataatcatcagcttcagtcatagcctagtattaggttactaacaatagtggcacctgttccatgaactcttatccccatacgctctgaaagtacgttatcagtagcgtgaggagttctggtgttctcggggtatttagagaggactgattgtatgacaccatgtcatcacaatcagggtttccaaacaagtcatatatgacatcataattaatctcacacaaatatttacctacgcctcggtaaatatcacaatattgccctgctcggcaaaagtttgcctcctgcgcgaggacttaaacatagaaccactgtacataggtaccacattgttaaataacataatatctaggtctgtgcccatcctagaactgtggtcgtactcgtttgtttttcataagtacttgggcagtcttatgtcagttggaacaatactagccactcggaaatcaaccatttctaccgtactgtcccaatctaagttcattatattttatgcagtctaactaggcagggctaagcaaaagctagcatatatctggtttgttgtatgttcaggttatgcattcaaaatcatggatgactaatgcatagaatagagatatagaatataggataattatgctcaagggaaggaataataacttgccttgctccaacgcaaataaatccgagataggcagcctgtttatctgatgcttgaaataccataggttgccatccaaatataatagactctactgaaaaagaggaagaaccaaattcaatgaaagccataaaagcaagaaagagataaatggttaggagggctagggtttagggtatagcctatctcttttatagggtatatggattactgggctgatattttatgtggagattctagagagttggaggctagacgtgcgccgtgcgtatcactatttttcttttttttctttttctaaaatctaatatatatggtgaccggtcgctcttttttttttgtggtcccacccattagatccgccggtgctaggaagcttacagaagacctagtagtatgacttatacgctccacccgaggggtagtctacagacggtctagtaccagataagactctaagtgaaacttgcttgcataagacttgcaattcaaggcgtagtccattgttcaagttgtgagtaagtgtagcttggagttctaaatagatgttcaaccttaatcggtctccatcgaaccgctggtatataaacggtacattggaaaaggcaaatctcagtgggattttgagatttggtgggggattgttggaattaattgatgggctaaggcccactcagagattaattctttggaaaatcacaaaagcccacctcatgggatggcatacatgtcgagtttagtaccaccttgcttattctagaagagggagacatccttaaaagggaggatgccctcctatccacttgaagcatgtgtggtggagagaagagggagaacacacgcccgcgctcgttcgcctggcctggcaggcggcgcgcgtgcacgtcgaatggtccgcaaaattggctcctcacccttgcgcagatgtagccttcttttgcagttttgttttgctgcaggaaattcgtatttgttttgttttggaaacattccgaaaaatccggtgcgtgaaaacggcgtggagtccggataagttacgcgtgacttatctggttcggttacgtggagtggagatcatgtgggtgccctgatcaagcgacctatctttatataaaccgagccgccgccttcacgcaagacacgcgaaatcaatctagtgtttgcctcctactctgtactgcgccgtcgctcgtagactactccatcccgctcgccggcgtgcaccggcgatcgggagagcaggtctccggaacctctgccttcgacgtcctgcaccgggagaaggcggcaataaggtttttgggaagcgcttcgcgcgactgctccctgttcgtccgcaacggctcgccttcctcttcgctcgcgtgctgcgcgccttcgtcgacgctcgcaaccgcaagtagttcctgccgagcaaccagtttttccgtcacctcggtacgtgttcgacatgttgcgcatatttgatatgttcatgttttactgcttagtttacatgtgtagatctaataatgcgttcaggctagtttacatttgcaatgtcatgatttatttatggattaaattaaatcattatgtgccttatgatttcaacacaatatagtcttccgtctgggcgctatctttgtcgctcttg

SEQ ID NO: 83048 - DNA, 702 bp, Oryza sativa
  unsure (1)..(702): unsure at all n locations
tcagtctcgccccaaggtgccatccacctactaccaaatcgtatattaccgatctcgatattggtccagtctaccccatgttcacgtacttttagtctttgacctgactcctgagtatagtgggcaacaaacattagacctgctactgcatagcagtaggtatatgcaactccattccagtacttggttctcagcaaaaatctaccagtcgtaaaacataacgcaaacgtccatttacgtttccatcatactcgttctgcaagcaagttcgctatcagggcaatcagcgatgctgaccactactgtgtttttctctgtgttccaattcttagccctgtctttcagcttggtattattataatccagattattaggagtaagctgaaagaaatagacaacttattgaagtagcttattataatctggagtccagtttattataatctgataagctcatttaggtgagctttttccagattattggatgaaaaattacctaccatgccaccccactccctttttagacttgcaaacctaataatctagactctaataatttagcacagccacaactagccgcttattctactatagattataataatttagcttatagtaatctgactcaataatctagattnnnnnnnnnnnnnnnnnnnnnnnnnnnnnnngggntatgtccaggctctaaaggggtacatt

SEQ ID NO: 83049 - DNA, 915 bp, Oryza sativa
ggacgaatcccatagaagttgacctctttttggtaccaagggtgtatgcttgagagtggaatcattgttcatagcccccgcaaaaaaaaaaaagaatcattgttcatagcaatagcaagtagcagtaacaagtgattataaagtagaacaagggacctataaagtgtatttcctgctgccaacttctttaaaaaacggcttcagcacatgacgcatcccaaggctcgtgcgacacagctccacaaatcgaccaaaatctcgtgccgaccacgacgaggcaggtgaacatgcccgcgagttacgccgcgcgcgaatattcgctaattaggacccacacaccgcgactcgatccacacctcgccgccgccgccgccgctttccccgtccatatccgctccttgccggctcagtccccgccattcgctaccttccacatctccgctcagcaccgagccgctgcttctctccacaggtaaagcatttggggctcttctttcttcttctaccttggccgcactgcttctaacccaacgacagccaccaaagctacacgccaccggagattcctacagcctggattactactagtgcttgttgctatcttctttggttgattgggaaagaaagaaagaaagaaagattcgtacggtttagattattggggtaggaagaaattttgttccatgctgtctgagaaggggggaattcgattcatggagatagccgaacagtaagattggcatttgaacccgacaatttctaccggccataattatctctgttcgttcgtgtcaaccccgtcgacaagacgtcaagacaccgtaccactaccaaaccattgtactactagtactgctgcggttgatgaatgatgatagagagaggaaaacgaaagaaagacgcatgcgtgcattg

SEQ ID NO: 83050 - DNA, 714 bp, Oryza sativa
  unsure (1)..(714): unsure at all n locations
agtgtgntttggnatgtananctgatatacnnnnnnnnnnnnnnnnnnnnnnnnnnnnnnnnnnnnnnnnnnnnnnnnnnnnnntgcatatgtcgacaatggctgtgaaagggcagtaccttggcccagagaggttgactgatatgcagtagttcctgaggttgtaccccgcccatgcttaccgatgatagcgttacggtaggtttgtggaatgtaagctggtgcagaaggggaaggatcatttcctgatcttcgagttgcttcactcattgagcgcgaaagcaatgtggaaacttgtacttgtgtagctggtacagttgatcttggggcagggaacacaggggcactcgaaggtcttgatgctgtgacagtaacttcagaaactgagggagatgcaacccttatggcagcagtctcttcttgagcttcagaattagaagtggtagaagtttgtggcaattctgaagaaagtgaagcagctttatcaacttggggtaatcttggagggactgggacaggtttatcaatttgaagtgatctcactgaaggaagggatgtatctttagcacttggtggtgatttggggggaactggacaagcttttcaattggggagattttggaggaacttggagtgcattacccactttgtgagattttgggaggaactggagcangtttataattngttggcgatcttgaaggagaagaacat

SEQ ID NO: 83051 - DNA, 6427 bp, Oryza sativa
gggagttgctgaagcctatggcgtctgcctatcaggctatcagccctaggtggtagaacatgtagagaggctatgggccaagcaaggcagcacgatggtccaccataccatctgacagcccacaccctcccccgtagggatgatgaaagcatggcggccattcaagcgtcgtcccgtggcctcagttacacgtcgggtaaatatatgtcatattgcttttaatgtaaggtacactcaagataataaatagcgtttttagctgccactatagcggtagcggaccctaccactaccggtacgacgtatactagatatagcatcttggaacttagcacccactattttcacttagcggactgctacagcggctgcaattcgattttgtggactgctgtagtgtgagcctattttatatgaccactaacccataacaagtaacgagtttattaattgttttgtctcccaaaacattgtattcttgtgagtcgtaacatctaacgagttggaacacaacatcaactcttcaagtgctactaaatctctacttatcctcataggttatacatgtattaatctatcactaatttgtttctcagttgatttgttaatttttataaagtcactattcattatatatacattcaaatatgtgcgatgattaaatgccgctattgaaacttagcgtctgctatccgcgatccgctacatacgcaccaatccggtaccgacccgctatacgctatctattaccttcggtacactttttcgatggcagcaatcagcaagatgcaacctgtcacagttaatgcgctgttgttggcccgagtagcctacaagagacaagcccgggggcaagtggcagctgtgcccgagctcctgccccgagctcggccaatactaacctgttgtcatatgaatatctccatggcaggccccaagaccatgtcctatcccacggccattgaaatagacccgagctgattaatagcgacatggatcatcccaccagataacatgtcgttaggtgcaccgagccgcaaccggtagtgggaacctggttcccacttcaccgacacacatcaatatgggaaatagaaaatgcatcatcgcatatagcattagagaggaaattaagagaaccattcgcgttgatttgcgccatgtgaacgatcccatatatgcattttttgccaccttatacttgccttcacaaatgaaatttttggaggcaaaattggttcctctttctaaaaaaaagctcttggtctttagaaggtttcttagcttttagtttttttattgtttggcaaaactgtttgaaaggtgtaccaaggcaaaggcagacagatctatacgactatacgtgcaaaactgaaatctagtagtaggtggtactaaacatttgctgacataaatttgttttagaaactgtcatatagccatttcaatggaaactttcaccacatgcttacttgttgtgttaggtaaacagcatatatagtcctacatgtggcaacggcgcaaccccatgtggcccacatgccgcggcaccaaattcagaagaaaatatccgcacgcagcatcctacccaaaagtctccactctccacaccacctaagctcctacgccgcggccgccggcgactcaacttcgctcagctcgcctctgctctggtcaacagccatacccgcctccccttaccacccaccccaaacaaaccactatgcaaatagtaatccaaacaccatcacttgtcagatttatcatatcgcacaagctttcagtcgactgtgccatggattcttttaggcaggcaaggcaatgcgtcgagcacctggtgtgcatacagcttatctatgaaaacaggagatgatggaggtgggggtgtatgtacttacagtttgttgatgtggcagagggtcccgttgttgtacttgcagtcgcacttgatgaacgggttgagatttgggtagtcgtcccagttggacaggtcggaggcgacgccgctgcagagctcgccgctgatgttccactccggcgacgccgtcttgccccatctccccaggatcgtgttcaacgccgccgctgcaatcacgcgcggggttagcgaactcaatattaaccaaagaagctaactagtaagacgcttgaacagttgaagtaacaattactgcgtgatgatgatcacgtactcaccttcgactggatcagttcgcggctgagcctgagcagctgcgataatccgccatgagcacagcacaagcacaagcagcggccacgcgagatgggtgaagacaccggccatgctaggccgcatcgctatcgatctgtctccacgcgtttgtctcttttctggtctcgctctctttgctggactggagactggactggcggcgaggcaacattgttgggattgttaaatagatttgaagtcgttggagcagtagttgtggccaataatttttaattttgcaaaccaagcgacgccaaactatatacgtgtgtgccaaaccgtatattgacgtttatttcatgaaaaaaagacaaataaaatgtcaaggctaaggagaggttgaaatatttgtcgtattggataacactaatgtcaaattttatctatgaataacttctcaaatatttgcgttagaaacatgaagactatgcatatgcgcctgtttgcacagctccaactacaactccaccttttctcgagctagagctcagccaaacagttttagaggggagctaggtgaaccaaataaactagagaggtggagctgagtttagacagctccacaacttcactacagaaccaactactggagttaaatttaaaagttggagttctaccaaacggaccttatatgtgacaccctggttcaattaagatttaacatgtgtggtccattagagctatgagtgttaagagcaaagttttaaatctccggctaagcctcttagctgctgaccttctcaacagctaagcacagctatagctggagatagctgcagctaagccatttagctgtttttgcaaataaataaataaataaaagacatgatcttggcataacttcataaccattaccaattgatacataaccaattcaaatgagtacattacaggttcatatgagtacattacatcacaggctaagtggttaacagaatactgaaacatcagtttcacaaaagtacagcattctagaataaagacaacagtacaacacaaaggtcatcaagaattctggatagtggatactaaattactaatatgaggcaatattgcaatcttcatttcttctagtcatcaatcatcggtctcagagacatagggagagggagagggtgacttatcagaatcagaagtctgcattggaataccatcatcacaatcttctgagtcggatgatggagcttcaggatgcactggggcattgcgcatcaaagactgtaggcttctgactttcctcttcttagcgtgcacaggccttttccttttagctggtgctggtgcttgtggtgttgtgtgctgctgtgactcttttgcacattgttgatccatttcacttgatgaaggcacaacaccagtaatgaattcattgtcaccatctgccacaacatcatccacttccttctctataggatctctacccttgttctctctcttatttcttaacttggagttaaatttaacaaacaccagatctcgcatcctttcatgaagtagcctgttgcgcttctttgtatgaacctataagccaagtagtgaacacaaagctgcaggtcagatctaaattccataaataagcattataattcaaaatagacagcatgcacataaagctacaggtcacaaatttctttttacctgttcaaaaactgaccagttcctctcacaagctgaggagctgcaggtcaaactcaaaatccttgcagccaacttcctaagatttggtgtgcttgtgccatggttcagccaccattttgctgcataaacattacacaaattacaacaaaaatgatattcagcaataaaattaagttcacatgttgagatctgaacctggattgaaatttttgttctttcactgccttacggcaatttcgtgtccaaaactcccatgctgatcttgatacaagttgagttcttcaattattttgtcttggatatcttcatcatcagccaacttgtcaatacaggaaatcacacctgctctaaatgatccatcactctcgatctcttgcttatttgggaagtagtagtaggggttcaaatagtacccagccaggtgtagtggagtcttgagcttgttgtcccatcttttatcaatgatattccaaacttctatgaagcggctcttatcattatcgaatctctgagaaatttctttcttcgcctcaagcattaaaccatggaagaatcccattgatggtacatcgctgtccattcttctcaacacgttagccaatggctcaaagtaattaactgcaatgtcaacatttttccaaaaggtttcagatttgatcactttgctggctttcttccccttggcctgcttcaagtaacccaattgctccatctcatctgatttaaatagtcttactaactcttttttgttgtctaacaagctttttagattcaaataagctgtggcaaatcgtgtaaccccagagcgaaccaagtctctgttaagaaactttctcatcaaatccaacaccctagtatgagcatacaagaaaacagtcacttgtcttgcattagcaatggtttcctcaactggtccaagcttcccaatatcctcgagcatgagatccaagcaatgagcagcacatccattccaaaatattgatggtctttttgctgtcaatagacttgctgcagttgtgttgacgctagcattatcagtcaccacttggacaacatgttgttcccctatctcttctatgtacctgtccacaagttcaaagatatatttgtcatctttcctgtcacctgagcattccactgaatctaagaagagtaccccatgagcactatgcacaactaaattcatcactcccctacccttcctatctgtccatgcatctgtcatgatagaacaacctgtgagctcccatgattccttgtgctccttgaatccatccatcaccttttccttccttttctgtaagaacgatccactcatctcatagggactaggccctttcagacttctaccaaattgtccaatggcctctaacatatgagcaaagctaggaagggttactgtgttgtgtggaatactagcttcatagaaccactgacatatgtactcacaagttctattcctcctctcttctcttttctgagttgtcaatgctgtttgaaccttattgcttagcttaattactctttgtgtcatactggcagattcttctatagaaggaggcttgtagtacttgtcaatagtatgaccacctgctacagatctagagctactagatcctgttgtctcctttggcttcaccacaagaacattattgccatgatctgaaccttcactgccactttcacaatctgaattttctatgtcaacttcagctctggccacttccttttctttgtttttctgttccttttcactagtcttcttggtaagcaaatcaaacatctcttgctgcactggacttggaactttctgacacttagtagtattgaaacctttaattccagcaagatggtacttaattcttgtaattccagcagtgcagaccttgtcacaatacttgcaccgtaggtgatgtttcttggttatgtctgggcagaaacagtgagcccatgcaggatcatctgagttgataccagcttgttttggtccagcttctactgagacagaggcagcactggacggattacctatacaaaaagcaaacttagcccacattaatgctagcgtcaaagctgcctaagcatcaaaataatgcaaactgatatagcacgtattatcattaccacctaaacaggcaaaacaagcaaacgagagatctcagggagtaagaaaatgtcgcgtcccaaatcgactctaaaatctatcctcgaaattgtgcaaaagaataattaaaattcaatgtgaaagccttcaacaattaaaatgtgcaaagataaaagtcaaatgaggcttggaggatttttgtatatttcctaaaagcctaaaatgcttaaataaattttagtggaattttcagagcacaaataataattgaaaagaaatgaacaaagttaaaaaggtttataaaaagaaaatcctaaaagaagtcttttccccctcccccttccttcttgggccggctcggcccattccctccctctctctctctctttcccctcggcccatcggctccccgcgcgcgcgcgcgccgctgacaggcgggcccgcccgccact

SEQ ID NO: 83052 - DNA, 6434 bp, Oryza sativa
aaatcaagtatattcatatgtgctggcaatttgcagaagtgaaactcaccaaagattgcttgatccaggcttccattttcaaggtactcataaaccaacaatggtgtgttgctgtcaatgcaacatccatgcagtttcacaagattccggtgttgcacagcagaaattgttgcaacctccgtaacaaattggcttttgccttgatgagatgattcagaaagttgtttcacagctataactcttccatcgggtagcttaccctgttgaatgaagaaccgtctaaagttacatgtatattttgaacgtggagaagaaagttgcacttaataccaaatcagacaattgagggaaatagacaaccttatacactggcccgtatccgccttccccgataatgttttgagaattaaaattgtctgtggctagcttgagttcagagttactgaagacatcaggtcgtccgaccaggttgtacagttctgtatttttcattccagcagatggtaaagaacaaataatttgaaaattatgttgtctgaataactgtactaaaaaggataccttctttctgctttgccattgttcttcgcttctttatccacataaatattccaaataagcctgctaatcctaaaactgaagcgccagtcaatattccagcaatttcacctgctttgcttcccttttttggtacaccatttcgcacagttggagtaaaatctgaaaataaatgtttttacttactagagccaatgtagcctacattgaagttaatataacaggtttgcttacttggagtgacgcttaatgctgagatcatcggtccgtagtaaccttgggtaggtatgccagaagtgcccttgccagcccagaagagatggatctcgaggaagttttttaacacggttgccgtgtaagtcctgttaattgcggtaaaagattttccaccagctgtcttccttatatcgaaattcttttctttcagagcaccctatgcaaatgttagtaatattttcagatatagaataaaagacttggtaaaccaattgctatacaatgcactcaatctgtacctggacatatatgtcaaaaattctccttcctaagcttagccaagtttgcgtgtctggaaaagcaaactctgcgaattgaagcataacagtgtaatttccattctcaagtccaagcccataatatctcagtgaagatggtgacatccttgcagtctcgaacaattttgagtcgactgcagtctgaaaatgctcagagctatatattatgtccattctatccgtggcttggtaaaagtatccaacattgctgacaccccatcttatttgatcagtaacataatatgatgcatccccaaggtttgtagcatctgcttcatatatggtattatctgagcccctagtagatatatcactgccgcagtcaaccgcaaacgaataatctggaattaagatgtgcaaaattatagccagtattcaaaatcatagcatctgtgcaaaactataaccattatccgaaatcctttcattctgttaactactacagataacaggagtggcaaatatacatttgggagatccacggaaacaaggagtgtcttgttggaggcagtttagtccggaaggtatactgtgcataatttgaattgaaaagtaaaagccatgaaaaagattttattacagttaataaatggcgaaagtataagtaaattttataagtacctgtttttggtgctaccaagaacaatgttgtttgccaccaaattccttgttcaaataaaacattagaatatctatttttgaacttggaaacaaaaatttgaaacttttacactcacaattgcaaattattctgggtagcccaagaaggagaggttccggtgagatgattgtaggaaaaatctctggaaacagcccagtattattacaattgaactgaatatatcattctattatgaaaatattttgtgctataatgatatgtcgatacttattgacgtacatcacttttaaagaagagcttataacatcaggcaaagttcctatgaggctattgttcccaagaaacctgaattgtgcagaatacaaaatgatgaaacatggacataatcttatcaggtgtttctatgaatttaattcatttaaataaagaatttttttacaggaattgaagcattcctagattcaggatggactgaggaacttggcctgtaatattgttaaaactcaagtccctgtgccacaggaaagaaacattacttgaacaaatacttatcaattccaggaaatgaccaaaagcattatagcaggcaccatggccaataatgaaaacatacagcatggttaacgctgcaaacttcgaaaaatctactgtttcaaggttttccgatatcctgcagttccttaatactctgtaaaaatgaaatcaaatataggtgacttgtaactttgacaatattgtaagctctaatgctctatagaaaaaggcatcacatacaagttggtcaaagatgtcagattactgataaatcccagtgaagaactcccatttacaatatcaccaatccgtctgctcaattgtatttcacaaatcagttatcaagcttgaccttctaactttctaagccatcaaatgtccaaagatgtcaaaaaacaatgtacttacaagtttgttagtttggtcagattggacaaacttgcaggaattggcccttcaaaagaatttccttggaaagccctacaagttcatactttcagaaaataaagtagggacttgcaaggtccaaattagtataagagaatgcaagctctatgtatcaacatgccatgtagacaaatttaatggtatgcagatatctgcatttctattcagtgacaactgaaaggtgaaaaatgctattgcccgagttcaaatggaaaggacatatacagaaaatttatgcttgacaatttccccgtctctaaaataagacactgtataacgctttaccaatttaatatagtaaatcttacagatcttccaattcagtcaagctccccaagtaatccggtaatttccctgtgaattcattatctgacgctttcctgcaaacagaccaaaatatttgacatttagcatatgaaaacacaatgaaaataacagttgaggatctgttattgactttacaagtacttcaggttcttaagcttggagatcgtcgaaggaaacgggccgctgaatccagaactatcaatgtacctgttattgaaacatgcagtaattatcaagttgaacactagatctctccattccaaatttagttcttagaaattggaagttataagtgaggcatttacaactgctcaagtttggtcaagttgcccagttcttcaggaagttcaccagtaaagttgtccaggctaatgcccctgaatcaagaagaaatatttcaggagtgatattaattatttgggttcaactgctaacagaagaggggcatagttttccaaataagccatctgagccactgttcaccagtacaatatttacttgaaaatactgacatgccaaacatatgacttatgagttttttttatagcttattgtcaataagttatgcgattaacaatttccctataattatattagtttacctagtccataatatatatatatatatagctctgattgatctcaaataaaagatctcttacagtgagaggagattggtgaggttcccaagttccttcggaagttgtccagacagtggattgaaacccaagccccttcaaatgatgaaagataattaaaacataacacccaccaatggatggtgtattaatccatagcttgacatgtaactcctacaaatatttcatggaagcaaattttccaatgaatgatgggatggcaccagtcaaataattctgattcaggttcctgaaacaacaccgggaacatcaagtccattagcaaacacaaaatcttgcaactaccatttgctgttttttgccttgcaatcaaaagttaattattcaaaggattttttacggtacaccaactctttccaaaccatgtattttgcatcgacggttcatattactcttacctcataggtggtaagtggacctttatgtgttctaatgtcgattattatgatagaaggaaatgaaatatgttttcaaatttgaatgtatacaatcagttctgtaagaaaacaaataaaatgctacaactgaaattctgaacttcaaatatatttggcatctaattatatttcctgtctgtttcacaagatatcaatcaatgattcagagtctaataagagtatcagttttcattcttctgttttgttttagtataaaactttgtgttatgattactttggatcctagatatatttggtatatttatttgaactttgaattcaggagcttcagttgagttagtgaaagattccacgtttttgtagctagacaacatcactgattacattagaaggataatacttttgcctgatttattaatggcaggacagaacattttctcattagggcaaagccatcaatatcagtatagtgatgagtattttgttagagctcttacctctaaagatgttagatggagccccctaaaaagaattcttatattcatggggttaaaactatgtattctacaaaacattgacatacagcttaacaaacttcattatcaatattaacattacaagtcatagatccatacaggtcttgtagaaaggtgagattctgtagctctgcaggtattcgaccaacaacgtttaactttcttactctcctgcaaaacacacaagtaatattgataagtaaaaggaataactccaatttttccacttttgaaaatagaagtccaattttggaccttgattttgcccctatataaacaaccatttgattttgccccaagaacatgcaaaacaaggtcagttgaccccggccggacaatggattactcttttttatctccaaaaaaatggattactcccgttgtgattcagcatgcactaactttgggatggactggtgtggttcatcttttcctcggagacattcatattgaattataaatgagaaaatcgttggccagtaattgtgaagaccaaattcctgattggatggggaaccaaatgcctctgcgtccctctaatggaatggtgtttgctttagcttgtatgcaagagttggtaaaaggcctttacataagatctataataaattatatgaaaaggtagacacatgaattactgctaaatataaatatattctagtaacctgattgcaaaaacagtaatgtaaattaacatggtaaagtcaagcacgtcaagctatggctctcaatctagtactatcctcaggtgtaaatagatctgaaaacgaaaggaagaacttttatatcaatggtattaaggaggtgagtctctaaatagaggataagattaatacactcaatagcatataaataattctcaaatgacacaatgtaattctcaatagcaagtggcatgtctaaagagagggatcaaaattttctgacaagtcaacagtacacgaaaatattgataaccatggttaagcatgactaagtggccatcttagatgacaattgcacccaacctagaggcaggatccgaagcatctagttcctggagatacaacgtcattctcagtaattcgggtcaacatagggtctagaaggagcagtaattctcagtaaataaaggtctagaaggagcagcatacagtaacacatagggatttgtgtgctggccacacaaagacaagaaagcaaataacgaatcagcagcaggaacgcatgcatgcatgcataaaaattgcttcgtgcttcacagtcatattgaatggccagccgattaatgctatcagctcactacgatcttttcctctcacaaaaacatgtgggctctagattttcttatttccaattagtttccagaaaatatgaaattcacaagttggaacttttattaattctctgttagataattctaacaatatacactttcacagacagattagtctggaatgactccaccattatagaaactcatagatgggttagggacagcctgtgatgaccctttcagacctttttcctagtagtgtgccggtttaagtctcaataggtcatttaatatactagccaaatacccgtgcgttgcaacggattatcaaaaatagaaaaaaaaaaagcagttctcatggttgaaaaaggaatatttatctctacttggttcaaacaagattcttcatattaaaaagtaaaacataggccagctattcttgtagaggttggttagtacaatgacctcatgcagtgtaccttatgacctcatctgtcaatggtgatggtggtgtagtgtaccccatggtcccatatgtcaatgg

SEQ ID NO: 83053 - DNA, 2237 bp, Oryza sativa
gatcaggctttggctggtactaaaccagacaagccagtgttccctttttttttccaattaaccggtttgcctggttgagttatttacgctatcgtaaaatctacgcaggggcaagtagcagatgcacatttgttgaacttgatgacacctagaaatcaagcaaccaacaatacttgcaggttcagcacgacatgggctatttcaggcatattgcatcgaacaccttgtatgtgcagctgatcaaaccaagacaagaaggcaagcttacagtttgataatatggcagatggtgttgtcgttggaagagcagtcacacttgatggcagggtcttttgggtagttatcccagtcggaattgtcagaggctacaccgctgcagggctcaccactgatgttccattccgatggtgccgtcaggccccatctccccattattgtgtttagtgctgacactgggccaataaactggtattagtatttatataatatgaatgcataactatgcaatctagtaaatcactttaagctgcatttggatcaatgatatgggcgtggggtcgcagaattggaaccaaaatcctggcagaaaggtatttgggatctcatggaaattgaattattgattccaacaaaattccaaacagtcagatgagagcttatgggattttttgccagaaaataggaaaatgattattttcccatacagcgtttactactacttaaaagctcataggtgccagttttagagggcttataggtccggtaccggcaccaattagaaccagtctaatttagaaccaagtttgtggcactataggcctataggggtgcacctgtttttttatttttgcaggtgctaaaaaaattaaaaaaaatgatatttttattaggcacctatacaataactctctcatcccacaagtcacatgattttttcaacccataatcacatacatgtctcatggaagattcaaactcaagaccactcacttcacacaaagtcacattaccatctcacctacaaccacttcttgtcttggaaataaatgctattcctttgagaccactatcatccaaatttataatccatatctaacaccatagataagctcaaatgaaaagtttgtcagttacaaaaatgtagatctcatccatatctacaatttttatataggttttgtctccacccgatatcgtttagaaattttaaatatccactcatgcaactagatttgagaccttgtaacacattttcggacatccaaacatccttcaataaaaaagtcataaactacaaagttgtagatctcgtcgagctctacaaatttgatataaagcttatcttcatacgactttatatgaaaaagttagataaaacacacacatatatgagttgtgtcatcataggtgcagttttaattgtaagcaggcacctatgggctcataggtaccggtttttattaagaaccagtacatatgtgatgcccatatgttccggatcataataaaaaccagtacctatgataccgtagttataggtgccggtttatgataagaacgggcacctatgtgttgtctaggtaacggtttgttatgagaaccggcacctatgactttggaggactattgatgccggtttttgttacaaactggtaccaataagtgtttgtaggtaccggctcttaattttacacaaaaaaaaaaaggaaaaagctttataggtgtcagttttaagtaaaccagcacctataaggttggtctctatggggtgttttgtagtaatggttaaaccaaactgaaaatcctatggttaaggaatttaatgaggctttcacgaatttatcattggcttccatatcatgatggtgagttaaaggggcgcacttgcgggtgtatacatgtgttgtgcgtcaggagtggtgatgtatgtctgcatgtgattgcaaaaaaacctatagttcatgcaacacaaacaaattctcacaccatttacatgaatcatttgctctttctctttaccgcactattaatgggcctactatctactcttctttttttcacttgtaccaacactactttaactgggccatccctgtgtttgaggtgatgtgttttacaacaggccacgcacatatgcttgttttgctatacatctttaaactttaatatctcttttttgaataaataaattcctaaatacttaaaaatatatatgacataatatcggggctgcagga

SEQ ID NO: 83054 - DNA, 1252 bp, Oryza sativa
  unsure (1)..(1252): unsure at all n locations
ctgaaagcgggacgcttttctcataaagagtaccagaccgacggtgtagtgcaactaacgctcccaataccataattcgtttttgctcacgaatatcagaccagtcaccaagtccaatgggcatggtattgcccgaacagataaagctagcatgccaccggtatacagcgagtcgctctttgtgaaggtgacgattacctaccaatcggtcgattcgttagatgtaatgttttgttctcgctttggtggccaggttccgcccaagttcggtaagagtgagagtttaccagtcaagtaatgcgtgccaagccaacgttaagctgttgagtcgttttaagtgtaattcggggcagaattggtaaagagagtcgtgtaaaatatcgagttcgcacatcttgttgtctgattattgatttttcgcgaaaccatttgatcatatgacaagatgtgtatccaccttaacttaatgatttttaccaaaatcattaggggattcatcagnnnnnnnnnnnnnnnnnnnnnnnnnnnnnnnnnnnnnnnnnnnnnnnnnnnnnnnnnnatcgcataacaactaaatctaagtggataaccacattgaaattaaattaaggggtattctctataaaaaaaggcgggtaatatatacttttcatgaaaatatgttactctttattaggccaatattatgaaatttgccatttttatctatacgtagcaaagcacatacatttagctagtcttngaaaaaaaagagtaaattgcgcccgcggtacacaaacttgttaggtgggtgcattatagtgtaaaaacttcaaaactcttgttttggtgcacaaacttgtataggtgcgtgcggactatgactaaatagaatagcaaatctaattttgctgagttggatgatgagtagacccccaactaagcattcacgtaagaaggacaggtttgcctgctcgtaagcaatggccctattttatcagaaaaccccttctattgtttggtatttcgatcatgtataagttttctgtgaaacgaatctgagaggtgttcatagcggcggggagctggggaggtcgaatccgcggtggctgtagtgatgggggtcgagcccaacagctacgccgtgggggaagtcgagttcgacggttgctacaacgggtaggtnnnnnnnnnnnnnnnnnnnnnnnnnnnnnnnnnnnnnnnnnnnnnnnnnnnnnnnnnngtagtctattcaaannnnnnncngcacact

SEQ ID NO: 83055 - DNA, 19270 bp, Oryza sativa
tccaaactcgtactgttggaaaattgtgcgcgtgaaaatattgtaaccaaaatctgaaaagaaatgaggtacaatattgggagtgttgtattgtagtaatagaagacttgactaattaagtcggatcctatcaatccctcttagggattgacttgactaattaaatcggatcttactagtctctcccttagaaaaaaaataaacgactcgtacgagacggtgcgaaattctattgatagtgtagaaaaagtctctcccttagggcttctatcaacgcttcgttgatagtgagcatgcgtgcgagtgaatgaccgagcatcccaggcggccctaagttgggcacaagctggatgtaggaagacttgactaattaagtcggaccctatcaatctctcttaggaattgatatgactaattaagttggatcctactagtctttctcttaaagacatatacaaaaggtagagtctgatatgagctcttagttaatacatactcacttatacaatattctcctagaatagttgagacaacaaaatctcttcacctttaatgcacacaaatatttttttattactctttttttcgttttattcttcccaagaaacaaaatattacgacttgactatgactgttgttatgcgtagcaaccatatcccccctccccctcacgttacttaatttactttgcatgaaaacagaagaaatacgttaatgagtagcgttgtatgtgcccttagagcatctccaacagtctcttcaaatctaactctccaaatgtctatttgaccaactctctgtctaatttagcaagtcaaacttgtgtttactccaacagcctcctcattcaccctctctattgcaagtatatgacagtgggacccacacgtcagtctctataaccctcttttcccctagccccctccgacctcatctgcagctgccatctaccgcggtaccgccgccgctcgggctctgctcccctctgccgccgccgctctggctccgccgccaaccgctgccaccatccgctggcgccggcgccactaccgctctggctccgtcgccatcctccgccgccatcgccactcgggctccgtccccatccatcgccgccatccgtcgccgctattcgggctccatcgccgccgccgctcgacggcgagggacgacgaagattacagcgacggcgagaggggagaagccaacggcggcgaatccgtgcgcaacgaaggcccctcttcgcctgcaactcgagaggcgataatatccgcgcgacggcgactacacagacgacagcggtggtggctcatgacgacaacctcaacaacggcgaccttgacgatgacccggggcgtgaaggcggaggccgcgcggccccgaatccatgccgccggccaaatccgcgcgaggtcgtgcggctggccaaatccggcaggggtggataccgcgcagaggtagagtcctccagacgacggcggccgcggctagcgccgacgcagacgacgacggcggtggttggcgacgatgaccttggcaagcacagttgatgggcgacggcgagcgtacaggaggccggggcggcgtcggacagagaagactagaagaggggagatggagaaagagatagaaagtgggacccacagtggggcccaccgtttggccaggggaggaggctggctacatttggccatccaaatagcttagcagttcaaatagcaagctgttggagtgagttttttcactgtttgagctaaaatttagcttggagagccatctagcaactctgttgagttgctcatctcatacggccacaagctgcacgcaggaagacttgaacgagcatctcatacggccataggctgcatgcagcttaatgcttgacttgactaatgaagtccgatcctttcagtctctctctcaaggctttataccaatctctctcttggcttcttcgttggtggtttgggtgggattgggcatggtatatttccgcgtcgacctcgcgacggtgctcttatcgttccgaccaccgctgcagcgcgcgtcccaggttgttctctcgcaagtccaaaaccgaattgttctgatttgtttctctataatgttacactgttttaagcttatttcctttttcactgtcgaattataaattcgatctcgagtttcaggatgaagaacgagcatgccggtaaactaaatttgctgccagcacttcaccgggcctgcttgccatgcggtgagacatcctaaatttcacccctagtaagcatgtgcacgtaattagaacgcgaatcaaaagcacaatacgatacagacgaaggatctgcccaaaactggatatatatttatggtcaaagtaaaccaacaacgatgaaaacagaattaagctagtattgcagtataaggagccctcgattgctgaatgtacaaaatctcttgagcatctaaaaatctggatctccagtgcaacaagaatgtctgagaagcagtacactgtcagtagctaaacactgcaccttagtctcttccacatgacaggagatgaaacatcttcccaaccaaaaggtaccttcggccttcctcaaatgcagcctggatacaagttgaagaactggttaggccaacggcaaaagcatcaagctcacacttccaagattaagggcccctatgaatcacagaaatgagaaaacggagaaataggaaaaacataggattctgacaggaatgtaagtgtaaaacagaggattgcaaaacatagaaatgactgtttgattgggccgtaggaaaaacacaagagtttgagataaagactcgaaggattctttccattcatgttaaatttcctccaaaacttgcatggaaagagacattccataggaattttataggatttcataggattcattccttctatacaaagggctatatatgttaaatttcctccaaaacttgcatggaaagagacattccataggaattttataggatttcataggattcattccttccatacaaagggctatatatgttaaatttcctccaaaacttgcatggaaagagacattccataggaattttataggatttcataggattcattccttccattcaaagggctatataggaaaaattcctattaggaatgaagtcatctaaaattcttatgaatttcctttgaatcaaagaggacctaactcacttctatgtgtgtataatagtgtaaaatatatcacaaataattgcaaatgaacacttgactacttgagcaacttgaataagagtgctgtaaaaaacatactgagcctgttaagatacaatgttaatgctttgctgctgaaggacatcttactatatcacaaataattgcaaatgaacacttgactacttgagcaacttgaataagagtgctgtaaaaaacatactgagcctggtaagatacaatgttaatgctttgctgctgaaggacatcttacctcagagtttcacaacttcttgctttaaatcttgatgttgaagtagtcagaatcaaaatggtgcagccttacatatccatcttcaccaccactcgagaagctgttaacaccgtattatacatgaagaactgaagctcaaagcaaaacactttctgaacaacataaattaaccatgacatgtgagaaaatatgcttgaagaatataaactagctatcacataaagcagctctcataaattttctttttcaccaatagaaatcagaatagcgtatatgaccaaatctgattggcaacaatcactgagccaccatgagataaaataaaaatatacagcaatcatcagaaggccagcttagtgcccccagcaagacatcaccaaatgagaccaagtataaaccttcatcaatctaacttgcaatttaaaaaatatatattttgacatactttacaattttcagataaagaaatagtggctcccaatggaaaatgcattgcaaatggtcatgaagccattaccttatgcacatacactcaatcaatacatgaaaccttgcatcaacataataattatataaatatggaggtgatagatacactcaatcaatacatgaaaccttgcatcaacataataattatataaatatggaggtgatagataactatgtttcttcctaggatgcctcgtggatgttgaggacagaaaaggtagctctcataagtcttatttttcaacagctccaatcagaatagcgtataaaaccaatgtgattggttgaaatcacagagctttgaaaccaacaggcacatacgacgcttcaaacagctatactaagaatgcaactcaatttcacactaacaggttatcaaattaaatattggacatggcatagctctcatattcttatttgtcatcaaacagtcagcatagcgtatattgccaatgaaaacggctgcaatcactgagctatgtatgacaagaaaagtacttcaacaagacaaatagaaacaaaaaaaacataaggattcaatggagaacaaaaatgtcaaacagataggaagaccaatgaaccaatttaagggacaaatctagagaggcggtgggttaaaataacaggtgaatgatgaatagttgtacaacaatataaaagtcaaaaaaacttttgagtaaaaagaagagaaatacccatgtaaacacagccagtagaaccacaagaatgtgctaaaaatccatgtggcaggttaaaatacaaaatagacacctgctctcataatgtttatgacatcttaatatgattcagaatagcgcatattgccatggattaacatggcttaatcattgagcagaaaacacacaaagtaatatgaaacaaaaagctaatcgagaacataagtgcggtggtagaacataaatatagcattcatataatattacacatgtattaagaatattacctccgtccatcaggattaaatgccagtgcgttaattggtccaaaatggccttttacaccaccaatttcctcttgcaaaatctgaaagtaaaatataagtgtcttattgctaaacgaaaaaataacattgcaaaagaaaactacactatcattgttctcactaaaacataagatagaaaccatgtgcaaagaactgaccttgtgaaagaatttcgcttcaaattttcccgctcgacgatctgtcatagtcacattcatcgcatcttgaccacctccgataaccacctaacacaacaaagatttcttgtgacttatatagctggaataatgataacaagaactgactactcattacagcaacattacaggtggatagttcagatgtagccaatagtacatttttccaatggtagtaaaaatacacatccttgatagccaacagcactcaaataaatatggaattgtgctaaatccagggtcaaaagatgtgctggacaggtatataggtgccttgaacttcccattgtatattaattgttatttatgcatgtaaaagtactaattgcagataataaacatgtgaatgaatcatttgttgctctcgtcttggtgaaactaatcacacaaagaaaatgatttgaaactgagaacaaaaaatgtggcagcaggagaagagaagaaaccagaatcttcggaaaaaagcacaagtcatatccaacttcaacttataaggaggaccacagcaaagcaaaatacagagacagagagtaaaggtcatttcaatccctactacatattgagatcatatgcatgtagcatgagataacaccaagtaatttaaagcatgaccatgtattttgattaaaaaaatctatagaagaacttacgaaaatgtagataaaaattaggtattacataggcacatacatggtctagaagaggagaaatgtcaacagcattaacaggtcgctcggtgacatatgtcttgatcagggtcagagttcttgtatcccatagctagccagatagcaatgtgcatgtcaggaaataatcatatttgtagcacaaagtgcaaacaattggaagacatgattatgctagccacatcaacaaaatatcaccttagcagacttatccaaggagcctgttaggaaatgtgaccaatctgcagattttgaaagtgaagtaattgttttctggtgtccttgttctttgtctgactcattcagacatgttccagtctgcacatgccaaaccaaacagaatttaaaaatgcattcaatgatagagttgacggaaaaacatgttcctacccatacaattaaatagttggcatgtttaataaaaggtaaaatgacaacccagcgtacattatgtatgaatgtagcatgttttcaattagtgcacaaacacaaactaccattttgtcgttggcaccatattgccagagtcagtttaaataaaacaagaaacctgaaaggtatttatcgctggttcaatagtcactaacatatgtcatgttaattcataatgttgccatcaataacaaactgacaatcacacatacgtaacaatgatttttcaaccatatcgatgagcatttttaactattaaacaacttttcacttgtcagtccagatacatgtcaaatgatcctacaagagcgctacaggtccacataccacagttataagcaaattatcgcattcctgaaaagcaccagaagcctagtactagcgatgagtttgtagcaccaacgatggttagtagaactatgtgcaaatgttgtaaatgcaagctaacctcagtgtcccaaatgcggatggtggcatcctcaccggcggtgatgatggtcctgttcaacggcccccatacagccctgttaatcctccccttgatgccagaaatcacgagaagagactcctccgactcttcatccacaaccacacacttcagaacccacgttgttggggggaattgttagggaggaatatgagtttgaggggtggggattaagtcaattgtttggttggaggacatgggagtttttaggagggattgggaaggggagtttaagagtgaactcccaccttttcaatacctggataggggcacgtaattggaagggaatttcctcctaagtatcacgagatgtttctcatcatctcatctctactactccctccatttcatattataagtcgctttcacttttttttccctagtcaaacttaagtttatagaataatttagcaatatcttcaacataaaacaaacatattatcaaaatatattaaatgttagtttgaatgaaactaatatcatgctatagatgttaaatttttctataaacttaatcaaacttaaagaagttcgactagaaaaaagttatagtgacttatattataatgtgaaacggagggagttactaaaatgaaactcccatgaccaatccctccaactcccaatccaaatagaagccaccagaagctttcgaaacataaatagaaggttagagaagaggcatcttacggtcatcggggtcgtcggcgatgcgcttgacctgggcggtgggcacgttgcccatgaagttgtcggtggtgatgacggcgaggccgtcgccgatggcgaactcgacggagcgggcgggggcgtcgaagcggaaggtgaagagctccgccccggtctggacgtcccagagcttggcggtctggtcggcgctgccggtgatgaggcgggtggagtcgcgggagacgtcgcaggaccagacggcgccgttgtggccgctgtaggtgccgaggcggtcgccgttgtcggcgaaccagacgttgggggtgtggtccttggcgcacgagaagaggaggtccccgtcgcggttgtaccggaggaacgtcagcggccgctcgtgccccttcatcaggatcggcctcatcttctcttcgccgccgccgccgccgccgccggggaggatgggtggttagggttagggaggtgggggttctggaactctggaaaaccctagctcgcgggtgggttgggctgcctggtagtgcgtgtctgtccgaacgggagggagggcttattaatagccgagttgttgggccgtcctggcccaatagcttactcaatattttggattttcgagtttgtttacttgaaaatcatcttaccaacatttagtaaaaaaaaatttggacatgttaccaaattttgttagtattggatatgtttagtttgaacctttctaaaatttggtagtgctatatattgtgaaacggatgaagtatatgttacctactaaaatttgatacggttaaaagtgaacatcctctttaattattttcttcggtgtccaatacgcacgatggtaggctagctatttggtggacgtccgtcaaatggaagattagtctaattagctcaaaaccgtatgagaaacgctacatgcgtgttgtatataaagcatatgagaaacgcgcagggatttttcagctagctccacaagatgtgggctagccgatctgtgtttgaagtctcacttcttttcattatgtgatattagatcattccctaatattcgcttttttatatataaagcatataaatgttaactatgatatgctacatatgcagattgacttagctagtagtagttctttattggtgagaggccgttttgttttgcatgtttagtttttagttgatcggttgatcattattaggctcttgagtagaaaagtactcgcgtgctgttgtaaggtaagttcgcatgagtattttatgtaggttaataatactcttgtttcggacaaggctatggttaaaatttaaaacctttaactacaaataatatctaaaatattttatcttacatatatgaaaccatatgactagtcttataaaatactttaacaaaaacatgtattcattgatattattatatactcccttcatccaaaagttcaaagacctatttcttctgtcaccaagactaagaagtaattaactcatctatcatgtgacaaaacctataaaagcaagtttaatagtacagctaactattggctctaaattacatagtcaatttaatagtcaattcatacaatatgtacctatgtctggtcccacctgtcatgcacacatgcatcttagagtccgtgctgtagctggctacaaatctgtaacccgctgcttttctctctcatcttttatctccttaaaatatgtttatagctgacttatagtttgctattgtacctactctaaactatacacatgcacgcatgcatgcaatcaataagtattaagatggtttcttgattctggttaacaatttaatttagcacatagatactatagataaggtttagacttttggaaaaaccaaaaaaattaaataggtcataaacttttggaattttttagaactataaacttttggatagagggagtatatattgtactgaaaaatggtgatcaaagttgctcttagagttttttttttttcaaaattatattactatcaacccagagaaaataatttgtaaacttccgcgtacacacaagtattcaaacttaaatgtatggcataaatgactcatgctaatactataaaatttcaacttttggacacaactgtctcctacttacccctcccaacatgtacttaccagaactagtgcatcctccatctctgttgaggcagagtagatgaggctattgtacttaccataactttcagctggaccggctggatgcattcagagtaaagtcatatagggtgtgtttggttgcctgcatcaggcttggcctatatccggagatgcaacttccgcttgtttggttagtaagtacgagtaccgaacatctcgattagtaagtactgcacagccttgctgcttgactccagaagcatagcaagacgcttggaggatttggtgcgtggaatagatagatatgtctaaaccattgcttacactttgcagagacacatattgagtttgttatccttgccaagtttatatatagaagccgtgaaaaggtaaaattcttcggttgcatttacgtttcccctatatttacccacttgcactactgttctatacctcacctcagttaccaagtgagacttgtcgcagtctcgcacataaactcgtccacgcatttgatcttccacatctcatcatccatgccccaatcggaatgcggtctgagccatatgcttctcaatatacctagcatgttggcttttaagtgtcagcgatatatatacttacgataccgagatacgtacaaccactactaacaaaaccattttttgtgaaggcaattttagatttttgcttgatggaatttagagccgccacaaagcaaagaccagtgaagattaagatctatcgaccgccaacaaaaattcgtcttaaaccacccgccaacaaagatccatttttactggcggttgccttacaccgaccgccagtgaaaattcattttcgctggcggctgtgttaaatcgaccgccagcgaaaattaaaccatgcagttgccctagccgccagcaaaaaggaaactcgaaaagcaaaaacatataaaataaaacactgctccgtccacctccgtcaacactccatccacaaatctacataaatttacatcaacaatttacagccaaaaatttccattcacccaagcattcaagcatcacaaatatcaccacattaagagggagagggggtggtggcggcgggggaaggggaggagggatgagcgggagagagagagagagagacagagagagagacctgtggagatgtcgcctcgcgcctccccgtcctgagcgccgccgcccgcgcccgagcccgcgccggtgcccacgcccgagcaccgctgccctctcctccatcgctcgcgcccaagcgccgccgccctttcctccgtcgcctgcacccaagcaccgccgcccaagcccgagctcgccgcccggcgccgactttggaccgtcctgagctcgccgccgtcgtctcctccgtcgcccgcgcccgagagccgccgcccacacccgagctcgcgctccgccgcctgcgccccgtgcccgagggataccgccctgtggatctggagggaggaggagatgttggatctggagggactagggaagaggagagagttgttggataaggatgggtaggtggataattaaagagcggtgggggcgcggtgaatttttaatggcgtgattctttcaaggcggcgctcttcattaggttaagaagaccgccagtaaaaataggattatttttgtaagcggacttcttgacctacaaccagcgaaaatggatttttattggcggtccaaaaccctctatccctcattataatttcgcaagcggatttttcatttaatcgccagcgaaaaaataggataccgtcatgaaaaatcgtttttttagtagtgaaccaaacttatatgctatagaaaataacattaaaatcaccataaagtacaggagtgtagtaaatagtagatgggcaaataatgtacattattagataaatagtggtctcatttgtccactttattatagctaattgctatgggggtgctaatcagcgcatgcgcgctggatgggcaagtctcccacattgtctccattgtatattttcccgggcgtctctctgtccacacagagaatgagcagagcggagcgagtgacgatgacggcagtgcccctcttcggcgctagcgagaccgtttggtaaccagggtactctttctgtaccaccgcttaacaccgtgacaccaccccgcctcgccagcactgacatgcatcaacgggtctacgcaaccccactgagccagcctcctcccgactcccgtcccatttgcctcgcttttcccccacaatcagcaccaacgtatcaccgctaccgaccccatggctccggctgcacctccattgtttgcccttgtccactatctaccaccggtccaccgcctcccaggccactcctgtaagcccgatctccacttccaagtgccaccctcccctaaccccacccctgaaaccctgacctgacacttgttgtcatgctatcgaaaagctgttcacgagatggctaggtcatgcaattaagctttccgcggttggcctgcttgaattgtaaagataaaaattccatttgttaaatatatatgctgcatatttttttaatataatgtattgctagtttgcgccatgaatagatttttgtgatgaagttacagctgatgccccttcccccgctcgagcattttctttttcttttttgcgattttcttttttcgactttggcgactccgtccctcggcacgttttccttttttttttgttttttcgtttttcttaatcttcggcacacataataaatcttgaaagttttcaaatcttgacttaaaagttttcaaatttcgagttgaaagtttcaagtctaagttaaaagtttttcgaatttgagatgacaagtttaaagttttcaaaatttgacttaaaaatttaaattttgagttgaagttttcaaagtttgagttgaatgttttcaaaattttacttaaaagtttaaatcttgagttaaattttttttagttttaatttgaaagttcaaatttagagtttagagttttaaaatttgggtatgatttttaatttttttaatagaaagttttaatttttatttgaaagtttcaggtttaatttttttttaatccgttagtaaaaataacgaccttcgaggaaaaaaaagaaaaaactaccttgattactactcccgagaaagaaaagggcttatcgtagatgggctgaaaaacgacgtgcgtgtgacctcccttgccaacgtgaattaggggctattcagattatagccaaaataaaccttaccaatattaaaattttggtaagttagtgatattattaaaattttggtagaatttcttatgtatttaccaaagtttggcataaaactaaatatatacacatttttgataactttatttaaaaaaggtatggtttgaaaatggaaaaatggcatcaatctgaacagttccttatgaattctgcgggagacaagcctatgctttcaccatgcagaaatctaccagcaatctttgcaaaactaaaaggagacaagatgcatcctaatgaacaatctgttgggccattctgacaatccttgagctttggcaaatatagtaccgaagtatatttttgcaactgtaacccttaacccaacatatatgtattacaacctcatcattaacgtactatatgtaccaaaatactctcagatgttcaactagaatactactagtaggaatagaatcatagggttgaaaattgtagacctaggatcatcatcagactaaacaagatgggcatttgatcgacccgtctggtagtcatcacgagctatctcataattctgcttgagctcctcgtagtgcttcagtgaagcctctgagaactttgtcaggcgatccagaaccgtagttagctttgactgcaacccttccactgcttccacgcttccactcacctcctgctcgttattctccagcatcccacattcctgcgactcgtttctagactgcgattcggtcgtcgttttgtcctgatgatcggccgggtggtcaaacgaaccgcgcaggagctgcatcacctctttgatggacttgcagagctcatctgtggggagtgactgtgactccatcatggcaagccagtctctgcagaggacaaagatcggaggggagagcgcgtggcggggagggaaagagaccttgcgcttgcgcctccgtctgtcctgggctggctgcaggacacacttctggagccacgcgttgagggactcgacgtaggacttgtgagcagtgacccagatcctgaagctggacgagaagcagtccaactcgttccagagatgcgctgcggccctgcggtggtgctcaccttgctgcaccatggtcgaactcttgacatggtatgccagtgatattgtgatgaattgtttgtggtggcattctaacattgctttccacattctgattaacctgcacgaggtatgtgtggtcagttcaaggtttaatatgcaagaaatgagttgaactttaaaatcaacataatccaagttgttttttcactacagcttaagttagaaatgtgagacttcaaattgtccaacaaaacatggttcttgaaagatagtgaatcgttatattctaattttcaatgttctagcaccaaacttaaattgtgagtaatgttgacagttcaaatgctcctaccaaacgcacgaaaaaggaaatatcaaacttcaacaaatgcactgtatccaacaattgtgataaagtatgcaagatcaagttacggcactgctaaatcagctcgacaagtttgatatttaagtacaagtaggtgatgtttaagtacaagtttatacccttggatcagctcgacaagttgtggctgcagttcttcatcccttatcttctctattctttttgatattgcatcaacagcctggatcgcaacagacaccctggaatgaagatccttcacaacagctctggtcttatcaatcagttgagcatttagacctcgtgcaaattggcgccggagaaggttacatttctcatcataagtctttctaacatgttcactagcctacagaaacaaaataatgcagtatcagtgatccattatgccaatgacagtcctacagagagggcaaaatttcatattaataactttcagcctgcatactgtctttgctaattattgtacaagagttcaattctgctgacaaattagaaactaaattgtattatcaatacaaataactatacaaaatatgctttgtattgtcaggtcttctggcaagagatatcttttaaataaaaatttgagaactgcaactaaaatagaccaaatttcacttgaggtatacaataaagcaaatatcttttgtagacaagtgacactaatgatgaattcccaatcaacagccaggagtagagacttgcacgcaatactaaagaaatctcactgcacaagtgcacatgtactgaaaatgtaccttgatttcatcatgtagttttctctcccaagcatgtaacctatccaaggtagacgagtggcttccagataccatggcgaattgctcaacaaaatcactgttactatcacccacatcatcagtaatcattgctgctgtaagtggactcttagatgatgaggacaaagatgatacagaacgcttccaagtgacaacttttgagatattctgtgcagtttctacagaaaacctcaaaattagtacttcaaacaaatgttatggtaaaaatatgagaagaggtcagtaaagcatcctacttaccctggttgagaatattctcacgattgcagcagactcgaagtgcggacacaaatcgggcagtaggtggcttgcctggagaacctggtatttgaggaataaaacaaagatatggagttccatcaaacaatgtcgggcatggtgcaggggaaaaaacagacaagacaatgactcagcatatgattatcacctggaatcttagcacatatatcaagtctgatcttctttgtctcaagcattctggaaacctcattcccagcttctgcggcacgtacaaaccgagtttcaatgtctttcatgcttgacacaaaatcttttgctctatgagtgatgaactctgaagggtcttctgcttctgtgcacaattctttttccatgtcatcttcctccacctttgctccaacttgcccagaagtagtagcttcagttgtaacctcaaccgatccacttggcttactcatcccacctttctttgcttgggcttcttgcttaggtgctgcattatcaccaggaagctctgggtgcattcgatcagacctgtttgttgtttcttctctcagcgagactgcttcagattcccttgaatctctcaggcccttcaatctactaaaatttaatgtcactccattctcattatttgaggtggcactaccagaagtataattggaatcgaagaagtcccacgaggtacataattcagggggcaatggtggtggtggtggcacaaaggtagataccggggattcttgccccacaaagtcagcagcagatggtcaatagtgaacgtcaaaggttttgttcctgctgctttcatgtaatggatctttgttgagggaggagtcagctgactacctcgatgtactggggagccagtgctctctactgctcgagaaggtgatggagaagccatagaagaatgtgatggtgacttatctgcttctgaaatggacagtgatgattctggtgagatctcagactctgcataccgccgcaatgcagtacccacactacggagggactgagtatatgataggtgtgatgccgacagtgcatctcttgaatcaatagctcgcctgatatggcgcattcgctccttgcatagaactagggcatcctcaccagtggctttggatggcgaagaacccattgtgttcaacgaaccaacaaatactattctacaatgtttttgagaccaacagattcatcaaaagaccagctacaaccacaagctaccactgagtagaattcctccctgaaactggcagtagtcttcagtccttggatctaatcgaaacaacaaagaagaaaggtcatgcttccagctagtagaaataactaacaatagaaagaacattaagtaaagcataatcttaaaataaactagtgaaatccaaattacaccaataaaacaattttgaacagaggcacaaaattcgtcacatatccttctaacttgagctatagatgcccaactcaacagaaagtctttaaaaagttcactccatcaggcaattagccggcacatctgcaggcctcacaagaattactccacgggcaacattcatctctatctttgttgaaaactcagcctcctcagacctccaaagttccaactcttcaagcatcatccatggcggccgccggtgcagggaacatgcaccggcaagaaccaatgtcatgggctaaggtaaagagcaaaagaactaaaggaacaacctttgctcccctacccttgctaacctaaaaatgctcaagaaatcattacccaatggccaaatgcaccaagtccattcaagcgaacgcctttgactgagcaatttagggattaaggcaaacaccagagcagcaagagtaaaatggtgagaaaagcaacaagcaaagtcacctttctccgattcctagctctgaccaagtaacaacaacatcatagattcatagattcataaattcaccacctcaaaagcaacacccacaatgccataatctttctcgatgcagataccaaatcctgatgaaatgacccagcaggctcaggttctttagattaaaaaaaaaacaataagtgtgccctaccaccacgacatgggcaaaaggggagaaaagaaaaacataaagagagggctaaaataaaatagttccccacatatagtattctcttccttcttgctagttgctaccaaaatcccagtccaatgtggtcctcacaaatcgcaaatcaccaacaaaatcaacaaaaataatgcagcacaggaagccaagcaacaatcacaagcacactgcaccctaaacccaaccgaaaccccccaggacagcaccaaagaaccctcctttgcctcatctctgagactctctgaccatcacaaaccaagaacctaccacaatctattaaaacatcaagacaagagacctcaccggagcctgaacaggcggcggcggcggaggaggaggaggaggcggcggctggactaaacgggagcagcggcaatgcggtgcgggcgaccgctgtcgatcgatccgggtcacatgcgcacaccagccgcctcctgtcgatttgtttggttctcggagagtggagtactagtcctggtagactactcctaccactagcacactagcagtagtaggagtactagagagataagtaaccgttaatggcggtggagagagagagagtgcggtgcagtggtgtggactgtggagtgaggtgggtggagactggagagttggagacaagggaatgagagcgaggggagataaatggaggtgggggcaggaatctaccctgatggcccatcagatggaggtgatgccgtgatgggcagatctttttaccccctccacagctccactgcattggttgggattacaaatctttttttcagaaagaaaaaaagtgttgtttttactataggtaaatatctgggaaaatatatagtgcaaaaacaaaccagaaaattaccgtatggttaaaaattaatgttttaaatttgtccattttactagaaaaattacttccaaatttaatttaataggaataaaatttttactcaacgtaatatggataaatctcaaatatctatttataaatattttctaggtttgcactatatatattttttccaaatatcttgtgtgcactttggttaggattgaagtgagagcggccatgtaaaactaaaaatagcgatgaaaacggtcggagtcggtatcatatcttcgaaaacgattcttgatctatagaggattaactatatttatcaatttaagtgtttagtgttgataacaatacaatgtttaaagaaattaaaaaaatgaatcactagtacaaaaaaagaacatacaggtggtcaccataggtgctagaaatgctaaaatcggcacttctagtgcttttcccgtccaaaacacgcatccaaggaacaccatcagctagaacagacacctttatggagagataggagccagttctaaataaaaaccgatacctatagtattagtgttagttttattagaagaaacgacacatataatatattacatgtcctggttttttaataagcaacacctatatttatattgtaggtgtcggttagaaaactggactaagctgaatctttccacctctctctctcccttatcttttcctcattctctctgccttttgccctctcccactctatccatctctcagctctctctctcgccccctctctctctccaccacaccaccaggcggaggcagcggtggcctggcggtgggagggtaggcggcagcgccctcccctccaccagatctggcggaagcagaggtggcagcggccccgtggcacgccctcccctccgctccatccgattggaggggaggcggtgacggcctagtgactgcggcggtgccctcctctttgccagatctggtgggaggggaaacggtggtggtg

SEQ ID NO: 83056 - DNA, 714 bp, Oryza sativa
  unsure (1)..(714): unsure at all n locations
cggcgcttgtnatgtagatcnnnnnnnnnnnnnnnnnnnnnnnnnnnnnnnnnnnnnnnnnnnnnnnnnnnnnnnnnnnnnttggagatgattgaatttacaggtgaattacaggtgctgtcattttatgtgaccggtcagaccgggaattgtgtgctggtcagaccggcggtatgcgcgcggtcagaccggccagcccgcggtctgaccggctgactctgtgtcggtttcggtttcgggttgtttgtttggatatccgtgattatttcatgattatggcttctagatggatactatacatatgtaatactgttgtttgctactaatgagtcaagttggagatagcttgttctcggaatatggtttctttgtttatttcatgtgtaggtgactcgatgcctcgggagagtatttgcggtgatggaccgggagtcggcttggggataagacgacgttcgtggtggtcagagatcatgcgggatacttaggctagagttgatgcacgtggttgatggagattccatatggcatacgatggaggtattgtgtgcgtatgggatgcggagttaaatttggaaggagtccaactttggtaccgatggttatgtaaaagtttgttcntgtactagagggtttcctaaagtatttagaactcctagtattgagttgggtcgtggctttaagcttgctaccttgggtataaatagtggggga

SEQ ID NO: 83057 - DNA, 18465 bp, Oryza sativa
  unsure (1)..(18465): unsure at all n locations
tgcaacacctatgaggcgcgtcatgggtggggccttgactgcggtgggcgatgagagaggtgtgcggcgggtagaaactcaacggcggcgggctgtggctagtggggagaagggtggtggtcggtaagagaggctcgcagtggccccttcctcttgccttcaccgttgcaaacttgcaatcgcgtgccgccatccagctgtctcgatctacacgtaaatccgaaggtgagaaggacaacgccatggtgtgccgtcccgatttcacacacatctcggaccccgtcgccgccccttgccccttgttcccgttgtcccgtcccgatgggaattgcagtgggcaggtaggatgccatcaccgcccacttctagaggcgatgtctcgttggatccctggtggcaaagcccgccagccagttattcctctcaccacccaccactagcctccatcctcttcaccgcctgccgctccgccgtcctcctcgccacccgccgccgtcctcctcactacccaccgctggtcttctcctcaccactcgccacctcgtgagatgggaacagcggaggaaaagagagataggtggagaggctctaacatgtggggcccatgctgactcagcgattgactcggatcaagttgccacgtcggacaaaaccacccactatactgtcatgggacgtacgttgcaccagttttggcagttgagggacccgttgcatctcgtatttcgattctaggacaaaaatcgaactcgctggaacctataaaatgaacctattcccctcaccatcagggctcagcttccagcacgattcaaggaagattgggcagaattgttcgccgacttcgagctttctgattgcgaggaagacagccaggaggagtaagaaggaaaggcacaagtttgagtcaaattcctgcaaaacttagcgaggaagaaggaaaaggcacaagttgagtcaaattcctgccaaattctcacaaaattcctcagttccaaaggaggcatgagttaacatcgctgctgcggaatccaactcaaattgaaaccaaaaccaaagccagtgtgagagaactaaatccaattgatcaactgcaactgtaatggttcacagtgaattggttacagatggtactagtcaccaatcaagcattctagctgaaacactagtttactccagtaatttggcagcatgatgaccaacgtaggagctagtagaaactcctttgtagatactgttatgggtaaagcataccaactgataacacatacgcctacttgccagtatgaatgaaatgcagctaactaggcagtacattttcaagtcactcatttcctaaccaggttgataatattcggaatacatattacacaaacacagagatattttgagaactagagtacaaaagaaacttgatgttacaggggagtggaacacttcatactcaatcagaatcagaatcttgagcggttgaagatctgaccctcctgttcattgacatataggtttcatcatcttcatcatcctcatccttcttcttttcgtcaattatacctatattgttgtatgttatcatatttgttactatttcaatttttgaagtaattgtgaagacgtaatagatatacctttcatcttgagtatattttccaatgctcttgttgaaaaatcatctttgctgccgaggtcttgaaacccaattaaccgatcagcagcaatgcccttcctaaataacaaaatgtcagttggacagcaaaaacagaaagtgtctgactcttgggttggtcctcaaaaaagttaagcaccaaacagttgagcacatgtgataaaaatccatgggtagaaatgatgaaagtttatgcacttacttgaacagtatcacacagggcaatgttttgattcccagtttcgtgacaaagaacggagcattctggattagttatttacaagattagacagcatctttgttataaaatacaattaactgaatgctaatagagatcgcattctaacttcagcatcaagcttgatgaatttagttcccaaatagattggtgcaagggccttcaaatgcttatccatgatcctaggaaacatttagataggtgtccatgaattatcatcagggtcaatcataaaacattttgtattgttttttaaagaacaacttatgtcctacttgcaacggtaaaattcacggtggtagaaatggcagatgactttttcactgccagtgacctctcctaggaagtccccttcagttatctccctatattcaccatgaccttgcctttttagcacttcacgcttctcgacctctttctgttatgcacaggcaaatgaataacttaaagtgaagagttcacaagcttcatgagggcaatatgcagatactaccttgagagcagcaattctctccgcatgcaacttctcaagctctgggtcctatagtgtagttccacagcatgatagataaaaaggtattcagtgcttcaaactaaagaaaaaaaaacaagagaaatataaaagatactatagttcaactcacatccaataattcgtcaagatcaacttcatcatggcttgcacttgctgcttgggctttctctttagctacaatttcctaacatgattactatgtcagtatgcagaaacaaaatcacaagggggcagagagaatagtattaccctgttctgtaagcaaatttgtttaaaaagatgcaagaggttcacagcatcggaacatgagggtaaaaatactttcacccccactataacaaggaaatgagtgaaaatgacacaaagaataagagaagataagaacttgcccaatcacattacaaggagtaaagaatcaagtataaataaaaaaaaaacaagtgatgtgcatgaaggacagttacatctttttgttctatactttcgatgtaaacttcaacagtttgttgctgtcaatatacagaaagctcattttgatataaaaaaagaataccgataaactttacacaacatgcattcatgtaagagcaaaatgcatcagaagttaacccattaccaaaatacataagaacgcgcagatggagcatgatccactgcagctttgattattgtaaacttgcaagctataccccaagctaaccacatttacaggctaaatgggagaagcccttgtttttgtgtactctgaggtgtcataaagcattacctcctaaccagcatggaataaactggtctctatagagtctagaccctgcaccatcactctatttcctgtcctagaatacaggactggagctaatccatcctcctaatgaactatgatcccaatcccaatgttcccaaccaaagattggatcatgctactaggcaagatttttcgcatgaaccaacatcactcccatagccaaaggctcaaacctaatgcgcctgccctttcccaagacgaaaaatcacactgctgtagtgctgtattaccaggatcatcctccacattgctatatggttctaccttcaacaatccatgcccgcagcacagctgagccgaggtgaatcagctgccagttccaacgataggtgtaccggactacaactcacttccaatttaaaattgagatttaatcgcctggttctgagatgcagggatctaggagcacaccagctccaccaccaccagccaacctgccagatcagtttttacaccccccccccaccccccaaccccttcttaaaaaaaagaaaaattacaacaaggacataaaatgaaaatgatagaagataataacttgccaatctcattacaagttgtgaaaaatcaagtacagataaaaggataaaagaaacaagttatgtgcatgaaggacagttatatctttttctctacactatgatgcaaaccccacacttttttgctgtaaaactacagaaagacgattttgatattaaaaggactgcctacaaaatttacatgacatgcattcagaaggcaacagaaggtaaaccattttcaatatataaaagaacggccagatggatcatgatcccctccaaatttgattattctaaattgaaataatatcttcaactgagccacgtttattggctaaatttgagaagaagcaacctttgataaatgataaagaattatcatcaccaattcagaacggaacacagtagtctctagaccctactacatcactctactagttgtcctggaatacatgactggagataatccatccccccttatgaactaaacctcctcatgatcccaatcaaagaccacctttcacaacccatgcccgctgcgcagccgagccaagtgctccgcggccgaatcaaccgccagagtactagactataactcacttccaatcaagaacagtgatctgatctgatccccgcgagataaagtggcacgcgagacctaggtgaacgagcgtcgggagaagaagggggggagtgagtgagtcaccttctggtagtcgcgggcggcggcggccatgacgttgccgaaggccaggttggagagcgtcgacttcaccgcgtcgggatccatggctgttcctccccctcttgcgatgctgctgctgctgctactccctcctccgcgagcaccgccgccgccgcttctgctcggccgagatctcctcccctccgatccgattcaggtggcggcgccgcgcagagcagctcgcaccggagcaccagtggccgagagaggtgacgtcggcgctagcggcgggcggacgagcggcgccgcacggttttcttttttctttccttttttttttaggcgagcctcgcacgattgtgctgtgccgtcgcccggggaactgtacgtgcgtatggtgtatagctgggcaaatgggccgtgccaagcagggcccagcccaagcacggcacgacaccgcctgggtggtgcaggccaagcctgtgtttaagcccatataagacgcgcaacccaagtcttacgcacaggagaaatttggtaccacacgggaaatctacgtagtcttagaccattatgctcccactgagctcggtggcgtgagcttgtcaccccagctgcagggggcaggagttggcagggtttgggggattgacggtatagaagatatctctctcctaacccacgatagaagccatggcactgcatggggcgggtgtggtatatataaggtatctctctccgaatccacaaagagatagatgccatgggtgtggtatatataaggtatttctctccgaacccataaaaagatagaagccatggcactatattgccaactccttttcttttcttttcttttcttttctaaattctaaatgggactagctagctatattttataggaaaaagggcactatattgctaactccttttcttttctaaataggacacggggcgggtgtggtatatataaggtatctctctccgaacccacaaagagatagaagccatggcactatattgccaactccttttcttttcttttcttttcttttctaaattctaaatgggactagctagctatattttataggaaaaagggcactatattgctaactccttttcttttctaaataggacacgggtcttttcttttcttttctaaattctaaatgggactagctagctatattttataggaaaaagggcactatattgctaactccttttcttttctaaatgggacacgggtgttggcagggttcgggggattgagggtatataaggtatctctctccgaacccacgaagagtagccatgacactatattgccaactccttttcttttctaaattctaaatgggactagctagctatattttataggaaaaagggcactatatttgggactagctagctatattttataggaaaaagggcactatattgctaactccttttcttttctaaatgggactagctatattttataggaaaaagggcactatattgctaactccttttcttttctaaatgggactagctatattttatagggaaaagtatgaattaccccctccctcgaactatcgcgatcatccgaattacccccctgaaccacaaaaccggacattcttcacccccaactatgcaaaccggacaaattacccccctcgacccaatccgcgggacattcttcacccccaactatgtaaaccggacgaattaccctcctcgacccaatccacggtggttttggtctatgaggcagtccagtcagcattctatctataaaaaaatgtgggacccaatccatggtggttttggtctatgtggtgtacacgttgcagtctctcactcttcctctcttctctctctcactctgtctcactcttcgtctctctctctctctcacggattggcggcggtgggtgatgcggaggcgagggaggagcgtggaggcagggcgaggtgatgcgaagcgagggtgcggcggtgaggtgaggcgagcgcggtggcggaggaggcgaggcggcacggcacgctcttcctcccgtccttgggcccggttcgctgcaccggcggcagcgcatcgccggtggacgaggagagcgtgcgacggacggggagcgaggctgccagcctgttctcctcttctcgccatcctcgatcccctgatgccgctggccagccacgccgcaccgttgttccctccctgagctccgatgtttcctgagctcgtgtgcctaccaccgtcacccaagccacctgcggcattacccctctcaccgagctacgatgccgccgcgctgagcttgccgccgcttgtctcctccttccaggcatcaccgagctcgtgtttggatctggggtggtggagcgggattggcgagtggaaggggctggtggagcgggattcccggtcaccatccacgcctacgtcctcgggtggaaccgcatctgccagtctccgtcgctgatcctggcacggggaggtgggacggggtgcggcgcgacggctcagaggaggagcacgcgcgtggcggcggtgtcccaccgcgtgtccctgcgcgccaccgccgtggaagagcccgccgcccactgcgcatccccgcgcgcccacgacgaggaggaggagcccgccgcccacgcgcgtccccgcgcgcccggttagctccgctcagtcgccggccgcgtcgtctcgggcccctccgccacccacaactggctccttccccgcgcgctgccatcctcacctcgccattcacatcaacaagtcgctggagtcggagtcctccaccgagctagctccgccgatacgctcctcctccgcatccgcctccgtgccgacgtcctgagcaccgatgactgcgctgtcctcgccgaccgcccttccccgcgcttgtcctcgccgtgtgcgctgcgcgagagagaaaagagtgtgagagaaagagaatagagagagaggaagaagagtatgacatgcgggtcccacaattttttaattaaaaaacgctgactggattgccaggtgtacgccacgtagaccaaaaccaccgcggattgggtcgagggggtaattcgtccggtttacatagttgagggtaaagaatgtccggttttgtggttcacgggggtaattcggatgaccgcgatagttcggggggggggtaattcgtactttttcctattttacaactaaaaactagcttatacatttattgtcaaattttataactaaagaaactggtaacttgcccatgctaatgctacagcgacatttagtaatgcaaattaataaatgctcaccacaggtattattgcaccatgaagtgtgctaaatagaactatccatgttttattcaggtcacttgcaacaaaagttgagtaaatatactacagatacatttcaagcccatctatcatgcaatagaagtattttcagaaagtagaccacatacaaggctactgagtttaagggtaaactaagggtgatacatacatctaaaaatattactccctttatcctaaaatataacaacttctaacctcaaagtttatcaaaaattataacaacttcttcaccatattctcttctcaaccgatcataactctccaccatttaattttctcacctacctctacttctcaaccgatcacaacactctcatttaattatacaaacttttttaatacccgtattcaatcctaaaaatccttatattccgggacggagggagtagcatatttgaccattgactaagctcttcatcggaaaacatgtaagtggccttgtttaacaagttctcgagcacctgaagccccagtgaacttcatttgatttgcagtgaaatctgatatccaatagtcataaaaataaaggggtatccagatagtgttttcttcacgacatgctgagtcggtaacaaaaaaaaaattgttaattagtccacgcatcacgttgagattggcgcaagaaaaaaagaaggcaagatttcaatcgaattaatgacttatagaatactatgtcagcttattcaatagcttccaacatctctgacctaaaggaaagttatccacaacctagtaaatattctgctaataatatatcttttgataatgaaacctataaaggcttataaacagaggaattacaatcgtgcagcaaaagtaccttaaggggattgatagccacttcaataaatcaattaaagaaacatcataaaccacaaataaccatcaatcactggtggagaaatgatctttgctgggttgacccaagaccacaatagtcccagttccaaaaagaaccgggactgaaaatgatctttagtcccggttgaaaaccctaccgccattctatgatctttagtcccggttggtgttaccaacaccaaccgggactaatatcatttttagtcccggttcatcccctgtcagatgtatgtgagggggccgagaatctttagtcccggttggtgttggtaaaatctttagtccaaaaagaaccggaactaaaattgaacgcgtagtatataatccctttcacttatcctctcctccacaatcgcaactcacacagatcgaatctctccccctctcctctcctacatatcagatctatcctctcttcctcatcccctctcctccacctcctccccttcctcctctcctccctctcctccccttcctcctcttcccccacctccctttcccatccggcagggctgtaggcagcggccgtggcgagcggcggcaacggctttgtttttgttttttgttttttttataatttatgattcactgagatgtataaatttgtgattcattgtatggatctgtgatgcatttgatttgtgtgtacaagtaactttaagatttgtgatgtggatttggtgatgtgaatttgggatgttactttgatttggggatttgggtttcgatttggggatttctatgccacttgattcgggagaaaataaaaaggaaaaaaaatgaccttctattactgccactattatctctttactcccggttggtaacagcaaccgggactaaagatccctctctttagtcccggttggtgttaacaaccgtgactaaagatccatctctagtcccggttattttaaccagtactaaagatgttcatctttagtcccgaattgctactcccggttggaaaaccgggaggtttccaaccgggagtaaaaatgggttctccaccggtgaatgtttagtagaccaattatgtatttgtcacatgggtaaagcagaaaatgtcaggagtactgcaaaaaatgctattatgcatatctaagggtagtagatcagtttttaacttgacagcaaccaaaagccatgcagaaatctacaaatccatgtgtgtctcagtcatggagtgcgccccatttccttggtgactaaaccattataacgggatcaaagtacgacgtcagattcctttatactgcaaactcggtatctacatttgcatacatctgagcaatcaaaattttaaattatcaaatagaataaaacttgaacctattgtgtgccatcatatatctacaatttatccatcatattccatgaaacagtccatttatcttcaaattcctagaataattcaatctgatccaatttagaaagataaaggcactggtggagaaaccatctttcgtcagtcggccgaattccacaatagtcccggatacaataaaaaccggggctaaagatgatctttagtcccggttaaaaagggtaacgggcatatttgatctttagtcccggttggtaacacaccaaccgggactaaagatcatctttagtcccggttcaaatgctgtcagggtctgttaggcccctcgggatttttagtcccggttggcaccaaccggaactaaagatcgtaactttagtcccggttggtattaccaaccgggactatagatctcgtggatctttagccccggttggtaacaccaaccaggactaaagtcccacccctatatatgtcttcttcctcctccagctgcccgagcaagcttcaaaatttcttcaaaaaagaggggaggtcatgccaaaatttctagtgaatttattttggtgattacatacaaatcggaggtgcctaaaaggtttgcaacttcatcctccaatgttttttttgtcatattacatttgtagctatgttttgcacacttttttgtctccaaaatttagttgtaagttgatgagggagaaaatttgtgtggggaataaagaatatatagaaatttagttgatttgctaaagaaggttttataaaatagttgagaaggaaaactatagtgaaagttaatcttgaataatagaaaacaaactaaaatgaaaattaaaagaagtaaaacacattaaaattagtttaaaactttagaaatagtaaataagaattatttggtgtaatattttatgatttttgtatgaataaagatatgtcattattgtatgactgttgaaacagtttgtaattatcttataattattgtatgattgtcattattgtaagaataattatttttgtacgattttttttcgactcatgtagatggatcggcaatggatgtacactgaccggtggtccaaagagtttattgacgacgtgcactattttttgagagtggccgaagctaacaggcaaaggggttttatttgttgtccatgcaataagtgtaagaatcagaaggagtattctgcatccaggactattcatttctacttgtttgagtcggggtttatgccaagctataactgtggacatcccacggagagcaaggtgttgaaatggaagaatatgaagtggaagacgacaatattctggactttgctcagtgtcacaccccgaagttttcctcccaagccaaaattgtaattcttataaatgaccctaagaaaatgnctaggtggaaaaaccaggnagaaaaccncnntaagnaaagtaatgcaaataataatcggatttgacatgtggaatttttcttgagttctacatgtcgaaattcattaacaggatttttagtggaattttcagagctctagaaataattttaaccaattaaaattgagcaagcaatattttaattccagggaaaatccttttttcttttttctttttctttttcctccctttttcctcctttttttcgaatgggccgccggcccattctctcctttccttccccctcctccttgctgggccggccgcaggccaaggcccagccaggccgcctcgccgcctcctctctcggggtcgccgacaggtggggcccacctgtcaggtccttcccccacctcccgccgatctcgctcgcgccgccgcgcccgcaaccgccgccgcgccctcgtctccgcctcatccaggccacgtcgaccacacccgcgcgtgcgccgcgtctcccgcgcccactcctctccctctcccgctcgcgcccgcgcccgagatggccgggattcgattttcgaatcccgcctctctctcctcccccactccccacgtcggccggcgattcccgcctctcccggccacgtccgattccctctccccctatttaagcatcgccgtcgtctcctctcactttttccccatttcgccgcactctctcgagcctcccatcgctcccgcgccgtgcaaccccttgccgccgccttttccgctactccggccaccgctagccgccattagggtcgccgccaggccgcgccgtcgccgccgtcgggttcgcgtggccgagatccaccccgtccacccctcctccgtcgaggttcgtcgccggagccctcgttcccccgcactcgggtgagcaccacctccaccgccgccttcggccatggtttccggtcgccgtggtccatctacctctctctaatccctctcttctccttccttagggcaccccgaagctcgtccgcccgccgacgtcgtcctcccgtggcttgccgtcgccgttcgccatcatcttcctccgcgccggccaccctcggtgaggcacccctcccctcttttccccttcctctccttctagtgccgtgccgccgcttcgcgcagccgccttcgcgtcgccttttgcgccgtcgccttcgccgccggttgccgtcgccggcaacgcgttcgcgcgccgttgccgtcgccgcggccggtcggtctgccttgagccaagccgagccgggtgccgccgcccctttcctcccaagccgctgaccagtgggcccgcgtgccggcgcttttcctccctctcctgagtcgctgaccggtgggccccgcatgtcggcgccgcgccccctccgtgctgacgtcagccctggaatatattgcgcaataaatgatttaaggtttttcttttatagtaataaacacagtgaatcttctaaaattcataactaattcatccgagctccgtttaagcccattcaagtctcagtaaatcaagaaaagtgtgtagaatccataaaaaatggttttgttccctgtttcagtagtcttatagcctgtttgcaatgtttgctttgtatgtcgctagattccgatccctccgacgctccggtgtactttgagatagtcgccgaggttcctccagcagcagagcaaggcaagtcatgcttgtcacttgaacatgttgatcctatattgcaaatgctctattgttttctttcaaatattgcattgttttataatattactatgagatggttacctattgttacagccatgcttgttggataccatgctcctttgttagcttgggttataacatgattagagtttggactaggaattgcttagctatgcttagttcaactagttcacaatgggaaaaatcatattaatgtttagactgttggttctaatggtaatgttggtttagtaccaccgctctggtgtgggttaattaaaatgaatcacatggtgggctgtgggtgcatggttttgctggtcgcacccatggcagttaaggaccggtgcgcgggatgccctggaagaacttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatcttttgaatttggatagtttaggtggatggttgggcctgtcgcaacgtgggttagcgttggacagcggatgattaaaattaattaattattacaactgtttaaatctttcaatttctgtttataaatgctcgctttatgcaaatgaactacttcagctcttctttgttaattccctgcatcatacccctattccggtatgacttgctgagtacagtgggtagtactcagtcttgctctacttttcccaaccccagagttcgagttcgggtcagatgaaggtttctctgaggagtaggcttcgtccgtgccgtcgaggatgcctgtggagtggtgttcccgctgcagtttagtcaaagtttagtcaaggcttagcccctgttgtttttcttttcttccgctgcatttatgtaagactttatgatgtttgtaagacgtggatctgtatgtcaacattgtcgtttgtgtaccccggctggtcctggacggggattttaatgcacattctgcttggaattctattcgggaatttctgggcgtgacactcagtacgttggatttgaaggaaatcaaacgggcgaggaggaaagggatgctgatggtaacgacgttgcggatgatattggtcagatgttgcaggacgccaaggaggactgcgaaagtgaaaagggggcccataaattggacaagatgttagaggaccacagaatttcgttgtacccaggttgcgagcaggggcacaaaaagttggataccactctggagttcttgcaatggaaggcaaaaaatggggttagtgacaaggcatttggcgatttattgaaactcgtcaagaacattcttccagagggaaacaaattgcccgagacaacgtacgaggctaagaagatagtctgcccgctaggactggaagttcagaagattcacgcatgtccgaatgattgtatcctatatcgcggtgaggagtatgagaacctagaagcatgccctgtttacaaagcactacgatacaagattagacgagacgatccaggagaagttgacgggcagctaacaaagaagagaattcctgctaaggtgatgtggtatttccctataataccacgactaaggcgtttgttcaggaacaaggggaatgctagaatgatgcgatggcacgttgaagagcgtcaacaggacgggatgctgagacaccccgctgatggttcgcagtggcgaaacatcgacagaaaatttaaagaatttggaaaggacgcacgaaacatacggtttggtttgagtacggatggcatgaatccttttggagagatgagcagcggccataggacttggcccgttacgatgtgtatctacaacctcccccctggctatgtatgaagaggaagtacataatgatgccgattattattcaaggccccaagcaacctggtaacgacatcgatgtgtacctaagaccactggtcgaagatcttaagctgttgtggaagaaggaaggtgtccccgtgtgggacgaggacaaacaggaggagtttaacatacgagcgctgctgttcgtaaccatcaacgattggcctgcacttagcaacctatctgaacagtccaacaaggggtacaaggcttgcactcactgtatggatgaaacagaaagtacgtatcttaagcactataggaaggttgtatacatgggtcatcatcgattccttgcagcaaaccacccggtacggaagaaaggcaagcacttcgaacataaggctgaccaccgtatgaagcctaaacatcgcagcgggaaaacagtgtttgctatggttaaagatcttaaagtagtgttcggaaaggggcctggaagccagcctatagagagcgaagatggtcacgcggcgatgtggaaaaagaactctatattttgggagttaccctattgggaattcttggacgtacgccacgcaattgacgtgatgcacctcactaagaacctttgcgtaaaccttcttggcttcctaggtgtatacggaaagtcgaaagatacactggaagcacgtaataatctgaagcatatggaacaacgcagcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccaaacaatgtctgggcaacaatgacaaagctatgtgcattcatgaacgcaattttgcagaaggtcatcgatccggatagattagaagcccttcagaatgatgtggtgcaatgtcttgtcagttttgagttgatatttctaccttcatttttcaatataatgacgcatctgctttgttaccttgtgaaagagatcagtattctcgggcctgtgtacctatacaacatatttcctttcgagaggtacatgggcgttctgaagaagtatgttcataaccgtgctcatccagaggcaagcatcgccaagggttatggaacagaggaggtcatcgaattttgcgtagaatttatcgaagatcttcgcccaatcggggtacctgaatcacgccatgaagggagactacggggaaagggaactctcggaaggaaagcaataatgacggtagacaacaatttattccgtaaagcccatttcacggttctgcacaatcttcatttgtagctccttatatcgaggagcacttggctctagttcgcgccaggaacatcggtaagtccgatgcatggattacacggcatcacattgatactttccccgcgtggatacgacaacatctcatgggtaacgagtagatcaaccaacaacttgccttcctggcgagaggaccgtcttagtcgatcgcgacattccagggatatgagatcaatgggtacacattctacacgagagctcaagacatgaagagcacgaaccaaaacaacgctgttcgtgtcgatgccatgggacacgttggaacaactggcacgtattacggtgccatcgaggacatatgggaacttgactatggtcctctcaaggttcctctgttccggtgccaatgggttaggttgactggtggaggcgtaatgattgatgacagtgggatgacaacggttgaccttaacaaggttggatacttggacgaaccttttgtccttgccgatgatgtaacgcaagtctttttcgtgaaggacatgtctagcaaaggaaagaagggtagagggcctgacgagcctaagaatcacgtggttctcccaggcaaaagaaaaatcgtcgaagttgaggacaagactgacgaggattacgatcagttggatgggcaaccccctttcacggtgacgattgaccttagcatcctcctatcaaatgaagacaccccttactcacgtagcgatcacaaggagggaacaatattaaggagaaagtacgtgcggtcaactgtcaccgtcgatgtattgccgtaattattttgtacacgatgtaaactattttggatgtattgattatccatataaatcaattgatgtatggaatatgttaattacgcacgattattagaggttttaacaagtttaaatcatgtatatgctagttatacgcgatacttacaatttttaattgttttaaatcacgcaggtggcaatttcatatgttaattagagtttttaacatttaatttactataattcatatgctaattataattgactaaagaatttttaaaagtttcaaatcatgcatgtggcatttacatatgttaattagagtttttcacaatttaatttactatcattcatatgctagttatatatgactattcgattttttaaaatttttaaatcatgcatgtggcatttacatatgttaattagagtttttaacaattaatttaatataattcctatgctaagtatatatgatgtttacaatttttattaattttaaatcatgccgtatgtatatacatatgttaattagagtttttaccaatttaataatatcattcatatgctaagtatatatgattattagaatttttattaattttaaatcatatatttgcttattacgttttatccacttaatttattacagacaacaataatttttcgaagtaattatcattaatctttgtactttaaataattttaaataattgtaatgcattatcttctattttagaaacacatatgtaatggaaaataatattcagtgcgcttatcagtagttccggttcttaaccctaaccgggtttaaaaagaatttggaaatagcgggaaaagatctttagtcccggttgatgagaacaatcgagagtaaagatatctttactctcggttgccgccagccaccgagtttcagacgccgacgccgacctcatcacgacacgatgccgcgccacgagacgccacgacgccgccacggcacggcaccggcgccgcgccgccacg

SEQ ID NO: 83058 - DNA, 1132 bp, Oryza sativa
  unsure (1)..(1132): unsure at all n locations
aggcgccttgantttcganactgaagaacctctagcnnnnnnnnnnnnnnnnnnnnnnnnnnnnnnnnnnnnnnnnnnnnnnnnnnnnnntgtccggggattgatttgccgagtgtattattgatcgtatgatctgggagcagatcgtgccctaagaggcacctggacccctccttatataggggaaggggtccgtattataaaatacagtccatatccctaacggaataagtagttacagataagattcaatcttaaccgactaagatcccgggtatttccttaacatacaagtttggaatttaacccaagtccctttaaagatattctatctatacatggcaccccatacccagtcggattataaatgccgtgttggtatggggtatccataatctccacaaaattggaataatgtgacggaaaagttgaaagtttgtgtgtaggaaagttttgatgtgatggaaaagttgaaagtttggaactaaactcggcctataatatataggacgattcattttgcttgaagattggtgatctaccggtatatttcctccgtactaaaataaacaatccagtatgaagtatgatatatcagaatcctattgttacgaaatccggacagtagatcgttataattgcccaaccaaaaaaaaaaagatcgttataattgccagtacacgaaggaattattactattgggccgattgggtcaataagcccatgagagcccactgggccggtgctgctgacgtcacgccgagctacttacctccgcgagcggccacaactccgctccccttccccctcttcgcctgagtcgagtcgcctcccccaccgccggccaaccatgctgccgccggccgcccgcctcgcggcccgccgccttctagggctcgcgacctcctccgcctcggaatcggccgcggcgcgacgcttgtcccgttctccggtcagtgcccccctccccctcctccaaatgcctctgtatctcctcgctgttcgtcggcggagctttgccgtcctgatctctcccttcgggggcaacgtctcgttgcagatctcctacgccgncgcgggctgctccttcaggctgntctccacggcgcttaactacgtacgtgaggcgcct

SEQ ID NO: 83059 - DNA, 674 bp, Oryza sativa
acgattaggaaaacgggacacagttgatcagaaaagcactcgacttagcattaaccagcctaaacgcggggaacgctttacagaatgcaaccctttgcccttttggaattaaaagtttggaattacaggccatgacacggctcaaacccagactgaacatctattacaggtaacaagcattatttttttttgattgcaagactgtatacaggcgtcatcacgttaccagcgaccgttggcgtaacggcgatggtatagaaaggatccattcaactcactagccaaattggtgtaatccggtatttgctgggggtatccatttgacccaactgcatggttcatcgatggatatgagagccatcaaccaagctttgatggacttatgtacacagccattagaataagcattcatgagggaaatggctttccttgtcccctggaagcacctatgtataggccctgagtatccctcgcggaaatgggtaagcaaataaaccgcccagactgttagcgaaaccatttctgtctgccaattggctttaacaaaacggtacggtggacaaatgttggggatatgaccaaggactctggatactgcattgctctgtacctctcaaacaatcgttatgatgtaagtgcgaaatattttccactgcccttgggatgtgcagaaa

SEQ ID NO: 83060 - DNA, 10252 bp, Oryza sativa
tcccgctcctgccacaccgagaacgtgaacgagcgaacgaacgtgaacgtgaaatgcaattataggcaggtgaatgaacgtgaacgaacaaacgtaggtgaatgaaacgtgaccttaacgagaacgcgtacgtgaacgatatcgtgaacgaaacatgaacgtcaaatgcaatatatgttacttcgcgtttatgctaatacatctttttgtatcttgcagaaaagacgttgttggagtcgtccctcaagccggagtggtagagctagccctcgaaggaattcgcgcaggcaagtaacgtaattatatatatatatatatatgattgttatatttgtaatgcaattaagattattagatttgtaattagacttaattagcatataagattgtgtagtgttctaatatacgacagttatacttagaatacatgactatttgagttttagtataagattattggagttttaatataagattattatatttgtaattagacttagtatataattattgactagctagggtcctataatatacgtcacctagacttagcatatatcatcactatttgagttttagtataagattattagatttgtaattagacttagcatgtaagattgtgtagggttctaatatacgacagttacacttagcatacatgactattttagtcttagcatataagattatttgagttttaatataagattattatatttgtaattagacttagtatataattattgactagctagggtcctataatatacgtcacctagacttagcatatatcattactatttgagttttagtataagattattagatttgtaattagacttagcttctaagattgtgtagggttctaatatacgacaattacacttagcatacatgactgttcatttagtcttagtatataagattatttgagttttaatataagatttttaaaacataaatgtctcatgacttagcagatgtttcctgtatgaatagatggctgatcgcgatgaggaacagatattatacgatacaatcgcggagggaagcagccagtactggaacgaagaagaggggaacgaggatccaaaccagtatttgaacgaggaagggaacgtggagagggatgcggaggggaactaggaggggcacgtggaaagggatgtggaggggaaccaggaggaggaggtgtcaggcccagaaattctcgaaccagaatttctaagctgaatgtgcattaaatccctgtccaggaccagccagggtacacaaacgacaattgttgacatacagatccacgtcttacaaaaatagaaaagataacaaatgcagcggaaaagataaaagcgagctaaaccgggaagcttgacttcagtagcgagcggttccattccacaggcaatccttgacggcagcgacgaaaccaactttgacaaaacagctccaactaggaaaatcttcagctctggtgtgggggaaaagagagcaagactgagtactacccactgtactcagcaagtcataccggaagaggaggtatgatgcaggatacaaccaaaggaggctagaggttcttttgcataaagctagcatttaaaagcagtagttgaaagcagtaaaacagctgtagtaattaatcaatattaaccaatcactgtccaacgctacaccacgttgcaacaggcccaaccaaccacctgaactacaccagttcattaagctaaactaggggtgagactaatcacggtgaatctggttaatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcgatcccctcttgcgccgcggtgaatccggcagctggacaaccggacaccccggccgacccaactccatcacgcccaccctcgccaccggtgcctaggaaagggtcgaggtatacttcagatcaagcagttacccactcccgcttgtggtaagcacggtaagtctcccagggtttcccgtgaaccggtccttaattgccatgggtgcgaccagcaaaaccatgcacccacagcccaccattcaatgtattttaattaactaacaccgttgcggtggcaccaatccaaagctatgctcatagtcaaagtctatgtaataatgtgatccccatatgtgtgctagttgaactaagcatggctaagcatttcctaaaccaacatctagtcattttgatacccaagttgtcaatggcatatggtaaacaataaatggctgagtaataggacccatcccacatgatattgtaaaagaatgcaacatttaatagaaatgcgggatattggtaaattgggtacaatatgatcaaacgtattgcatgacttgccttgctctcgcactgatgagatcacagcaacgtcttcgagaaactgcggatcgacgaaacggccgaaacctacgcgacaaacaaagcacacaagcaaaacatgctataagactacagaaacaggaaacaaaaccatttttaatggattctttgcatttttcttgatttactgagacttgaatggacttaaacggagctcggatgaattacttatgaattttagaagataaactgtgtttttactaataaagaaaagtccttaatcaatttattgcgcaataaagcccagggctgacgtcagcggaaggggggggcggcgccgacaggcggggcccacgggtcagcggttcaagagaggggagagagaagcgccggcaagcgggcccactgggcagcggctcaaagggggtcggtccaccgtggaccgggaccacgcgggtggtccaccgccggtccacgggaccgacggtccagatcggccgggagaccgatcggacggcacggcggcgactaggcacgactcggctcggcttcaaaaccggccggccggccatggcgaggcgacgacggcgcacgaccgccggcggtgcggggagacggcggcggacggcgcgaaaggcggcggcggacggccggagcggcggcacagccaaaggcggcggcgcacgcgtgaaggggagaaaagggagggggagggaggcatcggccgggctcagctcggcctcaaggccgaccggggcgaggcggcggcgaggcacgaccaccgacggcggggaccggcggcgcgggaagcggcggcgacggccgaaaggtggcggcgcatggctgaagcgcggcgatgcacgtgcggagggcggcggcatgcacgggagagagagtaaagaaagaaggagagagaggtagtcctcaccggcgatgtgggggaatcggggtccggcggcggcggacggaaagcgagcggcggccgaggtagctctcgcggcggcgaatctagcggcggtgattgcgcggcgaggcgatggctctagcgacggcagcgtgcggccggaggcggcggcaagcggtggcgctagcggcgagcggcgcgggctcgttaggagacacgggaggggacggcaaatgggggaaacgagagagggagctcgggagagtgatttaatggtgcgggaggaggcggacgtggccgggaaagcctccgatttcgccggcgacgtggggtggagagagagagagaggggtgggattcgaaagcgaatcccgcccatttgtgggcgcgcgcgcgagcgggaaaggcggaggaggtgggcggcgtgggcgcggggtgcgggcgcgatgaggggcgcgacgtggagcggagaaggcggggcggcagcggcggttgccggtgtgggcgcacggctggaggttggggacgacccgacaggtggggcccacctgtcggcgtcccgaagggatggggagggggcgcgggccggcccaagaaggagatgggcgcacgcggcggcggggtggactgggccgacggcccaagaagaggaaaaaaaggaggaaaaaggaaaaagaaaaaaaaaagaagaaaggatttttcctgggattaaaatattgcgcttgctcatttttaattggttaaaattatttccaaggctctgaaaattccactaaaaatcctgttaacgcattggagcatggggaactcaagaaaaattccaccacgctatttccgattattaattgcatttattaactagggattcagctctaggttaattaagataatttcttcggacaatttatttaaccaattttttaaagcaagcaaaaggggaaacttccgggcgtgacaaacctaccccccttaaacggaatctcgaccccgagattcggaagagctggcgaagaggtatgggtgggtggccttcaactcatcttctctttcccaagtggcctcttcctctgagtggtggctccactgaaccttgcagaatctgattactttgtttctggtccttctctcgctggtttcagggatacgggtcggcttctccacatacgtcagatcttcctgaatttcgatgtgatccggacttgcctgttcctcgggaactctcaaacatttcttcaactgagagacgtggaacacgttatggatgccaagcatgttggagggaagctcaagctggtaagcaacttcacctctacgttccaagatcctgtatggtcccacaaagcgtggtgccaactttcctttggtttggaagcgatgtactcccctgagcggagtgacacggagatacacataatcccctgtttcgaaagcgagctcccttcggcggttgtctgcatagcttttctgccgagattgcgcgattctcaatctttccctaacaactctgactttctcttctgcctcatttaaaacttctgtcccaaacaactggcgttcccctgtctgatcccagaagagcggagtacgacacctccgtccatacagtgcttcaaacggtgccatctgcagactagcctggtaactgttgttgtaagagaactcggcatacggcaagcttttgtcccatgctccaccaaagtcaagcgcacatgctctcaacatatcctctagtatttgattgactcgctcagtctggccatctgtttgtggatggtaagcagtgctgaaattcaaccgggttcccaattcttcttgtaatttctgccagaactttgaagtgaattggcttcctcgatcagacacgatcttcttaggtacaccatgtaaacacataattcttgccagatagagttctgctaatttcttccctgagtaggtagtgtgaaccggaatgaagtgagccactttggtgagtcggtcaacgactacccaaatagaatcatgccccgatgacgtcctgggcaaaccggtgatgaaatccattccgatttcttcccacttccattctggaatctgaagtggctgtagcaaacctgctggcctttggtgttctgcctttactcgttgacagacgtcacagagtgctacgaattcagctatttcccttctcatgctgacccaccaaaacttctctttgaggtcttggtacatcttagtactaccgggatgaatggaatactgagtttgatgagcctcggttagtatcaggtcttttaattccttgttttcgggtacacacaatctttctcccgtccagattgttccttgttcatcctcaacaaaacctcgggcttttccaactctcatgttccttttgagctccgctatttcaggatcacttgcttgagctatgcgaacctgctccaccagtgtgggctgtgcctctagggcagccacgaatccgtgctcaactataccaaggttcaaatgttccaaatcacgttgaacctcacagcatagttcctctacccatgcgacgttgcagtgactcttcctgctcaaggcgtctgcaaccacattagccttgccgggatgatagtgtattcccatatcataatctttgattagctccaaccatcttcgttgtcggagattcagatcaggttgggtgaagatgtactttagacttttgtgatctgtatatacctcacaacggatactgatgagatagtgccgccaaatctttaaagcatgaacgactgcggccaattccagatcgtgcgtcgggtagttgccttcatgaggacgcaactgccgtgaagcataagaaaccactttgccatcctgcatcaacacacatcctagcccctggcgagatgcatcacaatagacctagaaatctttcgtctgatcaggcaggattaagactggtgcagacaccaaccgtcgtttgagttcttcaaaactcctattgcattcagcggaccagataaacttttcttccttcttcaatagctgtgccattggcttagcaattttagagaagttctcaatgaaccggcggtaatagcccgcaagtcctaagaaactccgaacttgagtgactgtccttggtggggtccatttggtaactgactccacatttgctggatccacagctactccttgagcattcacgatgtgaccgagaaactgaacttccttaagccagaagtcgcacttgctgaacttggcatatagctggtgctcttttaacttttcaagtaccagccgaagatgctgctcatgttcttcctcggacttggagtagataagtatgtcatcgatgaaaaccacgacaaacttgtctagaaattccataaacaccttgttcatcaaattcatgaagaaggcaggtgcattagtgagtccgaaagacataactgtgcattcgaacaacccgtaccgagtgatgaatgctgtctttgaaatatcctcttcgcggatcctcaactggtgatagcctgatcgcaggtctatcttagagaacacagtagctcctttcaactgatcaaacagatcatcaatccttggcaaaggatacttgttcttgatggtgacctcattgagtgcgcggtagtcaacgcacatcctcttggttttgtctttcttctccacaaagataaccggagcaccccaaggcgatgtgctcgggcggatgtatcccttctgtaactgttcatcaacttgcttcttgacttccgccaactcgttggctcccattctgtaaggtctcttgtggatcggtgcagttccaggtaccaagtcaatccggaactcgatatccctttttggtggcattgttgtcagatcatccggaaaaacctctggatactctctgactatgggaatatcctccaacttcttagtggttttctccactgctacctcttgttcttcaccagcagcctggtttaaactaatccctggcttccgcggcactggagactggaaggttacctcctctccttttgcattggtcaacttgatggtgcggctggcgcaatcaatcactcctctgtgccttgtcaaccaatccattccaagtatgacatctaggtccttggattcgagaagaatgaggttggctggaaaaatcaacccttgaatttcaactgtcacagatgggcagtagtgagttgtggtcatgccacctccaggagtatgaactcgcattggtatcttaagcttcactaaagataacccatgtgcaccagcaaaacgcttggaaatgaaggaatgggttgcaccagaatcaaacaatattactgccagtgtcgagttgacggggaatgtgcccaatataacctctggtgctgactgcgcctcctctgcagatgcatgattaacacgggcctgaacgaacttgggtccagcacgtcttggcttcgggcactttccaaccgtgtgtccgggtttgttacaattgaagcagagtttgggtttttctcccaacctcttgggctgttctggcagagctggctgaactgattgggctggaatctttaatgaacttggagtagggttgaggctgtgctgctcactgttgttgtgactgccactatggtggttcttgttgaagctacccgggtggtagggacggtactgccggataatcatggtggaaggtccaccgtgatgtcccatcgtgaaacgaggcttctgactcttcccctgggaagtcctgaactgagctgccttcctcttacggtttattttgttacagtgctcctcctgacggatagccttatccaccagcttctcaaagtcctcataatctctagagatcaactggttaatcaattcatcatcaagaccagacagaaacttctcctgcctctcggcatcggtacgcacgtcctcaggagcgtagcgcgcgaggtggttgaactcatgcaaatactctataactgttctggttccttgttgcagggaacggaactctctcttcttttgtgccacaattccctcgggaacctgtgctttattgaaactatgacaaaactctgtccaagtaacttctgcccaagctggacgggtcaccatgtagttgtcccaccaaacagaagcgggaccttgcagctggtgtgtagcaaaagcaaccttctcttgctcgttgcattgcaaaagattcagcttcttctcaatggcatgaagccagtcgtgggcctcgattgggttggtggtgcttgagaaggtgggcggcttgacacgaagagattctaacagtttggactgaggaggtggaggaccaaactgcaggttctgctgctgctgctgtgcttgctgctgcacctgctgcagcacctgatggtactgttgctgcatctgttgcatcatcattgccatcatctgagtctgattgtccaacacctgagcgatcgttgggttctcgggcggtggggacggactgctattaggtgcattgctggcacgtggtccatcgatcggctcttcgctgccactggcgttgttggagtcacgggaaccattccttgtcttcaccatctgagggggataggtagaaatatgagaaaaggaagaaaaacaggaggctcagaaactaatcttgtttatgaatttaagtgcaattatcttaatcttgattaaaacactgaaaaagaggcacgcaactcctaattgaggcagtcataccactgacacatgatatcgaccgccgactaaccctcaagcaacaaacctaaacacgaaaactagcaagcaaacagactaagaagacgataaagctaagggcggcgactctgaagctcggggcggcgcttgcaaacgagggataggactgacatctaaagtagacaagggataggaaccaattcatgctcaaatccaaattaaaccaagcaacagaagactcaaataaataaccgagcatgatgatttttatgcatagaacatttttcatgaactcaaatgaggatactgatgcaactggctaatcaataaattaatgcataaaataaatgcatagtcataccgatacgcataaacttaccccaccgaacatagacacaacctaatgcatatcacccgacaattcccgaccgactgccgaataaattccgaataaatttttactaactccctagactgtccctagtcgagaaatccaattaaataagcgaccaagatttttcccacaaatcaaaagaacaaaccccaaaattttcccgaaacaaaatccaagtgcaaaagggcatatgcatatgaaaaggggttcagagggctcttaggttttccagttggcttgtcctacggtcaaggtcggctctgataccaacttgtcaggcccagaaattctcgaaccagaatttctaagctgaatgtgcattaaatccctgtccaggaccagccagggtacacaaacgacaattgttgacatacagatccacgtcttacaaaaatagaaaagataacaaatgcagcggaaaagataaaagcgagctaaaccgggaagcttgacttcagtagcgagcggttccattccacaggcaatccttgacggcagcgacgaaaccaactttgacaaaacagctccaactaggaaaatcttcagctctggtgtgggggaaaagagagcaagactgagtactacccactgtactcagcaagtcataccggaagaggaggtatgatgcaggatacaaccaaaggaggctagaggttcttttgcataaagctagcatttaaaagcagtagttgaaagcagtaaaacagctgtagtaattaatcaatattaaccaatcactgtccaacgctacaccacgttgcaacaggcccaa

SEQ ID NO: 83061 - DNA, 744 bp, Oryza sativa
gcccagatcgatagtttggtttcaaaatatggtcaaataaacaattgtccctttctttaagaaaaagtacaatagcaggctgtggagccagctataaacatattttaaagagataaagaaagagagagaagagcagcgggctacagatctgaagccagctgcagcgcggaattcaagacgtaatgtgtgtatgataagtgggaccatgtattagtagtatagtaagcaactacttattatatgaattggctattatattgattataaataatttagagtcagtagtagtgggtcttgctctagctgaagaatcaggtgagtcgcgtcgctgcgtgccgtggcgagacgccggccgcgtacagaacctctctctgcttgctccccatctgctacagccactgtgttgtgcgcacgtgtagcacgcgctggacttatctgctttgctcgtttcatccaacgagccgagctaccccatcacctgccgagctgctgagctacccatcggtcgcgacaaggtccaatcagattttcagctggtcactggcttgctgctgctgatatcatcagcacgagatctttcgtcttctccgttcttctccgatctgcaagggtccatcggtttctgctcctcaaattccactacctctctttttgattgcgagggagccaagaagaagcaagaacttgccagtccccggcaccaagtggtggggccaagtgcggcgatggcgtcggctctggctc

SEQ ID NO: 83062 - DNA, 735 bp, Oryza sativa
  unsure (1)..(735): unsure at all n locations
gcccctgccacacgaaccattgttagcaaggcctatcggcagggttttttctggcccaccgctgtatctgatgctgacataagggtgcgaacatgtgagggttatcaatttttcacccgacagactcatctaccggctcaggagttgcaaaccatcccgttatcttggtcgttcgcggtttgggggctcgacatggttggcccattcaaaaaagctatcggtggttatactcatctctttgtagctgttgataaattctccaagtggatcgaagccaaaccagtcgtcacaatcacggcagacaaggctatagatttttttcatcaacattgtgcactggtttggggtacctaatcggatcatcactaataacggcactcaattcaccggcggagtatttaaagattcctttgaagacttcggcatcaaaatttgttatgcctccgtagcgcatcccatgagcaatggacaagtcgaacgcgccaatggtatggtactttaaggaataaaagtacgagttttcgaccaatggtatggacaagtctttgcgatttcgtaacttcaaggaggagcgctacggagaagaccgagtggatgatctcaaccgactggaagaagcccgtgaagcagccttaatccagtcggctccgtatttacagggatacgacgttatcacaatgcgacggtcttttacgagctttttagtcgagacctgttttgaggaaattcnactac

SEQ ID NO: 83063 - DNA, 2539 bp, Oryza sativa
tattgcgctgctcatttttaattggttaaaattatttccaaggctctgaaaattccactaaaaatcctgttaatgcattggagcatggggaactcaagaaaaattccaccacgctatttccgattattaattgcttttattaactagggattcagctctaggttaattaagataatttcttcggacaatttatttaaccaattttttaaagcaagcaaaaggggaaacttccgggcgtgacaggaggctagtggaagtcaaccctccgttggacagaagagggcacgcggcaacgaggtgccgcgaagaagcttgagggtcagcacatcataacggaagtggaagaagatgggcgacctagtgccccggcagaagccgccaagaactatgtacgtcacagcggttgggttgtgcggaataacgtgcctgtcagtacggtgtactggcgaagaacaagggcacgcggagatcatgagagctttgtcacagattcagagaaagagatgctgtggaccacaatgctcgagacattcacccttcccgctggtacagaggacaaagtgaaaaggtggactctgaagaaaatggcagaacaattttagagcttcaagggagatctgtaccagaaatatatcctgaagggccagacaccgaacttcgacacattccgaaagctaagggatcactgggacgagttcgttgcatataagacaggtgaacaagggcaggcgatgatggaaagaaacaaagaaaatgccgccaagaagaagtaccatcaccacttggggtcaggcggctatagcgtcgcgatgccgaagtgggaggagatggaggctagcttgcttgagaggggtatcgaaccggccaccgctaattggctggaacgatcgaagttttggtactatgctcacggtggaacgcttaacccagctgatggctcactggtcttcggcgatcagatacgagaggttgcgtgtcgactaacagacgcagtggaagcctcttctcagggcacgttccgaccggacagagagagggacgagctgtcactcgccctgcagactccagagcatccaggacgaacacgagggaaatgggtgattccttggaagattgggttcaaggaggacatccacacgtacaggagtcggatgaggcgcaagagagataccgaggcgaagattgcagatctagagttcagggtatcgagctacgagcgcagcatgcaagaggaggtggcaaggaaggttgatgaacgcatggccgcacatcggtcccatgatcccagccgaccattcctcctgcaatggtgagcccgtcaggaaaccgtagcagctgcgcctcaacggggcaagtaggatcacagagcatggacgccatgcaaacccaggacgaatccacctgccccgttgatgacatcactcagcggacaccatgtgagctgcatattcctttcaagaacttatcaataaaggtaagctcatagtttatatattttagatttggccataccgatagttgcagcttatatatcgttgattagtaataaataacctctcaccacatgaaggtggcgtcgggcatggccatcccaacggacccttcaggtacttaccactgcaggccgattccagcaggatactccaaggtcgaagttgagttggtcgaaggcgcgtacgaggacctcgagctggattaccctggaggagacggtgagacgcatctacgagacacaagccatgccattattctatggcgcaggcggtacatcatcctccctgggcgacaagcggcgtctcgtgcaccgtctcctccggctccaccatctcctcctcaggatcctgcaccgtctcctcctcatgctccagcaccgtctccacctcaggctcctgcaccgactcctcctcaggctcctgcaccgactcctcctcgggctcctacactgactcctccgcaaactcctcttccgacaccttcaaagtcaagggccccccaagctccaccgcctacccacacaagggcaacgaagaaggtgaaagttgacgccgccaagaacaaggacccggggtacgattgcacgcaagaggagcttgacgcttacgtggcatcagaagtcaagagacaattcaagcctcgaaggccagaaaagaagattcctatagactcgagtgtcatgaacttcttcaggggtatgtctgcacctgccaaggaggccattaagctatcggactatgagcgaacgctgaagaaagcatcttctggaaagtccaaaccagtccctcagcttggagagcaaccaaaccaggagatcgagccgttggtgaccgataaagaaatgacgatagaagaatttattactgataccagtctaactacggatcaattgctaggagtcgcactaatcgaaaaggcggaagtgaaatacatgtacgaactcggtaaaccgcttgtcaagcctgagctgctgcagtccctacccacacaaatgtacaagttccatcagctgtacctggagatgagcgccaccggtagagagatg

SEQ ID NO: 83064 - DNA, 560 bp, Oryza sativa
attcggtggccccagtgctatagtatacttcctgtgtccctaaatatttgacgtagttgattttttagcacatgtttaactatttatcttattcaaaaacttttgtgaaatatataaaactatatgtatacataaaggtatatttaacaatgaatcggatgattagaaaagaattaataattatttaattttttttaataagacgaacggtcaaatatgttttaaaagtcaacggcgtcaaatgtttagcgacggagcgagtaagaattttggtaaaagaatcggagatcattcagttcactgatggaagctgccattgcccattgcgtgcaggggtggctcaactgaaagcgaggaggggtgagagggtgaggtgcggctactcctccagggacggcaaggaggcgacgcccgccgccgccgtgaaaggcgcgacgtcgatgctcgcggcggcggtgacggcgtcgtcgtcgtcggcgccggcggcgatggcgctggtggacgagcggatgtcgacggaggggaccgggctgagcctggggctgagcaacaacctgctg

SEQ ID NO: 83065 - DNA, 7711 bp, Oryza sativa
attatttatgaaagtagtaaaacatagttgtcagggttatggataccacatacctaatagtagttgactaaatctcagcaggacccaccacataccatgtcctatacggaaacaacctgcagatataggaggagttgcggataaggaaagacaaccagagttctacatggaaacgacgaggactactcggattgtatccatattggtttccctagttctacttggataagaggacacctatgggtataaatacaaggcctcctaggaggagaggggacacgatcaacacacacccaccatagaaaacacggaacaatagatcaagacataagatcaacatacaagcctacatacgccaagacaagccgacagatatcgacatcagagatatgcctggatcggccctatccggtacctacagaggccggccgtagggatctcgcgctgtctctgattttgccgggtacgaactcgaggaggaagactaccctgttgtcgactacgagtcagaccttcagaccgccatgtcgacaacagttagataggctaccccaaatattgtactggtgtgattatgatgaataagagcaacgaccggcttcggccaacaagatgtagggttattacctgacaattcaggagcccgaacctgtataaaaatcctcgtctttgtctcttttacttcagtctcgcatatatcctagtaccaacgatccccatactatacaaataccggaatcgtgacatcaaacgtcgacaatagtagtgggctatgggcttttgatcacaacagagcatcatgattcttcattatctggcagagggaataaagcaagtattagaagaacaccacctgaaggcaatagaaattaataataactatataacgtacaactgaataagcagtattggcagcaaaaatcattaaccttttccatttagcaattagtaagtaatgacagatggctgaaatacagagatcaactgcattgatctgaagcatgcagcaatcatgcaattgtagtgttaccttctgctcgctccacacacgccctgcgttaactccagccccaagtctgtttatcagttcctttgtctgctcaatctcctcctgctgcttctcccatgtggcatactgagtctccacccaaattgccttcgccaaaacgtattctgaatagtttgccttgtgtgttttggacatgccgaatacagtttccactatcttggtacacaaactgatccaggaaagccgtcatgagaaagaccattggcacttcctgcgtcttgaggtggctctccagccacacaatcgtatccaaatcgacatgattgatcagctcatcgagcagcaccaaatcaggatcctgcgtacaatcagttacagcattgtaaatgcacacagaaactaaaaaccacaattcatcaccaattggcaataataatatatcattccttactccctctccatcacaattacacataactaaattatacctctatcctgttgcatcaattgattgatacatgtaaagctcaattttcttttttatctgtaccagtgtacctaaagaagaatcttgccgagcgacatcctcatctgccaccgctggaggcgacgaggcggtcggtgtcctggggggcgaacccgagcctgggcatgagcttctggatcttgacctcgacatcctgcgaccgccgctgtagcaggtcgagctcgtcgaggagcctccccaggtccatgtcctcggtggcaccctccagcgcggcctgcaccttctccaggcgagacctcacctccatctcctcctcgaatgcggcgaggaactcctctctgatggtgagcaacgcgcagacctcgaactcctggctgagagaggcgatcctcacgtttttcttggccttgacgacattgccggtgtcggggtcctccagccccgcggcgatgcggagatgggtcgtcttgccggcgctgttgacgctgacgagcctgactttctccccacgctgcacctcccaagaaacgtccttgagtacggtcaccccctttaggacttcgagatgctctccagtcgaaaattataatcatttacatctatctaaaggtggatatattttgtatattatttgatccacatctgagttcaccaaaataaagttcaaactccatgtgaagctaacaagttttagtttgattcattttagttctgtagttagattatgctgtatgttaattattctttatacaaaattttagagattttttcttgtactgtaagtgtatcttttgaatctacaaaataaaagagaataaattttatgagtttactggaactttgttcatctaaaatggagctaggatgaacattttatgcatttctaaagtttgtataattttcagttcagcaaataatgctttagatattttcttggtatttatccagaatttaaacaaatgggtccactggtcagtgacctgctaatatgcagaaaggctcttgagatttctaggaatcaacccgcagtcctgtgactgttctctatgtgagcaaacttttataaattagtgcctagagttttgattcttctcagaagaggtccctgcgacctggacaagggtggcatcgatggccggcggccatatttgggttcgccagtggcgaacggtggccgatctcgccgtgtttccaaaatataaaatgtaactaaggttcttacgcacccgttgttagttgaatcacggctgataatgtatcacgatgtctgcgagacaagatcgaccaaacgatgatcacgaacagcgcgcacgtacaccatgcaaaatcaccgcgcgcgtgtgcattagcggatagctgaacgtagtcagcatgtacaggcagtgctcacgtgcgaaaccaagattttagtaccatatgggaaaattatgttggttgaggcccgcataaaagaggaggcgcgagcgctcctcccgccgagctcggtggtgcgggctttgtaaccccagctgcggggggcgggagtttggtaggtttcggccgtttggggatcgaggtaggcattatctctccaaccggggtgcctgtacttgggtgcctagcatacttatatgctgcttgctagggcgggtcaaacggcgtcccaaaccggagatggattctaatagctcgagtgaacgtccacctgcttattgcatgttaactaaatggctatgaaaaattttcaaaaaaattggtaagatagatcaatatgtaatatatcactccacaaacaaacatgcaagttaaaattcaacttctacagattgtaacaaaaataacaagctatgaaaaattttcaaaaaaattggcaagatagatcaatatgtaacatatcactccacaaacatgcaagttaaaattcaacttctacagattgtaataaaaataacaaacaaaactcaaattactatagtatatttatagttaaatttgatctaacttattcatattttttcaatttttttcataaccatttagatgacatgcaataaacgggtggatatccactcgagctgttaaaatagtttcccgtcccacacctgccaactctcttttttttttgttattttctgataaggcgaatccgaccgtgcgcggtggcgtggcccggagtggatcaggaacacgagggagcggcgttgatggcagcggcggtggtgggcggaccccgagaggcgctgtactcgccgcgcgcgtggagctcgtccacgggctgcggatggaggccacgagcccgttcagcgcgtgcagcggcgccggcgaggcggacgcggaggcgaccagcgcgccgacggcgcggcccatcagcaccggatcagttgaaacaacccacatctgccaacacactctcttttttttttttgttattttcgcttctgataaggccttctgataaggtgacggtggcgtggcgccggaggggataaggcggctgctgctgcaacaacgctggcgcctggtgccatgggagaagagacgcacgcatcgcccgagaccccaaacaccttcgaccagcgctcaaagcgtgcgtatctgcatgcgctgcgtatgcgatgacgtagctggatggtctctcaacttttcgccgttggtggtggtgacggcgctggtgcggggagggcggctgcggcgaaatcgaacacccaggtcgagaacgccatgccgacgaagagcgcgcttgtccttgtctgagccaccggaatcttgcacgtaggtttttcccggccgtgcgcctgtgccgattgttgacgttagtcctggcttgcttcagaagtttggctcggtcgtgtggagcggagcgagatgccaggaggacgtcatcttcttcggatcaaataaacagaaataacagatgcaatgcagtttgcgagagttgcgtggagtgcgcggtgtgcgtgtgtgttccagagtcctgaagaaccggatcgtgggatggcacgatttttgggcatagaattcgtttttctgttgagtatatttaggagagtagctccaatttccgttttgcaagtttacagttcagttcaatgaaagaaaccagaaaattgccccacaattcctctctcattttcgctactctgaaactctgcttttctctgttttgtatcccgctctgaatttattcgtttccctgtctgttgccgtgccagacgcgcatagtttgcacgcgaggtgttcgatccagtgcattgtcgctaacaagtggtatcagagcttcttaggttgggggggagggggtggatctgacactatggcgttggttccggtgacggcggatccagcgagggggagctcgggaagcgtgttcctttaccctcaactcacatcaaccaactacactagttgggtgatacgggtgcaggcaatgatggaagatcaaggcatatgggaggtgatcgagccagcggccggagcggctgtcgacccgaggaaggacaagaaggcaaaatcccatcttctccagtcactgccggaagatctcttgatgcaggtggcaaagaagcggacggcgaaggaggtttgggactgtctcaagacgaggttcgtcagggcagacagggtgcgcgacgcgcgcctgcagactatgaaaggagaattcgctagcatggtgatggaggccggggagtcgctggaccagtacgccggccggatcaccacgatgggggtccggcactctgccctcggcgcgacgttgaacgacgccgccatggtgaagaagctgttcgacaccgtcccggagaagttcgtcagcctagtcgcagggatcgagaattctacaacgtcgacgacatgccgttcgaggaggcagtgggccgcctcaaggcgtacgacgagcgggtgcgcaagaagaaagcggcggctggcggagtgaccgccgacggccaggtgctccttactcaggccgagtgggaagtgcgcttcaagaaaggcgggggagaaacctcgtcgccacaaaagaacaagccctctagtgatggggcgaattgcggccaggccgggcgcggtcgtggtaggggtcgcggacacggcggaacgcagagcagcggtggcggctccggcggtggtggctgcgacaagagccacatcaaatgtttcaactgcgaagagttctgccactactcaacgcagtgcccatatccgaagaagaagaaagctgaagcccatcttgcgcagacggacgacaccggtccagctctgctccttgcggtgacggaggcggtgcagaacgcgccggggcagggcatggactgtgggcttgtcatgcacgaggagcgtgtatggcctcgcctgatgctggcagagaagagagcaactgctggtgatctgtggtacttggataatggtgctagcaaccatatgactggggatcgacggaagttctgggagctggacgagactgttacaggggtggtcagattcggcgacgcctcatcagtgcagattatggggaagggttcaatccttttcgcatgcaagaatggtgaccagtggctgcttgatgacgtctactacatccccagcctctgctggaacatggtgagcttagggcaactcactgaaactggccaccgagttgtgatggataatgatgaccttgaggtgttcgacaaaaatccctggcgtctggtgatgaaggtgaggagaacctcgaattgtttgtaccggattgagttgcaactagcgtcccggctagtcgatccatcaaaacactccggacagaccgcggtggcgagttcctgtccggcgagttcgcgcgggtgtgcgatgaggctggcatcgagcgacatctgacggcgccgtactcaccgcagcagaacggcgttgttgaatgccgcaacagatcgatgatggcgatggcgcgctccctcctgaagggaatgtctgttcccggcaggatgtggggggaggcggtgcggcacgccgtgttcctgctcaacctgctgccaaccaagtcgatgggtgaacgcactccgttcgaggcatggacggggaagaagccacacttaggacacttgcgagtgttcgggtgtactgcgcatgccaaggtgacaactccaaatctgaagaaattggatgatcggagtgagcagttcgtgtaccttggcatcgaggaagggagcaaggctcaccggctatttgatccacgacgccgccgaatccatgtaagtcgcgacgttgtatttgatgaaaacacaccttggcagtggagtgctgctgtaggagaggagaattccatcgagtttgtggtagaggaacctgttggcgagcagcagccggtgccggcagaacagtctgccacggtaccgttgtaccgggcgccgccggcagggaggcgagccgacaaggagccagaagtggcggaatagcgaggaacttctccggcaagcccagtgacgttctcacccacgttgcccagcacgcccacacccggcttgacatcaacacactctgccgaggtggaggcgtcaccgagcacggccggcagcgacgacgacccgctgcggtacaggagtctggcgggcatcgtgctggaggcgccacgcgtagacttggtggatgaagaggatggtgaagcactgctcgcagagacggaggagccgtcatcgtaccgcgaggccgcagggagccggcgtgggtcgacgcaatgcagaaggagctggaggccatcgagaagaactcaacgtggtcgctgtgcacattgccggcgggccacaaagcaatcggactcaagtgggtgttcaagttaaagaaaaacactgccggggaagtaatcaagcacaaggcatggctggtcgcaaagggctatgtgcagaggcacggtatagactttgaagaagtgttcgtgccggtggcgaggttggacacggtgcataccatacttgctatcgcagcggaccgaggttggcaggtgcatcaccttgatgtcaagtcagcttttctcaacggggagctagaagaagaggtgtatgttgcccaatcggaggggttcattaagaagggacaagagcaccttgtgctgaaattgagcaaggcactgtattggcttgaggcaggcgccacgggcctagaacatttgcttggacaagagtctgaaggaacttgggtttgtgcggtgcaagcaagaacaagccgtatacacccgaggtagaggagcagtagctgtgattgttggg

SEQ ID NO: 83066 - DNA, 35337 bp, Oryza sativa
agtagctgtgattgttggcgtttacgtcgatgatttaattgtgacaggggagaatcctaccagggtagaagcattcaagaagcaaatgatgggggagttcgagatgagtgatctagggcttttgagttattatctgggaattgaggttggacaaggtgtgaatggaatcacacttaaacaaactgcctatgcaaataaggttctgtcacagttcgggatgttggactgcaattcgacctcagttcctgttgatccaaagacacagcttcagaaggatgcagatggacaccctgttgaagcgtgtgatcggtgtgatcggttgtctttggtatttgctgcatacaagaccggacctatcatatgctgttggagtggcgagcagattcatggagcatcccaccatgatgcacttgaaggcagtgaagcaaattctcaggtatttgaaggggacaatcgactgtggccttgtgtataccgcaggaagtggtgagatcacaatcacggggtacactgacagcgatctagccggagatgttgatgatcgtcggagtacaggaggtatggcgttctatatcaacaacagtttggtggcatggagctcgcagaagcagaagacattagctctttcttcttgtgaagcaaaattcatggcagccactgcggctgcctgccatgcactttggctaagggcattgctgggagagctactcggtgaggagccatcttcttcggatcaaataaacagaaataacagacgcaatgcagtttgcgagagttgcgtggagtgcgcagtgtgcgtgtgtgttccagagtcctgaagaaccggatcgtgggatggcgcgatttttgggcataggattcgtttttctgttgagtatatttaggagagtagctccaatttccgttttgcaagtttacagaaaattgccccacaattcctctctcattttcgctactctgaaactctgcttttctctgttctgaatcccgctctgaatttattcgtttccctgtctgttgccgtgccggacgcgcacagtttgcatgtgtggtgttcgatccagtgcattgtcgctaacatcgatgttctcaagagtgagcttccctgagagagggatctcgttggtcatgttgtttcttgtgtcaactaacatactgatgttctacgcaaccaaccatgccatgttcgagagaaatgattatgcgtaagcttatgtactctacatgtttttaaacatatatatatatatatatatatatatatatcagaatcaatcgagcagaaaagtttgattgagagagagggaaagagagaaccagaacttgaacagaactgattaccgatacccccatcgttggcttgttcatcctgctgagccatttgttcgagtgcatgcatttggtgcgttttatttgacggaatagcgtggttcggtattgcgccataattttattatttccgctagctcctctcagatatttgtagtgaaggattttctcaaccgcaaaaccagatatgcggggtcccctaactgtacaaaaccggtcatccgaggtctttcggcggtattgaccccggttttggtctacgtggcggctgagacagcgtgggacccatgtgggccccacatgtccggatgccaactcatcacctctctcttatttccccctcttctccctttctctctctttcacttttctcatgccggcgatgggcggcgctgtggggaggaggccgccggagggaggggagaggaggtccggtggccggcgtcgcgccgacggaggaaatgccgccgtccgcatccttgttcttcctcccattatcatcatccttgtggtcatcggagggaggcgggacaacacacggcagggcgaggcggcgtcggcaggcgagcacggtggcgcaaaggaggcggcggcggtggctgctatgcgggaggggaggccggttccgacccagaagcaacatcccaagggcacagcgtgcgtcagtggaagtcataggggatcgtcacaagacgggtccactgcgtctggcgatgtgtgtggctcttggcatttgcatcgccggaggggtagtctgatccgccggagacaagcagcgccgccgcctacaagtctttgggcgcctcggtggtcgggcccgggagcaggtgcgcgaggtccggtaagttgagggaaatgggcttttatggtgtggaacaatggagacagtttgttgcctcgccgtacatctgcatcggcgtcaccaccgtcgcaaagtacagggcagtcatcgggaacgagctgcgcgtgggcgggtcgggagcggcgctgatggcggtgcgggagctagttgctcggtgtcaccgagagcggcttcaggggaacctaccagaacgaacaaccctcctcctcgcccgccgccgccgatggcggagcacgagggagcagcgctgatggcggcggcggcggtgggcggacaccgggaggcgctgtactcgccgcgcgcgtggagctcgtccatgggctacggatggcggccacgagcccgttcagcgcgtgcagcggcgtcggcgaggcggacgcggaggcgaccagcgcgccgacggcgcgcgcccatcagcaccggatcaggtgagagacaatgtatacatctatcttttctctgaatccttcatctctgttcagttcaactccatctctgaaaagactgaaacattttgttgattggtaggtatattactcatgtcaaaagtgtcgatgcgtgtgatcgataatcacagtgtttgttgtgtgtttgcatgatgattgccaatttgccatgcgtgaatgcgtgcaagcttgagcccgggcctggtaatcacatgccatggttgtcctgttcttgtctcagctcgttgctgcgtttggattatgttggaaatatgatcacaatttggcatattttaatccaaaatattaagacaataagtatgacttttgcagggagtaaactagtgatcaaagagagtaaactacagatcatgcttaatatagaataagcataagaatttgtcacaacagaatgcaatgaaaccattgcacctaacaaaaatatagaagaaaagaacatgaacacagtgaaaaacgagttataccctgagaatggccctccgctggtgtttgaggcagtattgcctctgttggtgttatctctaggtgcaccgccgttggtgtcatctgttgacatgatcaccgatcacctggaacaggagctgaagaagttgattcccaatgaataggagaagaaccgtgagtagtcgtgcggaagcactccccaaaaacctgatcgcccatctaccgatgcaggtactcaggcaaaggcgtggttccggaggccctgctcgtcacgatcactagtgcacgcaagcgatcagaaccggggagaacagaagcaacgcaggaacagatggaagatgaaccaccgaagagtaaaccaacccgaacgtggagtaaaccagatcagatcgagagtagagatcttttctcctctcatctgtctctatgacccttgtagggtgtaggagggggatgggaagagaatcaatcccgattgcttccgcttccgttaccgcagtaacaagtaatcgttgcggaattatttggattcaattctcaactgttgcaaaacttagagagagagagagagagagagtagcagccgccgctcgcctgcctcgccacgccacgctcacggctcggcgcgcgtgcgcgtgtggctgtccgagccccacctcaaccggtcaacagggaatctccaataaactcacaccacttttaatctccaatgtgctattattgtcacctaacatttattgtggccccggactctttcgcttcgcccacgccgacgccaacctccaccgtccgccacgccctcaactccgtccaagagaagaggataagagaaaagatacaggaggagggagggagtgagatgaggttgcatcttgacatgtggggcccacgtgggtcccacgctgactcagccaccatgtagaccaaaaccggggtccaaaccactgaaggacctcgggtgaccggttttgtatagttaagggaccccgtatatctggttttacggttcgaggatattttttatcccgatgacaagttgagggaccttcggtgtactttttccaaaagaggatgcgctcgtttggcttatgccgagcctggttgtgtgggcttgtcacctcagctgctggcggtaggagttctcctcctctttcccccaggagggaggatgggatttaaaatttcccttacccatagtatttttgaattttgatatagaagtatgtataatttgtgggttatttttaaattttgatatagactagaaaaaatgtatgtataatttgtgggttatttttaaattttgatatagactagaaaaaatacccatgcgttgtaacgggtgaagatattttaattttattattgttatatagtttagttaaggtgaaattcattgtgttaaatttgcttggttgtatattctgttagcaaatcataagccgcaattaggagtccgatcatcccaagttagcatgcgagtttttttaaagagatttcttgtacgattccttttgtatttccaaaagcgaacgatcttaaaaaccgagtcaatatagatttgtatttccaaaagcgatcaaacttaaaaacaaacacataaacggatgacgtactaaagtaccggtaaaaaacatcttcaaattttataatagtacagaagtatgtaaaatttgtgggttatttgacatgggttatttgaaggaaaaaaccctataattttgtgcaacttaaaccaaaacatatgcggtttcacgtgggatactccagaccgctctaacaaataaccatgcatatatctcccaccatggggacaggtttactattccggtatgcataaatctaggggaccaaaatttccgaaattttggatattttggaaccgagagaaacaaaattgaatttatttttttctaaattcagaaaaatatgtaaaaaattgggccaaatagttgctcaacggtggggtctgatattttggaaattttgaaccaaaattgcgaaccatccatggggcatgcattattttttttaaacaacccacgaaagattagtacgacgtttcttctaacagagcagaaaaacattacaatactatagccctggaaggctatagctaggaaaaaaaaaacaaccacaccattcgtctacagccagatcctgccactgaaaggcaataaaagcacgacacccataaggaaagggccttctcgacgatgcctccgagaaggaaacgacacctgaaattgccgccactggccatcctggaaaaccaggacattgttttcattcgaagaaaatccataaagaagagcagaggagatcacacagtaacactctgagagaaagctgcgcccacatacatcgtcattgctggctggaaggctgggtttttgcccatgatctttctgccctccccgagtcgaggtcatttgccggaaactgcagcccaccacccatccagcacatcgttgctagtcggctatcaaggagctcggtcaccgacgcgctccgaatccatccacgcaattggtttcgagagggagagggtaagagagaagaatggatcccctctcccctatactagcccaccaatgcggccattttgtggcgggcaaggcaccgccgcaagatggctagtgtttggatcgtggcctgccacaggcctgcaccacccacctcacgatgtcaccgtagatgccgcctcggtcggacaacccgtggtacctccggccgcctaaggccacccaccctcatcatcgtcgcctcgccttgtctccccttgccgtcactgcgggcgttaattaattgtcaatactagaaatccaaatttgccagtgacacagacatgtaattgagaaatttcagccagccggcatgcatgtaactaaaaaaccatgttctgagaaccaaagattggaggcagtagatctattgggcgggtggtcccggttcccggacctctgaatatttatgtctactacttaaaaaatttttaaagttgtttccgccgtccgtccgtgaaaaaagggcgaaaaaattagggcaaaaaattcgaatccgattatatgtgacgcggtaaaaaaatgcgacatggtaaaaaaacaaataaattgaaaacgtttccatcgtccataataacagaaaaaggcgaaaaaattaaaacaaaaaggaaaatccgattcaatttgacgcgggaaaaaatctgtaaaaaaagctcttaagaaagggcgataacaaaacaaaaaaaacccgtagagaagggtgaaaaaaagaaggatgcatacaaaatccaatcggagatagaacgcagaggaagagaaatacttacaaaattaaaggtttttctgtcgtccgtctgtgcaaaaagggcgaaaaaaatcgaattcgattatatgtgacgctgtaaaaaaatgcgacgctaaaaaaacaaataaattgaaaacatttccatcgtccgtaataacggaaaaaggcgaaaaaacattaaaacaaaaaaaggaatgtccgattcaatttgaagcggaaaaaaatctgtaaaaaaaagcccgaagaaagggcgataaaaaaacaaaataaacccgtaaagaagggcaaaaaaaaaaagaaggatcgatacaaaatccaatcagacatagaacggagaggaagaaaaaacgaactagaggaataataaaaacctcacaaatcaggattttcgtccgtcttagttgcggacctcctccctccgattatctatcaatgcaccaataaaccaatctcaaataatcacaaatctaaccaaaaaactaaagcccaatcccaatccaatcgaaatcatccaatctcaaattatcataaatctaacccaaaaactaaatcccaatcccaatccaatcgaaatcatccaggataggagacaatcaaataagagagaagaggctgaaatcacaaaataaatcacatcacagaggtgatgagtgtagagggaggggtgagcggacgcttctgctgctcctcgccacctcgccgccgtggaggtctcgagccaccactgcgctgaggagccaccgagtagctgctgcgccgggagctgccgacccgcgcccctgcaccgctgctgcgacaggagctgccaacccgcacccttgcgccaccactgaactggggagatgtcgagaaggagggaagaggaagaaggcgatgacgaggccgaggaggcgcggccgcgcggcgaggtccggtggtgggaggcagatgcgacaggccataggggtggtggtgaggaggaggtgggcggtgctggggtcgggcgggagtcgggcggcggtgtggggtggaggtactgagggaggaagaggagcgggtggttgattggtaggtcggctccaactggtttattttaataggggtcggtatccggtttttaaaataggtgttggttttttttagaacagtcacctataagactaatatagatcattaatatatttgttggttgtgaaaaaccgggacctatatatattataggtgttggttcttttttttaaaaaaaactagcatttctctagtacttaaaaaattgaaaacgtttccgtcatcacatccatcttaaaataaagaaagagcggattttttttttcgcactatccgattccgccaccacacgaaaattggatacatactcgatttggactcaaaatcggatgaaattaaccccataaatacgaaggattccacgacaatccaatcgggctggactactacttaaaaaattgaaaatgtttctgtcctccgtcttaaaataaaaaaacagtaaacaataatctccgcccagtccgattgcgccaccacacgaaaattggatacaaactcgatttggactcaaaatcggatgaatttaaccccatatatacaaaggattccacatgacattataatcggacaatccagctattgagaaacagaatgggaagaaacatagaaacatcagcgtgaagctgccaacgccgtcatcaccacctgatctgtccacgggaagctgccggcaccatcggtgcagccggatcggcgacgtctacgtcgccgttggatccgctggacctttgtgcccaaaaatggtggtgctagcagcatcaaccacctctcccggtctgtgcttctctggttcaatcctccccctatcactttcatgtccttgactttgtttgggaggaaatccgttgggcttccattcagtatatgcaggggttggtctatgcccctcacatcatgaggatgattgagacagtcacgcagctacggtttcatcatgaggtgcctcacctgtagcttcacttgcacctcatcaaggccgatcattcctcccgtgcgagcactcctgcagctggggacatctcttccacctccactcagcctcctcctactcgtgagtgcccctctcctttggctcgtcgtgagccgtgtcccttattccactttttgtggagtctctttggcctttgctctgcggaggccaaaaagaaccgcaaagcacggaatgaggtgaagaagatggttaggcgcgtcaaacacatgcatgcgcagctcaacgagcatcttcacgtgaatgttccttcctccccaccgggctttgaggctgagcccgatgagcccgaggaggagatagaggatccttttgctgggttgcctccggattttgacttctttgggtttagccatggcgatggctatccccctcctcctcctccagaggatcctcctcaggccccgttcgcttgagctcgttggatcgtcctctctttttggtgctttgatgccaaaagggagaatttttctattcattacattccatctttggtcgaaccatgtggtttttatgtgtatgagactatgtgttaatggtttgagtttttgtaatccctttatgcattagtgtaagactatcatttgtgatattgggatgtaatgactattatgccttatgttaatgtgctgcaatgttctcatttctttatatattgtgcatgtgatgagtgaaatggcttatgattgttgtcttgtgagcttcaatatcgatgcaaagatttatggagctctccacttgccttaatgcacacttctagtgggagttttcactaaacctttacaccaaaaccttctattatattcattcccaattgtaatctaatcatattgtcatcaatcacctaaaagggggagattgaaagtgcatctaagcccctaatgattttggtgattaattacaatgcgattagaaaggataacattttttattcaagcaaatgtgaaggttgttatgtcctcgatgagttgtagtgtaatgcatatcccgcaaaaatcgtcgttatgatgagatgcggcaaatgaacaaatggtatattgtactttttcatctctttgggcctataggaaaaccgcactattaagagggatgatgcattgacatatgacgagtgatgaatgtgctcaaaatcaatttttaaaagtgtttctcctctgatttgtgtgttctggaaattttaagagttattcaaaactgattttcggaatttccgaaaatacacagaaccaaaattcgcttatggaaattttcggatatgtctaaaagagattttcggaacttccgaaaatgactaagtttccaaacatggttctgtatattttcggacttgtccgaaactgattttcggaacttccgaaaatgacagtggagtcaaaaaatcgtttctgtaaattttcggagttgtccgaaaccattttttggaatttccaaaaatttttggacttgtgcgaaacctgtgaacccaaaaacacttctggaaattttcggacttatccaaaaggaagttttataaggttgttttggttttggaaatttcggatatatccgaaaaattttcggaatttccgaaaatccttcagttgatttcgttgtttcactgttctagaaattttcagttatatcttaaattatttttcggaatttccgaatattgcaattattgtgcctaatgggcagatctggagctgtggctataaataggccattcccctcacttgtgagggctactggtgacattggatattttgtgtccttggcttgttcatcttgagattcacttttgagccttgctttcttgtttctcctctcacccgtgttcgattcggatttggtgtgtgtgtgagagttgtggattcgagtttgtgtgagtgcttgttgttaacttcatgaagattcgagagcacttgtatcatctctgggagttccttgcatcatttgttactcttggaggttgatgactcctatgcggatagatgtcactctcaagccaccgatctacgtgtggttggccgggagaaatttgtgaaggtcggatctcatctccgaaagggaagagataccactagtggaagggggagtgatttgtgcaacctcttgaggaaaggattagcaaagacccggctctttatcagctactcaacatggagtagaatcccctcaaggattcgaacttcgggaataacttcatatgcttcattcttggtaatataacttcctacctctcctctagctttgtttgattatgccgctagttgctgtttgtgctagcatattcttgttgtaggcagctagatctataatttactttgatttgcccttactctgctattttcggaaattccgaaaaatcatttttggaaatttcaaaagttactgctttgcatttacttgagtttttgaattagcctattcaacccccctctaggcctaattgaccatttcaatggaaatcaagtttaagaaattatgcatctaacaaaattataatcatctcattgagagttggaaccaatttcttatgtattataatcgtttacatctctctaacggtggatatattttgtatattatttgatccagatccgagttcaccaaaataaagttcaaactcacgtgaagctaaaaagttttagattgattcattttagttctgtacaaattttataagttagattatgctgtatgttaattattctttatacaaaattttagagatattttcttgtactgtaagtgtatcttttgaatctacaaaacaaaagagtatagattttatgagtttactggaactttgttcatgtaaaatggagctaggatgaacattttatgcatttctaaagtttgtataattttcagttcagcaaataatgctttagatattttcttggtatttatcgagaatttaaacaaaggggtccactggtcagtgacttgcgaatatgcagaaaggctcttgagatttctaggaatcaacccgcagtcctgtgactgttctgcatttgagcgaacttttataaactagtgcctagagttttgtttcttctcagaagaggtccctgcgacctggacaggggtggcatcgacggccggcggccatatttgggttcgccggtggcgaactgtggccgatctcgccgtgggtccaaaatataaaatgtatctaaggttcttacgcatccgttggtagtttaatcacggctgataatgtatcacgaagtcagcgagacaagatcgaccaaacgatggtctttttttttgttattttctgataaggcgaatccgaccgtgcgcggtggcgtggcgcgagggagcggcgctgatggcggcggcggcggcggtggtgggcggacaccgagaggcgctgtacttgccgcgcgcgtggacgagctgcggatggaggccacgagcccgttcagcgcgtgctgcggcgccggcgagacggacgcggaggcgaccagcgtgccgacggcgcggcccatcagcaccggatcagttgaaacaacacacacgtcacacgatcagttcagagacaatgcatacatcgatcttttcgttgaatccttatctctgttcagttcaactccgtctctggaaagactgaaacattttgtcgattggtaggtatataactcatgtcaaaagtgtcgatgcgtgtgatcgataatcacagtgtttgttgtgtgtttgcatgatgattgccaaattgccatgcgtgaatgcgtgcaagcttggagcccggaccgggtaatcacatgccatggctgtcttgttcttgtctcagctcgttgctgcgtttggacaatgttagaaatatggtcacaattcagcatattttaatccaaaatattaagacaataagtatgacttttgcagggaaggaaagagagtaaactacagatcatgcttaatatagaataaacataagcatttgtcacaacacaatgtaatgaaaccatttcacctaacagaaatatagaagaaaagaacatgaacacaatgaaaaacgagttataccctaagaatggccctccgctggtgtttgaggcagtattgcctccgttggtgttgtctctaggcgcactgccgttggtgtcatctgttgacatgatcgtcgatcaataggaacatgagctgaagaagttgattccgatgaacaggagaagaaccgcgagcagtcgtgcggaaacactccccaaaaagctgatcgcccacctaccggtgcaggtactcaagcgaaggcgtggttccagaggccctgcttgtcccgatcacttgtgcacgccagcgatcagaaccagggagaacaaaagcaacgtaggaacaaatggtagatgaaccaccgaggagtaaatgtgtggagtaaaccaaaccgaacgtggagtaaaccagattagatcgagagcagagattttttctcctctcatctgtctctgtgacccttatagcgcgcaggagggggaggggaagagaatcaatcccgattgcttccgcttccgttaccgcagtaaaaacgtaatcaatcaaggaattgattctctcgccgttactaaagtaatcgctgcagaattatttggattcaattctcctgtcatatgtctctgtgacccttatagcgcgcaggagggggaggggaagataatcaatcccgattgcttccgcttccgttaccgcagtaaaaacgtaatcaatcgaggaattgattctcttgccgttactgaaggaattatttggattcaattctcaaccattgcaaaacttagacacagagagagagcagcggctactcgcctcgccacgcccacggcctcggctcggtgcgcgcgtgtggttgtctgacccccacctcaaccggtcaacagggaatttccaataactccgtatttaagttgagatactacacttttaatcttcaaggtggtattattgtcccctaacatttattgtgggcctttgagattttaattgaattaaattgggcctagcctatttattccaacagattacagccatcaccggaggacagcgacggcgtgctcgccatgccaaggaggtcgccgaccatggacgtggtctcggatctggtcaccgccgtggcgggcgacgactggtgggtccatgacatcttcttagctggttggtgcatccacacgccgccgccgtcgccgccgccgccgtcggcggcgccccccgcggtggccccggactctgtcgcttcgcccacgccgacgccaacctccgccgtccgcagcgtcctcaactctgtccaagagaagaggagaagagaatacagagaggagggagggaatgagatgaggtggcatcgtaacatgtggggcccacgtgggtcccacgctgactcagccgccacgtagaccaaaaccggggtccaaaccaccgaaggaccttgggtgaccggtttcgtatagttaagggaccccgcatatctggttttgcggttcgaggaagtcttttatcccaatgataagttgagggaccttcagcgtactttgtccaaaagaggatgcgctcgtttggcatctgccgagcttggttgtgtaggcttgtcacctcaactgctggcggtaggagttctcctactctctcccccaaaagggaggattggacttaaaatttcacttaccgatagtatttttgaattttgatatagaagtatgtataatttgtgggttatttttaaattttgatatagaccaggaaaaatgcctgtgcatttgcaaggggtgaagatattttaattttattactattatatggtttagttatggtgaaattcattatgttaaatttgtttggttgtatattctgttatcaaatcataagctgcaattaggagtccgatcatcccaagttagcatgcgagttttttaaagagatttcttatacgatccttttgtatttaagaaagcgaacgatcttaaaaaccgagtcaaatatagatttgtatttccaaaagtgaacaaacttagaaaacaaactcataaacggatgacgtactaaagtaccggcaaaaaacatcttcaatttttataatagtagagaagtatgtaaaatttgtgggttatttggcatgggttatttgaaggaaaataccctgtaattttgttcaacttaaaccaaaacatatgcggtttcacgtgggatgctccggaccgctctaacaaataaccatgcgtatatctcccaccatggggacatgtttactatccggtatgcataaatatatatgggaccaaaatttccggaattttggatattttggaaccgagagaaagaaaattgaatttatgattttttctaaattcaaaaaatatataaaaaattgggcgaaatagtttctcaacggtggggtctgatattttggaaattttgaaccaaaattgcgaaccatccatggggagttcattattttttttaaacaacaacccacgcaagatagtaagacgtttcttttgatagagcagaaaaacattagaaatctatagccctgaaggctatagctaggaaaaaaaacaaccgcaccattcgtctacagccatatcccgccactgaaagggtaacactatctcgacgatgcctccaagaaggaaacgacacctgcaattgccgccactgcccatccttgaaaaccagtacattgttttcatttcaagaaaatccatcaagaagagctgaggagatcacacggtaacactctgtcagaaagcggcgcccacagacgtcgtcattgctggctggaaggctgggtttttgcccatgatctttctgccctccccgagtcgaggtcgtttgccggaaacagcagctcaccacccgtccagcacatcgtcgctagtcggctatcaaggagctcggtcactgacgcgcttcgaatccatccacgcaattgggttcgagagggagagggtaagagagaagaatggatcccctatcccccatactagcccaccaatgtggccattttgtggcgggcaaggcaccgccacaagatggcaagagtgtttggatcgtggcctgccacaggcctgcaccacccacctcacgatgtcaccgtagatgtcgcctcggtcgggcaacccgtggtacccccggccgccttaggccacccgccctcatcgttgtcgcctcgccttgtctccccttgccgtcacttggggcgttaattaattgtcaatactagaaatccaaatttgctagtgacaatgacatgtaatggataaatttcacccagcgcgcatgcatgtaactaaaaaaccatgttctgagaaccaaagattggaggcagcagatctatagggtgggtggtccaggaccgggaccgggaccaggacctctgaatctttatctctactacttaaaagttaaaagttaaaggtgtttccgtcatccgtccatgaaaaaagggcgaaaaaatcgggaaaaaaatcgaatccgattatatgtgacgcgataaaaaaatgcgacgtggtaaaaaaacaaataaattgaaaacgtttccatcgtccataattatggaaaaaggcaaaaaaaattaaaacaaaaaaggaaagcccattagaaagagcgataacaaaacaaaaaacccgttgagaagggcgaaaaaaaagaaagatccatacaaaatccaatccgacatagaacgcaaaggaagagaaattcttaaaaaattaaaggtgtttccgttgtccgtccgtggaaaaaagacgaaaacaaattgaatctgattatatgtgacgcggtaaaaaaaagtaaactgaaaacgtttccatcgtccgtaacaatggaaaaaggcgaaagaaacattaaaacaaaaaataggaatgtccgattcaatttgacgcggaaaaaaattctgtaaaaaaaagcctgtaagaaagggcgataagaaaactaaataaacccgtaaagaagggcggcaaaaagaaggattgatacaaaatccaattggacatagaacaaagaggaagagaaaacgaactagaggaataataaaaacctcacaaatcaggattttcgtccgtcttgttgcggacctcctccctccgattatctatcaatgcaccaataaaccaatctcaaataatcacaaatctaaccaaaaaactaaagcccaatcccaatccaatcgaaatcatccaatctcaaattatcataaatctaacccaaaaactaaatcctaatcccaatccaatcgaaatcatccaggataggagacaatcaaataagagagaagaggctgaaatcacaaaataaatcacatcacagaggtgatgagtgtagagggaggggtgagcggacgcttctgctgctcctcgcccaacctcctcctcgccacctcgccgccgtggaggtctcgagccaccgctgcggtgaggagccaccgagcagctgctgcgccgggagctgccgacccgcgcccctgcaccgctgctgcgacgggagctgccaacccgcacccttgcgccaccactgaactggggagatgtcgagagggagggaagaggaagatggcgatgacgaggccgaggaggcgtggccgcgcggtgaggtccggtggtgggaggcagatgcgacaggccataggggtggtggtgaggaggaggtgggcggtgctggggtcgggcgggagtcgggcggcggtgtggggtggaggtaccgagggaggaagaggagcgggtggttgattggtaggtcggctccaactggtttattttaataggggtcggtatccggtttttaaaataggtgtcggtttttttagagcagtcacctataagactaatatagatgattaatatatgtgttggttgtgaaaaactgggatctatatataatataggtgttgattcttttttttttaaaaaaaactagcatttctctactacttaaaaaattgaaaacgttcccgtcatctcatccatcttaaaataaagaaagagcgaaaaaaaatcttcgcactatccgattccgccaccacacgaaaattggatacatactcgatttggactcaaaatcggatgaaattaaccccataaatgtttccgtcctccatcttaaaataaaaaaagagcaaaaaaataatcttcgcccggtctgattgcgccaccacatgaaaattcggtacaaactcgatttggactcaaaatcggatgaatttaacccccaaaatacaaaggattccacatgacaatctaatcggacaatccagcgattgagaaaaagaacgggaagaaaaataggaacaacagcgtgaagctgccagcgccgtcgtcgccaccggatctgtccacgggaagctgccggcgccatcggtgaagccggatcggcgacgtctacgtcaccgttggatacgccggacctttgtgcccaaagatggtgatgctagcggcatcaaccacctctcccagtctgtgcttcttaggttcaatccacccccccatcgcttcaatgtctttgactttgtttgggaggaattccgttgggcttcgattcagtataagaaggggttggtctatgcccctcacatcccgggcgagcacttcttcagctagggacatctcttccacctccactcagcctcctcctactcgtgagcccatctcctgtggctcgtcgtgagtcgtctcccttattccacattttgcggagtctctttggcctttgctctacggaggccaaaaagaaccacaaagcgtggaatgaggtgaagaagatggctaggcgcgtcaagcacatgcaggcgcagctcaacgagcgtcgtcacgtggatgttcctccctcccaaccgggctttgaggctgagcccgaggagatagaggatccttttattgggttgcctctagattttgacttctttgggtttggccatgactatggctatccccctcctcctgctccagaggatcctcatcaggtcccgttcgcttgagcttgttgcctcgtcctctctttttggtgctttgatgccaaagggggagaatttctctattcattacgttccatctttggtcgaaccatgttgtttttatgtgtatgagactatgtgttaatggtttgagtttttgtaatccttttatgcatttgtgtaagacaatcatttgtgatattgggatgtaatgactattatgtatgccttatgttaatgtcatgtaatgttctcacttcctttatatattgtgcatgtgatgagtgaaatggcttattattgttgtcttgtgagcttcaatgtggatgcaaagatttaggggagctctccacttgccttaactcacacttctagggggagttttcactaaacctttacaccaaacccttctattatatttattcccaattgtaatctaattgtattgtcatcaatcatcaaaaaaggggagattaaaagtgcatctaggcccctaataattttggtgattaattacaatgcgattagagaggactaatattttttatttaagtaaatgtgaaggttgttatgtcctcgatgagttgtagtctaatgcatatgccgcataaagcgtcgttgtgatgagatgcagcaaatgaaaaaatggtatattgtactttttcatctctttgggcctataggtaaactgcactattaagagggatgatgcattgacatataaggagcgatgaatgtgctcaaaatcaatttttaaaagtgtttctcctctgatttgcgtgttctggaaattttcggacttatccgaaactgatttttggaactttcgaaaatactcagaatcggaattctcttatggaaattttcgcatatgtctgaaactgattttcagaacatccgaaaatgatagtggagtcaaaaaatcatttctgtaaatttttggagttgtccgaaaccatatttcggaatttctgaaaatgtctgtgaacccaaaagcgcttctggaaatttttggacttatccgaaaggaattttttaattttcaaaattatccagaaggatatatccgaaattatttttcgtaatttccgaaaatcgcaattattgtgcataacgggcagatctggagctgcagctataaatagcccactcccctcacttgtgagggctgctagtgacattggatattttgtgcccttggcttgttcatcttgagattcacttttgagccttgctttcttgtttcccctctcaccagtgttcaattcggattttgtgtgtgtgagagttgtggattcaagtttgtgtgagtacttgttgttaactctatgaagatttgtgagcacttgcatcatctccgggagttcattgcatcatttgttactcttggaggttgaggacgcctaggcggctaggtgtcactctcgagccacctatctacgtggggttggccgggaaaagtttgtgaaggtcagatctcacctccgaaaaggaagagataccactagtggaaagaggagtgctttgtgcaacctcttgaggaaagggttagcaaagactcgggtctttgtgagctccacaacggagagtagaatccacaactctcacacacaaaccaaatgaaccacaattctcttagcgtgtgtttggtttcgggactaggtgggatgggatgaaaccattcctgattttggggttgggatgattccatttacgtgtttggtttgtaggatgggataatcccaattttttgtttggttgaaaggatgagctagagatgggatgagcgccgtttgctatcaccgtcagcgagaaagaggagagcgagcggaggtgtgacgacagcctagtgggagctcggcgggtgggtggatgagcgcgacgatggctggcggcgaggaggagcggcgcaatattgcgagcaggtggacgaacagaggaggagaacggacgggcaagcaggggtgcagttggaggagcaagccggcggcgagcaggcagaggacgcggatccgcctccaccgccctccccaccactagatccaccgtcgccgtcgctaagccccccgcagtcaccgtcgctgagcccccgccggtcgccgtcgtccaggcccccgcggtcgccgtcgctgagccccccgcggtcgccgtcgtccagtcccccgcagtcgccgtcgctgagtcaagccccccgcggtcgccgtcatcgagcctccacggtcgccgttgtcgagcctccacggtcgccgtcgccgagccccccaccgtcgccgagccaagcccccgcgaccgcggtcgtcgtcgctgtcgccgagccgagcccccgcggtcgccttcatcgagcctccacggtcgctgtcgccgagcctcccgcagtcgctgagccgagcccccgcggccgcggtcgtcgtcgccgtcgccgagccaagcccccagcggtcgccgtcgccgagtcaagccccccgccgtcgccaagtcgagcccccgcggccgcggtcgttgtcgccgtcgcggagcccactgcggccgccatcgccgagcccgctgcggtcgccgtcgacgtcgctgagcccgccgcggccacggtcaccgtcgtcgagcccgccggtgtctgccgctgctcctgagggcgagtagggcgtgcgcgcaggctggcctcgagctcgagcatgtcacaccgttcgctcgtcccaaccgggacgagttcgtccgccagaatttgccggatcggttggtcccggatctgagaggaatatttctctccagggaccaacccatcccactcacccctcaacgaaacaacctcaaaagtgggttcgtcccatcccatccgattccatccttgcaaccaaacgcacccttagatcatcaacacctaaatgcctaggcttactacctacaattctctttccatctccatcgtaaaccgattctctcattttcttttttttttatctccttctcgtccccccatttctagtttaactgtacgacactgtatttcaagaatattcgtatctctatagaaatagtttgtcctggtcagtctttttataattagggtcctccgcccgcttcatgaaccactcgcggtctgcccccacatggccagccccttcgtattttaatgctaacggattttcttcactatcaggtggaccccatctccaacatatattccttcagatggatgaaactgaacactgaacttgcaggatggagttgcgggtgcaggaattgtcgcacgggataatacaggaaactttgtcactgctgagtgtcgaagatatgaccatatcagtgatccgagcacagtggagatgagggagtgatgtccttttatagggcagttatgacggttgtgagaaggggaaatgtccgaactgccccacaacagtcattgggagagtgtttggagcgtccacgccaaaccctaggatcaatggtgatcaggggggttcggccgaactaggggattcggccgaacctgggctgggccctcctggcctggctttcggtcggtggactccctggaccttcctctgtccatttctcaaagttttgggttgattcattgatgtttcgatgaagttcacaacccctccttgtatggatatatgattctcctctcttttagtctagatttcctcccaacatcggggtttatcacctgcatacaaatatataccaacacttgtggaataggtgagattaagcacctatcactatgttggatgttttattatctgaactttaggaatatgttggaggtatggaatcagcatttaacagccgccaacagcgtcatcgaactctaagggagcatccttagctaacagtttggtcagaggtcaggcgattgtagagaagtccttgatgaatcttctataaaagccggcatgtcccaagaaactgtggatccccttgatgttcataggaggaggaagctgatctattacattgattttagtatgatcaacttcgattcctcgttcgaatactcgatggccaacaactatcccttcacggaccatgaaatgacactttttccaattgagtagcaggtccttctcttggcatcgttgtaagactttgtctaaattttgtagataatgaccgaaggtctttccataatgtcctcgatcatgtccgagaaaatagacatcatacacgtttgaaaagatgcaggagcttacacagtccgaaggacatcctacgataagcataggtaccgtacggacatgtgaacgtagtcttactttggtcctccggatggatgggaatttgatgatacccggaatacccatcaaggaaatagaaaaaagaatgatttgccagccgttccaacatttcatcaatgaagggtagcaggaaatgatcttttttcgtagccttgttaagttttctgtaatctatgcacatcctccatccggttatggttcgttgcggaatgagttcattttgagcatttgcaacgaccgtcattcctccctttttcggcacaacctggaccgggctaacccactcactgtatggtacgggataaataatcccggcatgcaggagtttcaagacctctttctttacaacttctcacatcgcgttattgagccgtcgttgaggttccctggagggggtactctcggggttaatagggatacgatgagcacaaagcgcgggattaatccctctgagatcttgaagggaatagccaagagcagcgtgatgcttttctaacacagacagaagacgttgagtctcgtcttcagagagcttggtcgttgcaaatgctcaaaatgaactcaaatgctcaaattctcacaggattggaagatcgagagtctctccgggttccgcttcttccttgatgaagtcggggatttcattttccagaagggtctcgtgagacttgtgagggggaactaccgtaacctcctccgctgattcaatctctaggagagagccggttaaggcgaaccttgcccgcgagaatgggactgagaattcattccctcccaaagttatcttgaggctatccaacttgggcatgtttatgagaagttgctcaatgggaaggccgattagaatgtcaaaatcttggatttttgaagacgtggaaattcaagactgcctccctgtcttcaaaacggacaggcacatattgtacaattccaaatccttcaatgatatttccgttcgggtgcttgaagaatttgtttgtcggggttactgccttatcgctcagataagcaaatgcaaaagactcagagatgagattaaccccgacagttggactgtaaagaataccaacgtcgttcccctccagatggcagggaatgattcggggagcagtatttatctgaattacttcggatgaaagctctgcctaccttagctattcgtcgctcattatggaagttaactcccgagcagtttcccttaggaacccaagttccataggatcaggaggcggcaaggggatgagtggtttctttttactgaagtagttcagggtgttgccataatcttcatcaaaaccgtccctgaacagaactaccgcacgatccggcacgttccgaaaaaaataccgcttccgtatttacttgagtttttgaattagcctattcatcccccctctaggcctaattgaccatttcaatggaaatcaagtttaagaaattatgcatctaacaaaattataatcatctcattcatagttggaaccaatttcttatgaattttagaagttcttcttttatttttaattataatcatttgcatctatctaaaggtggatatattatgtatattatttgatccagatccgagttcaccaaaataaagttcaaactcatgtgaagctaacaagttttagtttgattcattttagttctgtacaaattttataagttagattatgctgtatgttaattattctttatacaaaattttagagatattttcttgtacagtaagtgtatcttttgaatctacaaaacaaaagagtatagattttatgagtttactggaactttgttcatgtaaaatggagctaggatgaacattttatgcatttctaaagtttgtataattttcagttcagcaaataatgttttagatattttcttggtatttatcgagaatttaaacaaatgggtccactggtcagtgacttgcgaatatgcagaaaggctcttgagatttctaggaatcaacccgcagtcctgtgactgttctgcatttgagcgaacttttataaactagtgcctagagttttgtttcttctcagaagaggtccctgcgacctggacaggggtggcatcgacggccggcggccatatttgggttcgccggtggcgaacggtggccgatctcgccgtgtgtccaaaatataaaatgtatctaaggttcttacgcatccgttggtagtttaatcacggctgataatgtatcacgaagtcagcgagacaagatcgaccaaacgatggtcacgaacagggcgcacgtacaccatgcaaaatcaccgcgcgcgtgtgcagtggcggatagctgaacgtagtcagcatgtacaggcagtgctcacgtgcgaaaccaagattttagtaccatatgggaaaattatgttggttgaggcccgcataaaagaggaggcgcttgtgctcctcctgccgagctcggtggtgcgggctttgtaaccccagctgcggggggcgggagtttggcaggtttcggccgtttggggattgaggtaggcaatatctctccaaccggggtgcctgtacttgggtgcctggcatacatacatacgctgcttgctagggccggtcaaacggtgtcccacacctgccaactctcttttttttgctattttctgataaggcgaatccgactgtgcgcggtggcgtggccttcgaccagcgctcaaagcgtgcgtacctgcgctgcgtatgtgatgacgtagctgcatggtctcaaactttcgccgttggtggtgttgacggcgagggtggccgtggcgaaatcgaacacccaggccgagaacgccatgccgacgaagagcgcgctagccaccggaatctttgcacgtaggtttttcccggccatgcgcatgtgccaatgttctcaagattggattttttttatttttaattttttttattaaaagttttacaaaaataattttctatttcaaaatttgacaaaagtagtcgccgccaccctctaggagggcgacttttaaatatcgccctcccagagggcggcaaatgtgacgtggccgacggccgttcactctcgggcgacggccgtcatggaaatttgcaggcgacccccttgccgccctccacaagggcgattttacactgtgcggggggtcgcctgcaaatgggtggcgagggggcctggaattttgcaggcggcccccttgccgccctggaggagggcgattttgaactgggcatatgtttctgaaataaatatttttataattatcaatagatcagttatccaatcttttatattgaaaactcaatacaagattttagtttccaagattggtaaaatctaattttatcaattttttattcttacgcatacaaaaatacaccatcataattaaacattgtaatgataagatagttaagaagtgcaaacctctgttcaacctcacttggacagcggtgatatcggcactgatatcctgtgcggcatcggcctatgcaagatgaaaataaaaaattcagtaacagtcctatattatgcaagataaatgaaataattgtaataagtaatacaaattcgacgtacccccatgaagtagtctcggtcacggtgcgtgggatacgcgtccgtgacagcggcaacgtgcagctctggggcgtctggagtgaaggtcacacgcgcacgagtgcgaggaaggtaccagcggaggtagtcatggtagttctcctccgtatgtgggaagagctcgttgatcacctcctctgtagctaacacccaatcgtcaatgtactgctgtacacgtggagcccaaagtgcgcctgcttgctgtccccatcgagtcaacctgtgaagagaggtaaattatatggctcgatcaattaagtagcataaaaattttgaatcgaacaatccgaactcacgagtggtcggcagggaggacggtcggctccacattgcctaggaacacctgcctcaggccgaactgtctcatcatacgctgcggccaatgaggctcgacgaaagtgtcgaacaccatcagcaggatggttagccagtaagcctggtcgcgtgtgcacaaggacgaaagtcctagcggtgttctcgcagcaacggcctcttctgtgtacggcttctagatgacgtcgctcagctggagatggtcaaactcaaacacaaagtccgggtaacctcatctcacctggacgtgagcgtaacgacgctggaataaacatgatcggaattagacatgttatgtgatgataaaaacgaaagacaacaaataaacaattaacgcaacaaagttccacttaccccacgtcgacaccagtaagtccccatcgtgggaccgtcctctggccactgcacgctgcgaccaaccccgtagggtgcggtgtccaccactggtcgacctatggcaaacctctcggctgcccaaagctgaagcaacattgggcaaccagcaaagatcgctcccgcgtcggtcttcgtgcaggcctcgtagaggccacggtacgtggctgctagcacggcagaaccccagctccactgcggcacgtcctgtggctcagcatccgtgatggaccgtgcgtagtggaccagccggaagtccacagcgtgcccgtgcgtgctagtgaacatcacccacccgaacaaccacagcaggtaagtttcaagggcgcatcggaccgagtaatcattagcgtcagggtggagatggtccgcctacaattaataatgaaatgttagtacaaaacaatgtgttgatcgcaaaataagcatgtatgataataacaagttgtttacttacagtgaactaaagcaaccaaaccttgctaggcccgacggtagagtacgggggaagggtgttgggcactcctaggtgtggaaggcgcatcacgtgcttgaagcgtgcggtgatatcctccttccagccaacaacaccgtccacgggaccaactggggctcctgccagtggtagcctgagcaggtacgacacgtcctgcagtgtcggagccatctccctacagggaaggtggaacgtgtgcgtctcaggtctccagcggtctaccagagcggcaaggagtgaccagtctgcatcccaccgcttcgccaggtcacggtcgtgcgcccccgcctcaacaagcctacaaagtggtagaaggcctgccgcacgcaacctgcatagagtaaactataaacataagcacaagacaaagcaaagttgagttgaaatgtgcttacgtaaaattgaacatacgcgtaccaaggaacgagcctggctgtgcaccctggattgctgacaggaacgagcggtggttcctatcaatcccatggttcaacaacgccggtgtgtcgtacgtcatacctgtatccaatagattgatcagaaacataaaaataattagttcaacataacttacaaatgttcataaatgaattactaacacatattaaaccagagtaaaaacaaacaaaaggtcacaatacagaatatttctgattacaacaatgattgcagttacacgatatgagtacttaggccgaatactcatcacgataacattacgatacaacaccgaagagttcacaatacaataggaccgtcatgaatccgagtactcactagtagtacaacaatagtcggaggtactcattacaacaacatccattgaaattacatgatagaagtacttagtccgaacactcatcacaacacaatagcagtttaattccaaattcgatagcaatgttacaccatggaattgcctgctgcacgacgacgtcttggccttgcgcgcttgcttgttgttccttcaccaggtggtcgccttccatcacttgcctgtccagatggatcagcatccgcgccgcttggaacttctgcattctttgaacatttcttgtaagtatggccgcgcagatcacacttgctgcagcgtaaagtcctcccacctgcttctgactcatccatatcatttctgatgcatctagtttggtgtcaaccctttttcacccttaacttagatggatctggaatataaaaaactttgggactcagcattgtgtaagatcctgacatcccgaacccatatatctcctcactccatgtatgaaagattgcttctttcttgaaataatgtgagacgtacacattgggacatatgccacaatcaccggcagcagcaagaacgtgtgagcaaggaaggtgacgaagcttcggcttcatacaactgcaggtacatccaccatccgccttcaggacacattcctgcacggcttgcttgcgatagataccacgcctgctcctatcaacacacattatttcataccgatgcacttgtgtgcattgagcaacaactctatgtctccgtgcctttctgattttatcttccatgtactttgttaccacgttgccaaacactatgttgttatcggccattgacggaccaattttcttgtatcgatccctaaagtaggcctgcgtgccgtgaaggatgaattcaacaatagcaaccaatggaagtacccgcactcctcgcattacccagttgtacacctctgccaaattggttgtcattatgtcataccaagatccatcagtgtcgaacaatagagaccacttctccttaggctcattctcaatccactgagtgaaatttctgatggacgaccccgacctccttctcattgttggtgggtcgtcatgtaatgcaccaagaggtatgggaggctcgtcaccttcaacttgtggtcagcgagattgctcgtctgtttgcttcattgtcaactcatccaacttgtcccacaactcattaaatttcttctcttggttctgtgcatagagcctcttaaaaagatccataagatgcttgttcttgaattgcttgtagaaatttgcacccatgtgacgcatgcaccaccaactccgaacatcaggccacttagctggaagtcccttctcatcccaactgttctacaagtaatcaatagcccgcaacatacccgcatgacgatcatgtataaggcaaatgttgggcctcatacgcaccactgcaatgtgcattctctctaggaaccagtaccagctttcagtgttctcactctctacaaatgcaaaagccataggtggaacctagttgttcccatcacacccaattgctgtcaatatctgacctcggtatttacttgtcaaaaaagttccatctatgcatagaacatgtcgacaatgcacaaaagcattgatgcaagcacccaatgagaaaaaggctctttgtagcacactctttgttcgatcatcagccgatgtaaatgtatgtaggtcatagtaagtattactattcctctgggaaatggttgctaacagacgaggcaaattatcagaggatgctttaaatgtgccatacctcatctcaataatcttttgtttggctctctaggcctttgcatagcttatggtgtacttgaatttgttctcgatgtggctaataattaattttggttcaaagccaatgttaccaacaacattgttgtacatcttacttgccacaaaagctgaagtgatgtttcaatgatacttctccaccccttgtaagtagcactggtgctcggtcacaatactaactttccaataatcattccatttacccttatatgcatggacacgccacggacaatcttccttcatgcacctcacttcatacacataatttgttgacttgaccaccctaaactctctcggaaagaaaactgcccaatgcttcaccgcctccttcatctcctacttatgagcatacctagcaccctcagttacctcgttctccttatattcccagggtacatgatcaccctctgatataacaagtccagaaaaattctcatttgtccaatcagtggccattacatcaccttcctcatcggatgatgcgtcatcctccgcttgctcattatccgaatcttccctctccatttcatcaacgattatactgactctctccccctcatccgccatgccaatggcctgctcctcccttagtttgattttcctcattttgcatcgatggtccaacaacatcccatgcattgctaggaccctccacattttcggtttgcattgaaacatttgtatctttctcttgtaccgacacaaatataacgaggggccatgaccgttcaaaagccatctccacataccgtctccaagcagcagtgctgtccatcggcattagttcctaaaaataaccttctattacacgactcattacaacagatactgacattgtgtagacttcttggtctattctaaatcctctcaacaaccaactataaattgactgaaatgttctctccgcaggcctatcgatgcccttagacgtcattacaaaatttgatagatcaacaccatctggaccaaatctaagatttccttcaccgtgaactatctgaaatgtgaccatatttgacattgtgcctgatgaaaacaataacttcgttaacctcgcatttctatactacgcactaagttacattctctacaatattgttctctctcctacgtccaaaattctaaaattaggtgacgttctccagatcaaactaaactacatcttacaattaacactacggtctatgtctcaattcatactattatattctgtgctctagatctacacatatgtgctgtgtgctacagatctgctaaaatatatggaactaaaactaaaacgcaacatatattactcaaacataatatattagtacaaatgcaaaagaggtatgggagcaaacctgtgatgaagtgagcaaactggcagggctttgccgctccccttctgctaccctcccctctccatctttcttttttttggattttttagagattataatgagatttcagagaaggggagtgggttatataggggaggggcaaaaatcaccctcccccagggcgacaagggggccgcttgcgaaattccaggcccccttgccgcccatttgcaggcggccccccgcacagtataaaatcgcccttgcggagggcagcaagggggccgcttgcaaatttccttgacggccgtcaccggagagcgaacggccgtctgccacgtcacatttgccgccctctgggaatcgccctcccagagggaggcgggcgactacttttgtcaaattttgaaatagaaaattatttttgtaaaacttttaataaaaaaaattaaaaataaaaaaaattcctcaagattgagtgagcttctgtcatgtacttgggcaggctctaggcccaaccaaacagcaaggagtataaaaccaagccacactacagttctttggatcatggatgaacatatgaatgaacaggcatatgccttgtctcctttcttcccaaatgctctcctacctcaagctccaattctctgattccccaatctcttgcttcttcttcccattctagattgctgattcctgtgtctatgattctatccctccctcaagttgtatctcaaatacttgatatcttgtgttggaattggagtatttcccttctccttgctgttgattgatggaggtcaagagggatcgtaacaatatggtatcggagctgtcggttcatgggattccatgccaggagacaaggtggttgacacacggttgcagttacgacttccagatactgaatccaagcattggaggtagttgcactggaggcgcccgccaggtgtttgatgcaatgccaagctggctgggagctggtgcaggtgctgctcttcatgtccaagtgagccacatcatctacccagtgaccaataaggtattgtaccaggtttatgacatctatggagcggaggaattgcatatactggtggtcgacgcatggcgagtggaggttcttgtttggttccgggcgagaggtgatgcgaagaaggctcggggggccacccatggccgcaacatctatgatggagggtgcctactcgaggctcagcatgcgcagccttgttccaaggatggtgcagtgccgacgcccaccaagtgttcgacgccggtaccaagctgtgccatcaccaagtccgatgccgagagcactcctaccacattggaacatgtgttcccagccaccatgagtcaatctatgccctcagccgcatcagcagcagcggcgccaccggtttccctcaccgcgactaaggaggatgaggccgacatggacaaatctgagattaaaccagaggagacattccaagagttgtgtgccaagatgattgccatgctcaacaacatgctcgtgacatgcgagtcaaccgcgagcgttgatatcaccagagtggtggcagttacaagcaccaacactgaatcagttcccaacacattggaggtcagaaaggaggccaattcaattagcttggttgatactaatgagtcgtgtatggcgacacctaccaagtgtttgacgaaaggcaatgaacaaatgatcaatgatgatgacgatgacatggccaccgaggatttagttgagcacactgaagtgaattccaagttcacattacggcaaacatccttcaacaatccatggtttggccatcaagctatttctgttgtttacttgacttgctatagttgccttgaccggagctcagaatacacagctaggtcaccactagtaccacgttggagagcagtaattccatggaaccaagctgagatgaccttcggttctcggcccttaccacggcctgatccacagctaagtcaaggcagcgaagcgcgtggtggtgaagtttctatggaattggccacctctcaagccaattgcaaaggtgatcgagtggagcaccagccacaaccatggcctaacccacaattgaatgaaagtagcggagacgtggtgtatctcctacaacgatggtcactacctgatctttctcttcgcattggtgtggctattgttcaggagcaggggcagctactacggaaacaagacaagaagaatcctcggtcagcactttttgaagcaggagataaaactgatgttggagcatttctctcactcggtaggacattgagtaaggttcaatggctgtttttgtttcgaccttgggatagtttgcaaactgttgaatggttgacttatatgggaaaattgattgccaagagcaactttgttgtgaggggatgctcagtaaatctttgggaggttcacaagcaatcttatttggctgaaacacttaatctgcaatacattctattggtgggaataatttgggatccaggagaatttggtttgcaaggacttagtgttcagaggaaatcaaatgcagttcttgattcatttgtcattatggagtattggttcatgcagcagcttatgttgaccatgcatactgaaaggcactgggaatttctttttcaccagcatcacttggatggtttacatgttaggtaggacatgcagcaaccacaactatgaccactgcaaattgtcttcccagttagtgtgagggctgacctggaaccattgctgcagatcatggcttcaatgacaaagctaattaaactacgcttttggcctgctcttagaagatggggagatcaagtactaaatcaagttcatgatttgtgcaagtgctgtcaagatcaaagcctattccagctcactttctccataggttgttccttaaatctatgtcacttgggtttcaaagtaccatatgcaattcaggggattataattacagagatgaagatgacatggctttgggatcttgagactgtcaaactgctagtagccaagtatgttcatgcaagctactgcttttcatgaggcccaagttcaagaaaatgctatgtcaaagccatgggatcctgggggaattgcatcagctgggaaactgaattgcatctgctcagagggctcaatgacatcaacaaatatggataagcaaatgtgcattgttaaaatggttgtgcatctcaactttattggggttatgcttcaagttaccatgggatccagctacatctcaatgctgatttctagagcaagagattggacagtgaaggggctcagcaagtacgtaaactcatggatgtatttcagctcaagcacaagagcacagtggtatggagcttcatatttcaccaaaatctggacaaattgctacttaaactacagcaaggcaagaatatttggaaaaaactggtgatgagaatcctacctgcatcgaagatttgcatgttccatgggatcccgatagaaccgctacatcggcttgggcacaagccgattttcgaggaggggagaatgtcatgtacatgggctgggccagctctaggcccaaccaaacagcaaggagtataaaaccaagccacactgcagttctttggatcatggatgaacatatgaatgaacaagcatatgccttgtctcctttcttcccaaatgctctcctacctcaagctccaattctctgattccccaatctcttgcttcttcttcccattctagattgttgattcccgtgtctatgattctatccctccctcaagttgtatctcaaatacttgatatcttgtgttggaattggagtatttcccttctccttgctgttgattgatggaggtcaaagagggatcgcaacagcttccctgagagagtgatctcgttggtcatgttgtttcctgtgtcaagcaacatactgatgttctacacaaccaaccatgccatgttcgaggttcgagagaaatgattatgcgt

SEQ ID NO: 83067 - DNA, 735 bp, Oryza sativa
tcctgcacccaattgccccactattcctctctcattttcgctactctgaaactctgcttttctctgttctgaatcccgctctgaatttattcgtttccctgtctgttgccgtgccggacgcgcacagtttgcatgtgtggtgttcgatccagtgcattgtcgctaacatcgatgttctcaagagtgagcttccctgagagagggatctcgttggtcatgttgtttcttgtgtcaactaacatactgatgttctacgcaaccaaccatgccatgttcgagagaaatgattatgcgtaagcttatgtactctacatgtttttatatatatatatatatatatatatatatatatatatatatatatatcagaatcaatcgagcagaaaagtttgattgagagagagggaaagagagaaccagaacttgaacagaactgattaccgatacccccatcgttggcttgttcatcctgctgagccatttgttcgagtgcatgcatttggtgcgttttatttgacggaatagcgtggttcggtattgcgccataattttattatttccgctagctcctctcagatatttgtagtgaaggattttctcaaccgcaaaaccagatatgcggggtcccctatctgtacaaaaccggtcatccgaggtctttcggcggtattgaccccggttttggtctacgtggcggctgagacagcgtgggacccatgtgggccccacatgtcc

SEQ ID NO: 83068 - DNA, 1393 bp, Oryza sativa
  unsure (1)..(1393): unsure at all n locations
agtgactggaatccgacatgccactggccannnaccnnnnnnnnnnnnnnnnnnnnnnnnnnnnnnaatcctacctgaaatcgtgtcaaaagaaaagaaaattccaacctgacacgagtgatcgtgtgctgcagctacgagggcgtggacgtggtccggaagcgcgcctcgctcctctggaccgccgccatgatctcccgctgcgccggcgccctcgacggcgacgtgaccagggcctcccaagccgccgccgccgagccgtccggatagatctcgtggacgcagtcggcctcgacgttgaggtggctcaccctctccaagcagccgatttcttcagggtccactagaaggttgctctcgccgtccttccatcctatcagctgtagagagagccagcgagcgatggtgaattctcatttctcaatgtgcctgatgttataaaaccggccccgataacaacatcggtaaccgaacacggaatgcattggtaagctcaccttggcggcgcccgtggagttggtgcagtagagcctcgcattgtcgacgaggttgcagtagctgtggaacgcggtggcgaaccgcttgtgggacttcagctgggacttcaccctcactgctctcccggtgatcacagctcttctgacaatgtgattaaccgggtcaaattttgtgcttatacctctttgttagtacacggaaaatagtgcagttgagtcaatcgcaatgctgacataatgnaagcgtgagcagaaacagcaaagatcaagcagaatttgtttgagtaatatgaacnagcatagtatcagtaatgtagacatgtagtgaagtaggattaagttctgaagcatacctgattcccctgacaaccgcaagataggcatcacagaccacacctacgagctcgatgcgatatggcttcctgtttctcgtctcgccttcttcatctgtactggagtcctcaactggctcccagtactcctcagtgattgacccgtcctccgtgaccttgtagccaacacccatgcggtaccgttgccggtgcacagccctggccatggtgatcgtctgctggacaaacggctcccacgacatggtgccgtccatgatcacatccctcccttcgttgagggcagtcaccaggagcgacgaggctgcgtccatcgatgactgatgtacctgcaccggaatcgaggggtcactgacaatgagccatggtatgtctgaaatgtacatactccctccgtcccaaaaaaagacaaatcctaatttccgtgccaaacgtttgaccgtccatcttatttgnnnnnnnnnnnnnnnnnnnnnnnnnnnnnnnnnnnnnnnnnnnnnnnnnnnnnnnnnnnnnnntggtctccatnngnnntcgaattcgagg

SEQ ID NO: 83069 - DNA, 4938 bp, Oryza sativa
aaaatggtaacgaggtgaacacaaccttagtaacaaacatatattgccattaatgaaagctgggtacgaagtggctggtgaagattacctggaagtaggactcccacttctgcctgaggacggcatgctccctcttcactttctggaaggatctcgtgcaactgcataacaatagtagtagagatctatcatcatacgaaataagccaatgaattgaacaaaaaaagatagacggcaagggctaattccagttcactagcaggaggaactttcacccatcagaatatgcatgtgtaactaggtactaacactcataacagtgagggctgacaggtgacacttctacatgcctcgactgagccatgccaagtttgacaaggtggcagactggcacttagccatttactttgttggtttttccgtaatgatcaggccgattggatgctctggttgccacagccactgcagctgcggcagttgaaaccagctgcagccggcagccatttacaactgccacagccgctgtggctgcaagcctgcaagcacagacgagcacacccagtaacagccatgggcatgggaaaatcacaatgctcaagccatgaacttttaccatgccataccacatgtcataaaagtggagagagagagagagagatacccttcggcgttttcttctccacagaaattcctgaatgaagtgcattcattcttcaccctggaggcaccaatgctgtgacaaaccatatcatgtcaagcattgataaagtacacaaaagattatcacatatgtataactaagcaaattgccagcttcttttatcatgtcaaataatgaaataaggagtgagcatgtactcatgatctaccagctgtgcacctgcaaggctgcaccaatcaaagcaatatgggtctctgtaaatatctctgtttaacatattccctgaccgttcactagaatttcacaagatattaagcaggccattatttgaaggtcttttctttgttgtgtgtgcgtgtggtgggagttcaggtacatcaggcttctggaagttctccttcagcttgtgttcgaaactgtcatatttgcttccattgagaaaaggataaacttaatataaaaacctgagaactatgccagttaggaaagttaagctactttcttgaagactgaagggagaaaaactaaggccatatagtttttatagggtaatgttagttagctttttatagattcttgacactctaaattagatttagtgataaaattattatcacatacatagtctttttgaaagatacaattgtgtgcagttaaaaacttaagatttcaaattaagtttacctacagcatatgctcaaaatatagaaaatctaatcatgttcattttcacccaacaaaccgaccttgcgatgtgtggctctccttctccaagcaatgtttttctaaacaaagttaggtggtttgttggaaaaaggcaggattattttttcctagacaaatgggtaattgcactaggcatacactttcctaaaaaggcaataaaattcaaacaccctgtaaaagtccatcagtgccagttccgtcaaatgacaacatggagatctcacaagaaactgagctgaggcttacctagaacagctgcctttcaattgctgcatgtgtgtgtcccatctggcgaagtctttcggatgcttctcactgtgtgatgttagatattagtaaccaacaataatgctgctgaatgtgaaaagataatcaagacaggtctagtttatgaaattgtcaccacttacatagcttgctcaaaattcaacattaccctggttgaatccttaaaaaacaaggaaacaacctcctctgcaaaatttggatttgcttcatcctgcaaatcctcaacctgacaaaattgctcatccaagtaaccctgtcaatacaaaacgatttgttaaaccagcacacttaacacatgttaaactaagataaagaccagaaaagagagttccgaaatggtgaaaggcgttgattttaaagcatttctttgctaactggggtggggataagtacgaaatggaatgaactctacagaaatatcgataacccacttatattaatataatgtgcttcaatctgattctccttagctttgttttcattatctgtgtgcaatagtgtcaatccatggtatggcaattaaaatggcatgactgtaaggtgatgtccatcaaaacactgtattctatgtcttgctgaatgataaatagcagaagaagatatagcaaaaggactgatggatatatttgcagagtctcagatatgcctcaactataatgcttgaaatttgagatgaacagagcacaagcctgatcgaagaggctctttttcaaggaagctgcttgacgtcgcaaattaccgtactccattcacaagtattgaacagtcaggaaaaaaatgaggcgaagtgaagcctttaaagtaggagtcaatcccaaaaatgaatacacaggttgccgatcacctaagttacagaaagtagaacatgaggttcatttatatagcccaggagcctgttactattccttcaccaacataagtgaagatattttaaagttcgtatacaagtgagttatcccagggtgtgcaatatctatccacattttagacagtgacttgaatagctgcagattctggagatactttataggatactattttgtatatttggtgttcagaaatcaaaattgctcatctataactaagtgatcatttatagaggctacagtacaaaaatattgtcagtatttcagttgacataggacccagtattataaaatccgcccattaaattttatagctaaattctactaaaaattataaaactaacaaaaggatttgtgatgaaaaatacattcacaccattttctaatggtcaactagatttttaacaaattatattgcaaattactaaagtatctttcccacatcaaccccaaccttaataatctcggttatttaataaagatccaagatgaaagtatctaacctttgtagttgcttttagttcactcagtttctcattcaatgaaaagacaaaattagtgcctctcggtatcacataattatgtagaagcatgcaagcgacaacttctgatatgtcgtaagaactctttcaagacttgatgcatcaaacttaatatctcacaggcacaaacaaataaccgtccagttgacaatttattttcaaggccataagaattcacacatgcagggcttagaacaagaataatcatttttgggaaaataaaaaaaatgaaaactatgaattacttcatctgatataatgttttagttagtaagtacctcttatattcaaataacatatgttgagtccaaatatatgaatcataataactcctaaaataagaaattttctagggtgacacattgcaggaacaatcaaatagggaaatgatactatcatttttttcacctcaaagttcaagcataatgcggtgataaaatcattgacaccgatgggaggattataataggccgaaaagattcttactttgtacacatcaaaaaaaaagttggagaaagaaagcgatttcaatagctcctttgaagttacaaacaaaattctctcaaatcagtgggccacgtggcaaactagtagcctttgcccttgcagaaaaaacaaagagtatcatttaccaaaaggtgtaaaataagttcattcaatgattggtcgaaagagtacattcaatcacatcttgataagagaatctgacgtgggttcaaacacaaggaaagtttcaaacatatcacaaaagcaaattctaatctatgcagatcaaactgccatggcagcgaatgataaatgaatggggaacagaaatagagtacatgaaagctagcagttgctacctcccctggataacgggtaatgtgtttaaataaagggacaatggcatggctcactattcatccttacagtggcatcgctctccctttagctacgggacattctcatgacgacatctttctacagaacatttcaacctcccaccagtgacctttcccccccaccccccaaacgaaaacatttcaacctcgatatgcagcaagcagtaaaacatctcccaggaccagccacacaagcagagagcaataattgtatttcctgtaaagatgttgaagatagtacaaaaactacaaatacattattcacgtattgcaattctaaacaaaaagcaacagtggagtattgagtcaggaattctgctatgaatagtttacatataatgtcacgacagcaccttagcacacagaattatcaatttacttactgttcattgaaacaataatcactgcccaggttttggttggaattttaatgaatgcttatctctgaagctattatcctgaacacaattcctctcagacgttgatttacacctgcaacatacaccatgtttattatagtgggtcaccatggtatgataagattctctaattgatgaaccataaacatggcatatatatcatgttgctaggtattcataatactcttcaacatatataacaacaaaaatcagtaacttcctagatataatattcatagtatcagcacagcacacacttaaaaactctcatttacattgtgttccaaacatgtttgttttattttctttgtatgcacacaagcttgcttttgctactataatttcaattctgaatatgaatagattatgtatgattgatagccagaaaatattccgtgatttgcaacaatgctcgatgttatccattttaacactttgtaatgacctggcatcatcagattaacagtgactgcaaacatcactacggcagaagtacacagatgatgggtgcaacccttagcccttacagccttactcagggggtgtttggga

SEQ ID NO: 83070 - DNA, 788 bp, Oryza sativa
  unsure (1)..(788): unsure at all n locations
atgaaaggtttgatgtgatggaaagttagaagtttggaaaaagaaaactttggtcaactttgaaaaataaactacaactacaatgaaaaagaaaatcaaaatgaactctaagattaatttttaggtggcagcggctaataagttataggacaaacgatggaagcctctaagatacttgagttgtaaaatctaaaaaaaaaagtaaagaaaaaaaagctaagtgtatttttagattctcatcaattagcaagtcaatacttcctttgttacaatataaatatacctagtgcgagatgtgttatatcttacgactataaatctgatcaagcaactatttagatttagatttatagttctacaaatacaaatctggacaaataactatatgcagattcgtaatcgtaggatatctcaagttctatcgcagatgcatttatattgagaagaaggttacttagccatctgcgcgctgagtacagcaatgcacgggccatccgctcgcggctgcgtagtacactttttacgtgcgcacgcaatgcatgccgagcttgatggaagggatgggacgtgatgccgcttgcttgttcgtgaagaagaacatacgagcagtagaatccaacccccacaagaaaggaggccgccgaattacgcgtggaggaacggggattngtacaccattgggancttgaggcgtacaacacattatgattcaccgggaaatattccatagncacatcattattccctagctaagtatagtggaggagcaaatacttggcttaaagaaa

SEQ ID NO: 83071 - DNA, 8358 bp, Oryza sativa
ccctcagcaatgcatacatatcatgctgctaacgatataaaaaagctgacacaacggaatccataactacatagtagagaataagaataaatacaaggccccgtttagttcccaaattttttttcccaaaaacatcatatcgaatctttaaactcatgcatatagtattaaatatagataaaaacaagaactaattgcacagttagggaggaaatcgtgagacgaatcttttgagcctaattagtctatgattagtcataagtgctacagtaatccacatgtactaatgatggcttaattaggctcaaaagattcgtctcgcagtttccaggcgagttatgaaattagtttttccattcgcgtccgaaaaccccttcctacatccagtcaacattcgatgtgacacccaaaaattttcttttcgcgaactaaacgggtcccaagctgaggatacgctacctccttttcgatgttttgattccttgtctgatgtggtggcagccaatccattctttcctagtggcatccaaattggggacaaaggtgcaatgatgcctgcacaacacaaccacacaagtgagagttttggcaggtaccgatcaatggataagagtctcctagcagccgatttccgttcgattgaagacaaaatcagcgtggacgcggatataatcacatgacatcgtaaactccaaaacaatatctgaacagttcgcttggctaatcactagccaactgcaccagcgcgacagatgcaaaactagttcacgccaaaattggaagtttggttgaaattggaacgatgcgatggaaaagttaaaagtttatgtgtgtaggaaagtttcgatgtgatagaaaagttggaagtttaaagaaaaagtttggaactaaacaaggcctaaacagggtacaggggtggggacttgggtgtgttgtggtggttaccttccgggttccggcgcatctcgacggcggcggcggaagactgcatcacccgcggtgagcactcatcgccgacggatctcactgctttcgcgctccccaactctacactctggtggaatggtagagccaataggccatggaaaaatacgattagggagcttgcgcttccagcggaagagagagcagcgaggagatgcggcgactccggtggggaagaggctcatggcgaggccgcgacggcgaggcggctgtcggcttcgccggacgagcggcgggaccccgggagagggagatcagagagccaaaatacaaaaaaaaaaaaaaagaacggaaacgaacacaacgtggccctctttgcacggtccgatgcggatcggagcaagggcccaagaagagattagtcgaggacgaataaaaaaaagagagagagagagagagataagtcgaggacggagaaattccccaagccgccgccactaaccctagcttccgccagcacggtattaaaacccttccgctctaatttcctcgcaccattgatttttgttctgtgcgttcgtttcgatccaagtagttccccaacaatcctgctactgcggaactgccgattttgctgtcagtttattttgatcgcaaacagtaaatattagccgagcgtcgtttggcattatctttcaattccatgcttctttcaaatttgacccatcatgcatgttatcaaaatttactagagacccagaaatatgccgatgttctgtggtgacatacctatgtcctgttttttctagttagtttgcatgtcttgaaataggcttgtggaaagaacttgtgtttcgagcttcatgttagagagtggtgggatggcaccctctaataggccacttgaggtctctaattcttttgttttcccagtctgagtcagatctgtgtaagaatcttacatttctagtaatagaaattgggggttactcccttgttttaaaaaaaaaaggaaagacccaaaaaaaattcactagactaagggcatgttgggatggtagccattgccaaaattttggcgaagtgggtttgtttgatttgatgtgaatatatttggagctttttttaaaccttgccaaaatattggcattgcaattttccttgtatcaaaccaaataagtgccttgccgttaccaattttttgtgttgttgatttaggcacataagatccaaagtattcatcgtttcctgcagggtgcagatcaagttccaaatcaacctgattggtcctcaactttgagggtaacatgatgcgagacagcaagaggacgaggtccgcaccacccagagaaccactggaaatgacagaggacatgaccccaagaagcaagaggaggaaatttgtaccattcggagaaggtgcggtgctacctgaggagatgctgacggaggtgttcctacgactgcccattaaatccatccttcgtttccgggctgcctgccactccaggtatgcaatgttgtcttcccaggaattttgtcaactctacatcacaagaactgaggcaatgccaccacaacctaagcttctgtttatctcgcctacagcaaatttcaactccactgcggtgtacacgtgctcgccatcgaagcccattgatgacctactgttcacactcgatgatgtgcgtggaaactatgtggaagtggcaccttcaccatgccatggcctcaccctcctgtataatgctgttgcgccagcttactacgtcttcaatgcaactacacgggcaatcacacggttgccaccttaccaagatgtgattcatgccactgctggcgttgggtttgatgcccggacgaaggagttcaaggtggtgaggctttttcgaggaaaatcgcatgagatccattctgtaaagtgtgagatattcattcttgggggtgaggaaggggatcattggaggcctaccgctggtggagtacctttcaggttctgtagttttgctctttctgctatccgcaatgcagtggcgaacaaacttcagccagtttttgttaacggatttctccactggttgatcaacccctcgtttttactcaaagcaccaagagctgctatcatatcattttctctcactgatgaaaccttcagatggatccgatcaccaccctttgaggtatccagagtgcacttggctgagcttgatgatcagttgtgtatggtccgagaccttcgtaatggcttgcctactggtagcatgtttgaaatttggaggctgaatgactataactctggtgattggtcgcttgattaccgaattggtttgacagggaatttgccaagagatttacttgagccacgaattgtgaaagttattggttcctttggtagctacagatcaagcaagaagataatcatcgctacatctaagcacaaggtgtgtgcctatgatccagtttctagaactcttgaaaccattgtctcaatcatggtgacctgcagtgcctatcaaaacgagaaatctgatattagattcagttcatttacaaagagttttaccccagtgcataggacgaggaaagagatagggttctctactcccttgtctaaggctactaaggagatcctactccgattaccagctgaatcaatcttgaaattggaacttgtttgtaagcaatggcgtggattgataaagaatgaaggttttgttcatgcatactttgagcataagaacatggacaggaggccaaagatcatgcttgtgggtaagggctctgaaaaatcagttttcaactttattcccttgagtaaatggctccaagaggcaaatctaggcacaatgtttctggacaaaaaggtggtttgctccaagccttgccatgggttgaatctggtgagcattgagatgaaagactatctgttcaacccgtgtacaggttaccgcatgatctactagaacagagaccatcagctgtaccaggaatggtccaatttgtctagtgatcgctgcaaagactacaatccttttgtagttggcaataagaatgttggtatggggttttgccaggtgactcagagtcatgccgttgtgggaattttctattactggaaaaactacgaatctcatcagtattacttaacatgcattatatggagttgtagctcccaaggccagccactccccgatccacctctgcctgtgaatgacatgccacctgtttctctggatggtgtgctgtactggatgagtgaaccaaggttgggtcagagttatgagcgggccattgtcttttttaacattgccgctaagatttttgatgttatcccttgcccttcatgcattgcaatctgggacagcagaaatccatgtcacgcatttgtggtcgagcttcagggaatgttgtgtgctgtcctttcaaatccagttgcagataagttagatatatggaagtgggatcatggtctgtggagtatagcatatgcaatcaatttaaaattctggccagattattcccttgcgacaaatgttgtagtgcctctcgcagttgacccaatagatggaaaggttctactgaatactgggaggaagcttggtttatataatccatgtgagcaaacaatcgaaaacttgcacttgatcaggcgtcgcagcaacagaaccctggagttaacagaaatttccacattgccagatgccaagatgttcctaagaagttctctcagtggaaactattattggctccgtgcgagaagtttgctaacccttcaagtgcttcatcagggaagaatccattttactccagagaccaatctaaggagctaaatagtgtgagtcaaaaaattatgcctctggttcctatgttgtacgaggagggtttagcttactatcctacaactcctaaattgagagtattgtgcgattgaagtgttgtcatattatgggcctttttcatggctcttgttctgcctctcttatagctggagcgtaactaatatagatggccataaggcccgaggcctgaaggcccggcccatggcacggctttttggcccggcccaaagcacggcacggcctgacttggatcgggcccgtgccggccggcccgaccgccgggctgtgcctgggcctccccatcggcacgctgggctggcccggcacggtcgggccagcctggcacgatgggccggcaagccaggcccggcagacaaaatatagggactaaaaatagacataaatgtcactgtccaaagaatagggaccttaaatagacttattttagttatttacatatcacagcccaaagaagagggacgtaaaatagacttttttagctatatataagtcacagcccaataggaggaaggaaaattatacttattctgaggaaaagcacgatggcccatcgtgccttcgggccggcccgacacggtccgaggcgtgttgggccgtgagtgcggcacgtgggctggcatggcatggcccgatgcatcggtcgggccgtgctggcccgacaagcctcggcccaggcacgaccgggcctgggccgtgccgtgccgggcggcccacatggccatctatagtaactaaacggttccagctctatcaaaaggaagtgaaattagttggagtgctctcataaaatgaattattagataggtggagagttgggtttaggccgctttcgctccaaatccaacttatgaaattaaatttaagagttgaagctcatatatagtagctaagattttataatgttaaaatgccgtggtatgtcccgttaaaattgtagtcaggggtgaagctagcatcaaaacaaggggggtgcactatcattgagaatctacaaaatttcagtacaacactgtatattctaatttttttaagtgagaaattaggaatttaggggttcatgtgcatcccccccccaaacactatatagcttcgccactgattgtagttgtcatttcaagcccagcttttatagctcaaagaccttaacattatttcctactccatcactgcaagaatgtaaaggcggatgtgaaagcaacttcctactcaaatgcaagatatttcctattttcagctttctcactcgtactacgtattttaacgccccttgtttcacttacatttatacttatccgtgagatttattaataaaagaataatttatgtataaaacttctatatatctgtccttagcaattttaaaaagtaaaccatgatgaaaaattcacaaaattaactcgaaagttaagttttaaaatttaaacttcggcttgtaagaataagcgatagaatggtgctgtagattatatactcgtgtaacgatgaggtttcattgcctgagatcgagtgcatcatgtctcgagcagtcaaatattagagtttcctttagcccaagtcataactagatggattcacagttgatgagctgggaacactgggcgaacggggtgagaacggtaacggtaattcccggctgaccggcgtttgtttctgactttctaccggccgagccatatgaaaatggtaatcgaccgaaaaaaatatgaaaatggtaaaatatatggaaatggaaacggaaatggttttattgttttaccgatcgtttccgtatttaccgtattcttgtggaaattaccgtttcttataatatgataattaccgtagttctaaatatgtcgatatttatagggcatgtctctacttgacccatagtttagaggttgaatgactcttcaatcaaattcctaacttgagtgcatggctaaaatggagttaatttatgatttatatagtatagcttgaatttatttgtacatatatcatacttatgtaaagttttctatagtttaatgttttcatatttgttaccggtttccgatttgtaccgacatgtttccgtccgtattattccgttttcggttttccgatatttccaatatcgttttcatttccgactttaccgttttcgatatcatttctgagaaaaaaatgattatggaaatggttgaggtgttttcagatctttcatatcgtttccgaccgttttaatccctacgcgaacctaatactcctcctagtagtcaagaaagtcactgacaaaagctccctacagaaataaagaacttctgtaattaaatttctttctatagaaatatctgaagactttatctaggaattttagatagagatttttactataaatttagaaatcttttttaacgaaactttctatagtgaatcctttcacaggagttaaaaatagagtaaaaacctctaatgaacattttgaagaaatttctattaaagcctctgatgaaaataattctctaccttaagtagaacaaacaaattgcatttttaagtttcaatcagctaaaagtacttcgtctatctcaaaatataagaatttttagtaagtttagaacaatttagggtgtgtttgtgtttggtttgagggatcatgaatgggagacggtgatccaacttttaagcaacaatcaaaaacataccatgccccttattgaacaggcatggcagatggcatcactcttgatcggtttaattgtcggcccatcttgactggtgggctaatctatctataccttaatagttacacgctcgcgcatatatacatatatatacatatatacatatatacatacatatacatatacatatatatatgtatatacatatacatacatatacatatacatatatatatgtatatacatatacatacatatatatatatatacatatacatatatatatatacatatatacatatatatatatacatatatatgtatatatatatattgagggaatggttagttcatatctaataattggatggttacaaccaaatacttctacatagaatgccaaaaaaaaagtacttctacataataaaatttaaacgctagacatcctaaaatattttgaaacatagtgagtaatattaaaaacaaactggtaggaaatcattagctcactgaaacaagccatcgatcaaaacctcgcctcctagtcctacacccatggtctcttgatcgaggtgttcattttttttcctcaatcgcctcctacaaaacacgccggtgttgcacacccgccaatggtgtggaacgctgcttagagcagatacaatagcagactattaactaattataaacatattttaatgaaataaaagataagagagaagagcaatgggctacagatatatagtcagttgcagcacggactctaagacgcaatgtggatatgatgggtgagaccatatattaatagtatagtaagtaactattttatgaattaggtattaggtttggttatagatgaattggaggtagtagtgaactgtactattaaactttctcttatgtattgggctgtgtgggtcaagtac

SEQ ID NO: 83072 - DNA, 1775 bp, Oryza sativa
  unsure (1)..(1775): unsure at all n locations
agggcttggcaatgaaccagagcacgagccggtttgaagaacgtgtgcaagcaccagcttctcccgctggctgaactcgcggcggctgtgcaccggcccngcgtacgcgctcgcgtgaatcacaagcagcccgccggcccccagcacgaacgtctcgccgcggacgggccggtcctggatcagccccacggggtaggacaccaccacgtaggacagcgagtaggccatccacatcacgccgcggaggagcttgtcgctgctccggcggcgggtggcgccgtacagcaccagcgccgccaggacgacggcgctggcgaggacgaccacctccagccgcagcagccgcccttccaccgtgctcagcctctccacgaacccgcgcgccggcgccattgccggccaagaagctcaagctctcccatagctttcactgatcttgattactccatttcttatcgaatttgatccatgcgagaaggtgatgagatagggattgaagcaagaacaaaaatgggatgtggagtaggatgcaagatagctgctgcttggcggtggcactccatggaagacaagaatctctcatggttgcacaaaactactagtacagtacttggtagaactaaaacctttcttctgtctgtgagtttggcagatatcaatcagatcagcttatctttacgcctggatcagtgaggagcagcttcaagactgccgaccaaatgaccagtgaaacggcacccagtgaagaaaaggatatgccccatactacataccgtatgatgcatgggatggaggtgaccaggcaaagaagcaagactgcaaatagtaaattttaaccagagaagattggtttcaaaatcaacacaaataatcaattgtgcaaattacagtcacgatcttatagggttggaccacccagtaatggagtactggtttagtggcttgagatggttgaggatgacatgagctactcttgttaccgaaacaatttaaatgagactccaaatgaattactcttttcattttttttcacaagttaacaaggtttgccacattactacaatggtgatgtgcaactttcttcactaatcatgatgaaagctaaacaactctcaaggatccaacattctgatatctcacctgaaagaaaaccatcatatgcaaaacacaggttatattattttgttggaatattcaaagcacaaacttggatcaagcaaggcattatccatgaactagacaacggtaagaacaatgcttgatactagaagcatatgaaaaccaccacagacagaggcactaatcctttcagagcctgaaggcccgttttatttaggatatcagtactaatccactataacactacatggccatatgtagctcaagcttgctcgccagttcatccttcatagcaccgacaaccctgtctttaacatctcccttcttcataaacaggaatgttggcatagcctcaacactgaattgctcagcaataggctgtttgttacataaatcttcattaggataaagccagataaggggaaaaccaacacagcaaccgtactactgtactacataaaaatataaaatttggggaacagcaataccttcagttcatcgacgtcaaccttcagaaaaacagcatttgtgtgcttctttgctagatcggcaaaaacttagcaatgatgcggcattgtcccgaccatgatgcaatgaagtcaatcacaaccctgtttgacaaanacagggttacacacctttgtgggatttgttat

SEQ ID NO: 83073 - DNA, 5769 bp, Oryza sativa
acgcaacccctacctggcgcgccaactgtcgaaactagatttcagcaataataaaagggggtggctatcaagctaggaaagtgtatgggtttgaagacaaaaggatttatacaggttcaggccttcttataaaagaagtaataccctactcctgtccggggatgaatccgccgagtgtgttattgattgtatgatttggagaaaatccaacctctgcccctagaggcacccggaccccccttatatatgggaaggagtccgtattacaaaagataatctatatccctaacggaataggaagatacagataaaacacagtcgtgaccgactaagtctcagggtgtttccttgatacacaagttaagaaacaaacccgagatacaaataagatattctatctacattaggtatcctgtacccagtccaaatactatcgccgtgtagatatgggatatccataatctccacaaggctattccccctaaagctcggattaattagtggttaggcctcgcctcctaataaactactgtatgttaagtatgcatgttatactgattaaaaataactttacccggctaactaattaaaatatactagaaccctctatacaacatacttcctccgtttctggacgccgttgactttataagtatatatttgaccgttcgtttattaaaaacttttatgaaatatttaaaactatatgtatacatataagtatatttaacagtaaatcaaatgataggaaaaaattaataattacttaaattttttaaataagacgaacaatcaaacatattaaaaggttatcggtgttaaatatttagaaacgaagggagtatataaacaaatttacatatactatagaaaacaatgtataaatcaattatcaccaaagtcaacccatatactgtaatctgccctctctgtcccccaaaattcttttgttgctgctccgtgtgctaattcataagaccagatgtttgtaccacatgtatcaaggtacgtatctgcgcagaacggtaactttggtacaaatgccaattcgccatcgcgagcaacaaggtcaacgtggacggtctcaggccactggtagaatcttggaaggaatatcatattctgcatccagttaaacttggtcttcttcatcatcgttgttagagacccggtgaacactgtctggctatgcaagctatctaccttctcccactccatgctttgctcgttaagcttgacgagatggaccttcttcccacgtcgttcaatcgctacaaccattaattcaccttggttggactcgagcaagtagctgtcttcacatttgaaaccgaagctattaggcttgtcaagaatcttaaatccttcatggtgcctgcaaggatcataaactgctaaccttccatcttgagctagaaggtatagcaagctgttatggagaactggattggtgcccggcgatgcctgaagttgcgaccagtcgggactgttctccgccaaattccagtcctcccactcgtcactgtttgttcggatggcactagcaacctcaattgtgaacatcgcctctataccaaatagcctctcatcacggtcggagacaacaaaattaaacagcgcataaggtttttgtggcaacacttcaacgaggacgccgctgacgaggtcgatatcaaacaccgaggatttatccacgcgcatcttgaggtgtcgtccggtggagcagcagattttcgcgccaggcaccttcagagtgtcgtcgacctcgaagttcttgtcgtagtaggggctatagtatcggatgttggcggtgccaacctcggcggtgttgagcaggagcggcgtgatccacgccgggtaaaagggacacagcgacgcggcgtagcgccagtgccggcacaccaacgcgacgatcgggtggctcgaccaccgcagactccccagaatcaggacgagcacgtccgccgggagagacgaccagccccgagcctgtgacgacgatgcggcggcggcctccatctagctcgatcgcttgctcgatctcgccggtttaaacccagtactgccggcctgatcaggagagacgacgtgcgtgagcgcggtgtgtcttcgtctgccaatggcgttttcttttttaaacattacagtgttatggagtatatcgtggtgtgccgcgcgcgcgcgggagcttatatatgtacgtagggcgtagtggagcgaaaataccaatcggtttacatgtggagttgcaatgcgatacgagttgtccggggaaaaattaacaaacctacacgtaaacgtacgtacatacgtgtgccgctggccggcacggtatagctctgctgcacgtacggtcggcaatttggaaaggtgattttccttagaaagggatcggattttttttaatagattagcaatagtgcacgtgcgttgcaacgggaaaaacactgtttgataatgtgacaccttgaaaacctcaaatctatattaacaaataggtagaaccgagtctaatttaatgaattagcataggatttaggatttagttttagattttatttttcgagcctacttaggagtttatccgacggagtttaatttaaaatatctgagccatattgtttgatcaaatatactttcggcccaggtcttcccaagccggcccaaacttgggctggcccatcttcggcgagccgagtcagttcgacggcccgcaagctgagcagctgaccgcagcacatatgcggggatggtctgatgcacttccgcggcccattgggcgcagcgtaatctgctgcggcggcggtgacccaacgctgggtaaatctgaaccgtccgatctaatatggacggctctgatcgtccccttgccggatgaagtgccgaccaggagagaggagcaaaaccctagctcccaaatccctctttctcgatcacatttctcttcggcgatgagcgagcggaacgacggcgaaggcggtccggcgagctggtgtgcgcgtgtggtgacgcccgtcgagcagctcctgcttcgccggctgggggacgcaaccgagggcggcacaaagccgtgccacggcgtcggtggtccggctaggcgggcgcgcaaacggcgatgagcgccgagcggcatggagctctcggcgggaggggcgacgccaagccgacgcttcccgtcttcggcaagggatggtggaggggtgctccaggacaacgcatgcacaaggaacccaatgtgactgcgaggaggtgaaggtgcggcggtgccacttcccggaaaactccggtgagctttgggacttcaagtgcggtaagtaacccgaacccttagcttaattgatttggatttttgactcttagggttcttacccgaaattaggtttcttcgaatttggggaattttgtcgggaaatttcaatctattttattccctcttttcgagttatgcgagtttcaatatcgtttatccacttttaattttgggaacttcaatctagtttatccctttgctcaatttattttttttttttttgctttggccggcgtttcatcacgcgggcggggacggagggcgccgctcggtcccgtcgaaaagattgagattaagataagatgatattttcacagacgacggaagtaaattcaatttaattttgggaacttcaatctagtttatccctttgctcaatttctttttttttaactttggccggcgtttcatcgcgcgggcggggacggagggcgccgctcggtcccctcgaaaagattgagattaagataagatgatattttcacagacgacggaagtaaattcaatcgtaagatactattttattcttttttgttttaatttttttaccctgttttggtttcgttattacggatgatggaagcgttttcaatatttaagcagtagagatagagatatataggctgtatttagatccaaaatttggatccaaacttccgtccttttccatcacatcaatctgtcatacacatacaacttttcagtctaatttcaaccaaaatccaaactttgcgctgaactaaacacaaccatagtacaatgtcacatataatagtattcgatttttttaccgcgtcacatataattccttttttttaattggacagaattcatttttttattttttttccgccctttttttaccctgtccacgaaatcggattctttttttttccctttttttcacctgatttttttcgcctgattcctttttatcggacagtcggttttttttttcgccttttttacacaggatcggattcatttttttccccggttttttctcactcgatttttttatgcctggtttttttattttttcgccctttttttaccgcgtccacggaatcagattctttatttttacccgattctttttttctatcggacagattcgattttttatttttttttttgtgttttttacacgggatcggatttatttttttcccggttttttctcacctgattttaatcgcacccggacgaaacggggagaagtgacgatctgaaaaatactaatcttttaattagttaagattaagataagaaaagaaaaggccagtgattttccttgtatttatatgggtagcgtttatgtgcaagctagacatttcgcatggatatataatttgtgttgattataacctgtcacactaatcaacgataaaaattaattgtatttaaaacttttatatttatgtgtttttagcgacgtaaaagctaatgttacaaatctctactacttaaaaaaaatttaaatgattttgtcgtccattctatcatggcaaaaaaaatcggacctgaagaaaaaagagcgaaattaaaataatcggtcctattcctaatcacaaaaggacaaaagatctaataaaaaagataaaaatatgtcccaccacaccttgcgcttgcttcgcttctcccccttccgatctcttttttgcccttattgttttaaaaaataaacaaacaatttaaattactaatcacaaaaagacagtgatctatctatctactactttacttaaaaaaagaagaggtgcttccatcgtccgtcaaaaaaaccgggtgaaaaaaaccggacaaacaaaaaccagtttgtccgataaaaaaaccggtaaagaaatttccttcgtccgtacagagaaaggaaaaatacgcgcgaataaaaaagtgcgtgcaaaaatagtttctgtccgattccaaaataaaaaaaattccaagcgaaaaaagagtttccatcttcctacaaaaggaaagaatagtgcgaaaaaaaaagtttctatccgaagggaaacacgcgcgaataaatacctaattaaaaataaatatctatctctaaaaaaccttctgtcgtaaaaaaagaaaaaaaagaccgactcccgtagagaaaaaaaaagtccgactcgtgaaaaagaggttttctcgtccgtaataaaaaaaaggaaaaatacatctaactcaaaatccgtaaaaagaaaaggaggaaaaaacgacccggccaaacttaaagtcgccttgttgtccgtatatatctctttaactctaatctaatctatcaatctaatctaactttttagagagagaagtttccatcatccgttaaaaaggaaaaaaatgcgcaagaaaaaaataatttccaaaaaaatgcgcgggaaaaatacggtttccttcgtctgaaaaaaacaaaaaaaatgctattaaaaactatcagaaagaaatacaccatttctaaaaaa

SEQ ID NO: 83074 - DNA, 864 bp, Oryza sativa
  unsure (1)..(864): unsure at all n locations
tgaaagaacaggtagatccggatccccccccggaaggggaggagaaaaacccctaatctctaaaaaaaaaccagacgcgaaaaacccacctttgattacccaaaatttcctcttcaggtaccccattcacaaaattggatatgagcataatctcaattaagtaaaccttaggccagctacgcacaccattgatcacaaaactcaaaaaacttagcaaaaaaagaaaaaaggacaggaaagaccaaagaggaggagagcgacggttgaattaccagcttcttggcgctgttggcctcctcgatctggatggtccactcgtcgaggctgtggatcgcgatcaccgttccctccgcctgcgccgccgctgaggccgccgccatctctagctctctctctctctcttctctctctcctcggcgagcagagcagagcgccgcttatctttcacgcgaggcaggacacacacttgctctgcggtgttctgactatgtgctccccttggccatggctcgccttcccaaagatattgtcgttgggagaggaatcgaaactttatcctagctggtgacgtgacgaatggtcgaatatgcccctctattctgtgcgaaattaccggcccccaattggccaaacggtatatttacaaatgaaaaataatatgtgaataaaacttttatatacgtgttcttagcaatctaaaagcaaagactgaaaaataaattttgatgaaaaaactctaaaatcaatttcaaatttaagcctgaaaatttannnnnnnnnnnnnnnnnnnnnnnnnnnnnnnnnnnnnnnnnnnnnnnnnnnnnnnnnnnnnnngtcttcgaaacaaannnnnnncggcacact

SEQ ID NO: 83075 - DNA, 738 bp, Oryza sativa
aattcctgcagcccatacgccgacggaggccatgcaggtggtgtcgggtaggcctacgtgacatttaatatggcggtataaagtgtggaggtactcgcaatgggaggcaaagtggtcggtgtagctaggcattggtgaggcccaacagtggaagcggttcgatgaagatggggaagcgatgtagttgaggagacggtgagagtagaacaggagcccacgctttgatcacacaggcacgatcatcatatgctcaatggatttcttaatcattgtgttgtaccgccaccacaagggaccagcgtgtggggttcaagcttttcactccaagttattcctgtaacgtagtaagggcgaaagcagagttttgtatatccgcctactcgtccaaaaaaaaagtttcaaaaaaccggtgaacatacacaaatagagaaaacaaccatggaaaaaaaagttgaaacacactaaaaaactgaaaacatactatagtagagtggaatggaacgtttaacccctcttactagatcccgttgcaaagcacaatatatttgctagtaaactaaaaatatatcaagtttcaaaaaatctaaatgttggcaagaactgataagatgaagcacagaagatggaggcggaattcctccgtctcaaaaacaaattaattacctgctattgaagcggttgcatgacctagtgcggaaatgcaatttgaggactgtctaaggctgagtttttttccca

SEQ ID NO: 83076 - DNA, 19482 bp, Oryza sativa
  unsure (1)..(19482): unsure at all n locations
gattcttagcccaacgattgtaaattcttatgttttatagataccactccactagtgtttcccatcaaaaaagaacttcttattggatgattgatcgttttgagtgttattgagcatctcgctctgtatgtttattttaaccaaaatacactattgtcatttgctgcagacctctggagacagataatcacacacccaagcatggatgattacgtgagaaaaccagatcttctgtcattttccattggaagcaaacttcctgtatcagaatctgtgagacaaaagctactggagattgatggaatctcgtatcgtcttcgaagggagattcagcttctcaaggcctttaatctcataaaatgtagatgctgcaaggtaactatctaccatgtttggaattgctaatttatcgagcttctgattggaagtaatggacttattgttggccatttcgttactactttaaaagaaggtgaattgtttatggtggtgttgtatgttaatcatatgagtctgtcacccgacagctcaccattgcaattttttggacaaccccttaatttttcttgaattgcacagtagttaaatatctaactgaatacacatacacagacacacagtatatgagttggtctataatcaaggagtttaagcactgtcaagttctccctgtagcgaagttataattctgttaattggtatcaaccacaagtatttagctagttttccatataaaatggataactattctaggtcatctgtatcgtagcaatttcatttaccatgtcatggcctgctaaattatctgtatgtacatcccattttcatttttcagcagggtatgacatggtacagtttgtcgttgtagaatgctgcagctgcagcattggaagaattagcactaacataaaatcaaactacttgatagttcatattgatttgctgattaggctcatttggctgctaggaaaacaatgctccatgtaacctggttttcgttgatcataaacattatttggaaatggcgtgtagttacatcaaagaatttcaatacaaagtttatcactctgtgttgacatgatttgaactatggcagtctctcatagcaaagcgtagcgacatggtagtgatgtctactgatggtcctcttggtgcgtatgtcaatcctcacggttttgtccatgaaacaatcacagttagcagggcaactgggcttgctcttgatggcaatccttcaacggttcacagctggtttccagggtaaatctacagtttctccttgttctttgtaatcttcatgtccatcatacaccctttaactgtaaaaaactaagttcatgcatgattttcttcttgtaaccaactttgtttctgctgctatgcagatactcgtggacgattgcatcatgtacggactgtgagtccaacataggctggttgttcaaagcaaccaagaagaatctgcgaccgagatccttctgggggatccgtagctcccaaattgcagatgatgcacaagaactagatcaggacgaatgatgctccgtgtacagtagtaaactttgtgtgcccctccctttttcttatgaagttatggaaaacactttattctctggtccataggcctagttctccgtacctgagtagtggtcgttgtgacgatcgctatagaataaccacttcctcctgtgtgtattacacaaccattgccttatgctaaagttccgtcacagaattttctgaaatgtagtgttactagaaatccatagtacaagatgaatgatgatatgatcagatgtttcaagcaatggtttgacatgtcttatgagcacatagaagttggtgcttgataccttcacttgaggcaaatactcgtgctgtagtggtaattggtaaactggtactggtagtgagctagcactggcagtgccatgtttttgctatctgtactgaaattggggccaattgcacctgacgagcagcaactcaatatgggcatatggcatcctttttttccctgcgtattgtccttttgtttcagccacagtagcaattggccggtattccattgccacctttgatgagagggagggagagagagacctcacgggtggcagcaaaggcaaaggagcagcaagaagccgacagagaaagtaaggccatggtagaatgacaggtgaggaatcgatcagacgggaggaaaacaacaccgaaaaggaatgcacttctctgcttttgtatatgcatgcacctctacctacccattcgcgatgcaccaatgaaatacgttgccaaataccttaaaatactagtctattgttcaggtgatagtaatattgacactagtagttctctaatctctagttgctagtcttgtttatgttctattttttcttgttgcaatagtagcacatgatcgtagtaatgctgtatgattgatgattggatggcatggaactatgaacggatcaaacttatctcgataatatggtaataacaaggagatgtagacatgtactccagcattgtagtcagacagccgaatcacgaagctagtgtggaaccatgacagaagaaggcactactcagaataaatccagtcacgggtttaaaaaaaaaacagagagagaggagaatcatcatcacaaagctaatgcaacaacagcacaagcgtacttccgcatgagaccaagcaaggaaaaaagaaattccaaactgtccccaagaaaattcctgccccaggagagcacagcgccggcctgtacaggtcatcgttcccaataagacagggggaagctgagaggcaaagagcaccaccaacaacgcgtgcactgaattgcattgcacatgggacatggcaaacaccggcgcgtcgccacccgcgcatgcacgcacgggcgcgggcgcggccacgggcacatcctctcctgcgactcgtgagccgtgtcattccatcgcggcttcctgctcgatccgctccctgccatgcccgtgaccgtgatctccataaattcccccaccctgtgcgcgatgcgtctatcccccacgataattagtaggcctgccacctcttgccgcgagcaagacgaccacaccaccaaccaccatccatggcggtgtccgtgtcgtggtcgtgggcgccgcggttcttggcctgcgtcgcggtggcggtgttgcttgttacgtcgggtttgggcggtgcggccgccggcggcggcgggcgacgccatgggcacacgaaggggttgcggccggggaaggcggcggcgaagccgtactatccggtgaacgcgacggcggtggaggcgatcgagcggcagttcacgcggtgggtgcggtccatggtcgggcgacgccacagcacgttccagcgcgcgctctaccgcgggctgctgcccacgcgcaccctcgtcgtcgacaagaaccccgccgccggcaacttcacgtccatccaggccgccgtcgactcgatcccgctcatcaacctcgcccgcgtcgtcatcaaggtcaatgccggcacatacacgtacgtcactcacgtggctacttaatttggtctctgtaattttcttccacacccccaccgtatccagagcgttcgtccgaatgcctacaccgatctccccgtgcaccgtgcagtgagaaggtgaccatctcgccgctccgcgcgttcgtgaccatcgagggcgccggcgcggacaagacggtggtgcagtggggcgacacggccgacacggtcggcccgctcgggcgccccttcggcaccttcgcctccgccacgttcgccgtcaacgcgcagttcttcgtcgccaagaacatcaccttcaaggtgagcaccactactacactacaaatgcggcatcatttgtgccgtggcgtggctcattcgtttcgtctgtcgcgtgggcagaacacggcgccggtgccgaggccgggggcgctggggaagcagggtgtggcgctgcggatatcggcggacaacgcggcgttcttggggtgcaacttcctcggcgcgcaggacacgctgtacgaccacctcggccgccattactacagagactgctacatcgagggctccgtcgacttcatattcggcaacgccctctctctctacgaggtacacacattgcttctttctcttggttgcatacacatttcctccatgaacattatagcagggaattgcatgcaacccgggtgattaggttgaaggtttgttgctaaccaagatagataatttaattagcgcctgaaatcgagtcaaacaggaaatctatgctcaatcctgtgtgtcagtgtccagtgctacagcccaaatgcacaacagatacaccgtgtcagtaaacactggcccgcagctttctgacagggcactggcctactgtggcacctactacaatgcaccacactggagtcacacagaagaaagaattctactatcgaccactgttaaaactcacagggttacagtagaggcaaaccactattatcggccacattagccccccgatcttgtgactggccctactacagctacacgaaccagatggtgccaatgcgttgtgcatgcccgtgtggcacttcgtttaatgcgaaatccaacgcaaatggaatgttgatgagcccactagtaatagcatagtgagtaatcagcctttcggtttttaagaggagtgtggtaaaacctgcatcgcttgtcgttggcgccggcacggttgccggatggggttttctggagcccggcaggttctctggtccccctggccccaggcgccgtgaccgctacggcccgtgacgcccatagctggacgtctcgtgccgtgcgtatggccccaaaccgtagcgtatgtgtatagccaccagtctcctctgcaaatcctgctcactttggtcgtacactttaaaatctggtactagtccaacactactaccagtagtaaccgacttttttttttggtcagaaatcaaaaattgacctttgggacgatagggtcgtccaagctccaagggaaacatattatctgctgtaccgtgctctaactttaagtgattgatatgtgtactatcccacatctaatatgtccacatgtcaatgacccattcacccatatcaaaggatagttctgtagagaatactcatccgtcgtgcaagtgcgcaacgcacctagcatggttcgaatgctagactttgtaatagtattcaccgtatttcagacattcagtaatactccacacaccacactagtggttattctaacgtgtgttacagtgtgtgatcgtaaagaatactagggtttacgcaaatatttgatcagaaatcctttgccgtgtattactttggtcatgtatgtactcagtactcacgttggtgacacgattgcagggatgtcacgtgcacgcgatcgcgcggaactacggagccctgacggctcagaaccggatgagcatcctggaggacacgggtttctcgttcgtcaactgccgcgtgacgggctccggcgccctctacctcggccgcgcctggggcaccttctcccgcgtcgtcttcgcctacacctacatggacaacatcatcatcccccgcggctggtacaactggggcgatcccacccgcgagatgtaagtagctaccactagtacagaatcgaacatcgtgaacgatcatatcactactattataatgatatgtgggtctcatcctatcataccccacccatcaatatttgtgatgatagcgtcataatggtagaggatgtgaaccccattcacccctcacatccatctcgttcttgtgttttttcgctaacgatgctggtgttttgtgtgtggttggtggcggtggcaggacggtgttctacgggcagtacaagtgcacggggccgggttcgaactacgccgggagggtggcgtggtcgagggagctcacggaccaggaggccaagccgttcatctccctcagcttcatcgacgggttggagtgggtcaagttgtagcaccacgtaggagagaaacacagctcactcgactattagttaacttgtgaagagaaaagaatagaacagaagaagtggcagataaacactctgatttgattcgattgcagatttcaactttgcagttgcattgtgagacagtcctatactgtgtccggccttcgcctcggttttgttttggactgcaaacagtataacatcaacttaggcccactggcccaggcagtagagaggtagcaatcgatgcgatctccctgctcagcctagaagcccatagagaattgaagtggggaaataggcccagaaaaaggttagagtagtgtagcagaagtgagcccaacaatcacaggtgtgttgcttccatgttccaacacgtatagccttttcgaacattattccttttttttcaaacattattctagacagacattttaatggatttctgcaaacttttagtagtagtagtattatagacccagtggccaatctctaataccgatttcatggttctaaccctggctagagattgggccacgtggcgccctgaaaatcaagtttgcctccctgcgaatttgccacgtgtctccttggctctcctcccgcattgtttgatcgagtatcgacggctaaaggctacagctcgctgtggtggtctggtggacctcgttagaaaactggaattttttttccatgaaagtgctccatccctaatccacccatcttcctcccggacgcacgcaccgccgtccccccgccgcccaccggattctccaccacctgcgcgccgcggccagcgccgcagtagaccacccgctcgtgtcctccttcaagacgctaggctcgtcttcttcaacgccgcccggccaccttgccctcccctgcgttccctgccgcaatgccgctgcctttcctcgaagccagggccgccgtcaattcgccggcaagagtcaccctctaacaggcggtggccatcgccgatacaaacttcggctagatccggtgagcccacgagagaaagaagggagggggcgctagctagcagaggaggagaggaggcggcgtgcgctggtgagaggtggcatcgcatcagatccttcgccacctgcgcgtcgcggccaatgacgccgtgatgaaccacccgctcgtgtcttccctcaaggtgctgcgccgactcgtcttctcccccgccgtcgtgcccgcgccgaggttgagggaacgtacgcaagcggctgctgtgcaggctcgatgtggagcgcggcgcgagggctgcggccaagcggcggcagcgatgtcggcgatggtcgtgcgggcctaatgtggtggcagggcagggcggacgaggaccgacgatctgggatcaacacggcggcagcggtggctggggcactaggcactggccacggccatgtgaacccaatgtggcagcaactgccgcgccgccgaaggccatgtaaatttgtgctccgcaaaggctccatgaggtgtaggctccacatatgtgaaaacgacggcggctggctctgctgcaaggtttgtgcaattcattctacaattcattctacaatgcatatcttgcagctaggaatcatgatatttcttttaaataattaccattatgtctctcaaaaaaaagtatgcagtatttattgccaataaccttgatttgaaaagggtgaaaatagtttttgttacatatagttatgagttacatatttaaacgcactttattaagtgaaaaaggattgctctgcactggacgcgtttcagattagaagttcagatttgcaagatgcggtttatgggctttcattccattctgttcaaggaacttattttcatggttgctgtcggtctgaatccataaaactcttctatgagatgtagcttactttttttttttgagtcatgtcattgtatcatgcttgctctattaaaatttccatcctcattagctaatagaaagcagatcgtccgatttgaatctgatttccatcgtcaagaaaagcggtgattcacaacctatactcatctactagctagcttaacttatcagaaaattggaaaggacctttatcaaaagctgtgatcatttcctcaacaatgtatgtctatatcttagataatctatattcatgtctttgataatctacaataaatctaactactaaacttaagtaaaacaaagttatggctacctattatctatacatatatatattccaatgcttgtgatatacatactattacaatttcatcctcgatctttaaattctaacttgattaggcactatgtcatactttggcagagttgtaatatcactgaactgaaactttcatatgacaaaaatggccattaatttgtatagatcagctgctgctgcagttacagtgcatctatatgtcatggtgctgtttggctggtgctttaatcagtttgttacatgctgaataaaatgtcatgatctttgtacatgctgtcaaagttgcaaattttagctacatgctgccaaaaaatttcatgatctgtgactctgtgtatgtgctgccatgatgaaattcctaagctgctggatttccaatttctttgttcccctactcaatttagaagaagtaagagttgtggtcaaagtgaaggagcgttctcagaataaatgtgctctactcttttttttttaatcaattagtttctctggttttgttttattcaattccaatattatggcatggcattgatagctcaggaacaacatcaatattcgactgaaactaactacaatatacttgctaaagtgcatatctgcagctaaaacaagcaaaaaagttttggatcttaacgaacaatcatgtaaatagcttatataactgctaaattttattcacataatgctaactaaatttaagttccaaatgccttgctatgttttctttttctttctttcttttttctattgcagattagtgtagcggcttcctgaccaaaggtgtaaagcatcactgctatcaaagtcatttgactgatatctgattgacgtcctcaacggttgacacatactcatcggtcaagtcctcaacgtacatggagttgaataagtttgttgcaatccattagcaaacaccaaatgcagagttagttttttggtggtacaagatggttatgcacatgagcaagagaggcagagagcaagtgaaggggcgcaagcaacgatgtatcacacaactcacactcactggtgctttgtccagcaccaaacctcagcaccagatttttgtgccaataatcacatcagcttgggagatgtcttcctgatgcggtgggcaaaggtatcgagggccatggaaccggttgatagcccgaggagcaagagggatttacaggaggtggaggacagggaacgcatcgcagacttgttctgtacatgtttattagatcattgtgacagagtgacatgttgcactatcaagtaccaatagttggttgggattggaatgatcaaaatgagttgttcatgttttagaaggctgtgtgtttctccattttagtttagatttgagaaggttctaggtttttcctttaaccttttcactctgtttctcgcccaacataactcagtttttctccttttcactctgtttaatttatcaatttctaaatagtgccacacggtccaatctccggtaaaactgtcagcttgagaaaagtgatgtggaggaaccatgaactcaatgtcttgctgcattgaactaatatgaataaaagggtaaagtttaaataatttcaggttttaaatagatactccctccgtttcacaatgtaagactttctagcattgtccacatacatatagatgttaatgaatctaaacacatacatatgtccagattcattaacatctaaatgaatgtaggtaatgctagaaagtcttactccctccgtttcacagtgtaagtcattctagcatttcttacattcatattgatattaatgaatatatatatctagattcattaacataaatatgaatatgaaaaatgctagaatgacttacattgtgaaacggaggaagtacgttgtgaaatggaggaagtaaaacatattaggtgtacttatcagagcatttcattcatttatttcataaaagctggtcaattacgcggcacggcattttctagtcatatagtataccactaggattagaagtactgcactgtagtacttactacgagttgtagtaggtattcgactcctactgtcctacattgaactgagccactgacaacatcaagattaggcagcgtatttttcaggggctgattgatgaaaactaacggatgattttctttatcatggatttgaattaaacagtagtattttatattataagtcttaactgatatagtttaaaacaggttatctaaataacgtaataagaaagttttttaaaagaaaatgtctttttttttgcggggaaaagaaaatgtctttttagaagcgtgaaatacataatctgtgctgataacgggccttgacctgttacggagagccaccgaggcgacaaaaacaatcttctacagtaccgtagaccgtatgcttctgcatcataactactcctacacagaatcagagttcggaccaatactaaactgtcaaaactcagatctactgttgatctagatccaccagcagtagcagcagcagataaaaacaaatctcaagtcccatccgttccgactcacaccgtcagcaaaaacaagattgacagctgcaggtcgtgtcctcttcaatggagtccaaatcgatgtgtgcattgtcgcactgtcctagctccgcggtcgagaatagctgatggaaataaattccgcgcagcgatcctccaaatgctgcaaacgagtgacatattgtatcgagttcgaaaaagtttgaacagaattcagtggttagctgctgacatgtgcttggttaatgaaaacaatatggtcactgcacatttcagacggtccaagatgctactagtaacggttaagcaattccctcatgcatctcgggagacacgcacaagtccctttgtactttcaggtgtgccttttatcctaagagacaggattatctacatctaaatctggttctagagtcactaccagaaatgacagacaacatcaacagccaaacaggaaaaacgctgtgcacatgacttgcacatcactttagtgctcgttggaacagtgttcttattaatgtatagtactgtatagtattcatccccgtcttaggtaagctgttgtatcaggatattgttaaatggtcagtagcgctcattaactctgaagaaattctgaagactgaaaaggacgggatcatctctagaggtggccaaacgggcagcccggggcacggccgaacctgtagcaggcacggcccggcacggcctgctacagtaacgggccgtgccggcacggcacgagtagccgtgccgtgcttgggccgctggccgagcccgcgggccggcacggcacggcacggctactgtagcaggccggcacggcacggcccgcggcacggcacggcccgtttcgccggcggcccgtcaggcgcggacagggcgggcggcggtcgaatgggaaggcgccacgtggcactaacggctacttgaccgttcaaatttgaaaataaccgttgggaggctaaaaaattcataaaaatttcgaaaaaattccaaaaaatctcaaatttcgccctataaatagggcatgaaccccagccatttctcctcatcccacactcctcatcttgtgctctcaagtgttttaagtgctctctttgttctcaagtgtgcattttttttgattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaatggatccgaactttccataccagtcgccgtcgttcaccttgggtgatttcgaccccaactacatgtcggggtttgacggtacctccggatcggctccaactccaccatctgtggaggaggtacctgttcatacggctgtcgttgaggaggtaccggttcaggcggcgacagcttcggaaggattttccggaaccgcgagcggaagtgtttcgacacacaccggctcgaagagatcgagaacctccgttgtgtggcaaaacttcgacgagataaaggaaacatgccccgacggaagggaggtatcgaaagcccgttgtagaatatgtaggcaaattttatctgctcgttcttctggtggtacaggtcacctcaagcgccatgcggagtcgtgtgccaagaagcaaggaatacaactccggcagcagcaacttatggtaaacccagacggtacggtacgcagttgggagtacgatcccatggttgctcgggaatctcttgtccggttaatcgccaggcaagatttacccctgaactttggggagtcccctgcttttgaacattacattcagcaatctcataaccctaggtttaaagctgtgagtaggcaaacatcaactagagatttagagaatgtttatcacaaggaagcaactgcacttaaggaactgtttagtacatgtactttctctgttagtgttacttcagatatatggagtagtggagctagagaggattatcttagcgtagttgttcattttgttgatgatgattggcaattacaaaagagagttttagggcttaggttaatagatgtctcacatacaggagaaaacatagctgaaagaattagggaagtaattaatgaatttaatcttgctgataaaatatttgctgtcaccctagataatgcatctgctaattctagggctattgaaatattgcaacctttattttgtgtgtatgctcaatcttttctactccatcagcgttgtgcatgtcatataattaatttgattgttaagactggcatgaagagggtaggtgaccacatcgatgctgttcgtcaagcaatcgcgtggttaactgcttctaacccgcggattgctgaatgaaagaggttttgcaatgcggccggtgtgaaagctcgtaagtttgccaccgatgcagagcatcggtggaatgcaacgtatttaatgttaaaagttgttttaccttatagtagtttactttctgattttgttcagtcacgtggtggcccaagaaacagtgacgggtcttcagtactgaacgagcatgtttgggcaattgtccaaaaatttcaccaatttctagaaactttttatgattgtactctaactttgtcacaagtttattatccaactgctaatataattttgcacaaccttcttgaaattgctacattatttaaagaatacgaaaatgatgacgttctaactgaacctgtctttcacatgaaacaaaaatatttgaaatattggaaaaatatacctatgttgtatgcttttgcttttgttttagatcctaggtgtaaattaaggggattgtctgctattttatcacttgttggagatactataggtgtagattatagttctttttatactgaggttagacgtaaattatatgaggtttttagaagatatgaagtaaagtttcaggaagttcgccagcagagaccccctcctatccccactacaggtaagaagaagatacagtggggtaggatttggggtggatcgtcttcaagttcaatccaaggtggtggcagttcgtcggctacaagtggagacgcctcttcgcatgttgtggccgaagagttgtccggttatttggacagcgacgccatccaccacgaagcacaagatttcaacgtcctcgggtggtggaatgaccacaagataacatatcctgtgctttcaaaactagcacgggatgtgttgacggtgcccgtgtcgacggtgtcctccgaatcggccttcagtctatgcggccgaatcatcgaagaccggaggacgactctgcgcagcgaccacgtcgaaatgctactaagcgttaaagactgggagcttgctcgacaacatgcccaatacactgcggacaaccaagaattggccgcccagttcgagcaactctacctggatccagaccaaccccagtagaattttgttagaagtagttctgacctttgagctgtactcttttctttgtcatggttttctcattttcccctatgagtttttacatgacaaagtttttaacgaggcagcatgtatcattgtatcctgtaatgatataaacatcaataaaggtcattactatttttaacaaattcttttgcaatattttcgcaagtgtggatttatctttaaattatttcaaaataatgaatcacaatctatatttttaaatttttcaacacaacaaaaaaataccattttttctttttttttaacattagcaaatcattacttttttaaaaaacttttatttccattttttaaataccattttttcattttttaacattagtaaatcattacttttttttaaacattttatttctatttttattttttttccttatacatttcctttgcttttttttaaaaaaaaacactgtgcactgcaggctggcggcctgccttcacgggccgccgtgccccgaacggcccgtgggccgcaggcgtgccgtgccggcacgggcacggcccggccatccacgggccgtgcttgggccggcggctcggcacgtgggccggcacggcacggcccgtttcatcagccgtgcctaacgggccgtgccgaaacgggccgtgccggacccgtgcccgtgccgggccgggccgtgccgcccgtttggacacctataatcatctcggcgtccaaatacgctcaggcaatgaatttggccactctttttccgagccaaaccagctctggacgtgttatcagacaaccaccgtttgcaaccatgtagggagggtactattttagcgtccttttgcctgatgcttcacatcaaatgcacgtcaacatttaagccatccataaagcaatgcagttgtggtacactgcaacaaacaaccacaattttgtcttcagtgcaaaggatctgccagtgccaagaaggcaggaactcgtccgtgtactctttacttcttccttcccttaacttccatgccatttcagctatcaacctatacaggtcggtatcagataccgcatcagcatttaagggggagggatttaggactgtttagattgtagccaaaataaaccttattaaattttgttattgccaaaattttagcaggatttcttatatatttactaaagtttggcagtaaattaaatgtagtcactttttgacaactttaccaaaatttgataaggttgaaaatggcatcaaggtgaacaggcctttgtttttttgtgaggtttagtccctctcaccaaaccaccccgtaaggcctgagtttagttaccaattttttcttcaagcttccaacttttccatcacatcaaaactttcctacacacacaaacttccaacttttccatcacatcgttccaatttcaattaaacttccaattttgacgtgaattaaacacaccataagccacactgtcagaaaaacaaaggaatggcatttcggaactgtatgtacttttgtttcttcctcctctttttcccttcctttggcagggattcacccgtccaatttctcataggtaagtgcagtaatttagaccgttttggtaattgagaaacccaaattaaatttacaattttataccatgaagacaaactttactctatgacacttaaaagtttatataattaactagtggacattgtaaaaacatatcatggctagagaataccctaaaaacgtgttatgtttatggaaagatattttcgatccaattaaaagagaaactcttaaaagaaaaacaagaatgtcctatggctacaagtttctaacctaacatacgagtgaagacggattatgatatatactaacaatgtacaccttagagtgatggcattttaagagttgcataatttcaaagctttcactcaagcgctaggttagaattttgtggccccaaataggtaaaaatgtcgttcgataaattaccaattatttattatccttcaattatagcacatttataggatatttatcagtaaattacataagatttagttgtcgtggaataaaatttgtcaataagaagagagagaatgtggttagagctgtagcggtagaacagattttattccctgctcttttgccatactcgagctacatattctggtggtactttgcgaagatttaccatcttagtcctaacactaatatgtaccgaaagttaattaaaacacactcctggattagcattcgggctccggttgtgagtaatcaccagagctgatcgaggtaataatctctagtgacgtcgtcgctgaactccgagtcctcgtggcggctcatctccgagctcttcaagctgatggcgctgtccggccgcgacttcctcgacccggcgcgggccaggctaggcctcggctcgccggcggcgccgtgccgctgcctcggcgcgctctggcaccgcgcacgcgccacggacgacgccgtgtccgccatgtaccgcgggctcacgacgcgccccttcgccggcgacgccgggccgtggtaccccgccgggagcgcggcggcgagccggggcgtgttgtgcgtcgtcttcggctgcgcccgcgcatcgtgctcgtgctcctcggcctggaggtggcgcgacggcggcggcttgtagcagtagaggtgcggcgaggacagcggcaccgaccccggcgtgccgtccggcggcgggtcggcggcgtagcggctcgtgatccgggaagaccggcaccggagctggcacgtgtccatctccacgatcctcgggctgcggtcgaagttgatgtcgccgccgtcggacacccgacggcggtgcaccaccggcaacgtcaatgtctttacccgccctccttgcatttgcacgacaatcctctcctacgtacaaaagatgctcaaaaatttaacttcatctgataaaatcaaggtgatccgaggaggcatcacagtgaaaaatctcacctgttcgacggatttccgcgatgaggccatcttgatggcgcgagaggaggcttggagcctcatgagcgcttgcagcctctgcagagtcgtcgctgcttgcttcctcacaaggtagccacgtaccagagcttgtatcttgacaagcgccttgagagcgcgcaatgccctcctagcctgcatttgcggtggaaaattcaaatttttacagttgcttcgaaaagcaaatcaacagaaacaatatggaagtttttgaactatatgccatgacgactaggcttgtgtccccactgtgcagttacctaagcgtttgcagcaaatcatcactaaacaaaaatatcctaaaatgtggaatttatctatagtaggaagcagattaaacaatgtgcattgtgcaatggctagctactcaacggcaagaaactatcaaacaactgctgccattaacaacagttagtaaagtgaagtcaaatctcctgtccaatataaaaccaggagaatccataccacctactccctccgtcccattttgagtttttgcttgtaacgtttgaccactcgtcttatngaaaantgtttggagttattaattattttatttgtgacttactttattatctatagtactttaagcacaactttttattttttatatttgcaaaaaaaatttgaataagacgagtggtcaaacgttacaagcaaaaactgaaaatcccttatattgtgggacggagggagtattttcaaaaagaagaatctactaaaatcccgtgaacctatccttgcattgattgctaactgaatcgtggaaaaccaaataaaatgtcatttacgaatactaggctaatgttcaaagttcaaacacatgcagcagctgcagaacaaaactcaacattttcaggggaaaaacaagacaccaaaacagtacttgggagacgtaccaggtatcctctgaaggccttctggatcatgacggccgcctccacctcccgttgctggccgcagctgcatggccggacctgcgagagctcgccggcgacgacggcggtgaccgagggcctgcggctgccgtcagcgaaactgctcctcggcttagcgaagctccacctcctcctctccatcggcggcggcgcgacgccaccattggcgcctccggcggcgctgtgctccttccgatccctgtctcctccttccttcttgccggtgagaaccttcttgaaccacctcatcgcgcggcccatggtgaatcaacctatctgcagcacgacgaatgccacgaacagaggcgtcaaaaaaaatgtgtagagagcgtggataaaaggattcaagaacagcagctagaactattactccagtgctgaaacaatggaactaataggagacgcaaagatcaactcgggagttgttgaaagttgaaaaactgtaggcgaacaggggaaagaaggctatagtataccgctatagctcaataaaacagagacgcccacgatttgaaatgagatactccagagtccagatagcagagtggacaagaaaaaagcatggaagcaagaaagcttgggtgaaaaaagggtcttttttcgatggtgaagcagggaagaaacctttttacagagaggggctgctgccgagaacatgggaccgaacagagatggaaaccgaactgaaaaggcctcaagaagcttagctgaaaaaggagaaggcaaagacgtgtaatgtagcgccaaaaacagccgagttggtgggggagatcacagtgctcccctccagctcacgaaacgtgactccctgatgcggaaaaggaccttttcatcagtgaaacccagtacccaccagcccagccagcccagccggttgaactctcccaggcgaagcagcgagccagccggcgattcagagcggaagcagccggcgacgaagtgtgagatagcgagctatcgagccagcccagccaccgcaaccgcagcgacgctcgcaggggaaaagaaaagattccccctgcttgccccctctcgcctaagagtccgagcacaaggcaacaaaaaggctaagcgagaggcaagaccaaccgaagcaaaaaaagacccaaaccccggagggttcaccaccacgcaccgcacgagacagcaaaagaaaaaaagaaaaaccgagatggcaacaagatccaaacggcgtcgctcgcgcagatgcaatcattcgcacggacgcacctcgcctccgcgccgcgcgcgcgcgggggccgagagcccgagatagccgcgcaacaacaagtcacaagttggggggggggggggg

SEQ ID NO: 83077 - DNA, 4351 bp, Oryza sativa
tatggtgctgaagtgggggtacatcaccttagaccaccttaataccttaaacaccactgcattctacagaccagtaaatggtccctggtacttgcagttgcagtctggtctagcattctgttctgttagtgctatcctcagtaatcttgattgtcagcctatgtcaggtctaatctgtttgactaactcaggcatgtaggatcttgtctggcgattaagttatggttgtgtcctggttccagtattatattttgttgtctgaatggcactgcacttctctatcatctaatgcatgtgcaatgaacatgtgatgttcaaagtttttcatagttgctattccctttttgtttcccagcacaaagaaatgcttctacagatattgcatgatgctcagagatattctgcattccggaaaggtcttgcaatgattgacatttgtcaggtacctgtcagtttatcagattctgatcaattattatgcactattatgctgaacttgtttgtaattagatcaaactttttgcagctgaaaaatgatcctgaagaagtactaaaatggctcaaattttcaactggatggtctgtgctgcacaatagtgagctaagaattggtttaaaggttagagctaccatattacataagctgaacatgtttcataagatgaatctaattttgtcatttaatatatgtacattcttttcacagaggcacatggaccttctgaaggaacacgaggggaataaaatgaacccattgtccatgcctgaggtagaatggcatcttatttggcattaatatgacataaaatacatacatgccatgcctagaatagaatgtgcgtgtgtgtttgtgtgtggattttcatgttttgatgcaattctagattagaatatgtattcaataatttaatgctttggggttatgttgtcatatcagcaggcaaaactggtaaaatattcagacgcttaacataacatctgttgctccccaatgggaactaaatcatatctgtcagccatgtttagttacttgattcttcaaaaataaaaagtaaatgatagttggttcacaaatacctggatctatctagaacaaacggaagacaaatcagtccgatttaaaggaatatgtgatggagttcaaatggtcactaaagttgtgctgcatgcacattttgcactgtaaaaaggtggcatctgctgacagcagcaaataagtagagaaatcaagtttctaatattctttgatagtccctctggtcataagtatttgacagttaggacaagatttggtcaaattttaaaattttgaccatcaacaatttcacagatgcttagcttaaaaataagaagaatggtatgcataggtttgccctgaacaatactgtcgtaaactcatttgatctataaacttattctcatataaaatggaaggtcaaggtatacaaaatgaccgaatcttgtcttaaatgtcaaacatttatgactggaggaagtgttgtttatcttctccctctggtagccagatgtggaaatttccttaatttgtattgaaggcattgaacctccgtttattgtataatgtatcttggagtaaatctgttttcaacgactgttcttgtgatcagctgagattcagataccttctagtgctgtaacccatcttgccagatgttgcatatttagaggaatgctttccccttaaccggcaatgtcatgcaaatttatccttagataaacacttgcatattttattgcatatactgaagaatgaagtgagcacatgatttttccaatagtagactgctgatattttactaacttggcagaattgaggtaactttagagtccttttgggggattcagtttgcaccaagaacttttgacactagttttttcggctacttttgttcagaactattgttgccatgtgatgccatatcaaggtttcatcttctgtgcctgaactggttcccacagtgggatgtgaactacttttaaccagtaataactggtgggacccaccactccgctagaatattgaattgttttggattcccaaatttcaaactcaaaatttaaaatgagttggtgattacattattattcacagatttacttttgatgcattatttgattgcccgatctttatgctagataccttttttctccaattgtccaggatgaaaatttagttttggagaagataaatgcagagctgtgttcagaattggagaaaatgataggtacctttgactgggtaagttttttgatgctaagtgtagcttcctcatatccttatatttcttctttagatgtaaatttttttgtctgcataatttgtaggcacttatgagtcagtattactacaaggcgagatttagcaactttgcaagacaatgtgctattcaagcaagagcgagtggagttattcttgttaagcaggtcagattcatttgtcagccttaaaattggagacattcagtcagcacatgatacctagagatattttgattgcgctgctgcctgtcccatcctcttatatgcaaatgcaatattagttttttccatcctcttatatgccatcctttcatcagcacgttctgtttactacaagtgggggaatgaattataaggccattttattccctccgtgataaactccttgaaaatttgtgaggagccgcaatctttatgtttgcacaagtttgttcaatataaaacagaaagcacctgtctgccaaaacggccacaaaaatgagattccaagcctgtctgattggtctcatgtgaacagttctgaatcatgagttaaccttgtatgttatttttattgcaggctctacctatacgagaaacttggaaggaacagaaacaatccacaagtccaaaagtgtcaaagttgtcgctcgaggattgcttaggctcactacgtcgcccactacgtagaataaatgagcaatttggtagaggtgctgctcgtggtaagccgtggctacttgctgcttttgcttcaatcgcaacggctgcaacagttggcatgtccagcacacgctagagatgaaggttgatatatgtgtagttcatgctctggtagtcgttgatggggccaaagctcaacactcaatttgtttatgttgtgtccctgttcgtagaccgtcggctaaatgattgagccttaatcgaaatggtggagctgcccatttttctttatatttgggccactgtaaatcaacatacaatcattggctactgtttccgcctagaaagtttaacaaagttaaatcatctaacattaatgtattttgataatatgtttattttgtgttgaagatactactacatttttcaaaaacgaattataatatgatgaaatgaaggaagtatttcacaaaatgtgacttttggagaccccactacgttgtgtgccagagttctcaagggactgtatctccgaaatcgtgacttttgtgaggctgaacgtccatgaccttctacatatagttggcatagcattctatttggaagggaactcgtggagaaacggatcagatggccagttggaattggtaacaaaattaggatcttggctgataattggattccagggaagaatgacgaacaatcggcatgtgatagtgatactgttcggagcttcttcgaggaagatatagccaacgcaattcttcaaattcctatcagttctcatggctggggatgatttcatttcctggtcactttcttgtttcggtatttatactgtaagtcagcgtataactaacatctaaaatcaacaaaaatgtgtaatttttttaactttttgcattatgctgatctttgtctgtgttgtgtgttaatactaacacttgtacgacatgctacagaagaaggaaaaagtacacccaaggtccctcaactatatatggggtccattaactatacaaaaccggtcacccgaggtcccttggcggttttgacgccgtttttgtcctacgtggcggctgagtcagcgtgggacccgcgtgggacccacttgggccccacatgtcagggtgccacctcatctctttcctcttatccctttctctctctcacttttcttagccggcgacgggcagcgctgtagagaggaggctgccggggcaaggggagaggaggaggtccggcagccggcgtcgcgccggcggaggcaacgccgtggccgtcagcatcctcgttgccgccgcgcgccgtggcacagcgccgcttggcggtcgcggggggagcaaggcaacggggagaagagcaaggcggcggcgggaggagcaaggcggcggggaggagagcaaggtggctgggagggggggggggg

SEQ ID NO: 83078 - DNA, 5936 bp, Oryza sativa
gcttttggagcccgagtctggccgagaactcacgccaagatccgatccggcaaccggctaaaaacaaacgtagtacgagcagtgacgcacgcccaccccacccgcgatggtagcagctcggctaaccccttccacactccacaccagcgcaacgacggaagtgtgtgacgcggatggatgtggtagtacgctgtagcatgtactccctccctccgttcttaaaaaaaagacaaaccatgttttcgtgtccaacgtaaattaaaaagacaagtcacgtataaaatattaatcatattttatcatctaacaacaataaaaatataaattataaaaaaatttcatataagagagacagttaaaattggcaaaaaaaacccagagtttgtctcttttttttttatggagggagcacgagcgctcactgatccggtcaaataaatgtttgtgcctttgtttatcgccttgtgtagggatacggattctaggcctctggaccacagtgggaacgtccgaacgtgaattggttaaggctgtgtttagttcacgctaaaattgaaagtttagtcgaaattgtaacgatgtaataaaaaatttaaaaatttatgtgtgcaggaaagttttgatgtgataaaaaagttaaaagttcaaagaaaaattttagatctaaacacggcctaaccatcgttggcatggaagttgaaccgctcgtatactgtatacttcgactctgtaatgtgtatagtgttataactcacggcaacaagcttgagaaaatggaacaccaaatgtaaagatggcagaaaatggaacaccaaatgtaaagatggcttaattaacgggttgtgcatctgtaactccagaggtgctaagcgttaattatcaaccatgacgggaatgcacatgccttgccttgcgttgtggtccatattcccccggttcagtagtagaagatcacaaatttatttactgttcaaaatacacagccgatggcccccgctggagacgcacgcgtgacgcaagcggcgtgcacgcaagaaattttatgggaggagagtggtacggatgctgaagggaaaaatttctcatacgaattggcacgcttctcgaggctgccgctctgcgtgacgccatcctcccgtcgtggaacacggtttcgacagggcatggccgtcctttcgacagtgcagagcatgtactcctccgtagtagcagatccgtcgaaaacgaaaacggaaaaaaaaaaagaatgagtatctgttgcactgacccgtgggtcccactccatcgtatatgcttctaatcggcgtagctacagaggtggcaaaggagtagtagggtaccaagatactggtatactatggctgtgttgagatccaaagtttggatccaaagtttggatccaaacttcagtcctttttcatcacatcaacctgtcatacacacataacttttcagtcacatcatcttcaatttcaaccaaaatccaaactttgcgtgaactaaacacagcctactagtatcccaaatgggtttatatcatgtactataatgacactgttattatagacaccaacatgtgaggcaataggagagtagaagtgtgggacccacacacctacgctagtgacattatggtagaggatactcatataccccaaacactaccaagacaccaacacgaagagagtacgaacgctagtagggcgttcccagcgcgccttcatggtgttcgaactgaataatcaacaccatgttctccacacaggaaaacccgtgaagatcgatcgtgtagtcaaaactgatcgcccgttctttagcttgaaaaacctgtaaaaagcacatgcacaaatgactgggaagaggagagagagagagatagagtgtgtgtgtgtgtatgaaagctgtggaaggaatcgacagcggttgaagccaccttgacgagtgaagtcaacggggaaatggaggggctcgccggcccgatatgctgcgccgctggacatgatgactcaaagagcagccatatccacttgtccaccggaccacgctacaccgacctcattgcagagatggcatggaagtgtggaagggaggaagatgaggacggatccgtcatcgaccgcttcaatctaccacagagatgttgagcgtcgcggcgaacagcgaaggagaagagaagggtatgatgatggctgttgcaagctcaattatttgtcactcagtcaatccacaacctgctctcggttcatcgctattgggggagtgccggggggctgcctcctccgccaccagggatcgtgcctatcgcggccacccgctcgtcaccacctcagggagcttgtcgcccgtatggatcgaggcatcgctgggagagggtagaggttgtggcgcctgggagatagaggggagaggcagcaccgccaaggagcacatcgctggtgatgggttgatggaaggtgtagggatgccgacgaagtgatgaggagaggcgtagggaaagggagaggtggaaaattttatatttgtttttgaattttaggctgttgagtgtaaaaattggaccacttcataatttgaaaacatgtgatgactgagccacttgcactataagacaaatagatttaggtttaattggatccatgccatataaatatgctgatttagataaataccactataattcgtctattatatttataaccgtgatattaaaatgttacaaaatttgggccatgccactactgtcatgttttccatccatctcagtcttcatcctcatatacacataggacccatctgtcaaattcatcaacttcatttttcctcttatcttcttcttttttttcctctcagctcctcatcgtcgtctgagagaaagtacgagaagtttccgctggcgctcatctgctcctcggataccccatacgcgtgccacatgctggtccgttcgccacggcatgccacgtcgttgtcgccgttacggtatcagctcaccgagtcagccgcggaaaagcccagatccaaaaatgaggtcttgctcccgttgcgcctcgcggtcccgacgcggtgccacccatgctactggtgtaggcgtgggctccctcgttgtcggcgccactgctttcgctttgtggataggcgtgctcaggtgagggggctctctccaggttaatgcagcgatgtgtgtgcattgcgtgtggatttgttcatactgacgatgttgttgtgatagatgtgcaggggatgcgcctcgttgcctctgaagcctcaaccgcggttgggtgtgggtgcggggggtgggggctatgtctacaacaacgagagaagatgagaaaaaaaagaagaagagaggaggatggaagaagaagaatcctatgagtgtcccacatactatagatgaggaagaacacggagatggatggaaaaatgtggcgacagcggcatggttctaattttgtaaaatttcaatagcacggttacgaattggagattatagtgatgacatttatctgaatcggtttatttacaatggcatggatctaattaacccatacatttgagacttgtagcttaatattatgtggtacttgaagcctcctcaaaagtatgcattgcactgctagtggccgtagtagtatacagtagtatagcgctagtcattccctagatgccaacttttgtcgctggtggttggacggcactccgtggcaaccgcgtactctcgtacaagtgctggcgccgtgtcgatcggtttttcgaatccacgcttgcctgcacggagatcctctcgccgagagcaattatgtggtcaccgtgtagctagcgatcgagtactttgctggcgccgtggtacgtaaacaaatttactcctcatgcagtggtacacgctccgttctcgccagaacgaaatctagtcctgcacgaaccgcacgcttttggtgtgtaatggccggaggcagcagcagcagcaacgtagtagtccacactcgcgagcagagtgtaatcaaggctaaaggttaagctacggccataatggcggcgaaggcggaccaaacggcagcgtcgccgagcctgtgaggaatcccggctcgctgacactggcagggagggatcaactggacccccccttggtccccttgcaatgctgcaactgcgagccctgtgcaacgaggtagctagccatttccgtcgcagttctagacctgtggcccgctacgcgtggcattcgagtttttaaccgagagggggacccccaccacccccctgccccaagtgcagtccgcgagccccgtgccgaggctttgggccgactcgccgcgtgcgcgcgtgtgtgggcctcgacggacggtgctgcgcgctgcgtcctccaccgggtccaggcgcattgaagaggttttacggatcggtgcaaagcgtcgggctgtaaatgtgtgttggatcgctgtggtcggcgagacgattgatgcattgatagttcgatcgatacgctcgctgtggcggtgctgcggcctactgactactgtgctggtggctactggaaccatggtaagtactacaagtacgcgatgtgtttgctggtgttgcaggatgtggatttggcagtgaaattacgttgtagtagctgctagtcggggagttactcatcatgtgggtacaatggtactcctgttttgcacctgcacgggtgctcgtaccactccttggttttgggcccggccacgcgttgctgcatgttcttgcccgctggtttgatgcacaagggaggcctcgctgaagtccgagctcgaatatttcacacgaggaaaaagtacaaccaaggtccctcaacttatcataaaaccagatacaaaattatcctcaaatcataaaaccagatatctcgcgtctcttaactaatcaaaaccagtccctcgacggttttaaccccggttttagtctatgtgacagctgagtcagcgcgggacccacgtgggtcccacatgtctttcccctccttttcctcccgcggcgcgccggtgcccgcggagagacgaccccgtcctcttccccagccacgacgcgctccgcttccccgtcgtcgagacctgcttcaccatgtacaccggcggcctctcgtcgagaccgtcgccgccaccaccgcatgggcgaggtcgaagtcgcggacgcggctcgaccggttgcagcacaggcacagcacgagcgccaccacgacggccgagacgagcagcgtgacgaacgccatgggcgccctcttggacgagctcgctccgccgtctgcacacgcttgcacggccggtcggaggtcggcacgtagtagaggtactagttgccgccgaacctgccgcacgtcatcatctcttttccctcctttcccttcctcctctctctctctctctctctctctctctctctctctctctctctctcactcagttttctcctcttgcaggcccgccggtgggtcgggaggaggtcgacggggcgagcagggagaggggaaggtgcggcggctggcgacaggcgacgcgggagcaggccgccgcgccgggtggggaggagactggcggagcagaggtcgcaggcgtggagccgtggagtagggcatcggtggccgacgacggcggaggagcggcgatggcaggaatagtaccgacgggaggggccacgagtcgtgcggcggcggcggcgtgcgctggctctgactcgtgcgtgtcctcgagctcgtggcgccggcgacgaagacggcatcaggggagctagcgatagtcggcgtcgccctgcggctatatgagcccggagctcgctctaatggaagcagaggtggagctccttggatggcgcggggaggccggcgtcggcgtcgccctgtcagaggcatcacggtgcggcaacgtcgagcagtcggcttggcggcggtgggcgagcggtggcgggcaaga

SEQ ID NO: 83079 - DNA, 5180 bp, Oryza sativa
cacgcgggtgggagctcgaagccgccccccgccgcggaggaggaggagaagaccatgacggtcggccgcgccgattgccgtcgagtggaagccgctgctgatcgaggtcccctcgcaggtgatcgacggcttcaactgcgtcggcggcggtggcgacgccacggccacggccacgctcagcgagcagagcaaggaactcgaaatgctgggcaaggagaaggacgttgtgattagcatcccggcgccggtgtacgctccacggtccgtgtcggtgtcggcggcgtacgaacaagagggcgcgtatataccgtactccgtgtcgctgagcatgccggtgtcgccgtcggggttccacttctcgcagttcgggatggcggcggcgaaggcgaaggccgtccaccgcgacgatgcccgcgtggcgtcggcggagaccaggttcgacgacgcgcacccgccggcggtggggagggtggagcgcactccccgcggctgctgatgaagcagacgtggttccactcgcagcccatcctgcacctgtccaagaacgacgagacgacgcggcggtgcgacagcacgcgcgacaagcgcggttcgaccagttcaagaccttctccggccgcctcgagcggcagttctccaccctgtgtggccggccggcgcaggagcagatgaccaacggcgagggcgccctgttgtggcaaaaccctcacacacgcgatcacttggataaacacaagaaaaacaaaagtgtagacgcgcgtgaaagcaacgaacacagatgaacacaagaaaacaggttttggtgccgcgcaacgtcttgtggcttttctggtttttctatctcatttattctccaaatgcataacaaactaacagcttcacctattcagccgctacaggcagccacttcctccgcgccatcccacgaagtgctgatcaacgctgcattctcggcgagccacacgcacacgcactctcggccatgacgcgaactctgcgcgcctctggctcatgcaacatgtaacagagaaactaactcgtgacagaatccaatgacctgccacggatgcacaaacaaatgaataactaaccagctaaatgtgacaggcttagtctaacacgcccccgagccgaacatcgccgaggaggagacggagcaggtccccggcgccgaccgctacttcgacaccctggaaggccccgagctggagacgatgagggcgacagagacgacggtgctgcccaaggacgagaagtggccgttcctgctgcggttccatacctgctcaaggtcgtgttctactttgaggcggtgcggcgggagttctaccacccgatccgcgccgacttcttcgcgccgtggatcgcctgcctcttcctcgtccagggcgtgccccgggcggtgacgaaggtgcaccacggcgtctggtatgcgctcatgacgccatggcggaggcggcggcatcatggtcggggaagcgtgggtgccacgactgggggcggaggcaacgacgaagttggagtaggccgtgggatgccgccggcctcgacggggttctcgcggcggctgcatcgctccccctgcctcgtccccttcagccggcgacgaggatgctgacggtggcggcgttgcctccgccggtgcgacgccggctgccggacctcctcctctcccctccccccgtggcctcctccccacagcgccgcccgtcgccggctgagagaagtgagagagaaagggagaagaggaaagagatgaggtggcaccctgacatgtggggcccacgtggggtcccacgctgactcagccactacgtaggacaaaaccggcgtcaaaaccgccgagggacctcgggtgaccggttttgtatagttaagggatcccatatatctggttttgcggtttgaggatgattttgtatctcgctgacaagatgagggaccttcggtgtactttttccacagaagaatgtgtgtgttgtcgagttgttgggcctgcgagcctagtgcggagtgggcctgaaagccaaagggaagactgtagatgccatcgaaaatggaaacgaaaactttgctactcttattcggttgtggggacttgttatagtggtatgagattcaggttcatggttgcgcttctcacattctctcgatccgaccagtaaaattttcatacgctatggttcgtggatacctttgggtgtggttgcggtaaatctagttatgatttggttggatttggagaagtcaccacaacgcccatgaagcttagtgcactgttgcgacaatctgtggagactatggacactggtggagaaaccatctttcgtcggtcggccgatttccacaatagtcccggatacaataaaaaccggggctaaagatgatctttagtcccggttcaaaagggtaacgggcatatttgatctttagtcccggtttgtgttaccaaccgggactaaagatcatctttagtcccggttcgaatgctgtcaggacctgtcaggcccccccgggatctttagtcccggttggtaacaccaaccgggactaaagatcttaactttaccaaccgggactaaagatcccggtgatctttagccctggttggtgctaccaaccgggactaaagatcttaactttagtcccggttggtaataccaaccgggactaatgatcccggtgatctttagccccggttggtgctaccaaccgggactaaagtcccacccctatatatatgtcttcttcctcctccagctgcccgagcaagcttcaaaattacttcaaaaaagaggggaggtcatgccaaaatttctattgaatttattttggtgattacatacaaatcggaggtgcctaaaaggtttgcaacttcatcctccaatgtttttttttgtcatactacatttgcacctatgttttgcacacttttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaaaaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccagggaggactgcgaaagtgaaaaggaggcccataaattggacaagatgttggaggaccacagaacttcgttgtacccaggttgcgagcaggggcacaaaaagttggataccactctggaattgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtatttccctataatatcacggctaaggcgtttgttcaggaacaaggggaatgctagaatgttgcgatggcacgctgaagagcgtcaacaggacgggatgctgagacaccccgccgatggttcgcagtggcgaaacatcgacagaaatttaaagaatttggaaaggacgcacgaaacatacggtttggtttgagtacggatggcatgaatccttttggagagatgagcagcggccatagcacttggcccgttacgatgtgtatctacaacctccccccctggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtaccttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacaatgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgct

SEQ ID NO: 83080 - DNA, 2689 bp, Oryza sativa
catcgctgccgaatctgctagtgggacatccccttcgatgctccactcgccccaatatgtcctcctctccttgttgcggcaccccccttcgctggcagcgacgatggcctcctcctccatcctcatcttctggtgttgggcgtaggagcaggcgatgattggagcgggtgctgcggtggcggacgcgatgatgacgagtgcggttgagggtggcggtagtaggccccaacgggccccaacatccccctcctagtgattttattttttgacgaatgttttaagagatttccttttgttgttttttcctctttttgattttccccttcctgtgtttgaatctgtgataaattgattagctatgtttttacttgtaaaaaatatgttgttttcggtcctatcctgacctgcatggctgcatgtcaaccaaactgtcaaaaacagatttttaaaaaaattgcaatgcacattaaaacatcatatatcaattagaaaacataaagagtcaaattatatgtagaatatttaaaaaacaaatgaagactctatttgtgacttagttccgaaataatattccatatggttctcgtaaattgcaattctcacatgtaaacatgtttggagatacgagaaaagaaaccaccatgagctctttttaccgtctcttataatctttcttattacaaataattatcgtttaattatggtcagctagctagtactaaaatcaacccatatactatagtctaccctctccaatccccaaaactctcttgcctcttcttcttgccgcccaattccatatgaccaaatattcatactagaggtgatcttctttatgctagacggtgagtacgactttggtacaaatgctgcttcaccatcacggacaataagatcaacatggacggtctcaggccactcatacaacctgggaaggaaaaccttgttttgcatcgatttgaacctagtcttcctcatcattgttgtgtatgttcccgtgaacagcgcacgtccttccaaggtctccaacttgtcccactccatcgtcgcctcattgagcttagcgacatggacaggtgcgccattgtagccgacgaggacagccatgagctcaccttggtccgactcgaagaggtggctgtcaacttcttggtggtcaataccaaagttgtcaggcttaccaagaagtctaaaattatcggcgtggttacatggatcatacaccgccagcttcccatctccaccaagaacgtacagcaagccatcgtggagcaccgggttgctgatcggcgccgccggaattagctgtgtccctgcttccacgttgaactcccgttcggtcccaaggcccccactcgccgtcgccatcttgcgtcgcgcaggtgagctgtagcgccagggtcgtgttgacgcagtacaccctccgtgagccatcgtcgtatacgatgaagtcgtaggagtaatggggcgtacacggcaactcgtaggcgacgctcgtcaggagatcgatttgggagatggagaaaggtgagaacaacgtgaggcgttgtccgttggagcagcagatcctggtggcatcattggacgacgacgccttctgcagcgtgttgccgatcacaacctcgaagtttgtgttatggtaggggctgtagtacctgatgttggttcggccgacggcagcagcgcagcggagtaggagcggggtgatccacgctggatagaagggtgacacggcggaggggatgccgccgaggtcgatgatgtggatgaacttgtttgtcctcgtcgtctcgaggacgaatcgttcacggcgatggcggcgaggtggagaagcgggcacaggttgaggaaaagctctggcgcgcgaggaaaagctctgtcctcaccaccccgctgcacgcctcgaaaaggccgaagaccgcgtgcccaacttgagctccgcgaaccttagttggtcacgccagaagccttgctggcaaggaatctcggacgtggcaagcctaagctgaacgccaactaggcgcattgtaaacgccctaataacagccaagatgcatatatgtattccatgggaaatagtttcaatatcccagtttccattcccatttgatgcgataataaatagcgttacatatctcatgcttgtcaaagagaaatttatttggccctggacggtaggaggaaaagtaacattatccttatccacatgatggtttggctactgacagtaaacagggcacatcggtccctgccatagataggttatgcaatcagcactattattattattttttttgaaaacgcacggcaggagctctacctattcaattcaggaaggaaagaaacatgtttatgtacatcccagcacccgctatgacgggtgaaaaaggtactaactccaccccgctatgtatgcgtgtttttcttcgtaccttccttgatactccctctgtattttaatttatgacgccgttgattttttatctaacgttttactattcatcttattcaaaaaatttatcaattatcatttattttattatgacttgattcatcatcaaatgttctttaagcacgatataaatattttcatattttcacaaaatttttgaataaaactaatggtcaaatgttggtcaaaaagtcaacgatgtcattcattaaaatacagagggagtatcaaggaagg

SEQ ID NO: 83081 - DNA, 3554 bp, Oryza sativa
cgcttgccatatccacggcaggcgacgactaaggcagctggtcgttatctctgctgtttgattttttatttttagaggcttgattggttggggttttacgccagcatatctgcttgatagctttgtaccatagcctgtgatgtaattgtaaaatcttggtttgtttattagtttagtatatgttcttttatatatgtcgccattctttctgattatttttgttatttgccatatgctgtacaaattgctcttaacggttgctgattgtaattgtggcttgcacaggctactgtttttacagtcgcccagcggtccacattgatgctagtaaagctttgcttctaccgcacagatggcaatgatagctgtagaaatgtttttttgggggacatttaaggcccctccaatgtacactacgatgtctcaaagataaccatatatatatatgtatgttcttgaattgcctcccaattaaacatttctcttacgacttaggcatcgttcgttcgggggagatcggggagattgagtctcgtttttcgcgcgcacgcttttcaaactattaaacggtgtattttttgcaaaatttttctatacaaaagttgtttaaaaaatcatattaatccattttttttaaaaaatagcaaatacttaattaatcacgtgctaatggactgctccgtttttcgtgttactgttccgggttggaaaccagcatatgcgaacccacccttagaggccattgaacactgaaccagggttagtattgttttctcgtaaaactataggttcttagaatctgtttatttcccaaacaaaaattttcaccctgtcacatcgaatgtttggacacatgcatggagtattaaatatagaaaaaaactaattatacagattgcctgtaaattgcgagacgaatattttaaacctaattgcaccatgatttgacaatgtgatgctacaataaatatttgctaatgacggattaattaggcttaataaattcgtctcgcagtttccaaacggaatctgtaatttgttttgtaatttgttttgttattagtctacgtttaatactttaaatgtgtgtccgtttatccgcatgctaaaagttttcgttcacgaactaaacagtcacagtccctagtccaaataacaaaaacacaccatgttttagaaacgtaattgacatatgggcacatgacatgtctgaattgctccaattaacttgggccacctaccatggatcagacgatggttaattacagacgcacggtagattgggcgctcgccgcgaggccgtcgctattggcctattgcctcatctagcttcctcgcacgcgtcgcatcccggccggcagccgtaagagcagtacaatagtaggctacaaaccagctgcagacatattttaaagagataaataaaaaaagagaagggcagcgggctacagatttgtagccagctgtagcacggactccaagacacagtgtgtgtatgacatgtgggaccatatattaatagtgtagtatataattattgtacgaatgagctattagattggctatagataaattggagctagtagttggctatactattgaacttgctctaagctgccgtgttttatcgcaaggcgcgcaggagctaatcaaaacattgttttcccatagctgtgatgaaaataaaagcaagaatttcactagctgagcgcatgccacaatggccgagcgctactaaccgggtaggctctccatctcgctcctattttctgtagcttcttgtcgccggtttcggcctttttttttttccaataaatttggcttctcattcttttgggcaaactatttgacaattgtaatttttaggtttggttattgggatgccggcatgttttagtgcacaatatccattttctctggatgggtttgaagtgaactgtacatcattcctcttgccactatattgtgctacctatacatggctggtaaaataaataaattgactcgtagggatttgttgatgtttcaagaataaaaggcgaactggcagattgaggcagcacctatagatttcactatttttcagttgaagttagggcctgtttagttcgcaaaagaaaaaattttagatgtcacatcggatgtttgaccgaatgtcggaaggggttttcgaacacgaatggaaaagctaatttcataactcgcctagaaaccgcgagacgaatcttttgagcctaattaatccgtcattaatacatatgggttactgtagcacttatgattaatcatgaactaattgggctcaaaagattcgtttagcgatttcctctctaactgtacaattagtttttttaatttatatttaatgcttcatgcatatgtacagagattcgatgtgatgtttttggaaaaaaaatttgggaactaaaccacagccttaataccgcaattggaggggggggaggggggggtagggcccgatgaaggacgccttcgttgaagacgttcttgatggtgcttctcacctgcggcagccaccagagcttcacgaggccggaccatgcgatggtggggggaggattttcggagcctgagtcgtgtgttctgcacatgcagtgaggggtcggtgcggaaggatgtggtgatgatgcgtgaggcgcgcggagacggcggatgacgtcatcaacaagttggtgccgggggttcaaggttggtaccaacaagatatcagttgaaaatgatgggttcttttctccggaagatgaagatgaagatggagattattatttttacataaaatgaggtggtattaacgtatgattgattgagttttaactattacaaacttgaaaaatagattaatatgatattttagatcaactttcatatagaaatttttcacacgaaatacaccgtttaacagtttgaaaagcgtgccacagaaatcttaatcttcatccaactcttattggagaaaagaacgggacatatatctggtatgaccagtgcctcagtggtgaatccagctcctgggctggtacgggaccacccaaggtaagtgaaaatgcttgtaaaatattgttaccgactaagaagtacatttcatagtagaaattgtcaactcctgacttttgagttatactagaaaaaatgcccgtgcgttgcaacgggtgaagtctattttaatcttattattgttatatggtttagttaagatgaaattcattgtgagagttcgcttggatatatatatttgtagaaaatcataagttgcagttaggagtccaatcatctcaagttagcatgtgagttattttaaatagatttcttctgtattatcaaaagtaaacgatcttaaaaaccgactcaaatacggatatttatttccaaaagcaatcgaacttaaaaaccgactcatacacggatgacataccaaaataccgataaaaacatcttcaacttttataatagtagagatttggcccattctaaacgtagtattgcctttggattattcgcatatgaattctcaaaaaaaaatccgattttgccat

SEQ ID NO: 83082 - DNA, 7582 bp, Oryza sativa
ggcctccccgcgcttcgccgccaccaccaagctgacgccgacgccggatttgtagagctcaccggccaccccgtcgcctgtcgccagccgccgaaccttctcctctccctgctggcatgcgagaggagagagagagagagagagaggagggggaggaggaagggaaaggagggaaaagagatgatgacgtggagggatatgaggggaaagaaatgtgaggccatgtaggtcccacgctaactcataatcgggatcaaaaccgtcgagggaccttctgtgacctgttttgattagttaagggatgcgaaatatctagttttgcggtttgaggataattttgtatctcgatgagaagttgagggaccttggttgtactttttccttcacatgacgagtactaagactggccctggacgataggaagtccagaatacatccttagtgtacacttgattatgggcctcgctatggattaggcatgcctggcctagcaggccactgaaaggaagcccaccgggctgacagtgcagtagttgggcttaaagcatttgtctgttaggctttttacggcatgcgagtacaacattgctcccgttttagcatttgaggttgcaagttatttgtcgttcaaccttaacccaaaagccaagactagcttattgtattttaggtcatgtttaaaattacatgatgaatttgatcattatagtggacttttaatcttcggcctgggtctatggcccaagtgacctgagactttgggtccatctctaagtcaatcgttaatatgtgtggagattatggttaccccatatctacatggcggttatattctagctggatatacggtaccaaatatagatagaatatctttatgaggactcgggttagattctaaacttgtatgtcaagaaaatacccggtatcctagtcggttacgattgtattttatctataattccatattccgttaggatagaaaatacccggtgtcctagtcggttacgattgtattttatctataattccatattccgttaggatatggactgtattttgtaaagaggactccttcccctatataaggagggtccgtgtgcctcttggggggcgattttttttttcaatttatacaatcaataacatactcggcggaatcatccccggacaggagtagggtattacttcttgaataagaatgcctgaacctgtataaaattcattgtctccaaacccatccactttcctagcttgatagccacccccttttattattgccgaaatcttgtttcgacagttggcgcgccaggtaggggtagcgtcaagttctcgccgactaagtgcgatgggtttcgtttctggcatcgacgacttcgcctttcctcccgggcaggcgttccggttcggcagcctcaacttcatcaccaacgacttcggcaagatctctctccttgactcggactcaaaccagtcggggagaaaccaggtcctcgtgccattcggtattccgaactcggccgaggcctactccaagatcatctctcccgagtcggctctaaaccactcggacgagatccaatctactcttccgcgaccggatcaagacgacgggtcctatccctcaatcctgatgaaacttcctgatgatttggccgttgtcttcactgccaagacatctcccactcgaagatctaggcgagctccggcttcggccccgatccaatctagatccagagaggttgacattatactccaacctcttgggacagtctcgacgaaagatttggatggctacctcagctcccccggcgtcagttctcgaccaaccgagatcctcgactacgacgatttcggctaccactatgaccacggcgacctcgacaacttcgacgacagttatgaggataactacacgcccctcttcttcggcgtattcatggctgacaacgaaacggaggaacatcgccaagcccgagaagcggaccaagatcgcgcacggcaagaagctgaacgtcgccgactggaggaagagcgatagcgacaggagcgagaacgactacagcgtgagcaacaagatcgcgaacgaattgcaaagaaggctgaagatcgacggcaacgctccttggaatctgggcgccgagcgagagagctcattgggcaacaagacgtcgatggaacagcggtctttcgcaccccccagcagaacgcggttacagcaatcactctcctcgacaccctcctcaaggaagacgcactcaaccaagccgatcatgttgtcaacatcttgaaccagacgaagaccatgatcgctgcctcggttccagccaactccgcaagcacccgcaccccgactggtagccgagtccctcacttccgatctcatgattatcatcagccaaccctcagtatcatcggcacaggatctagtcacaggagcaggggtcacgacgaacgatttgttcactcgcctcccgaacgtcacagggagcgccgggtcgaacggcctcgctctccacctcaccagcgtcccgtcgacctttgcaacacgatcaaccagcgccgtgcagcacgaggtcaccgccattcaccagatcgctacgacgacgacgtggacggagtagctgccttcactaatgacctgcgttgagtggattggccagccggctttaagccaactggaatcaagaagtatgacggcaccaccaaccctgagtcttggctcaccgtctatggtctcgcaatccgcgcagcaggaggagacagcaaagccatggtaaactatctacctgtggccctagcggactccgcccgatcctggctccacggactatcccgtggcacgatcggatcatgggcggaacttcgtgatcacttcatcgccaacttccagggcacctttgaacgccccggcacacagttcgatctctacaacgtcgttcagaagtctggagaatcccttcgagattacatccgacgcttttccgaacaacgcaacaagatctccgacatcactgacgacgtcatcattgcccatttaaaagggcagtcggtggttacacgcatctctttgtggctatcaacaaattctccaagtggattgaggctaaaccggtcatcacgatcacagcagataaagctagagattttttcatcaatattgtgcatcggtttggggtacctaatcggatcattactgataatggcactcaattcactagcggagcatttaaagacttttgtgaagacttcggcattaaaatttgttatgcctccatggcacaccctatgagtaacggacaagttgagcgcgctaacggcatgatactgcaagggatcaaagcacgagttttcgaccgactacgcccctatgctggcaagtgggtagatcagctgccgtccgtactttggtctttacgcactactcctagtcgggctaccggccagtcgccgttctttttggtttatggcgcagaagcaatgttgccgagtgaagtggaatttgaatcactacgatttcggaacttcaacgaggagggctatgaagagggtcgagtagacgacatcaaccgactagaagaagcccgagaagcagctttaattcagtcgactcgatatttgcaagggttgtgccgttatgataatcggaatgttcgatcgcgagcctttttagtcggcgacctggttctgaggaaaattcaaacaacacaggatcggcataaattatctcccttatgggaaggaccgttcataattgctgaagtcactcggccaggttcttatcgactaaagcgcgaagacggtactctcatcaataattcttggaatattgaacaccttcgtcgattttatgcttaggcatcttgcttgtatctttcctatttgactgcttatcaattcaatttgcttacttgatgtatcattgctctgtttgatttcttggcttagtcaatgaggactgaaagttttttaacaacttttgcgggttttaggctcaacaaggtttgacaaaaacttttaagaaatcaggagctaagttaagatatcaagcacagcataaattcatcagtattgtacaaattgtgcctccatcatcattaatcatcaaaatcattggtacattaatcagtatcagttttttcatcatcagacttatcagacctagtcggccgaaggtcgacatcttggaatctctcaactacatcagcagcaattttgtcagccgctttctgcgcatcactgatgaggtcaagagcagcttcttcgctcgtcccgtctgcaaagccatcaatggcatcaatatcaactcttggataaagggatttggtcatcgccaacgccagacttgctcccatactcccagcttctttgatgttcttgaagtaagtatctggagcgactctcagcttgtcgaagatttcggcagcatcaagtgtactcgaaccggcgttattgaaaaacattgcttaaacaattggggtagcagcgttagcaacctcatcccgggttccttcaagttttttgatcttgccaaccaggacgtcgaattgagcttgagatttgatcttgcggtctgcatcaacagattcacattaataagtcagtatatggaggatattggcttttgaggtattgattgttgataccttcaacttcctttaaagccaggtctctttgtctcgctagttctgccttgtcattttccagaatttgaacctgcttctccaactgagatatcttggcagcttgcactacattgattacggttaatcaagattgcaaagataacattatgagtcagttgagcagagtttgtgcgtaccttttgatgagccactcagttcaaaatttgattcctggagctcagcgatccgatccctcagatcatgttcattcttcctggcaagttctttcgcttcgtgcagttgattcctggtagcttcgagggttccgagatgagggactaacctctctaaggttaccgttttggcttcgttcctaagatgaatcctctgcaagacagtttaatgagcacatgaattaaatggcaaacaagatggttgaaatcaagtaccagagggcttacatttacaatacgggttgcttgaccaagtgccttcttcagtaggcataactcttcgtcctctttttgcttatttatcacgatcccttgaggctgcatgttgtcatcccaccacttgaccagaatcggagggcgtgaatcctcagccgcttgtatccggaggatttcttcttcataaccaattattggccctagtgtatccatgaatgaagatgaagcagctaaataaagtctgttggatcaaaatgatttcagatagcgtggctacctgtgatgattcccggtcggggacgagtggactttggtgtcttcacaggagatctggtttctgattcactgtcggcatccttcccgagaggactgttcgtttgagcttcaacctcgggaaccttttggcttggccctgcatccgactggtttccagtcgggggctcctggttagcaccgacttcagcttcggccgactggttcccagtcgggggctcgttgctgggttctacattgtcggttgccggctgattgtcactcggatgatcctcaacagatggcccggtttctttggaagagcttgtgtccatgttagtcgggtcagagtctttcccagacggatctatatcagatggtttcctgcaaatttgattatcagtgttattaccgcaatgggtgcgcatcaatgcaaggaagatcgttatatgagttgcacctggaagacttcctgatctttggcacaggacgactggatgttttcttccatggagtagcctgttttggtagttttttggttgtctctcggtctccaggcctcctgatggtatcatcggcttcgtcgtcacttagaaccagcttcctctttcgagaatctggctggccgactggatgtcacgcccagaaattcccgaatagaattccaagcagaatgtgtattaaaacccccgtccaggaccagccggggtacacaaacgacaatgttgacctacagatccacgtcttacaaacaatataaaggtcttacagaaatgcagcggaaaacaaaagataactggagctaatccttgacttgaactgcagcgggaacaccactccacaggcatcctcgacggcacggacgaagcctactcctcggagaacccgccatcggacacatactcgagctctgaggttggggggaaaagtagagcaagactgagtactacccactgtactcagcaagtcataccggaatagaggtatgatgcagggatttaacaagggatagctaagcaggttcatttgcataaatactggcatttataaacaggaattgaatgcgaaaacagttgtaataattaagcagtattaaacatccgctgtccaacgctgacccacgttgcgacaggcccaaccatccacctaaactatccaaattcaacagattacactagggtgagactaatcacggtgaatctggttgaccgcccgtaaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagcgggcgacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataaattcttccagggcatcccgcgaaccggtccttaactgccatgggtgcgactagcaaaaccatgcacccacagcccaccatgtggttcattttatttaaccaacaccagagcggtggtattaaaccaacattatcatataaacctatagtctaggttttaaatgagatccccaatgtgtgctagttgaactaagcatggctaagcaattcctagtccaaagtctaatcatgttataacccaagctaacaaaggagcatgatatccaaaagcatggctgtaacaataggtatccatcccatagtgatattataaaacaatgcaatatttgaaagaaaacaatagagcatttgcaatataggatcaacatgttcaagtgacaagcatgacttgccttgctctgctgcgggagggacctcggcgactatctcgaagtacaccggagcgtcggagggatcggaatctagcgacatacaaagcaaacattgcaaacaggctataagactactgaaacagagaacaaaaccatttttaatggactctacatatttttcttgatttactgagacttgaatgggattaaacggagctcggatgaattacatatgaattttagaagattcactgtgtttattactataaaagaaatccttaaataatttattgcgccatattaacca

SEQ ID NO: 83083 - DNA, 1083 bp, Oryza sativa
ccacgtggtcacgtcttaacatatatactcatatttgcatgcataggcgtggttaggtgcacgaatgaaagaaagatcgtcggacgggttcgcgcgactgtctactagcgaacattcgcgtactacacctctcgggggggagggggggtggttcattatagtagccctttggtagagtattcaggccggcatcctccccttggataaagagccaccatatattgaccgttcaccattgcaataattttttttaacgattcgccgttgcaagttggcatacgtgcagcagaggacatgggtgctgctgcgctgtactgtgtattcgatagggatttggtacacacggatttggcaagagctcctgtgtacgtagctatctcgccgttgatcgctcgtatcacgttgcaactccacatggtgaacttaaaccgattggtatttgctcgcaacaaacccacgtcctacatgatcctccgcgtggcacaccacgagaaaatcggcagaaaacaccagtggccaggcgaagcgagatggaggccaccgcatcgatgttgcaggcccgggactggtcgtctctcccaacggacgtgcttgtcttgatcctggagcgcatgcggtggtcgactcacccgagcgtcgtgttagtgtgccagcaatggcgctccgctgtgtcgctgtcgcccttctacccggcatggatcaccccactcctgctcaacaccgctgacatcggcaccgccaatataaggtactataggggagtggattctaatccctcgaggggatatcctctcgtatacctttttcttccaaattcgatgcaaatagttgtgaaaaattctaaaaaaaattgacaatgtagagtataatgatacctactagtccaccaaaattcatgttcaaatttgatctacacatcgagaaacaaaaaagacaaatttagatataaactgtacactactattcatacgctgaatttgtcttttttatatctcgacgtgtgagttgagtttggacttaagattttgtggagttgtatatatgtgttgtatgaatgttatcaaatttttccagaatttttca

SEQ ID NO: 83084 - DNA, 1156 bp, Oryza sativa
gtgtgtccaattccaacataagccacccattccatagtgtccaaatgatatgagaattcccaaagtctaaagttataaaaccacctaatgttgcctaattaatcagcgaagcatctacctaaattcatactagtggaaccatgaatagagtacccactagttggggttttatttatcctagggtgaacaaggtaataataacaataacaacaataataaggtcataacaaaggtaaataggcatggctaaataaaacagtgataacgcgggaatttaaataaagcgataatgcaataatttaaatcaaaataattttataaactgggattcaatatgttcaaggatgatgtgacttgccttgctcgctttcccaaacgtcggcttcaacttccacgaagagcggatcttccgaagctgcagcgtctacacgaccgacggaaaagaaaaggcttttactctaataaactccatataacaagcagaaacaaagcacaaaaatgggttcttgacttcttaaggaaaaattagagacttgaacggtccaattccgagttcaaatggtcaagttatggccatttgaaggttatatgctctttaaatgaatatttgcgaatttcttcatttaaattttaatttaaaatcggatttattgcgtcagccgaggggagaggagcgcgcggaccgggtccacaggagtggggcccacgcggcagcctctcggtccacggtggaccgggagcacgcggcttacgccggccggcgccgtgggtcccacgcgtcagccgcacctaagggcgcgggcggctgacagccgggccccacacggcagccgcggggcacgcccgaaggcggccacgccggcacagccgacgggaggcgacgcgcccgcgccccgatggtcgccgccggcgaccaccggcgcggcggagcggcgcccgagagaggggagggaagggggaaacgaatcggcggtccacagctcaccccgggtcgacggcgacgacgggaacggcgaccggagcggaggaaggcggcggcgcggctcgggtcgacggggacggcggcgttccggcggtcggcgggcgaaacggaggggtggacgaggtcggcgaggacgcggcggagccgaaggagacggcgccgaagcgggagaag

SEQ ID NO: 83085 - DNA, 1800 bp, Oryza sativa
attttaatatgagatatgacagcatagtagggatgtcttgtatggtttattttggaaagggatagagtaagggtgtgtttagttcacgttaaaattgaaagtttgattgaaattggaacgatacgatggaaaagttaaaagtttgtgtatagaaaaattttgatgtaatagaaaagtttaaagaaaaaattcgaaactaaactcggcccaagtaacgatattacttagtatgaagtagtcggatgtttgatgccatacctttacgcgtcgacagcagctagccagtggcctagtgcttcgcgctgcctcgccgatacacttcgcgctgccctgtgtctatttattggaactcctcgtcgtcgtgggctgaactggattcaccaagcggatgagaattggatatggaatcggacggatagttggtgtatacacgttttcggctatgatgcgctgatagggcaagctaggtgcgtgtctgtgtctgacacggatccagtgtcccgtacgtatctacgaggatacgttaggtaaaactccaactcttaaatttagcttcacagattagggatcagtttagcacagctccatctctagctccaactctggagcttgagtttaaccaaacagatttaactccacctaaaagaggagtggatgtggtttaatttgcatgtgagacgagaggagccccgtgtcacttaggggcaggggcgacacgggcggcgaccaccaccgcctcctcctcacccccgccttactccctcctccgcttcgttgtcgcccaagcagacgccggaaaacgcacggctacaaggacggggcggggccttccaactccctcgaggtcgcggggtcagtgctcatgaccccggccagatcaaggcagcgacggtgtggctgcgtcgagtcgtcggggtgtcgggcagggcgagcggaggcgggctaggtgcgggggtggcgacggtgccagactttgtgtccctcgccagatccgggccccactcggtctggccaccctctcgcggacaacggcgacaaccaaaggtggaggcaaggaaggtagatggcaggcgccgaggaagagagcagcggcgacgacgaggccagatccacggcgggctctgccagatttggagccggcgaaggtggaggaaggggaggatgaggtggcaggcggcgagggcgcagaaaaggtggcggtggggcggcggctactgcaatgggcgcagccagagcctgccagagctagcgcccctcggacgtagtagggggcatgaggtggcgctgaaggcgccgtcgcgacatggcggtcatggcctcaagcgcgcggcgacatccatcacagttggcgacatgcaggggagttttctaggcgctggcgtcggcttgtgctccacggtggcaaggcatcctcttcttcatgcagctcctcctcctatggccagctcagatgtggtcgcggagagatccatggggaggatggaggcggtgccttgcagaggggagtggcttgacggcgttcaaagcgacgttgttactctgccggaactgtgggcgatggcctaggcctaatcgctgaagagactatgtagtagaccggcgacgatccttcttgtgcggattggtgtgtgggtttggacgggtaatcgctggcgaaagcctcgccgggacgttggccagctgacgatggcaatgccttttggcgtcgctcccctcttggaggcgtcgttatggcattgacccctctcatttccttacccaggcgcggatctacagtatagtcattggtgtcaggcgaca

SEQ ID NO: 83086 - DNA, 24395 bp, Oryza sativa
gagccaggccgcctttccccccttttgtgacactgcccagtgggcccgcttgccagccgccccctctccctctcttagtgccgctgaccagtggggcccgcatgtcggcgccgccccaccccttcctgacgtcagccctggggcaatattgcgcaataaattgattaaggcttttctttaatagtaaaaacacagagaatcttctaaaaatcataactaattcatccgagctccgattaagtccattcaagtctcagtaaattcataaaaatgtatagaatccattaaaaatggctttgttctctgtttcagtagtcttatagcatgttttgcttgggtgctttgtttgtcgcatagatttcggccgtttcgtcgattcgcggattctcgaagacgttgctatggtctcatcagtgcgagagcaaggcaagtcatacattgcaattgatcatattgtacccaatttacaaatgtcccgcatttctattaaatattgcactgttttacaatatcatgtgggatgggtcctattactcagctatatgttgtttcccttacgcctaccttgggtattaaaatgactaaatgttggtttaggagatgcttagccatgcgtagttcaactagtgcacaaaagggggtcacattaaagcatagactttgattattggcaatagctttggattagtgccaccgcaatggtgttggttaattaaagtacactacatggtgggctgtgggtgcatggttttgctagacgtgcccatggcgattaaggaccggttcgcgggatgccctggaagaacttatcgtacttaccacaagccagcgtgggcaacggctgggcttgtagtgtagtttttctctagccgacgtacccaggcaagggtgggcgtgatggagttgggtcggccggggtgtccggttgatcggcttccggattcaccgtggcacgaaaggggggctgcccgttgcctgctggggacgggggcgaaccctaaggtgtggtgcgatcggttagatagggttatgcgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtctcatccctagtttagcttaatgaactggtgtagttcaggtggttggttgggcctgttgcaacgtggcgtagcgttggacagtgactggttaatattgcttaattactacaactgtttttactattttcaactactggttttaaatgcctgctttatgcaaatgaaccccgtagcctcctttggttgtatcctgcatcatacctcctcttccggtatgacttgctgagtacagtgggtagtactcagtcttgctctcttttcccccacaccagagttgaagtccttctcagttgaagatgtctcgaagaggttggtttcgtcgctgccatcaaggatgcctgtggaatggagtcgcccgctgcaggagtcaagtcttcaggcttagctcgcttttatctttttccgctgcatttgtaatcttttatatttttgtaagacgtggatctgtatgtcaacaattgtcgtttgtgtaccctggctggtcctggacaggggtttaatgcacattcagcttagaaattctggttcgtgaatttctgggcgtgacaccccgccgcgtcgtcaagaccaccgcatcgccttgctgccagacactgctcccgtggtggtccgactgtactgctacccggcgcgccacaaggatgaactggaacgacggtgtcgcgacatggagtctcaaggcatcattcgccgcaagtcgtccgccttctgctcgacggtcctcttggtcaagaaggccgacggctcgtggcgcaggagtaaaccctaattaacaacgtgtctaataatcggaattgtcagggaaattttttttcgaattctctttgctttataccattaacatgatttttaatggaatattcagagcagaggaagcaacagtgttaattaatttgaaatgtcaggatttgaattaataattttttcctctccctcctttggtcctgaaccgttccaggttcactccccgttcgcggttcgtcgcattcaccaacccctttcgccgccttggtttcgttttgtatggcgagccgagtcctattccgtcttcgattatgtttctttttcctttcccgaaaatgcaccgcatttgtttccccctccttcaaatccctcattcgttttgtatggtgagctgagaattattccgtcttcgaatcctttttgccctccccctctccttctgccgagccgcgcgccaccctaccctcctttgccgcgtgcgccctcctctcccccttgtcgaacccacaccggccccaccatatccatctcgatttcctcatataagtcatcataccccctctttttttttcttcttttcacccgccaattcctagccttcacctcctcctctcccgtgcgccaccgccctagccgtcgccgccacccggagttccgccgccgtctcgccggtgagctcacatcgctcctatccatctcgtcggcacagtttaccgcggtggtttttccctaggttttaatctaataatcttgtttgtctagcgttgtcgttgtctctgtgtgttgccgcgggaccttcgccgccccctctccctctccggtcgtcgtcgcttcttggtgaggtccttgtccgttttaggtgtagtcataggttgtggtttttattgatgacattttggtttacacaaagtctgaagatgagcatgagcaacatcttcatttagtgttggaaaaattgaaggaacatcagctttatgccaagttcagcaagtgtgatttctggttgaaagaagtcacgtttctcggacatgttataaccgccaagggtgtagcagtggatccatcaaatgtggaagcagttactaagtggtcaccaccgaagacaataacacagatcataagttttctcggactatcgagtttttaccatcggttcattgagaatttatctagaattgctaagccaattacgtagttgctgaagaaagaagaaaagttactatggactccacattttcagaaaagttttgaggaacttaagaagaggttggtgtttgcttcaattttgatcttgcccgatcagaggaaggattttcaggtgtattgtgatgcatcccgtcaaggattggggtgtgtgcttatgcaagaaggcaaagtggtcgcatacgcttcacgtcagttgcacccgcacaaagataaatatccaacccatgatttggaattagcagcagcagttcatgctttgaagatttgatgacactatttgattggcaaccattgtgagatatattgatcacaacattctgaagtatattttcacgcagcctgatttgaatctccgtcagcgaagatggttagagttgatcaaggattatgatgcaggcatacactatcatcctggtaaagccaacgttgttgctgatgctttaagtagaaaaagttattgcagtgcattgcgtatgaaaggaatgtgtagtcagttgatataagacttagagcgtcttagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaaggtactgtggaattggggcttcactatactaggtatcctgcggtactggagggttatagtgattctaactggatctctgatgtggatgagatcaaagccactagtggatatgtcttcacactgggtggtgttgctgtttcatggaggtcttgcaaacagaccattttgacgaggtcaaccatggaagcagagctgacggcactggatactgctactgttgaggcagaatggttgcgtgatctattaatggatctgcctattgttgaaaaactggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgaaaaacctggcagatcccttcacgaagggactatcacgaaatgtgatagataatgcatcgaaggagatgggtttgagacccatgtgagttatactatggtggtaacccagtcaatgtgatcggagatcccgtgaattagatcctgggaagaacaaaccattagtaaactagaggagagtaccaatatataccctctccaagtgaagatgcatgtactctcgtgagctacaaggcaggttggctatgccttaatgagttttgttggctttaattagcgaagatgttgtcctgcagagcattcttgaaagaactcacctttgtgagcttgactgttggtcgcagtctatgaagattttgggtgaatcttctaggaagcttactaaagatctaagagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaatcggtctccatcgaaccgctggtatataaacagtacattggaaaagacaaatctagtgggattttgagatttggtgggggattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacgcgcgcgctcgctcgcctcgcctcgcctggcagggcaggcggcgagcgtgcacgatgtacacgtcgaatggtccgaaaaattggctcctcacccttgcgcagatgcagcctccttttgcagttttgttttgctgcaaattcggattcgtttttgttttggaaacgttccgaaaaatccggtgcgtgccaacggcgtggagtccggataagttacgcgcgacttatccggttcggttacgcgcagtagagatcgtgcaggcgtttttgttttggaaacgttccgaaaaatccggtgcgtgccaacggcgtggagtccggataagttacgcgcgacttatccggttcggttacgcgcagtagagatcgtgcgggcgccctgatcaagcgacccttctctatataaaccgacccgccgtcttcacgcaacacacgcgaaatcaaaatagggtttgcctcctactctgtactgcgccgtcgctcgtagactactctatcccgctcgccggcgtgcaccggcgatcgggagagcaggtctccggaacctctgccttcgacgtcctgcaccgggagaaggcggcaataaggtttttgggaagcgcttcgcgcgactgctccctattcgttcgcgacggctcgccttcctcttcgctcacgtgtttcgtgcgatcgtagacgcctgcgaaaagtttcgaccaagcaaccggtctttccgtcacctcggtacgtgttcaatatgttgcgcacatttgatctgttcatgttatactgtgtagtttacatgtgtagatctaatgatgcgttcatgctagttttcatctgtaatgtcatgatttatttatggaatagattaaatcattatatgcctataatctcaacagtggcggcggcgtccaggcgatttgtttgagatgatggcagaggcatgggcagcatgggatctgtgattgagtctgtagattgggcatcgagcaaaagattggaacatttttttcggggaattcgattttttcgatagtggttttatctgcatatgttttttctaggggatagtttgtcacttggcttttttgagaaagctggttttctagaagagtctctttacgcatgcatgaagcacctgcagcagttgaggattagtctcctgcacgacagagtagcagaagacagacaacctccccttttagactaagattaattcatataggagggccgaacttagagtatttcacatgctaaatgcagctttactacgcttttccagtgtcgtatatgctaaatgagatatgttattgaaactgatttgattactgcgcctaatgaaatatcttatgccattatgaattaaattctaatatcttcatctactcacttaattcaggtgccgcaagttgttgaaagtgaaagtggccgcttcaccctatcatatgttactttggcaaagctgaagtcttacgtaccatatgcatggggtttgcaacacatagagactgttttggtaaacgtgtggcagttggagaacttgcaaaacgtataatgataagacaaccttcagatgtggttttcaatgtgaaaaatttgatcggaaagcattttaatgactcttgcgtacaagaaatgaggaaaagactccctttcagcattattgaaggaccagaaggagaatcttgtgtagagattcatggaataaaattatctcctgttgaaatcaccacagccatatttacaaaactgaaggatatggttctgatgcaccaatttcatcacaaatttaaagtggtgatatgtgtaccttcctttttcaatgaacagcaaagggaagacatcatgtcagcaggtcgacgagcaggtttagagatattacaattgatagatgaaccgatagccgctgctctttctagcacaacaataaaagaaggtgttgtggttgtttttggcatgggtgctggatcatacagtgttgcggtccttcatgtctctggcatgaacattgaggtatttctttaagttcatttttatcttgtgcatagttttctagatcattctgatgttgctgaaccctgggtcaattgttttgcatgaacagatgatagcacaatgtggtgattcttgtatcagtggggatcagtttgacaatatactactacagttgactattgtgttacgcagatgatcaaacttcattcggtcgatgttcgtggagataaatgtgccatgagacaacttgtggaagttgctgagcaagctaaagtgaaactatcaagccaacctacagctacaatttctatcccttacttgacttcatctggtcaaggtcatggccctgctcatcttaacattaccatttctcgccaagagtttgagaagttagtgaataatttaacagaacaaattcaagagaagtgtcagatcattttgaaagaggctaaaattgctgccaaagatgttgatgaacttgtattgtttggggggatgacaagagtccccaagatacagagaattatttatgaagtttttggcaagcatcagagtgcaaaggtgaacccagaggaagctttggttattggttctgcaatgcaagcagctctaattgtagaagatcagcaggagatgagcaaagacatgattccactgtctataggaattgagtgcgaggaaggaatttttactaaggtcattcctaggcacaccagaatcccaacaaaaaggatggttaagattcctgcatggtgtgctcaaggggagtgcctacatatcagaatttttcttggggagcatgtaatcgttgatcataatacacttttaggagaagtagaattaatcaataatagaagatcatatgaaggtggtgttgattatgaattgacatttgaagtgagtaggaactatttggttgaagtcagtgtcagcaatgctgatgatgggagcaaaacaatcaaggccttcccaatagatgagaaggttgtatgcaagcataatgtgaacagagctgtcagaaatgctttacgtgactggtcaatgtatgcagcagaaatttatgctgacatgagaaacctggcaagacatacaataaacacactaagtgatgccttgtcagccagaaaggatgaacttcctaaggacctttatgaggatgcagtgacagcgttggatgatctgctgaaggcaatgggtaaggatgttagtgtgttacatgataagatacgtgctgccatgtctgttgaagtaactattctgaactggaggccaccatcaaaatctcatcctggtgattatgatgactactcagattatgaaaactaaggtagggtgtgcttagttcacgtcaaaattagaagtttggttgaaattagaacgatgtaaggaaaagttgaaaggttgtgtgtgtaggaaaattttgatgtgataaaaaagttataagtttgaagaaaaagtttggaactaaactcggccgcagtgcgaccgcagaaacttagagcccgtagaatttatgtttaaactagcttgttaagtggtgatgctatttatgcgacatgcaacttgtccttcaaatctataaaatccatacgcggatgggattgaagagaatattccctatcaaatacctcgcaatccacttgtgggtgggattaattgaagaaggccttgtagtttcacggtacattgtgatgtttcttgctgcatgcaccctgctgcaccttgcaacatgattgccgtgtttgatggcacattttggaggttttttttttttcatccagatggtgctttcctccaaagatgaccctgggatattccgtgtcgtgctggatatgagctggaataagtgcttgtctatatattatttcattagaaaaatgctgcgttgcaacccaaaaaaaaactaatgttacgataatgattatatttattttttagttccatgggagttataactgtaagcgacgacggcgcgcatttccctaccgcgggcggtgaaataatagttaattttaataatacaaacatcatttcagcatttatttaaataaaaatctaaatttctctattggccattttcagtccatttaatgtctgagcgcgcaataaagtctaatttacctcctccaactcctctgatttcgtttgttggacctgcccgccttccctcagcccataaagtatgcgtggcccgacaatggtgtcagcccagacggctcggatcgcctccacaccattgaaaagcctaaccctaaccctctactctctcccaagcggcagggtcgtgcgagcagcgtcggcggcgcgcaaacggtggcggcggtgccctccaataccacgtgcgacggcggcgacaccattccccaccacgagcggcgtcggcggtgcgcgaataacggtggcggcgccctctcataccgcatgcgactgcggctacacccttccccaccacaagtggcggcggggtcgcgcgagcggcgtcggcggcgccctcccataccgcgtgcgacggcggcgacctccttccccatcacgagcggcagctgaattgagataagttttgtgcgctttttattatttttcccgttctttttcctttttttttattgtccgattggatttcaaacggatttacggatggaaattgaatgcgacgaaaggaaaaatgctaatcttttaattagttatatatatagagagaggacgtgtctactaactaactaccttaatctcatatctagttgttacacccaaaagtgcatgtatttttttctacttatgaaattttcttttaaattacttatccgattacaccattacgttcgtaacaattaaatctttataaacatttcacattattatatttttatgaaaaaaatacaaattacttttagatttcattaaattattcttagtcataaaactaaatttaataaagcctgagagtaatttacatatattatataagtaacttaaaacaaaagtaaagtaacttgttatggctttaaaagaaatttattgtgggggtaaaaacataagtgtatctagaaattagatttaatcaacaattcaacatatcatagttacccccataacggatttacttctaatgtcatgacaagttactttctttttcttttaagttacttctataatatatgtaaattacttttatgttttattaaaattacttttatatgtctaatatgtaacttaatgaaatataaaagtagtttattaatcatgtgaaatcttgttataaatatttaattgttacgaatacaatggtgtaatcagatcgtagatcgggtgagtaagttaaaaagaaaattttatttgaagcataggttttcttatacattcataatgttgtgggttgtttattctataatcatttttagtcaatgaaataatttgtgctaattaaatttaatttctatatagactcatgtttttacctccgtaacagatttacatttaatgtggtgacaaatttactttctttttgttttaagttacttctataatatatgtaaattacttttaggctttattgaatttacttttatatgtctaagaagtaatttggatatattataaagtaatttataattttcatcaaaatataatcatgtgaaatcttattataaagatttatttcttacgaacacaacggtgtagtcagatcgttgattgttgtgtaatcagatcgtagatcggatgagtagtttaagagaaaattttatttgaagcataggtgaatagggtctctcattagcattaaaatgagaggcctcttgatttagatttttccattctctattctgaccgactcgcccaatcgactaattgccgttcagttggggttggggaggcggcgctgggttgagccgacttggctaatatttcgttcacgtattattttttgagcgtaaagagatattttattaatggcagaacataggattacattcatggttaagcggtacaagaatttctgacggagcctctactttgcttcaactcctgatctcataaccatttgagctaaaatatgagctatgttatttgaatctctctttatcttgtgcacttacacctgcaccagacattgcaccgcagcttttacttcagcaataatacctctccattctgctcttgagtcttgtgttgcattcagtcctgctacgacgtcggcgttgtcggattctaagattattggcatctgtacccaattggcagccaattggacaccctccaggcaagccaaagcttcagcctgagcagctgaactgcatcttgatagtttcttacaagctgcaagcagaaccaaacccctgcaatctctagcgataattccagcgcccgcttcacccatctccttattgaacccagcatctacatttatctttgccactccctctggtggaggttcccatttcattttttgtgcagcattgatttctgctctcgctgggggttcttcaaacatcggtcttttgcccttcttatcttcaacattttgtcagacaggcaacatgcacccctcataattggccaagaagttaactgaagctgctattggactgttctcacttccatgcatcatctcatttcgaaggtgccatgctctccacagcatatatagcgtgtgtgccctttctatctcgttcgattcatccagaagcagcaaaagccaatccggtccagttttaacaaatttattttcgaggggtagtcgccagacatctctcaacaccttcctaagtgctttggctttagtgcattcgaccgttgcatgaaaaccatcctcatcagttaagccgcacatttggcatgtgccctgtctttcaatttttcttctgcatttgttgttccaggttggtaacctgtcaagagcaagtttccaggcaaagatcttgaccttggcctgtacctttgttttccatatggacagacaaagtttcctttcccctaaaattgctctacttgaggtagcttccacaacattcctagacagattccaggccaatctgtaagcgctcttaacagtgaacaggcctgttttttccaagtgccaagcagggaaatcctcaagttggcgagtatataatctaatctttagaatctcatcagcatcttccttcttcattacatggcgaatcagattttcattccaactcctggaatcaacatccatccgctcggcaccgcccgccgccgccgcgtcctccccgcgctccgccaccgcccgcacaccgccgccgcatcctctcctgccgccaccgctgacctgtttgagagagagaggaagagagagagaaaagagagaggatgaggagaattgcaggtgggtagcacatttttttaataactagagtgctgactgggctgtcacgcgtatgccacgtagaccaaaactaccgcggattgggtcgaggggggtaatttgtccggtttgtatagttgggggtgaagaatgcctggttttgtggttcagggggtaattcagacgaccgtgatagttcgggagaggggggtaattcgtactttttcctttttaataaaacaataagttcgcctagtccaaaagtttttacagggcatcaagaccattgcaacgtatgttatctattgcaaagtggactcgggcattgcaagatactcaatctttgcaacacatgttctgcaacacatattatctattgcaaattggactcacccactaataattgctagggtcgcatttcagcaacgcatgtttaatgcattgccaagcatgtattgctagaggggggggtcctgttgtagtgtaacagcttgaaacctaggattatgagcagttttaatgtaattttcaaatgcaccactctcaccaaagtttaagggtaaatcttgtctagcaattaggcggggaagagattcttgagctaccataggatcgtactcccatgtacgtaccaaaccatcaggatttagtagcagttgttgttatcgcaactggatcccttgcttctttgcacaacccttagcatgtcatctcaaagtatcctgttccaccatatgattttgtggataaattatgcttgcatattctacatttcgcgtatgttacctgccttctgtcaggacctgtcaaggcggtcacctcatcaaaatgttgccaaacctccgaagttcgtgatctctttgagacagtgttcgtcgatgtagtcccactcatagttcatgaaactcctgaagccctcagtacctcatccaaaatcggtggttgttaacgaccaaatttggtaatccaagtatcggagatgaagatgggatcgaagcggaattcgagatggagatcactctggaaatagagaagggatcgactgaagttcgaatcggctgcgaccaggatcggccgagtccgagttggacatggttagccgattgagccgaatccgacaatatgacacggcatacattgtcgggttgagttgatgtacttcatgaggattgccacgtatggatagagtcctgagaaggcaattgtatctattaattagatattttatgtaatttccttagagatatgtttgggcaaaagtctgccgcaaagacttatggtatcttagagtttgttagagataagagtcgtatccgacatggacatattttgtaatctcaggtataaatagaccccgagctccatgtaatcaatctaacacacgttcaatacaatctcggcgcatcgccacccttttactttcgttttgtttcgacgagttcttgctttcgggttgagctgcatcggtttcgatcttcaactagaggtaaaacttgttatggcggcttgcgttctcgggattagtgcttccatctttatgatactctaatcttgtttatgtaactcgtcgagttatcatatatcttacataatcttcggcaatatcgctatctaaccttcaatcggttagcgtctgttattagaaggcagccgattaggttatatatcgacgttgatttagattatataggatatctaccactttatgaaacatccaacggtttgattatctagatattgtccttcttttcatacttatagctgcatcagttgagttagaccttataagtcgtgattagaatctcaatctctagtctgcttttggttgccaattagagtagtatcggggtttcagccgatctttcctgatttaactaaatttttcctatatgtttgattgacatattaaatctgccctttatcttaagattttgttgcatttaagtatattaggctttcgtttgatatattttacttgctttgatatcttaatatagagtggtatcggagtattagccgatacatgctagatctatttgatcggctatgctataaacatatatagtcttgttgttaatatatactttgatctaagtgatttatattgtctcggcatggcgaccgatctatcccaatcacttgatttaaatgtatatcgacataaggattatatattattaatatctacagccgatcgagtagatttagttctttcttacttattcatgattgccgatcgatccacatatgacatcggctcaaagataaatgatatgtcatcggcaactagccgatcgactatcgtttatggatttaacagcggtttctttgtctttgtttctcgttgattgcaggatcaaatcaactggcacgctcatacacctaaaggcaagcttttggacctgcactggagttaagcagatctcccaggcctcatgtttttacatcaacagttgtgttggcgccgatctggtggcatcatgcttgctaggtgggaatgaccccaacaggtaagtaggctcgaagccagataacgtgaacaatggataactcaaatcgcccatgctgaaatattacaaccacatgcacaaaaattcagaaactttattcatataacataaaatatgaataatgcaaaagtattatccacttcctttcttacctcctttacaccttgtgcgtgcagctttgttggaaaattgtactccacaaactatttttttatttttgaacataactcagaaaatcgaactagcacacaagaaaacacaaaatggggggtttggatgatccataatgttgacggtgcgtgccatgtccattcttgacggtccttaaatcataatatctgaccgtcaatacctgcatataatgaaataaaacatggtatccaacttagtggtaggtattattactaatcatttccactagtgttggtgaaacatgtgtatgcaggtaatttgaggagaaaacacatccgtcatgtgacaaaatgcacctccgcgcattcaggacgcgtttacacggattggagggccaataagtcagtaaaaaccatttagaattgggccaaaacatagcccaggttgttgggggcccattaagcaacctctcggtcgaaggagaggccgggaggagtgtttttgggtttggccgaacccattagttcggccgaaccattcctggcgcctcccgccatctgcttccacgtggacggcttggattcctcccctatggcagttgcatggtgttttggtcatttcccatacccctaaccgtcatttggagcctatataaggaggtcttcatctcacttcaagaacacacaactttgagctgaattacaagaggctctattgtatcttttgtacattaaaataaggtagagagtgaggggaagctctagaggagtgcccggaagtttggcgctcatccgacttctacctcgacgagtgtagcttcctaggaggaattctggaggaataccggagttgtcggtacactctgctccgggctcagagaaacttcttctattaaataagcattcatgatcctttcttatgttatttaattacttaatctgaataagatatatttccatctttgcgggttcattgtttagtattcatattaagtgctctagtactaggattctggataaagaaggaagttcctgtacaagtattagagtagtaattaataatatagacgtggtgtctaggttagagattacctttgtttgttgtgtatatcccatggatttgttagaggtagacgtcaggtggtgacagccctgaattccgtcccagtaatcctccacgttcagatacatcatagagctatagccggaaccacgctggtaggggtgggcccacttcaattcatgggtattcaaatgaatacccaagattttggaacaaaaaaatacatatatgaactatatattccatatgtatacatagaaacaaaaggaaaaatgcttatatctattcaaaactcgaaagaagcccaaacttaaccctcccaccacccaccatttcaggcccgttggcccaatagcaaaaaaaaaaggcccaattcctctctaaccctatctcatctcctcacctccctccccttcccatcctagccgccacgcccacaccgtagccgcacacgccgacggagccgtcgccgcgccatcccagccacctgcccacgcgcctcgccgtccccccgcgcccacgctccttgcccgtcctcgctgtcgcgacgtcgccgcccgccggtcgtgctacccagccggccagcctactagtcgtctgcgcgcgcgcgcggcgcgcctcgccgtcgcccggtcgccggctgcccacaggccatagccggctccgcacctcgcgcctcctcggccttcgccgcttcgccgagtcgccggacgtcggctcgccgcctccgcgtctccgcatgaccgcacctctcgcctggccggcggtggcacctcgcgcccggtggccgcctgcacgcctcgcgccctcgccgcctccggcctcccatcctccgtccttgagacctcaacagcagtctgcaacggtgagtcggtgcactgaagtgttgattattttagcttcatattttgtgaaatgtgaatgactatctagattactagattaggatttaggaaccaccgaaccactactgctttgctcaattgctctttgataattgatattgttgtttgtatgtttgaaacatgaagagaaaaaaggttcccatggttaatttaaatttgatatgttttgtcaatttatagtttagtaatgtactctaatatgtttaatgcattcaatttatggtaaattctatccatttatgactttatgaactcatacttataccgttacatattatacaactattagaccttgggttagaaaattttctctcttacaatttcgaatacccaagttgcaaaacctgggcccgcccctgcacgctggcagaccagcaggggtcggtgctcgaagcaatagataggaaattacctttaacttagcttaggtaactaaaatacatagaaagtcctctctagcctgcctagcctacctttagttgttgtccttggatagtcttagccttaggtagattacacacgttccctgagttcgatatccttttggggtcacccgaaggtgaagtgctacagcggtatcccgtgcgcttgcggatttatctgtggttgtaagaaataccaacatccataatgctacaatgttcacttttaaatctcgtgcgatttccattgggcaggcggggacgcgtgagcgcgagaggattggcgtgcggcaggcgtgtggcacggcgaccagagcgcaatgagattgggttggggcgcagggcaaggcgccgcgggagcatgcatgcgcggagattgggcgagagaggtgatgccactcgtgctctgtcttggcgggggcttgcaccatgcgcgcccattggtgttgacgggaagtggcatggccgcatgggcttgatgtgacggcctactataggaaccgtgaagtgtcgtgccagcccacgggctgcaacctcggcccaggcacagcacggcccagaaacttccatgaccattccttgcagggccgggtactgtagtggtgtgccagggccgacccattaccgttcagcccatttggtcagctataggctgggataggtaggcccctcttgtcatcctcgacctccagccgccgctagctccaccctatcgaaccctagcaccgccattgccactaatctcatcgctcccgatagtttctacctacgccacatgggggtggaatactcctcgtgactccctctcccatttcccctacttttaccattccatcttgcgctaaatcgctcacattcaatcacgttaatctcgccggtgccattgatggaggccgagatttctatcgtcgtttccctctctccttggcctctttccttcccactaaccgctataaatcgatgtacgcacctctgtcgccccttttcgttcgccattgtagctcctcgcgctcctattttagctcgtaccatcactccctctctttgccacaaccgtcgacctctggtcgggctttgccgccgtccgggacctcatctcaccttggcgtcaatgcctccagcttcgctgcatcgccaccgacattgtctacccattcctcttgcttggagaccgctagaacctcgccgtccctatcgaccagagtttgtctgccatcttcttcctcgccggttgttgttcctccgccaccgtcgcatttgggtgagccatggacctctctggccctttttcctccttcccccatcaccacgcctatggtcgccggtggtgtccataggggcacgggcgccgcctcccaccggctgcgcctcgtggccgcttcacgtggggcccgcccatcagccaccatcgtccgcctcaggtggctgacatgtggggcccgtgagcgcccacccggtggccggtgcgtgcacccgttccaccttggtccgtgagaatgacacataggtcccaccccatggactcgatccatgcaccatctctcctctgctggcacaataaatcatttttttaatcacaaataattcaagaatttggaaatattcatttaaacaacacctaaacttcgaatatccatatcttggtcgtttaggctcagagttgatccgttcaagtctctatttttcccttaagaagtcaagaactcatttttgtgctttgttactgtgtcttatgtggattttattagagtaaaagcatttttcctttccattggtcgtgtagacgctataagttcggaagatccgttttacttttaggaaagcaagcaaggcaagtcacatctcgattgaaaatattgttgtccgatgattttaaaagcattattttaatttaaattattatattactgctttatctaaattcccgtgttataattgttttatttagccattcttactgcttttgttatagctctattattacttagtgaatactactttgttcaccctaggcaaaaacaaaagccccactagtgaggactctatatgtagtacctctagtgaaactagtgaaagtgtaggtagatgcttagcccgctaattggacaattagttatttcacaatcttagattttgggagttgtattaacatcattgagacatcattaaagtgtaggtagatgcttagcaacgcacggggtttctgctagcactaacaagtgagagagtccccataggccacctgaaacaaaggagtaatgggctgaaggggtaaccccagcaaccaagcaaaattgtaatccagaaaactgtgagacctaccagaatcaactaacattagcaacactttgttttgcataagggttctcaaccgaatagctctctgatgactagaacttgacaatacgtacagagaaatactcctttcgttttttaatagatgatgccgttgactttttctcacatatttaaccattcatcttattcaaaaattttattcaaatgtataagatataaatcacacttaaagtactatgagtgataaaacaactcataacaaaataaattataattacgtaaatttttttaaataagacgaatgatcaaacatgtgagaaaaagtcaacggcgtcatttattaaaaaacagaggtagtatgacaatcctcctcatggtcagactcttcctcagctataacagcattcaacaactcatcaggaatcacttaagtaattttcattgatctgatctgaccaatcactgcgtgcatgtgtttaggagaatacttatccccacacttaaagcagagcccattagctcttctctttgaggtttaatggccaatgtttcagctacagcaggtaacccttccaacgtaggaccaaccctcttataagtcagtttcttcacatattgctgagattgttccaacgaaacacattcttgtgtcagagcaacagcggctgcttgctgaattgtatcaggtaattaagtggaccatcactgcatttcagatttcctcgagacccaacacaaaacgacaaaccaaaatcatgccacccactgagggatcaaacaatctcactttgtaaactaatgaatcaaattgttgtttatactcagccacagtgcatgtctgagtcaacatttccagagctagcgttttctccctgtgtgtgttaccctcaaattccagcacgactgcataacgaaaatgagcccaatcgtgcatatcttccaccaccattgcgctgcatttccagtcagatgcaacacagttgtagaaacattaaagttgacaggaattttatacttctcaaaataagtttcacacatcaatccaaatacgcacataatgccgatcaaaacgcgaaaaatccttttttggcaagtaactctttgatcaaatactgccttcatgaggtctacttgattcagcctcaggtggtggtggtgcatcagtgctggccagagaaacaccgaaagaggacccaagaatagtcacttaatcttcaccaacaacatatgtaggtgtggaggcgatctgcttctgcagccgcgcagcttgtgactggtcctgctggctgctgcatcttccccaccgaatccaatgtgagatctactttggtgatcacttgatccaatcgcccctctgctcctccatcttggaatccagcgtatcaatccactgtgtgagtgtgcccaacttctccatgagtttggcctcccactggtggagtgtggagattatgggtaccccatacccacatggcatagttatccgactggctataggggataacttatatctatggaatatgtaacagatcatgacttgggtattacgtttccttgtatgttacggaacggcctaaagtcctggtttgataatattgtaaagtagatttaggaaaccgataccgtattggttaaggtttctatcttgtaatcctgccccccaccctatataaggtgggcaggaggccctctagggggcatgagacaacctgatcatcagatctatactacacccggcggattcaaatccccaaacaggagtagggtattacctctcattgagagggcctgaacctgtctaaatccttggtctctgcatccatccacttttaggtctcgtgcgctacccccttttattattgccgaaatcatgtttcgacagttggcgcgccaggtaggggttgcgtcgagtttcctatcaacgagcgcgatggaatcaatttcatgagtcgccgacttcgctttcgctttgggagttttcacttcctttccgtcgaccacttcttcaagctcctcttctctgacttgatccaaatcagtcagggggaaactcaatctgatttttatcattatttatcatattgatttttaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaatgacttcaccgccggcctgcctccgtcgccgccgactggtgtcatcgcctatacggttggtcggtcacaccaccgttcatgggcgtccatgtcttcaccgaccggctggccttcgccgccgccgactggtgtttccgcctgcacggctggcctattatgccgccgctgttgggcgtctacgacttcaccaccggcctgcctccgtcgccgccgactggtgtcctcgcctatacggtcggttggtcacaccaccgttgatgggcatcgtcatctacaccgccggcctgcctccgtcgccgccgactggtgtccccgcctatacggtcggttggtcacaccaccgttgatgggcatcgtcatctacaccgccggcctgcctccgtcgccgccgactggtgtccccgcctatacggtcggttggtcacaccaccgttgatgggcatcgtcatctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgtcctcgcctacacggctggcctattatgccgccgctgttgggcgtctacgacttcaccaccggcctgcctccgtcgccgccgattggtgcctccgcctacacggctggcctattatgccgccgctgttgggcgtctacgacttcaccgccggcttgcctccgtcgccgccgagtggtgcctccgcctacacggctggcctattatgccgccgttgttggatgtctacatcctcaccgttggctcaccttcgctgccgtcgactggtgtttccgcttacacggctgacctattatgccgccattagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagtaaactccgatccgtgaaactttgttccattaatgacgaactcatgtcactcatatgcatgtttgggaagtgcttaggccgactcccagtgcttggtggctatgactagttgggcagagcgtttaaacgtaatgagtcatctgctcggggaaatcaaaattgacaagaggagaaatacatgtttataaatattttaaaatacttgattttttctcgagtattatatttatatcagatactactcatcctatatgtttgttctgcaggatccagatccagatatgcataaaagggattcatggctttaggcttatctcttacgctccaggaatggatcagtcagaacatcaccgactggcttgccttcgccgcggccgactggtgtttccgcctgcacggctggcctttatgccgccattgttgggcgtctacgtcttcaccaaccggcttgccttcgccgccgccgactggtgtttccgcctgcacggctggcctttatgccgccgctgttgggcgtctacgtcttcaccgaccggcttgccttcgccgccgccgactggtgtttccgcctgcacggctggcctttatgccgccgttgttgggcgtctacgtcttcaccgaccggccgcctcgtccgccgccgactggtgcttccgcctgcacggctggcctattatgccgcctttgttgggcgtctacgtcttcaccgactggcttgccttcgccgctgccgactggtggttccgcctgcacggctggcctttatgccgccattgttgggcgtctacgtcttcaccgaccggcttgccttcgccgccgccgactggtgtttccgcctgcacagctggcctttatgcc

SEQ ID NO: 83087 - DNA, 2705 bp, Oryza sativa
acgggagggagaggggaaagagcgcgggagacgcggcgcacgcgcgggcgtggctgacgtggcccgggagagacggaggcgtgggcgcggcggcggtttcggcgcggcggcgcgccgggatcggcgggaggtgggagaaagacccgacaggtgggccccacctgtcggcgaccccgagagaggaggcgggcggcggctgccaagctgggccctcggcctgcggccggcccagcaaggaggagggggaggaaggaggggaatgggccggcggcccatccgaaaagaaaaaaagagggaaaaagggagggaaaagaaaaagaaaaaggaaaaggattttccctggaattaaaaattgcactttagtgatttttaattggttaaaattatttctagagctctgaaaattccactaaaaatcctgttaatgcatttcgacatgtagaattcaagaaaaattccacatgtcaaatccgattattgtttgcattgttttcttagggttttatcctgatttcctctgcattttcttggggtcatttgtaatttacaatttggcttgggaggaaaacttcggggtgtgacactggatcagaagcacttggttgagtttcagaccgaattcttggtcctccgctcccttgtccagtttggtggcggggagatcggcgttgagcgattgggggatccgacttcattaaagcaaattcctgggtgtaatatccttcattgttaactgattcaacaagaaaacaagatcatattttgagaaaggttgcagtgtatgaatacgtaccagtggaggagggttgaatgcattgaatggcacaacgggcagcagatgtgagtagctgacaacgatggcgttcgagaagatcttatacatcctttctttcatgaccttgaagtcaagagaatctggatcttcacgatttgggtcatgcttgccgtcaaattcgaaggctgtgcgagatctttctttgattggagctaaccgacacttgataaagtgccgggtgatctgttccccttgaaggccctgttctttcagctttatcatcctctccatcagttctactgcttgtgcagcttcatctcctattggcagtgagttccatgtgtcctggtaaaccgaaggaagacaacagtactcggggagtgcgggctcaggattctgaacatagaaccagtttgcatgccagcctttgtttgaggttttgaagggcatggagaaatatttttggctcaaggttcctctgagttggaaaccagctcccccaacaacgcacggtttgcttttgtttggctggggcttggggaagaagatgcggcggaacaaagcgaaatgaggcctaatgcccagaaaagcttcgcatgcatggataaaattggcaatatgcactatggagtttgggttctagtgatgcaagctaatcccgtagaagttcagaatcccccggaagaatcttgaggttggaagagaaaatccgccatagaagaaatgagcaaataccacgatttcatgtgtatcgggggttgggaatgcctcaccaaatgccggtcgccacccgatgatttcttttgctggaagaacgccgtgcaccaccatctccttcagattatcttccgtcacatcggagggcgcccactgactctcgaagctttctctttcttccgccatgaatgtgaaatggatggtctgatttagttcgagatatggctggaaaaagatggggaatcggagcggtgaatgcggggagaaatttcgtgaagtttttgagggcggattggagcggattgatgaaccctagtttgcccggcgcagttttgcactgtagcaagaaatggggaaaatggcgagagtctcagcgggaagacgaagagacgtttttcacttcggtattattagggtatcgggagtactaatgggcctgggcctgtacagtacttcagcccagtcttatttccagcgtggcccgttgtgatccttagggacttaggcactttttgctttggcaatttgtgttcacaatgatgcgacccaatgctgttaaaatcctttttagtgcggttttataattctttaagaattaacacgatgcaaacaaaaggtgcccaacagaaaggtgttataccgtttttgaaagctttattaggctgcaaaggctgtctgggttgatttgagatgactggtttattaatagtcattcttttaacatgttatatgcttattttggttatggtaagggtcacagcctaggctattggactcattaattaccatgattttctatcttgtttggtgggttattttacgagattttttactcggattcctatcaaacatgtttatttttggaccttttgagtgtttatcactcggcccttcttgtattttttatccttgatatattcaagttgagaaggagtcggctgggtatcttagtaagtaccatgcgtgcttcgctataaaaccactcggttcttgactatatgtttagtttttcaactaatcacatagtcgggggctacacctaattaggtgcatctactcgatgcaccatgttttattttcgccctttgtagtctttgattttagcactcggcaagccggagcaagttgaattgaagcactcggattattgttttttgtttcgagaagactattttggtcaactgcgaaggtctcgggggctactgtggagatt

SEQ ID NO: 83088 - DNA, 8393 bp, Oryza sativa
cgagacaagggagggatttaaattgagatctttggcacaacttagactcaacactcaaggaacgaaattttcgcaattaggatttttgccgaattagtttttaacgtctcacgaaaagcggagcgttacagatccaccccccttacaagaatctcgaccccgagattcgacggtggaccacacacatgaaaccaaaaggggaacttcaaacttcttcttagcttcatactctgcgggtctttctttatctcgagactgcatacttgccacaaaacggtctggtactctgactcacttagcagtctcccttttactgtggctctgatcttgcatgtggaatctgttcttcatctgctctttcaacttgctcgagattcaaaacttttccctttgtttctacttgcacatggttcagacgactttgtccaataggcggtgaggtcaacgaggcagaaccactgtttggtggctttgaactttttggtccagatacgttgggaaggcttgttgttggttgaacttgctttgacttgactttctgagggcagtaccatgaatagtgtctcatctcatggcagatgaaacattcgactcatgccttataaccacgtctttttcaaggtggagggcatggtacggaattgcttccttcaaggcttttattgttgatcactatggtttgctgactagattttgactttgtcgaacgagacgtagaatcagaaccattggaatactgagattctccctgatagtactgcactggcgggtctatctcttgacgcaaaccttctcttgcttgatcctctaaggacattaccttgtgcttcttgtagtcctgcatttctttttctgcatcttctagtaacaaggctttattgaccatgtgctgaaacgttggaaagtcgtgagctaaaggtttcactcgcaatttcgcttccgttccttttagaaaccttttgatcttcttcttatcaatgtccacatcttccggggcatatcgagccaatccgttgaagcgactcaaatactcgttgatgcaagaggatccttgcttgatatttgcaaattcttccttcttcaaatcaattatgctttcagggatgtgtgctaagcgaaaggcttctgcaaactctgtccagatgatggtactagcatctgtatgggtagcacagtagttatcccaccaatttgtggtatgtcttcttaactgatgtacggcataaaagggttttcttctacggagtgcactgcaccaaatttaatttcctttccacatctttgatccagtcattggcttcaatggtctcagttgtttgggagaaccccggtgggcgagatcttaagaattcgttcagtcttgaccgacaattatcttgaaccatatggggttgatgctcttgcgtgtgttgtcgttgcataacaactatattctgaatcattccttgtaatatctgggtttgcatggccatgagtgggcaaaagtccactgttggggggctgatttctgtactgcggcatcattagttgatccagaaacaactgcatgatcacttctcaatctgttgctcatctgctaggctaattgactgatcgggaatttctgactgagctgacccttctttagaaccagggcggttaggggcacggatctgacggatagaacaatgtgccattggcttcagagtgactgagatctgactgaaccagaaatgggataagaaaagaaggaaaacaaaaacactacatcaaaacggttttcgaaatcacagaagacataggtggtgtattccagtcggtatcccaactggtctaacacctgaacacggactaccaaacaaaactcacgcacgcactagttcaccacaactcctaccgagcgggtgacggtactagggtctgcctaccaacgagggcttaactaagactcctagaggcttgagctcacctttcttcaactgggcgtgaagacaggtttactctaggataaaggtcaaaacactcgactagcttctacttttggacacgaaaagatttttcgcaaaactagagctaaaggggacaacgacaccttagctttcacaaatagtttttttttttggtactcaaataatgccatcctattaaggggtttcgatcctagggccaactaatgctctgataccatctctgtcacaccccaatccggcaccgccgcacaacggcacctgataggagcgtgtcgtaggaaaaacggcgcgaaccgcttcctacgaaaccgcgaactcggtaccagtcccaggacatagtgctggtacccacggtgacaaatatgaatcattgcaaatccttagaataaatagaggacttatttaccttaacttaggttgcagctcagacagcccgagaatgcaaccgacgacacggacgaggcgaacaccaacaacagcagctgcagcggaaccaacggtctaacacccaacaccacaggcgacggctgggatccaggacgaaaccctaatcttcgcttcacttcatcttttcttcaagacggaggaactatatatatatttatatagagcaagggtgagtacttacgtactcagcaagccaggggaacttaggtggttaatgcaggcttaaagggaaggctgttattttgcaaacagttttgttttcaagttttcaacaatctaagtgtgtgctttccacaaccagagcgagacaagtctcagcttggtcgggaggtgagaagaacaaatttatttatcaagatttgcacaactcccagagttggcttcaaatctggttttttttcccaaaccaaaccaattttccaaacttcccgataatagtggtccccaaacgaccaatcacttccagggacacccggtcccgctgtcccccggacagctaaatgcttcccaagcattaggtttcccaaaccttaacaccttttcataaaacagggtaaaacaaaaactacgctaaggaatcacctcacatccgcccgtgaccgtgggcacggctgttcgaacagtttgttaacctctgcagagggggtacactttacccacacgacattactaacccgaatcacccagcccgtgtagaatggccacgtctggtgacctaagggctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccccgattagcaatttactcagccaggggcgtcccattccacccgtgtggtcgcactattgtatgctcggatgtaattccaaaggaatcggtccttagatgcgaccgcacaagtattccgcccaggaatggccttgtgtcgcgagttttatttttaaaactcattttctttcacaaggcaccgacccaggcgtcgggttttccaaagcttttgcaaaccaagttttacccaagaagttactcagattttaagtttgaaggcgaccgttgatactcgcacagagtgcacgaatatcgaggcgcaactagatggttacaagggaacatgatataacaattaacaatggaaggatcagatgcaacaagttgggtaggcccaccggtctgcctttcagacggggcaaacaaattaagtgtaatcctatcaatgcataatattttgcaagcaatataattaagttcaaatataggctcagtatgttcaagggtggcttgccttgctcagggtcttcacgaagcttcacgaatcttcaagatatccacgatcgacgaaaatccggtaaccgcaactatgctcaaacaaacaaaaacctaaacaagagaccaagaaaaagaccctatttagactaaataatagtgccattaaatagatctcaattttatggaaatactggaagtggaacggggtcaatcggacgattggatcgagagatacgaattttggaagtttaattagaatttctggcgaaggaagatatttgtggaacaaggggggattgattcatgaaatttatagaaataatattctcaagaatattattgaccgtatctgacgtgcgggaccaaaggaaatgatttataaggaaaatgattcatgaaattttggaatagagaattgttttataggatcaagggaaaaaagatttattaacccacgaaataagataaaatgatttactgaatttatagaagagagaattatttgtggaatattggaaagacattctcaagattatctttgactcattgacgagtggggccaataagaaggtgagagagagagaggagcaattggagggagcaattgcggacttttagctcttcggtgtgtgagcaccggactcggaagagggagtaaaggtaaacttcctttgttttgttaggccgaggaggaaggctggccaatgggccaagcccacgagccaggggagagagggggagggggacgactgaccggctgactgggcaggggcgggcccggtcaatgccacgtgggcagccacgtcggatggggagagaaaaaggggggcgggaatggcatcggacggctcacggcgcgcggcggaatccggcgaacggcggcgagccgaagcgagcgacgaacaccggtggctagaggaggtcaaggcgaaccgattccacggctcggattggggagacgacgcgtgacgacggccggcggcggcggcgaagctcgccgggatgccgacgtggatgcgcgatgggaagggatgcggctcgcgcgctcgggtttagtggacgcggtatggggttgcggcgcacatgcggtgacgcgggacccgacggtcgccgggctgtggctcgcggcggcgccttgcggcggcgggaggggcggcacggcgcgggagcgaggaggaaggtcggcggccagggggaggggttggggaggtcgagggggggcccgaggaaggtggcagcgccgggaatcaaggataggagggaggccgacggcaggggaggcacagcggaagtggccgagcgcggcagcggcggatcgggcgacgcgacgcgagggcgagaggggaggccggcggctgaaacagcggcttggggaggtagcgagggaactcaagaacggcggtggctagaggagtcgccgagagggaggccaacggcggctctcgattgcgcacggcggcggaaacagagcacgcgcgacgcgagctacgcgagtgctgggacagcgggaaagggaggtggggagctcaccgacgggaggtaatggcgtcggcggcgagttgaggatgggaaggccgatggcggcgcatggacgagcagcggcgcacggcgacgaacgcgacgccgaggcggcatcgcgtcacggcgggcgtgccggggaagggaacggaggcgtgcggtggcgcccttggtcgcggcggtggcattcttggccgcggcgaccaagaaggcggcgacgctccggggttggccgcgcgacggcgaccgaggttgagggaggaggcggcagaggacggaccgtgcgacggcgagatgtcgccggacatagagctcgacgcgacggcgaggagttcccatggcggcagggctccgccgcttggggggggaacgaagcaagggagggaggaagcacggggggtgggttttatagagacggagtgggagcggcaaggtcggttcgaggtggccgcggttttctcggcgctcggctggtgttcatgggcgccgcgagaacgagctacggcgaggatgcaaagggtggtggaggcggtggatcgtgtggtggaaatcgaaccgcgagcacgggaggattggcgcggggcgagcgggtgcggtcaaggtgggggcggcgaggcgctgcagcggcgtcagcggctctgccttttgaacaagaagccaaggagtggaggcagggagctcgctacccgggaggggaaaaagcgaaaggaggaggaggaaagggagctttgctccttccggtttgggaggaaagggatgagagcgagccgcgcctcacggttttggatgcatgcggcatggggcgccgggcccgggaggatgacgccggcgacgactgcaaaaggacggggacggtttgaaggcaagcgcggacacggtggtcgtcggggcaggcgacgaccgagggtggcgatggcggcacccaggcggtcggccactcgcacgggtgcgcgggaatcgaaggaggcagccggaattttgggcggcgtcggcgggaagcgacgccgagagagagagagagagagagggggggcgctctctgagggagtcacgtgcggcgcacgtgcgatggagaggctggcgaaagaagaggatgggccgaggatggtttcggcccgagcgagttggagggaggcaaaatagacttttactggaaggtttgatttggagagaagtttgatgtggagattgaatttgaatttaatttgtgtatttgtacacgagggttcaaggtggatccaagggaggggtcaaggaagggcttcaaaagcgggaattttggtattcttgggatggatttatatttggcggcacgaaggattatttcagaggatttcaaaaagggaagatcattattcaaaaatggaacaagggagatagcggtagaatgccatggatagatagatagacagaaaggtaggttgataggtagagggacggatagacagatggattgacagatggatagataaacagatagataggtatagtagatagatagatggatcgatcgatagatagatagatcgagactccgagagagatgggatggaagagaaggaagaggtggatcggaaaaagaaagaaggaatccaacctatgagggaggttaaatagactttcacagagagatttaattgggagattttagagttggagtctagattcgaatttcgaggttgatactcggtctcgggagaataggaaggagtcaaggaagggaacaatattcggagacgagtcaaaaggggatggataattcagagaaagagagtgtaacttgggagtttgagtttgactattcaacgagatatgagggtaaggattttggagagaagtctgaatagaagggttcggacattcgacaaagttcacggatggggttccaggaggggattccgaatagaaggaatcgagcttcgggactacattgggatggtaattttgaggagacgatctttgataacagggtatcgagacaagggagggatttaaattgagatctttggcacaacttagactcaacactcaaggaacgaaattttcgcaattaggatttttgccgaattagtttttaacgtctcacgaaaagcggagcgttacacggttattgcgataactatatgattgtcgtgaaaaaccgtacggttaccacaaagattatcgcggattcaagaaccgagaagatcaccgtacgtgataatcatgataaccgcgcaagttttacaaaccatgctttatagtccatagcatcttcttctctcattttgctttctccctgatatattgttagagcagctttgttagagtatagataactctattggattcaattgttatgataggatatgattagttgtcattgaatctatcagggctccttaagatctaaaccatgtactccctcaaggttcgatacattaatccacaaaatattacaacacatcttctatccatacacgctttcacatatgatcgtttggaccattgaaggaaaattgaaatgacagtagttgtggagtttagtgctaagaaggaaaacaagggaatggagcttgttaactcgccatgggcagagagagaaaaggcaaacaaaagcaccaaagaggatgaatgggctggttcggctgcgatacagccgtctggaaacaatgctccgtgtaagcaaccgtggcaacaaaactgtgttttagtgtctacaccttgcagctgaataggcccaatcataacatagggaagttttgtactaaaggtttatgtgaacaagcttaggcattgatatatcgcctcaacccagggccgtgcacatgggcgtgcgacccgtgcgaccgtacagggcctctaaatttccagggcctcaaaaaatcagcccaaccggagaaggcccatgtattcgtgtgaggccagagcgccagaacccggtacgagttcgcgctttctccgcgcggcaatttcgcgtgcatggtgctttgtattctcgactccgagctccgaggccccacggtgttttgcattctctttcgttttcgtatctgtgacttattcagttcgtctcgagtctcgacgtctcatctcctccgagtaccaggctgccagccggctcatccaatt

SEQ ID NO: 83089 - DNA, 719 bp, Oryza sativa
caatacaagctaatagattcgggtactgttagtatcatagaatgcacaaacacattataagcaccatgagaatttcatagtcatatttagcttaatcatgaactcaaaacgtaaacatgtttcataagccatgacaatgttatagagattatgcttatctgatattcttgataatacgaaactggagtaccaaattgaagatcttggaaacttgtgtgcatattaccattttttccttttttttagagaataaatgttatgactgctgctttctcactgtaagtattaatattaatttggaaggaagcatcttaaattaaattcattacaccacagtggaatcttgaataagtacctccaagtgtctgctgttagtcatgttctgtgaggtgttcccagtaggcatctttttacttcctgccgcatcactagtgccatgaaggcgttgcaagagcttctggcttttagctttagcttcagcagctttatttaaagcatcttctgtggccaagaattgctgaacatgttctttctgcaaggtaaataaatgttatgtggaagttaacttcagtgacatgtacttcatttgaggtggtaggcataaggcattaacacagaattttactagcctgtggagaaagaagagcttgatgaaatcatgcagcttctttttttttatcaagaggaaagaaaaaacaatcaagtgggctgcaggaatt

SEQ ID NO: 83090 - DNA, 669 bp, Oryza sativa
attcctgcagcctattgtgtacacgatgtaaactattttggatgtattgattatccatataaatcaattgttgtatggcatatgttaattacgtacaattattagaagttttaacaattttaaatcatgtaattgctagttatatgcgataattagaatttttaaaagtttaaatcatgcatgtggcatttacatatgttaattagagtttttaaccattaatttaatatcattcatatgctaattatatatgattatttgaatttttattaattttaaatcatgcatgtggcatttacatatgttaattagagtttttaacaattaatttaatatcattcatatgctaattatatatgattattagaatttttattaattttaaatcatgcatgtcgtatgtatatacatatgttaattacaatttttaacaacttaatatcattcatatgctaagtatatatgattattagaatttttattaattttaaatcatatatttgcttattacgttttatccacttaatttactacagacaacaataatttttcgaagtaattgtcattaatttttcgactttaaataattttaatgcattattttctattttagaaacacatatataatggaaattaatattcagtgtgcttatcagtagtcccggttta

SEQ ID NO: 83091 - DNA, 3993 bp, Oryza sativa
cgatgtcctcgcctgcacggctggcctattatgccgccgttgttgggcgcctacgtcttcaccgaccggcttgcctttgtcgccgacgaccgatgtcctcgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggccgcctcgtccgccgccgactggtgcttccgcctgcacggctggcctttataccgccgttgttgggcgtctacgtcttcaccgaccggccgcctcatctgccgctgactggtgtcaccgcctgcacggctggcctgttataacgccaactgatgctatcttcttcacggctggctacatcgctgtcactactaataggcatcagtatcttcaacacaagctgcctacgtttgccatggctgccgactggtttcttcacttccatggctgcatgattctgctagtgttgattggccttaccatcttcatcgccggtcgtctcgtctgctgctgactagtgccctcgcctctacatctggtttatacagctaccactaatgatggacatcatcgtcttccgccgccgactcgtgttatgccgccgccgactggtgcttttatcttcacaactgcgcgtcttcactaccggttcacttcatcacggcaacacaactttgtcatcatggtggagcgacttcatctttattatcttcggaaccagcaaactctattgctgctacttcacaagttttgctacatcaccaaccatgacgttgttgtgaatctcgacatctcggcatgcgatgccgtgttattttactacaacaagtggctctccaatattcaggatttctacttggacatcttcaacacatatcttcaatcaagcaatgactactcgacgacaagaagctataattctcgactctatgttcagttgtttcccaactaaccaaagagtcgggggctacacaaatataaggctcaaaatttgacaaattttatataagccaatgagtcaactccaggagtcattatcttcatctttgcttcggaacagacattctacttcaacaacttcaaatatttcggtttgaacgagttggacaacaacatcaactctcctccaagtgaagcatctacaacagctataacattaatttgatggattattgtcactgacatcatcaccagcacctctgcttcatcgaccctgacatctccgctgttgctaatggatgattatgttttcgccgacttattatttcaccttcacggttgacctactatgcaaatgctgatgagcgtctttgtcattatcattggttgctacactgctattggctggatcaccgacatcgtcttcttcatcatgtcggttgcgtttgtcgtcgtcaactattttcttcatcttcatgattggtggattttgtcatcacctttgatctacctcgtctgtcaccgactgattattttgctgccatggctacacaattttatcgctgggttccttcatctttattgttagttgatctgtctgccgccgactggtttcttcgcctccatggctatgcgacttcattactttagattggtatcactatcttcactaccaccagtattgttgccacctctggtgggcaatattatctctatattggtcgtcttgtctatatgccaactgcgtcagctaccatcaatggacgattgtgactacgacagaaggacaagctatatgctcaggggctcatcaactcaagcgtgaggattatatctccaatttggacttattccggatacattccacatggattcatagtcatgagtctattttctatgctcaaagactggaccaattattattccccgtaagggctatcaaccgaatacttgcgccagtcgggattcaattgttacacctattttggagtatcccataagggataatcattcagatcagaagctattcatatgagctacacctggtctatattacccggaagatttattactcggaagcatgttacatgcgtcatcctttaaagggtgtcgaaggcatattttttggcctaggcctaatatgtctgcagcccatattttcaggtgtgacctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagtaaagctttatatagctgtcccgctgacttttttatatataagtcaaggtgctgtttgggtttttaagcaattgattggatacaatatcattgcttttcgccacgtaagtgtgcatttttattgaccaatattatggcttaggctgattatatattgtggtcattttctaggcggttggtaaatcctttatgagtttattcactcggattttacaccacatatgccatatatttccaggtgtggtgaaaccatgtgtcttttagggactaaagcacgtctgttaaagcagtgtgcgcatggcgtatgcccaatactttagaaatttatttattcacaacatacaagcttctttatagctgttttgctatgtgaatttttaatgatgtaaccaactttaggttacactcatcatattttacaaagcggtcggtatatcactcggatcatgttattcagggattcacaccgcatatgctacgtattaatatcaggtcgcttggttgactataattattaaaaccactcggttggttggattatttattccttgactatatgcttggtttgttcaattaaccacatagtcgggggctacacctattaggtgcatctagtcgatgcacctgactttatttttcagccctccacagtcttcatatttggtaaaagtacttcggagaccatggcgaagataattgaagcactcagctttggagtaatctagttcgagagaagattatcttttcgactgtgaaggtctcaggggctactgtggagattatgggtaccccatacccacatggcatagttatccgactggctataggggataacttatatctatggaatatgtaacagatcatgacttgggtattacgtttccttgtatgttacggaacggcctaaagtcctggtttgataatattgtaaagtagatttaggaaaccgataccgtattggttaaggtttctatcttgtaatcctgccccccaccctatataaggtgggcaggaggccctctagggggcatgagacaacctgatcatcagatctatactacacccggcggattcaaatccccaaacaggagtagggtattacctctcattgagagggcctgaacctgtctaaatccttggtctctgcatccatccacttttaggtctcgtgcgctacccccttttattattgccgaaatcatgtttcgacatggagaaaccctttgtagtcccggttcgtaacccccctttagtcccggtttccaaaccgggagtaccaatccgggactaaagatcgagctgacctttttttttttttttgcatggctgtcgcgaccgggaaaattgccttttcccgaacgctagtgtattaatccccgtcccaggaaaagccggggtacaccacacaaacatgatataaaagacacatctttattatatcgataatatttacattattacaaaggcacttcaggcctgacaataaaaaataaacagcagcggactagcgggcctacggctccatcttcacaggcgctcaactggggtataagccaggactccacctaagacttcttctccaaagcttctcttactgaaggggggaaagattgagcaagaatgagtacaaccacagtactcagcaagccacaccggagatgcgtaattaat

SEQ ID NO: 83092 - DNA, 719 bp, Oryza sativa
tttattttaaaatatgaaattacgattgacataccattcttttttttatatttgtatagatgcattagtattttacatataattattttgattagtcaatatatacagttataatctagacccaccatgattgacaatactgggccttttgccccctctgattaatgtactaatttctaattcttggggtgaaaattgaaaatacacggcagacatatgtagataagatagacaaaatgatagatcaattgattaagagaaacatgtggatatataccaacgataacatataattggttagaacacgtggtaggttttcttataaaatttgtagaacccagtttaatttatttcttttgtgaaatccatacattagaaatcacttgtaatcgttggacctatgtcgatctcttgagcatgtgctaactgctaagggtgcgactgtggcaaatgtgtgcatttgtgtctttcatttaatcgtaaaacatactttggcaaaaatggatatcctggtaagttgcaacaattaaaagtgattgaaatggtcatgtagcggttgtcggtgctagaatttagttactgttaagaataacttagatttaaattcaaattatataattttttatatagtgttatgaatcaactgaatgtcggttcgtgttcctatttgttactgcaatgttcctttattttacaaccacgatggggctgcaggaatt

SEQ ID NO: 83093 - DNA, 6034 bp, Oryza sativa
ggagcggcggctgcctcccatgccaggggttgggccgccccaaccccctccacgctctgtctcgcgtgtgcggcttgggcgggtgctcccagcgcccacctaccacatttattaaggcagcgtcagcgcggcacatcgcatttaatgcgacgtgcaggcgcactaaccggccacttgcggccggaatgaccgatgtgacggtagccagggagacctgcgcacgcacctactgctagcaagggacgtggcctgcgcccgccctgtctaatcggctttaatgaggggctttttgccttgcatttgagctcggaccagttcttctcacaccagtccatatgagagatcaccacccaacggtgggaacgaacggccggacgtcgtcgataattaagaaggaatgacacgagcgttcgcccgtgtcgctcggcgtgatgggatgggcccatgccgcggtaaggcgcgcgtggctccacacgtcggaagacaagacaagcattaattgcatgtaaagaatgttttctttacgcttgaagctaggttttggccttaatttgtggtaaccccttaagatataaaaggaggtctatgtcctagtggagagagggacgaatcccagagaagaaaggcacttttattctcccacctaaatcaatcacacacaggagtagggtattatgcttccatagcggcccggacctgtataaacctcttgcatctccatcactctcgaggggcccgaccccctctacctctctctccatcaactctcagacctacaaccgtgcccctggaccgaaccagaaagggggtccccacggtcccccgcttgaggagttcgcccttcgacacgcatggtaggaggacaaaacaggttggcatgggagaggatgggccgggttgggttggttggatggttgggggggggggcaggatttctaacatttttgacattcttgaattttttttataaatagactcgtagaaaaacttatttcaggagtggctccttttcacggcgccagtgtgattggtgccatgatcaagatgacgactccaatgtcattggtgtcaatgacctatttgtaaaaaaaattcaaaaataattttcaaaaggactaaaatgcaaatatatttcttccaaataggtcctcgacttcattggcgccgtcatccaatatgacaacgctaatgatgctggcaccgaaaaaagggtccatcctagagtaagtttttctagtgtctatttgcaagatgaactcattcaggtaatttgataaagaaggggaagaaaaaaggtcatgcagtttggtgctgaagaaaaaaattaagccgttgatttagtctgagggggtgtaaaatttttgtgtgggaactaaacagggcctgaattcgaagaagaaaataatgattacattgaattcagtgaattcggagggaaaaaaaggaagtttgaattcagcagttagtctgaatccgaagaagaaaattagtgagttactttgaattcagtgagttcggaggggaaaaaaatgaaagtttgaattcagtggttgatttgaatccgaagattaaaaaaaaagaaaaatagtgagttactttgaattcagtgagttcggggaaaaaacgaaagtttgaattcagtggttgatttgaatctgaagataaaaaaagaagaaaaatagtgagttactttgaattcagtgagttcggaggaaaaaaaaaacgaaagtttgaattcagtcgttgattttaatctgaagataaaaaaagaagaaaaaataaaaaaaaatcacttggcttcgaacgggagaccttcagtgtgttagactgacgtgataaccaactacaccacgaaaccatcttgtgaagatgatctttaccaacgtaataattgaaaattttgtcaatacttgtcaacaaagtttttttttcccgtgcgtgccgaccttttcctcgtctgaatggttttttctctatagatgagcggagcatgtgatgagcgcagttgcaaagtttgctgtcgtgtgtaggaaggagggcatcaagcagctgggagctgtgtcgcatggtgcagatctggagcaagcacagccaccaacaccaatactactctttttttctttttttcaccttgtcctgttcagagaatccactgttctttttttcacctagccctgtttagatcgcaccttaaaatttttcactcggtcacatcgaacgtttgaacacctgcataaagtattaaatataagctaaaaaataattaattgcacagattacgactaatttgcgagacgaatcttttaagcctaaatactctatgatttgacaatgtggtgctacagtaaatatttgctaatgataaattaattaggcttaataaattcgtctcgcagtttataatttgtttttgttattagactatatttaatacttcaaatgtgtgtcgatatatccaacatgacacgtcaaaactttccacccgtggatctaaacaacccccctattagtgcgtcagcgcttgtggattctgaatttcattggactaaattttccttcttccaacggcagcgaatctctgaatttttgctgctccgattggttctacgtgttgtcctggatttttttgttggctttactgtactagaggcgaacgcgcgcgttgcgcgcagcacctgtcctgcaatattggatggaagggaatggattactgttgttccgcatgtatagtttggaaggtgtgacagagacggtgatgatattagcgttgctgatacaatgcgacaacaatggaatggatagatggtcttcaagctgtactgatgcttttttatacggaataagacccatggcatcagaaatggaaaagtgaatacacagctagaagaatttgcttttctggttgtttttgttgatagtatagggaggaaataagtgctctgttgtcatgtataatggtacaagtggaattgatgactgtttccatggtatgagggctaatgtacgcaatgaaatagaatgatagttctatgaagatcccaagttcctgggcccaatcagccagcctataattaagacactgatttgagcatagtattttgctgcaggaaagacttgttagcttgatgcatccaaataagtgattgcggatctgtcacacagagaaaaataaagaacattcaacaacagagatcaatcctactgtaatttaaaatgttaactgacatgcattatagagcttccaacaaaatctgtacattaaatcattggcagataccttgccctatctatgatgtacaaacaaatcaaattgaacctctagcagaatatcaacaacacattatattgatcattgatcaacgtaagcaaatttcaatagtaaaaatctgaaatcatgagcaaatccaggggaacatagtactgaaacatcaaaaaagatggaacattcacctttatttcattatcctctctggtaattagcactgatgaactgttgagccccattgatgcatcatgacttaagagcaaacacaggtagacatgaaatgatcaaatttatatgcctagataaacgaagatgtacaccaaattttaataagcaagcatgctggtaaaagaaaactaatatagcagagcaaaaatgaaaatcccccttttttcctatcacaagcaaaatttaaggaacaaacaaaaaacgtagttagtcattccatattagtttgtaatagcaaaatatgctaagtgttacttgtattttggtattctaagcattgaaatacaatctgcaagcaaagtttatgttctggcatgactgagaagttgaggtacggaggtggcagcagcactactaccctttcaattggtcccttattgtcaacaataaacatgcctcttcataaatttgttttctccctacaactgctatcagcacacatgtactgcattgccctatgagtggtgcctcttgttctagaaattgttacaccatgcccactttgttagttatgcgcttccaaatgtcaggtgctgacactttcagaaaatgaacatgaagcaaagtcatgtttggaataagcaaaataagggcaatagatgtaaaagatagcggtgatttctagagtattaagggtttaaggtggggatttctaccagatcattttaagagtgcccctggatttgttgagtttgttgcctggttaacaacgataattaggcatgacattcatgagttgttccactttgttaatcatacactcaaaacacctaaacaatctatagaaaattaaagcatgcactacttaacactcgtcagaggattcttaaaatgtaacggaaagagtagtaattagtttagcataatatgtaataaaaaattaagcacaagaaaggcacaaaattaatttggtccattccccagaaacatatctattaaataaaaactgaatgaggcatttaagtgcattttaagtctctaacaatttctaagaggtgggatcctggttatcacctgtcaatgttacttagcataaaaaaacctcagtagtatctgcctgtgaagtgagtattaagccggcataatagcaagaaacctgcaacctttctttaatagcaactaataccaaaaggtaccaacattatcaccggctttttcaatcaacaattcagcaccataacaccaggcctaatcaagcccttctcatgtgtatcttcaactaacccgcagacaagaaaaaacacgcatgtcagaggtacggttgcacacatggtttatatatgcttgctcacataataaagtgtggtgagatgttacttagaagtgggatggagtataatcaaagtaaaacaatttgttctagaaaaatatttgctccaaaataactaaagtgaaatcagtttcagtcacccaagagcagtcctgtagttgactgatcaagggggaacgaaaccatacatgaatggaaaaatgggggaaactgctctaatatctgtatggagggacaatacaatttttatcactcaccatttatgttctgatcaaggagcatgagcaaagaagcattagcagcttaactgtccgccaattttcttagccaagtgcattacaggaaaaggaaaagaatatatttttcccctgcaatgttaacattagacagcaggcatcaatagaaaatcaagaaactatagtggtgggttgcaacactgacctcttccattttggtcagacaatcttgcagagtgcctggactatgcaaatatgcaggttgcagggacatgtagctgcagctggaagcatagacagatttgtgcattgtgccggaaggatgccagtgttgttggtgcatgcctgcatggagaagcagtgccgatggccacccatggccgcaatgagcgcgttgtcctcgagacagacttctacaccgccaggttgaccttgtcgctggccactgtcacctctaacataatttccggcaccacacctctagatcggctagtttgcgatctagcaaaggaatctgctcccaatcccaatacatcaccagcagaaacagagaacatcatatgttgctatttactggaagaaagcatgcaacaaatcaagcttttgtaccttgtcgatggctgatgttggatgcgttgtcgggatgtagagactgagatgcggatccacacattgttccgctcaatcgtgacaatccccttctggccaccaccaaaccgagtgctggagagtggaactttccgtgtggagctcaccgctgtggaagaacaaacgacgtcgtcactatcgatctgtggatctcaccgatgtggaagaactaccgccctcgttactaccgatgagcctgctgtggtaccgcttgccgtcgactccgggtgaccagatcggccggcggggacaccgtggctgtcggatccggcacccacgacctccccgacgagcgggcgccggcgccggcgtagcaaggagagcgggaggcaatgacggcgctgcgaggaaagcaggcatcgacggcatccccttcgagcgggcgat

SEQ ID NO: 83094 - DNA, 1324 bp, Oryza sativa
gagcgaatagcaacttagcaagcaaccaacaagcaaggcactaggctgatcatgcaaaacaagagttaaaaaaatgtactattcttgatatatcgcatttgctctgcagtatatacattattttagggggcaatttcgtttttgcccccactttcatctctaaattgagtttgcccctactttttagagttttcatttttgcccccacttttttgaactgaaagatgcttttgcccctgttttggatggaggagttaacggtgttaaatatgacatttatgccctctcccaaatctattcattaattgtgtttttgcccctattatgcaatggctttgaatttttttttgtgaatatgtttaaaactaaatgacatatttggacattacaatttggacaaaatttgaatttgaagaaattttggcaaaatttcggcatcattttaacaaaaattgaacaaaatttcaacaacattttacacaatcatatgaagtcaaattgtacctcacaagtatcacaaagcatgacaacataataaccaacaccaatatagcaaagtttagttcataacaagcaccaacatagccaagttcacatcataaccaacataatatcacacattacaggttcaaatcatagccaacatagtaagaagtaattgtccagatcatgcattcaaacaaaagcaccaataaagctattacatatgaggtccaaaccatttagctagcctccctcctcttcctccccttcccctcccaccaccaccaccaccaccaccaccactagcagcaccaccacctccaccaggggcagcagcagcacctgctcttcccctcccaccaccaccagcagcaccacctccacctccacctccatctccattaggggcatcagcagcacctacacctgcacctccccttccccttcccctcccaccaccaccagcaccaccacctccacctccacctccaggggcagcagcagcacctacacctgcacctccccttccccttcccctcccaccaccaccagcaccatgtcacgccctgaagttcccctcccttgctctaaattcataaaataaatcgtccgaagaaattgtttaatttaacctagagagaaaccctaaagtaataaatgcaaataataatcggaatcggcatgtggaatttttcttggattctacatgtcaaaatatgctaacaggatttttagtggaattttcagagccttggaaataattttaaccaattaaaaatcactaaagtgcaaattttaattccagggaaaatccttttcctttttctttttcttttccctc

SEQ ID NO: 83095 - DNA, 8396 bp, Oryza sativa
agttctctttgattcaggtgcctcgcattctttcatttccaaaagatttgctgggacacatggattatcggtagtggaacttaaaataccgatgcaggttcatacccctggaaatgatatgaggacagcacactactgtccctcggtgactatagagatcaagagatcaccgtttctatccaacctcatccttctcgaatctaaagacctagatgtcattctcggaatggattggttgaccagaaacaagggagtgattgactgcgcaagccgcaccatcaccctaaccaacgacaaaggggagaagatcaccttccgttccccagcgtcgcagaagtccgtagcgagtctgaagcaggctgctattgagggtcagacagaaacagtggagaaaagttctaggaagttggaggatattcctatagtacaagagtatcctgaggtgttcccagaagacctcactacaatgccaccgaagagagaaatcgagttccggatcgatttggcacccgggactgctccaatttacaagaggccgtacagaatggcagctaatgagctagcagaggtcaagaagcaggttgacgaacagctgcagaaagggtacatccgaccgagtacttcaccttggggtgctccggtgatctttgtggagaagaaagacaagaccaagaggatgtgcgtggattatcgcgcccttaatgaggtcacaatcaagaacaaatatccgttgcccagaattgatgacctgtttgatcagctaaaaggagctaaggtgttttccaagatagacctgcgatcaggctatcatcagttgagaattcgggaagaggatattcccaagacagccttcatcactcggtatgggttgtttgagtgcacggttatgtcatttggactcaccaatgcaccggctttcttcatgaacttgatgaacaaagtgtttatggagtttcttgacaagtttgtcgtggtattcattgacgacatacttatttattcaaaatcagaagaggaacatgagcaacatcttcgtctggtacttgagaaattgaaggagcaccagttatatgccaagtttagcaagtgtaacttctggttatcggaggtcaaatttctgggtcacgtcatttctgctcaaggcgtggcagtggatccatcaaatgtggaatcagttacaaagtggaccccaccaaagacagtttctcagatccggagttttcttggacttgcgggctattaccgtcagttcatcgaaaatttctctaagattgccaggcccatgacacagttgctaaagaaagatgaaaaattcaaatggtcagctgagtgcaaccaaagttttgaagaactcaagaagaagttagtctccgcaccagttctaattctgccagatcagacaaaagacttccaagtctactgtgatgcatctcgccaagggttgggatgtgtgttgatgcaagaaggcagagtggtcgcatacgcttcgcgacagttgcgtccacacgagaccaattatcccactcatgaccttgagttggcagctgtggttcatgctctgaaaatctggcggcactatcttattggcaaccgctgtgaagtttacactgatcataagagcctgaagtacatcttcacccagcccgacctaaatctccggcaacgaagatggctggagttgattaaagattatgacatggggatacactatcatccaggcaaagcaaatgtggtagcagatgctctgagcagaaagagctattgcaatgcagtatgtaccgaaggcatgtgtgacaaattgcagcaagatcttgagcacctaaatttgggcatcgtagaacacgggtacgtagctgccctagaggcccggcctacgctcgtggatcaagtcagagcagctcaggtaaatgatcctgaaatagctgagctaaaaaagaatatgagggtcggaaaagcccgagatttccatgaggatgagcatggcacaatctggttgggagaaagattgtgtgtgcctgacgacaaagaactgaaggatctcatactcacagaagctcatcaaactcagtattcaattcatcccggcagtacaaaaatgtaccaggacctcaaagagaaattctggtgggtcagcatgagaagagagatagccgagttcgtcgcactctgcgatgtttgtcagcgagtcaaagcagaacatcagaggcccgcaggactgctacaaccccttcagatcccggaatggaaatgggaagaaatcggaatggatttcataacaggtttgcccagaacatcgtcggggcacgattcaatctgggtggtcgtggatcgactcaccaaagttgctcattttattccagtacacaccacctatactgggaaaaggttggcagagctttatctttcaagaatcatgtgtttgcatggggtacctaagaagattgtatctgatcgaggaagccaattcacttcaaaattttggcagaaactgcaagaagaattggggactcgtttgaatttcagcacggcttatcatccgcaaactgatggtcagaccgaaagggtcaatcagatcttggaagatatgttgagagcttgtgcacttgattttggtggagcctgggataaaagtctgccttatgcggaattctcttacaacaacagttatcaggctagtttgcaaatggcaccgtttgaagcattgtatggccggaagtgtcgtacgccactcttctgggatcaaacaggtgagcgccaactgtttgggacagaagtgttaaccgaagcagaggagaaagtcaggaccgtcagggaaagactgcgaatcgcccagtctcggcaaaagagttatgctgataaccgccgaagagagcttactttcgaagcaggggattatgtgtaccttcgtgtcactccgcttcggggagtacaccgcttccaaaccaaaggcaagttggcaccacgctttgtgggaccatacaggatcttggaacgcagaggtgaagtcgcttaccagcttgagctcccatctaatatggttggtatccacgatgtgttccatgtatctcaattgaagaagtgtttgagggtacctgaggaacaagctagctcagagcacattgacatccaggaagatctgacttatgtggagaagccgattcgtatcctcgagaccagtgagagaaggaccagaaacaaggtgatcaggttttgcaaagttcagtggagccaccactcggaagaagaagccacctgggaaagagaagatgaattgaaggccgcccatccgcacctcttcgccagctcttctgaatctcggggtcgagattctgtttaaggggggtaggtttgtcacgccctgaagttcccctcccttgctctaaattcataaaataaatcgtccgaagaaattgtttaatttaacctagagagaaaccctaaagtaataaatgcaaataataatcggaatcggcatgtggaatttttcttggattctacatgtcgaaatatgctaacaggatttttagtggaattttcagagccttggaaataattttaaccaattaaaaatcactaaagtgcaaattttaattccagggaaaatccttttcctttttctttttcttttccctccctttttccctctttttttcttttcggatgggccgccggcccattcccctccttcctccccctcctccttgctgggccggccgcaggccgagggcccagcttggcagccgccgcccgcctcctctctcggggtcgccgacaggtggggcccacctgtcgggtctttcccccacctcccgccgatcccggcgcgccgccgcgccgaaaccgccgccgcgcccacgcctccgtctctcccgggccacgtcggccacgcccgcgcgtgcgccgcgtctcccgcgccctttcccctctccctcccgttcgcgcccgcgcccgagatggccgggattcgaaaaccgaatcccgcctctctctcctccccactcccccacgtcggccgtcgaatcccgccgctcccggccacgtccggctccctctccccctttttaagcatcgccgtcctcccctctcgctttttccccatttcgccgacccctcccgtgctccccatcgtccccgcgccgtgcaaccacccaccgccgcttcttcccgctactccggccgccgctagccgtcgctaggctcgccgccgtcttgcgccgtcgccgccgttcgattcgcgtggccgagatccaccccgtccacccctcctccgtcgaagttcatcgccggagccctcatcccctcgcgcacgggtgagcaccacctccaccgccgccttcggccatggtttccgatcgccgtggttcatctccctctctctaacccctcccaaccttttctctaggtcctcccggaacccgtcgccgtcatcctcccgtctctcgtcgttgccgttcgccgtcgctcctccctcgcgccggccgagcccctcggtgaggatcggtctccctctcttcctctctctccctttgccgcgccgcccgccgcgtagcgccgccgctagggtcgctcgcgccgccgcttcggccgccgccgccgtctttgcgccgtccgccgccgcctcccgtcgccggttgccgtcgctggcaaccgtgcgcgcgcgccgccgccctcgccataaccggccggccggcttgaagccgagccgagccaccagccgcgccccctcccgccttgtgccactgtcagtggggcccatgtgccggcgcccctccctctctctcttgagccgctgcccagtgggcccacctgccagccgccccctccctctccccttgtgccgctgacccgcgggtcccgcgtgtcggcgccacccctccttgtgctgacgtcagccctggggtgaattattgcgcaataaatacattaaggcttttctttaatagtaaaaacacagagaatcttctaaaaatcataactaattcatccgagctccgattaagtccattcaagtctcagtaaattcataaaaatgtgtagaatccattaaaaatggttttgtttcctgtttcagtagtcttatagcatgttttgcttgtgtgctttgtttgtcgcgtagatttcgcccgtttcgtcgattcgtggtttctcgaagacgttgctgtggtctcatcagtgcgagagcaaggcaagtcatacattgcaattgatcatattgtacctaatttacaaatgtcccgcatttctattaaatattgcattgttttacaatatcatgtgggatgggtcctattactcagctatatgttgtttcccttatgccattgataacttgggtattaaaatgactagatgttggtttaggagatgcttagtcatgcttagttcaactagtgcacaaaaggggaccacattaaagcatagacttgattattggtaaaagctttggattagtgccaccgcattggtgttggctaattaaaatacactacatggtgggctgtgggtgcatggttttgctagacgtgcccatggcgattaaggaccggttcgcgggatgccctggaagaatttatcgtacttaccacaagccagcgtgggcaacggctgggcttgtagtgtagcttttctctagccgacgtacccaggcgagggtgggcgtgatggagttgggtcggccggggtgtccggttgatcggctgccggattcaccgcggcacgaaaggggggctgcccgttgcctgctggggacgggggcgaaccctaaggtgtggtgcgatcggttagagggggttatgcgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtttcacccctagtttagcttaatgaactggctagttcaggtggtggtttgggcctgttgcaacgtggtgtaacgttggacagtgattggttaatatggattaattactacaactgttttactgctttcaactactgctttgaaatgccggctttatgcaaaagaacctttagcctcccttggatatatcttgcatcatacctcctcttccggtgtgacttgctgagtaccgtgggtagtactcagtcttgctctcttttcccccacaccagagttgaagtccttctcagttgaagatgtctcgaagaggttggtttcgtcgctgccgtcaaggattgcctgtggaatggagtcgcccgctgcaggagtcaagtcttcaggcttagctcgcttttctctttttccgctgcatttgtaatcttttatatttttgtaagacgtggatctgtatgtcaacaattgtcgtttgtgtaccctggctggtcctggacaggggtttaatgcacattcagcttagaaattctggttcgtgaatttctgggcgtgacaagttggtatcagagccgaccttgaccgtaggacaagccaaatggaaaaacctaagagccctctgaatccttttcattgcatatattctttgcaattggatttgtttcgggaaaaatttggggttttgcctctttggtttgtgggaaaaatcttggtcgttcattcggatcggatccttaaaattagctcggtctagggttttagaaaaattttatttggagttatatttgacagtcagttggggatttatcgggtgatatgcattaggtcgtgtctatgttcgatggggcaattttatgcgcatcattttccatgcaactagtttatgcattaagctatggtttagtcagtcgcattagtgtctttatccgggttcatgaaaaatgttctatgcataaaaatcatcatgctcggcaagttacttgagtcattcgttgctttatttaatttggttttgagcatgtgttggttcctatccctctgtactctttagatgtcagacctattctccgatcgcaagcgccgctccaagcttcagagtcgccgcccttagctttatcgtcttcttagtctgtttgcgtgctagtttttggtgtttaggtttgttgcttgtgggttagtcggcggtcgatatcatgtgtgagtggtatgacagcctttattaggagttgtgtgcctctttttcagtgttttaatcaagattaagataatggcacttaatttcataagaaagattagtttccgagccatctgttttcttcctttctcttatttctacctatcccctccagatggtgaagacaaggaatgatccccgtgactccagcgacgccaggggcagcgaagagcagaccgatggagctcatgtcagtagtgcatctggcagcagaccatctccaccgcccgaaaacccaacagtcactcaaatgatgacaatgatgatgcaacagatgcagcaacattaccatcagatgttgcagcaggcgcaacagaaccagcagtttggtcctccaccatcacacgtgtccaaactgttagactttcttcgtatccagccacccactttctcaagcaccaccaacccaatggaggccaatgactggctccgtgctattgagaagaagctgaacctactgcaatgcaacgaccaagagaaagttgcttttgctacacaccagttgcaaggtcccgcttctgcctggtgggataactacgtggcgacccgtctagatgcaacggaggttacttgggcagagttttgtcaaagcttcaggaaggcacagattcctgaagggattatggcacaacagaagagagagttccgtgcgctctagcaaggaaccatgtcagttacagagtacctgcacgagttcaaccgccttgcgcgctacgctcctgacgacgtgcgcaccgatgctgagaagcaggagaagtttttgtttgggctcgacgatgaattgaccaaccagctaatctccggagtctatgaggactttgagaagcttgtggacaaggctatccgccaggaagagcaacgcaacaaaatagaccgaaaaagaaagacagctcagatcagctttcctcaggggaacaatcagaagcctcgtttcatgacgggacagctaggtgggccttccaccctgatcgtctgtcagcaccatccctatcacccgagtaacttcgacaacgactacaacggtggcagtcacaacaacagtaagcagcacaaccacaactcgactccacccccactaatggcaccagctcagtcagatccgccagctgtgtcagctcagtcagaacaacccaagaagggggctgtaggaaagccaggacactgcttcaactgtggcaagcacggccactttgctggcaagtgt

SEQ ID NO: 83096 - DNA, 11974 bp, Oryza sativa
aattcctgcagccctagtagatatttttatttagagggatttattcactaggtaaagtcctaattatacccctgaactatggagtgagtacgaagtaccccgaaaatcagatatcttttaccctcaactatcaataccggattgaaccccctcctcaaagcagctttgcaagtggtttcggtactacgtggcagtctagtcagcaattcttttattaaaaaccaatgaggctcacctatcggatctctctcctccctatctcttaatctctttcccctctcatacatttctttctcgcgcgcgtcagatgccgaagaggaggcgcgccagcaactacaagtgtctcgcggtggaggccgaggacgagccgcgtgccggcggccgcgagcgtcctcgcggcagaggctgaggatgaggccgaatgtcctcgtggcgagcggcggccgacgtcggacttgcacgagaagatgatggtggtgggagggggagcggcggacggcaccggactcatcttggaatgacacccacacgaacaccctgtcaccggcgcgtcccaccactgcgaggctctgctgcactaccgccatctgcccatcgccaccctcagctccccctccatcgccccgagccgcctccatccccgctccgtcggcctccgtcctcagctcccccctccaccgcctcaagctgcctccaccccatcccaatcagccgttatcctcggctcctcctccgccgccccgagctgcctccgcccccatccccgcccaccgcaatcctcggctccccctccgctaccccgagctgcctgtgctcccacccccgccagccgttgtcctcggctcccctctcggtgatagagagagatggaggtgaggggagggatgagagagagatagagaggggagaggaaaggacagagagggtgggagactgacaagtggggcccagtgattaaaaaagaattgctgactgaactgccatgtaggatcaaaaccactccgattcgagtcaggggataattcgtccggtattgattgttgagggtgaaagatgtttggtttttgagtcaggagccgattggtcacaatttgagagctctctagagacatcatgaaaggcgactggaaaaaaaaaaaaacaccacctctcctagtaatcctagattagcatagcgtgagtcggtcggtcggttcctcctgttttcaagaaagtgtctttaccatcgctagggctatgtcccgtttagcccgaggtcgctagtgcagtcttcatggcggccagccttacaaataattgatcaggtggtggtgggttttagagtcagttgtccagtggatcagactgcctcaacttcgaggcttggtgttggcggatcaacgaggtgagtggttacgtgtagggtgaaaacagtatgtgtattttctgaccgcccacctgactaaggctcactggaagaatgtgggaaagaaaatggtatacccgatactatctaagtttaaatccaaattcacaaaaaaaaatataggttaggatacgaggagagttgtatccgtccgtttgtcccatattatgaaacatatataaaaatctattataaatcaacctacaaacatgataaaagattggttaatcactattttacgaggtcacatgtaattttgtacaatttttttctcaatatatctcctctagcacttaattatattcttatatttaatatctataaattagagatacaaatacatatatgttacccaatcctatttagaggaaataatatgggctaggattcaagatggttgatatgttatccagcgttacctgtaccggtttcgaatttgaagaaaattatgagttagaatatgagaatgccaccgaacccgtccgttttcaccccttgcaggtgctctcttccgatagatctcgcatcagcgatccctccgctcgttggctttgctggtggggagatgcacatctgctcacacattcggccggcggtccaggagatccaacagggcaggagcttgatagcgacgaatctgctatctcattgacgaacttcgtcgatcggttgtgggcacagaggcagcgatttgtgccttcgtcgtggtgaaatccttctgattcaatacgcaggcaaatgttggtgccttcgtcataatgagatccttcttattcaatgcccgtgttgatctccctggattctttttttgaacttcatctccctggattcatgaagcacctgtttgatccagataatattagatacagtgaatcgtcaccatgctagtgctagcgtgattatgggctgctgttttatgggggtttcttctgttactatcgattgcggtggtcaacaacttaattaacatgtcgattttaccagtgaagtgtcagccacaaatgcgactttggtcagcagggatgaagctagcgctcctcagatttaacgtagagccatggcaattctatattgagaccgatgaagcttataaaaaatcaacaattcaacaataataaatatcaaactaataaatctcaaactgtgctttactctgtgaaggcaatcgaagagatcgccagtttctcaagcggcgtgcacgtttgtaaaggcctctcgatagaatcatcgcggcaacgctggtttcgtctattactactgcacgattgtatttggaagattataaccataacccagctatctttacctggatggctttatttatgtctttatgttgtactccctccagtttataacatttgactattcgtcttataaaaaaatattataaaattattatttattttgtttgtgacttgctttattatcaaaagtattttaactatgacttactccttctatttcacaatgtaagattttataatattcccctcatacatatagatattaataaatttaaacacatgcatatgtctagattcattaacatctaaatgaatgtgggcaatgctagaaagtcttacattgtaaaactgaagcggagaaagtatcttttttatattttccctaatttttttaaataaaacgaagggtcaaactttaccagcaaaacatcaaaacgacatataatttgaggtaacataagttaagacaatgtactgtgcatatttatatttccctaaactcttattaataacgtacaaattaagttattttttttagaaaaaagaaccggcaatggggcaatatcacgcggggagaagcaaggtacgtcccaatccggggcagacttcgcgcgtgcgttccgaattttttttatttttagatttttttaaaaaaaatatttacagaaataatctatcggccaaaaaaattgcaaaaatagaccctgccgcccacctctggggcggcaagctgacgtggcaaacgggggagggacgggcggtgacggagggagggtttttttgcagtaaagcccttgccgctctcttttggggcggcaaggggcccgaatgcaaaaaagctagtcgaggccggtcattttgcaggcggccccttgccgccctctggccgggcggaaggcctcgctgcctataaaaggcctgccgcccagcccccagccctcattcctcccctcaaatccagtgaaaaaaaacaagaagaaaggggaggagaagagaagaaggggtgaagccctgccggattcagacgccgatttcaggtaatattcatagatcctatatgtgactattgagttaaatagtgtattttttaaaactttatttgaataaatacattatatttttagggttttagttgtactaatctagaagtgcgtattgtagatattgttaactatgtagatctgctagtttggaatcaatacttttccgttgcattggcatacacaagaagatattacgttgtagatgtttattgcatgaaagagtaatatgatctagttattttgttgacagatatgtcgaacaaacaaatattccaagtttaccatggcccaggaaacgtctgttacgggccaactggggtagatctgtcagattttattgtatcagaaaggggaattgatagaccggctgagaggagtgtaccttctataaaaggatggttaatgaggggcttgagagttgatccacagacaagtgacataacaatcaatgttatagtaagtcgggcaactgagggtttttattgggaactaatgccagttcaaaactctcgagtgtggagatggtatgtggaaaatgcattgcaacacgggtggcctctagctatggttccgtttgttcacccgaaggatccatgtgtgcagatgaacatggatgatggcgagggaccaagtgctgaagtaaatgagacttctgtggaggaggtcaacgcacgagaggacgggggtgtagtagctccagtgggcattcaaccaggtgtagtggccgacgagggggagactgtcggtgccattgtggatgaaatggagagggaggattctgacaacgagcgtgtagaggaaggtgattcgtcagatgatgagacggatattaatccagcagaatgggctagtgaggatttttctgggttggtcgtctctgaagaggatagtgtgagatgggagtacaaagaaaatgagattattcaggaagcgatttatagtagagcagaagatatgaaggaggcggtaaaacattttgcagtgtcacttcatagagagttttgggttgccaagtccaaccggtcgcaatatgaagttcggtgtgttaaggaaaaagatggttatccctggagagtgcacgtgtataaggggaaatagaaggattattggacagtgtcagtcgttaccaagcatacatgttttctacctggtgttcagaaataccacaggaacattacatgtgcatttgttgcatctgagatgtatgcgcatgtcatcgataatctcacatatgaaccaaggtcaataatccgacacatcgaagagacatacaagtatactattagctatgccaaggcctggagagccaaacagaaaataatagagatgagatttggaacttacgaagcctcgtacgacaatttgccacgcctgcttggcgttatcgaggaaagaaaccctgggagctcttacgaagtgaagaaattcccctcaattgaacatcctggcaagagtgtgctgcaaagggcgttcttagctctacatgcatgcaagatggcattcgtgaactgtcgtcctgttctctgcattgatgggacattcttgacaggaaagtatcggggccagatactaacagcaataggggtagatgggaacaatcaggtattgcccttggcatttgcttttgttgagagtgagaataccgacagcaggtactggttcctgaaattggttaaaacaaaaattgttggtatgaggccaaatgtgtgccagatacatgataggcacgctggcattctgcgagcgatagaagagttgcagtttgggaatatggaacaaggataccctggtgagtgggaagatgtacagagcaggtggtgcatgcgtcatatgggagctaatttcttcaagcaattcaagaacaaggagctcatgaacatgtttaagaggctatgcgatcagaaccaggagaaaaaattcaatgagctttggaagagattagatgagttgacagccaaatgcagtgatcagcgtgcagcggctccatcaaccgccgatgctgaccctccttaagctcttggacctctcccaacggatagtccaacattggttagaagaactggattggagattcggaaattttctcagtggattctgcatgaaccaaaagagaaatgggccaaggaatatgacacaggtggtgctagatatagaataatgacaacaaatttggcagaagtttacaactaggtgatgcgcggtgttcgtggactgccactagttggcatagtggagttcattttacatgggacatgcaggtattttagggatcggttccaggcagttcttccctctatgccgaacaacagcattttgtttggaactttcatgcagaaaaagctagaagagttgcgtaaaaaggccatgaaacatcgagctctagtgcaaggtacccaacagcacaggtttgagatactatgtcaagataaggcaggcaggggtatctaccgcaagagagtgaagcagtagtgtgttctcaaagccgacggcacatgtcattgctcttgtgcaaagccgaagctgctccacagtccatgcacccatgtcattgctgccgcagcggagtgtggcataccagatgcagtatatgtttcacagtacttcagtaagcaagcaatatatcatacatggagcggcgagatttatgggttcggcatagctgggtagttcacagagactaacgatgaagtactcaatattcctgacacatcgaagctccgaggcaaggctggaaggaggaagactcgtcgcatccgcaacgatatggacgagtcggaggctggcagggtgaagcgttgcagcaaatgcgatgaacgtgggcacacctacaagcattgtcctaaagacaaggagaaacctagtgcggcagaggcaggactatcaggatcaacagcagatggagctcgccctacggatgaaggcactacctccactcgaccacgtcctaggcgtcgtcgtgccacgtctggctacatggtgtagttcttatgttctatgttggcatgtggctttgcttgtaatttgtttcgaacttatcgatgtgtttatgtttcgtcgtgaaatgtcagacttcggcatgtcatgtctttaggtctcgtgatgtaacgtcagactaaggcacctagtgtctctctttctttctatctgggcagctgagaggattgcgatcggccgccctgaggtggaccagcacgcgtacaaggagtcactgtacgcggagcgaccagaggtcgactaccctacgataggtactctgtggtgccgtcgtcaggtacgttgcatcgatcttctcgtattgttaagttaattgctaagttcattgtacatcacatcgatcgtctcgtattgcagcgccgatgggctcacgtccaggttaggcggtcgtatcctgagtttgttatggagttcgaccgccttctgccgactgacgtcgtgtgggagccctacagtgccgcggctacccaggctcgtgcgccgttgggtctgtccacagtctgcaccagggaccaggcgtactggatgactacggttccgatggtcttcgacatctgcgttgagcctcatgcccctttccgcgtgatgcggcagttcggcttctgtcagccctttccagtaccgtttccgacgaccgtcccagctgctgttcatcggtaagatctttcactacgctttgagttgttgcattaaaatctacatgtccataataatttgcaacatctgtcgattcacactaatatgacacattaattcgcaagtactcgcgcaagggtcagcagtcagctggcgactggcccgccaagttggcgacttttgttgaggactggttgctcacaaccgaggaggtcgtggaccacgagggagagccacacactgaggaggcgtaccaggcctacctacgctggtaccagccacgtacccgtactagggtcaccttcgctcccttggagcagcagccccacgttgcgagcactagagacctctacgccaggcaccgcgaccaggacttcgctcgtgctgtgagtaccatgcatcgcaccattcctttatgttttcatgtctttctcttcatcaaattttacgaatatgtacgaaaaaattaaccaccaatgtttaggcgcggggattccggtacccgtagaggagcacctgacgacatacacgcggatggtggagtcgatacgctcgattctccgagtgctcacatgtcgtgcagatgacgttgctcgggcagacgcagctgtacagcggccacccgtaccgactggtccccgtccagctatgcacgttcctaggccgactccccctccgcacggaggtaagtatttttaaggatttttctgtacatgccttgcacatatatgtgagccgtttcacttgccgattgcttcagggtttcgtgcaccgttcagcaccccgccttcctcggctaggccctctgttgtgccccccacaggtacttaaaaaaacaacattacttcgacaatcaatttacatgcattttatgtcttagcttacaagggtcccgttgtccatgtgtaggtttcacccagttcgctatgacgcaggctgcccacttctcccaggctgcagcgtcagtgtctcaggcagctgcgtcgacctcgcactcagtgcagttctggcagtacaccgggacttcgtcacaggcagccggcacgtcgagtcagggtccaccactggaccatgctgggacctcgtcggaccacttgctgccttccaccttgctcttcgacatcactgacttcgatttcgcttcaggctagacagaggatgtcatcggcccctcacagctgagaggggcaccgccggtgcagacgcaggaccaggcgcaggccactccgccgccagacactcgtgctacccgtgctgtgccaccggatcgtttcacctactcccaggaccacgtgcgagcacaggcccggaggaccaagcgtggtcgcggcgcggggcagggccagtagagcagtcttctctttatttatttgcttcactttccagtactgtatgcttgtgtcatgactacgttgttgttatatgtgcacgatacctttcggcgcatgcacgactactttctgccgcaccgatgcagcctcctttattcgcgtgcgatacgagtatttgcccaccatttgccgcatacgaccaatgtaactttcggcgccgatcaggcatgtaactttcggcgccaatcaggcgtacccaccatgcctcgccacgttcacatgtcagggatatcactcgattttttgcgcctatataagtcgccttaacgagtgaggcctcacaatctttcagaactcagtcacattcagtactctcttcccccacttgcttcattacaaatcctaccggctttcgtcaatggctagacgccggggtgttgaggatccgaactggcgtagcgatccttgtgtatacctactaccaccttggtgccagcgtcctctttgcctatgcggtgatcgatgccaactaatggcttcgaggaatcctgatatttgaggaaggcgcttttttaggtgccctaactatgaccgtgaggtattttattatctgcatatgcttattcattccgtatgggcaatcgctttattcttcgtaacactactctattcggcagacccgcactacggcttgcgcatacatcgagtgggtcgatacagaaaatcctgttctcgacctaaccacttgtttacaagaaggtcgctggtatttcgcatccgaaagtactgagcaatacttacagagaaaagcggcttatgaacgacaatgtcgtgaacaacagagcgactggcgggtgctaactacggcactccctccatgggatgcccatccaagatgcaggtgtggtgatcgtggtcaggttcttcgttccataaagcctacaacattgggtcgaaggttttttgtttgtccaaatattcttgacgacgatttcatggtaagaatattttgattacatgaatccttattttctcacaacatttactaactttgctcgctttacatctattctttcctcctaggaaccaccaaggagatatcaatacagaaaacggatagacaccagaagggttctaactccacctagccgtgttgagcagcttgaaactaccagagcaatatagggttactaaagcgcgttttgagagaggagagggatcctcacgtaggggttagctattatcggacaacttggcatattgaaatttctactgtcatgcttccttgtcccattactacatcgtcgttatgttcaactattgcactacctccctcctagttcgaatctaatattatctatgtaaccgcaatggaaatagttgtatcatgttcaaattgtactactatttcttcatgttacataattctccttgtttaaatccatataatgtttatacgaccgaaactgcgataggcctattaattatccgagtactaatacgtcgaataagttacaaaataataccttacttaacatatgaaattgcgaaacaaccaacttcaatacatttttataacaatattaacaagttttaccaataaatacttctttatttattattaacataacatagaaaaatcgtttggtcgtactttttgcatctgggtcccttgccgccctctactggggcggcgaggggcccaaatgcaaaaagtacgagggcaacctctttatgggcggcaaaaattgcaattagccccttgccgcccagggtaattgcaattttggccgacggcggcggacggcgcggtcgacccgccatctgccacgtcagcttgccgcccaccactggggcggcagggtctatttttccaatttttttggccgatagattatttccgtaaatattaaaaaaatctaaaaatgaaaaaaattccgtgcgttccaactacttgggccagaaccaaacgctaacccacagtcgaattagcccaactttaataggccaatacgctagctcgggaaggggtcgaaaagtccaatttgatcaaaaagtgtaacgacaccggcccacagtcgaagtggcccagttggccaacgcagcccacattaacaacgccaaccccaccagagcacgcgctgcctagccccaagtcccccaaccctcgccgccgccgccgccgcctcctcgcccccgaagcgtccccgccgccgccgccgcctccccgtcgggaaggatgaccctgtccatgaagccgcggaaggtgctggtgcggaaggcgatgaaagaccgcaagaagaagaagggccccaccaagcccaccccatggaagtgccccctctgccacgagctcttcctcggggtgcgcgagggtaaccgccacttcgaggagtgcgaggcggcgaccaaggccgcgcgcgccgccgaccagaggaagatggacgtggaacgcgctcgccaagaggagctcgtgggatccaaaaaggccgccccaccgaaggaaggtagagtctcgttttcgttcgcgttatttgcatcgcaatgcatggatgaatgaattagactttctggagaacaatcccgcaatggatggatgaatgaatgaattagactttctggagaacaatctgataaattaacgaattgaacccgcgtagttttcaggctatgaaaactttgctgcgaaattcaaacgaatgttccccaacatagataggaattccatgcagacatttttgacaaatattagcatgctgggtgtataaaatatatactgcactgagcaaatcttaaaaatcactcttttcaagaccttacatagttggacgcacctggacctgctgcaaagaattactagtgggttatatctgctgatttgttttagaacccatacatttacctttccgtagtacctggcaagcttgtgcaacacaaatttgcaaaccttctcatcgaatttgacttgcaaataagcctttcgtgccacctatctatagaaacacaattttcttcatgagacttatttttattatcaacataatgtggcatacactatactctaatggctcaagaaatcgttaaagaccatgcaagagtatcagagcaactttacatattgccattactgtgcaaatggaaaaaataccgttgcttaaagtgctgaaaatatctgtgcattgtgatataaaaatcaattaaaagtacaaaggcactcactattagagttcaatattttatctccaagattcagtctcaatgcacttcacaatggtattgcactcccaaacactttgcgttgttgaggagggctgcaggaat

SEQ ID NO: 83097 - DNA, 10915 bp, Oryza sativa
cggaagatccggccgccattgatgcgccggcgaagtttgcgggagcggtttccaaccgaatccgagggagagagggagggaaaattggggggaaagggagagggaatcacggggaataattccccccactttattgcgcgcggggacggcgggaggcggcgggattcgcggcggcagcggcgctagggcgcgggcggggcggcgggagcggcgggaggatagggatgacaggtgggccccacccgtcagcgagagtggcgggcgggcccgcccgtcagcggcgcgcgcgcggggagaggccgagtgggccgcggggagaggagggagaggggagggagatgggccgggctggccagagagagagagggaaggaaaaagagagggagggagagaggactttggccgcgggccgagagagagagagagggaggtctttgagccagacttggcccaaagggaggagggggattatttttagcttttcctttttataaaatcattttaactttgtttatttcttaacaattattatttgtgctctgaaaattccactaaaatttgagggctccttttagaccaaggagaatttaacaaaaattctccgggccacatttgaattcttcttgtacgtattttaatgtttgccaatttcttttcgaattttaattaatactattattccttttagggaatgatttttaattcgggatgaatttatcaggacgtgacaaatccaccccccttacaagaatctcgtccccgagattcgaggaggctagcaagaagataggttgggcggtcttctcttcttgtctgacttcttccgtcgcgtcttttataacaaacttgcctaacaaaacttctccactctaggctgcttggctcgatcccttgttgcagagggaatcttctcttcacctgacttgtccctggttgaacctttagctgacttcgactgggttgcggcacttgaagatggggcttcagttccagaacttcgcatagttcaaatctttggagtcaacctcatacaagttacccacttcatgtcatgcgtcgagatcagctcgtcattactaggataccatgcttgtcatcgggagaataccatgcttggcgtttccttccagcttaccaccatatgctttagactatgatatcccgcttactaagaataacatgattgacaacttgccactaattgtctcatattagctttcctggtctccggtgctagatatttcctctattcaatgtgagggtcgataactttgcctttgaattatgtttcccaagggaaccaaattatcctacttgacatgctttgacgtcttcccaaatgactttactgctggacttgttatggtctgatcgttatcctgccaaatctgaagcttcgttgttagatgcgattttaatctgacctctatagactatcttcgaacatatcacttggttcataactgggaatagctcccatgaacagacaactcggattcactttctttacattcagtttactttccactattctcttcatgttgtcatcatttagcattcaacgtattcctttgcaccttcagccttgatgtgttctttctcgatggatcgattgctaggaaagtgcgttgaacgatactagtgcaagtgcttttattctagtagcatctgatacaaagcccaaggttgaaccgagctttagattccactgttcaggttttacttcttgacttcttggtcatgtcacaaaagtttccatccttgtccccatagaagtacttctacctgtggtcatctctcttactcgtgaattcacctactttaatgacaaggcaactgttgtagggttgtttgctatcgggagtcttcctcgagtgacacaaatcatggttctcgttatcctttatcaatcacctttcgacctacttcttttcccagtaaccaaacatcttttccgatctcttccattaatcacctttcgacctttctcaaccaggtactcttcgctccgggtgttgaggatgcttctggggcaatgaggtccttgggcgtgctgtctttcagagaaaccttgaagtagttcgtcaaaagctagactgacaattgttgcctttgatccgaagaagacacatctgaaactcttagtccaaacaaatgtctctttggttgatcacttgattttcttcgctatcaatcgctaggttatttgattcctaacagattatgggtttacggaaatgagaccctaggtctccctaatcaacaacaaaatgtacacaactcacagcacttgcaatcttaacatggatccttcataagcttatcaaactcattcattatctcatgtttctctgttattacatgattgacggggaacaactataaaacaaaagtatttgaacactgatataagagtattatggttgcttctgactagcgctaggcttatcaggtactgcatttgctccagtgaccacttggcgattggcatgtctgcttccttaacaggtactacagtttgtaacaggcaataactttcttacgctcgggttcttcatcttgtacttgatttctttggctgctgtgctggaacatccaaaggtacaatgccgatactggcctctgtcttgtcaactgatggctggggctgaaattgagcattgacaccttgtggtaatgcactcgctggagttggagctgttgcaacgcgggctataggactgcttcgggatgcatggatgacaattcgctgaggagcaagcttctgattgcagggagttgcgtggactgacgtgctggcagctatgtttctcggttttgggcacttgtcggcgaaatgacccattccttgacaattgaagcaacagatatcttcccggactcggcattttcttttctcattttggttcctctgtcctggcactggagttaggctgaaactgtaatcttggcgaggatttgtgttgccttgatgcttctctccgttggaactggcgggttggttggccatcttcttcgtcagcagaaaactggattgacaatcttttggtacatgatcagttccttcacaaaagaaacaagtgatcctgctcgttggacacctgtcgggtggatggtcttcctcacaatgaaggcagagtgtgagacacatgctagcaacgtgtccaatttctccacaacgggtgcatgcctttgattccatctcttcctcgccgagatgtcggggagactcatcttcatcatccgaggagacttgatcagatactctgccaccatggcttaggaggtgctgggtcaaccgtcgtgcacctcggaaggtatttcctctttgacgtctaggaatagttatccctgctggaggccattcggcgctggtaatagtcatcttacgtacttcttctttagttcgcatcggcgcttttctcttctgactcttactcttcttgcctttggcttgcttagtacgtgaccccacgtggtacgaaaggctaggaggaaagcaattctcgggattcaatggattctctccattgggctctctaccttgcacactaggctgcaagcttgacttggtgcgaggaggcgggtttagcgatgtctgccctgctaaaccaaaggaaggggcttctttggcatatacccatggacaattcagggcatagtgtccttgctctctacaatcatgacaaaaggggacatgctcttctggcattggaagctcattgacctgggtggcaaatgcttgatcaaacacatactgattttggtcttgacttccaaccaatggtagctgtgaaccaagcagcatgctcggaatggaccaagggtgtgcccttgttaactctcttgaggccagtggtggattgagttgaaaacttgagttactggaggcataccctctgacattcttttctttttctctgttaaacatctgttacagggattgaggtgagagaggaaacaagctaggaaagaatagaccagaactagagacaggaccttaaaggaactaactcttcttgttgatgtgttgtttgtttcacttattctgcaagttgattaagcaaacaacctagcatggttacatcacaccccactgatgaaaaccacgcgctacacacacaagcaaggaaacacacgactaacgactctaccctagagggtggcttaggttctgcgacgggttctccaagatcttcactcctgctttacagctggcttcactgcttccttcgcttcgctagcggatcctgcagtcttccggagcttcggcaaacaattggcgacatcttcttcttcgcaaaactaaccatctagtactagtggaaatccgaagaaggaagaagggagtaaaccttttgcaaatagcattaggggaaggagaaaaaaggaactttcgcaaatagttttatttataaaatatgtccttaggttttatccactgggcttatcctacagtcgagatggctctgataccagcttgtcgcgaccgggaaaattgccttttcccgaacgctagtgtattaatccccgtcccaggaaaagccagggtacaccacacaaacatgatataaaagacacatctttattatatcgataatatttacattattacaaaggcacttcaggcctgacaatcaaaaataaacagcagcggactagcgggcctacggctccatcttcacaggcgctcaactggggtataagccaggactccacctaagacttcttctccaaagcttctcttactgaaggggggaaagattgagcaagaatgagtacaaccacagtactcagcaagccacaccggagatgcgtaattaatgcaagggagtacaaggggataataatattggggttaagttttgcagtaaacagcatttaaaagtcacttagttgcccaaagccattttataaagacgatcctagagctacacaatattattaatcaaggccgtgaaccctcacgaacctgccttaacccaaggcctacgatgattcagaccgaactggcaacccgaccctgggtcccagctcgtcccaagccaacccaggccaaccattccacattttagttgttaagcaaattttaagaattaaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacctccgggacaggcaggcaggattgagccccctagcagcaggacaccggccttgtgccatgacatctcgactaccgggccgcagctcgtgtagccttcatttgtcctagagatgtccatcgacccccgacttcgtccatctccatccgtgtacttttgtttataaccaaactgagccacaaactaagccttacccactagacatgtggaagtacggtagtgctttgcaacagaggcccgagcttaatccttatagtacccgaggtacgactaacaaaacccaaccacgcacctcgagcccagcctaaaaccattttgggggttttgaatagagggggaggtgtgtgtccaattccaacataagccaaccattccatagtgtccaaatgatatgagaattcccaaagtctaaagttataaaaccacctaatgttgcctaattaatcagcgaagcatctacctaaattcatactagtggaaccatgaatagagtacccactagttggggttttatttatcctagggtgaacaaggtaataataacaataacaacaataataaggtcataacaaaggtaaataggcatggctaaataaaacagtgataacgcgggaatttaaataaagcgataatgcaataatttaaatcaaaataattttataaactgggattcaatatgttcaaggatgatgtgacttgccttgctcgctttcccaaacgtcggcttcaacttccacgaagagcggatcttccgaagctgcagcgtctacacgaccgacggaaaagaaaaggcttttactctaataaactccatataacacgcagaaacaaagcacaaaaatgggttcttgacgggggaaagggagagggaatcacggggaataattccccccactttattgcgcgtggggacggcgggaggcggccggattcgcggcggcaacggcgctagggcgcgggcggggcggcgggagcggcgggaggatagggatgacaggtgggccccacccgtcagcgagggtggcgggcgggcccgcccgtcagcggcgcgtgcgcggggagaggccgagtgggccgcggggagaggagggagaggggagggagatgggccgggctggccagagagagagagggaaggaaaaagagagggagggagagaggactttggccgcgggccgagagagagagggaggtcgggattatttttagcttttcctttttataaaatcattttaactttgtttatttcttaacaattattatttgtgctctgaaaattccactaaaatttgagggctccttttagaccaaggagaatttaacaaaaattctccgggccacatttcaattcttcttgtacgtattttaatgtttgccaatttcttttcgaattttaattaattctattattccttttagggaatgatttttaattcgggatgaatttatcaggacgtgacaaatggatgtaacaccctagcccaagacataataggattgataggatactcatgctaacaagttgtaacttcttttccggaagcccatctccaaagaactctaaagttaagcgtgcttggcttagagaaatctagggatgggtgaccgaccgggaagtcttcccgggcttcccgggtgcgcacgagtgaggacaaagtgcgcaggcactggacatgggtgtgtcgcagttgcgcaggcatggtgtgcatggctgatgtggacccggtatggtcacacagcatggcacttgcgctggcactggacacacggacgtggccaagagagggagttcctggattggggttgatcgacgaggacgtcgatctcttaagggggtgaggatgtaacaccctagcccaagacataataggattgataggatactcatgctaacaagttgtaacttcttttccggaagcccatctcgggtgcgcacgagtgagcacaaagtgcgcagaaaagactggtgttggtttgtgagggcagtctatgtcctatttaagctgctagatgtaagcgggcccggcctcgtggaggcgggacgttacaatggccctgttgctgcatggtttatatatatataaaccatgcatatatatgtttcaatacatatatatgcatacatatatatatgtatatatatatatatatatacatatattatattatattatattatatgtatatacatgcataatatatatgtatttatacatatatatgttatgcaaatgcatatgtatatagatatatatatgaccaaaatatatttacattatagaaaatgtgtacacatgcatatagaaacatatgtagtcatgtattaattacaatccattatatgtcctagctagctacgatttcgacgtagtagtactcgctgctagctcagaagctaaggatcggtgaattgtgtttccgtcgtagtagaattcacccttgggatcaaggatttcttcgttgatgaatcccatgagttgttcttgaaccgccgtgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtttgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatagtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggattggtttggactttccagaagatgctttcttcagcgttcgctcatagtccgatagcttgatggcctccttgacaggtgcagacatacccctgaagaagttcctgacactggggtctataggaatcttcttttctggacttcgagacttgaattgtctcttgacttctgatgcaacgtaagcgtcaagctcctcttgcgtgcaatcgtaccccgggtccttgttcttggcggcgtcaactttcgccttcttcgttgcccttgtgtgggcaggcggtggagctggggggccgttgactttgaaggtgccggaagaggagcttgcgggggagtaggtgtaggagcacgaggaggagtcggtgcaggatcctgaggaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcttgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgtgatcctacctgccccgttgaggcgcaactgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgccctgagaggaggcttccactgcatctgttagtcgtcgcgcagcctcttgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatgttacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagca

SEQ ID NO: 83098 - DNA, 22138 bp, Oryza sativa
tgcgtgggcttcctttccagttttaagttaaagtcacccccacatatttccagtaataaaagttacatacataaataagattcccacgcaaaagcatgggctaccttcctggataactaactatatctataagttttgaacttataatacttctgaaattttgaacttctgtaaattgaagcgaattttgaacttctgtaaattgaagcggtgactaattatatcaattatatcttatctgcaggtatttgagagagtcataaagatgtagaaaactctagaatcaagttagcgaaggaactatcaactaagtcaggttctatgacttttgactttgatgttatggtgtgattgggatttgtaatatcatgcagtaccacacatttatcacagttacgccgtaaccttctgagttttataccagtcaccgcaatatcgtgaaaaccctgggtgtgatgttatatactcctttgatatctcgctacatgttttttccaaacctatttaagcaatactaaattcccaattatgttgctttggttataagcgtggtcttaaaaatacaatgttgaccactaatgtcaatcatagcatgtttatttgatcgatctgaaaaacttataactcctaaccgaacttacacatgggaattttttgtatatacgtaatttaagtagataaaccgaactgaaatacctatgttcaaaggtttagagctttatctaacacatacctaatatgatattaaggataagagcagatggctttgatatagagagaacgccataacaatcagcacacctgcacatcagaagatagtttagtgtgaagtgcagtggaaaatagctcaaacaaaatcaacccgcacagaatcatgtgtaattttaaaatactaggacaaatcaattaagcatccaattgtggcgtacctttactatttcattaacttattaaaatgctgaaggccagaaatgccaatatggaacaatataaacccctcaccagccaccagactaatgagtacccctttagccccagggaaataataggggaatccacaatacgttacaacatcttcaacctttcaagcacatcgattcaggggaattacatcacatatgagcatggcaagaaagccatgctaaatccatcttaacaaaatatttttgttattacaatttccacatgttgctgaagatgaattggctaaagctatgtaacatgacgtgattcaatcacttacaaaatgcacgttaggatgtcatatgggtacttattagcatgctagcctcctaagatcccagtctttcttttatgctcttaagtggaacaaaaagacatattggttcaatataagaccattaggcctataagactactactatacatataatagtgaagtgacccgttttaaaaattaggcttattcaaatacgatacatttgtatcatgactacatcagcaagaaatagacaaactatatttgcacataaaaatatttttaagaaaaaatataaaaacaaaaataactagattaaattttagaagaccacaggttttgaggcacgtgtaacacaaaacctcagatattacgatttgtttcaaggaaacccaggttttgaggtatagcatttcaagaaaccccatgtttatatcacatactgataattctattattatatataatatttttagtatatgtttgcattggtatgctcaaaatacataaccatcccgtgtacttcatatttttccttacttttgcattgtacgattgaataaacacaaccatactaataatgacatattaaccggtttacttatatagataaacattaatcatattaccataataatgcttgtaaaaatgaggcaaacatgcatatatatactcactaatatctcgttatttttttgcaattaatatgcataaatatattagacaaataacaatataagcttaaacatgagatttcgtggaacatttttccccaaaacctacggttcttcatcacaaattgtaatgcatgatgttttgtgttataagtgtcacaaaacctggggtttttgtgaaatttactcaaataactacatttttggctatcatagaagatccaatggacccgtattgcattgcgttggatgcaccgtcaccaagatcttgtttcataggaacaaacaaaaaaatagaacgatatttttcattgagaccaccttccccaagacaaaagagagaactaggaaatgctagactgtacgtgctacaatcgtgttctgccatctctaatcgctaagtagtacgtaagaaatgaaagtatatatgcccagttttataggataccgatgaaaatctgaaggttaactgaatgtaaggatttggtcgtaagggcctaggctaccaaatcatgacctaacacagaacatgaataacaaatagcttgacagaacagatcaaaaaaacaaaatgccaataaaggaacaaaacggcggcagtcaaatgcagagaacaagaaaataatttgtgacaaatgaagcctatcatcaaaacaataaattccacagtagacccaaacagagtgtcacccattaccattagtgtagtcgataaattttcttctgaagaagatgagaaaaatacatatattgtaataataaacacgtagaaaacttgagcacaacgcctcctgccatggctgataacatggatagccagatgaaagggagaacatcatctcgtcgaacccaaatctgcacataaacaaaataataataatttaccggatatgaaaggaaaagaaaagccaaactagttgaaacataaactaaggataaacttgaagggtcaagtgactttttcagagtaaaagaagtatactgtgaaacgtatgaccctgcgacttgttgagtaggagtgcattgccaaatactggaactgaatctcccttctacggttagctcggcagagaggggtagaccgggcgggtagtccagatggcttagatctagtctctccgttaaactcatcaccgcaataccatcgccgggagccgatttgcggcggatgcaaccgccggcaacggtgccagccgaagcccctggcatcgtctcgcctatagggagctgagccagccaccgatttcaacagatctgtcataaactaacaccgattagaacggatctgtcataaaaaatcattcatctggcggaaagagactaaccatcctgataatatccttggccgtgagaccgagtcagcgccgatagaccggcaaacttccgtctacggccaagtcccaagtcgatctggctccggacggatcatctagcccggggtatggatcatccatggatggacggcgacaaacgcgcgcggccaccgacgcacccggcgccggccgccgagcccatgtagacggctgagagttgaccggcgctcaggactgccaccggcacgcacaggcgccaaggaaccctcaaaccagacgctcgccggagcgcttacaagcgcggagtcgacgtgcaggtttcgtcgggcgggcgagcgggcggcggcggcggtgaggcgcggctagggctcgcggagtcgcgagaagagcacggcggcggctaggagttggagacagggttgggggtggggaactggggattccgcgtctatcgtttcttgacctcgcctcgcgtcgcgtcgagtatggacggtaaaaaacgtaaaactgcaggtcattggaacatgggccacgagtggactcctttttcgggaagcgtcacgtaccttttggctgtcagatggcccaggcccaattagattctctttttcaaagcaactgtaatgttccgctttttcaacgtgctttgtcgcatcgtcatccggccagtccacgtacaggaaattaaaatttccgccgtcctcggccccgtcacgctccacgccgcgctcgccggtgccggcgtgacaatctcacaatcctctcgagccaacgtacggcgtgctggtttacggctaggagtggacagaaaaaatccaaatcgaaagaccgagaccgagaaattcaatcatcaattcggctcccctctcctctcaggtccaaccgaaggagggaggggggatggcggcggctcccctcccctaccctcccagatctagccgaaggagggagggaggagggtggcagcggctcccctcccttcccctaacagatccagccgaaggagggaggggggagggtggtggcggcgggcagcagcagtgctgggacggcggcgacggcgagcctacgacgacgatgacggcggttgttgatggtgcccgtcgacctcgccgtacctgcacgccggttgccgtctacaatttgttgatttgttgctttcaatttgtatattgtggatttcttgtagatgaacttgggaatctataatatatgaatttgtattgtggatgaaatggttgattgtgtgcataagcttgggaaatctgtctaagatttggatccaatcccagaattttttgagtttgaagctgggatttggatcccttgtttcttttttttttgtttgggaaaaagggttttcactagcgggcctcttaggctaacggatgtaataattaatcagatcttcgctagtggtgcctctaaagggaccgccaaccaaaatccgttttctctagcgggcgtgttgcgctagtgaaaatcattatcactggcctttggttacaagcggctagcaaaaccgctagcgaaaaaccaattttggtcgccaggaaaaatgcttttcatagtagtgctagctcctggtcggacgtcggccgagtccgggtacactgaacacgatggtggcgatgcgccacgtcaagtggtagtgcgggaacatgccgtacgcgcgttggtcatacggtctggttggctgtgcctgacgcacacgtgatctctgacatgtgggacagtggggtcatgtatctaaggccgtgtttagttccaaaatagttcttcaaacttccaacttttccatcacatcaaaactttcctacacacataaacttccaacttttacgtcacatcgtttcaatttcaccaaacttctatttttgttgtgaactaaacacagcctaacttgaggaataggatttcaatccacaccggaccgaaccggcactttggcagtgggccagtcaagtgaacatggaggaaaatgctgcacggtgaggagccagctgaggagaagtgtagcgccttgcatggtgttgcaactaaggctctcttcgttccccagggttcacaactccccacactcgttttccacacgcacgcttttcaaactactaaacggtacgttttttaaaaaaagtttctatacgaaagttgctgaaaaaaatcatattgatctatttaaaaaaatagctaatacttaattaatcacgtgttaatgtgaatatcgttttacatgccggggaggaggggttccccaacacagcctaacctgccggacagcctgcagctgcatggttagcttgcttgccctgtgcgtgcaagcgagactgcggtgtgtgggactgtggcagtggcggcgtggcggcgtgcgaggatacgatgcgggcatgcagctgccccttcacaaatcacacaccattggagtacactattagagcgttcaggttcgtagtgcatgagtgcatcgagctgtcgttcgacctgaactcttcatgtcggtgtttatgtttgatttgacgccacttttgcgggtgtgcctaccaaattgaagaccgtgtaaccaaagatggtcacccattcttcagccccttcaagggttggtgacgtgggttgtcaggagagaaggcatgaggcacattgtggaggatgtggcttcgctgcgtcgttgcccgcaccacttgggaagggagacggagaaaacagagctcgtctcggtggctgaagtgggagcccgtcgtcccctcctctttcatgtccccgctctacgccgcaccgatcgaggagcttgccatcgtccccctctccacgctgccatgaaaagttgtgcccctgactccgcgcaaccgcggggctcgttgccatcctccgctgcccgccaccgacctcgtcatcgacttctgttcctgcagagagctcaacgactgtcgccttgatctggaggctgtagcaacggaggacgcttgcgacgaggaggacaagatggttgtggcgccctgatctggttgacgtcaaagctccatggcaaacctcgaggtggtcgccggagggggaggggaaggcaatagggggagtgggagggaaagcagacggaggggttggaggagccggcctcggcttgctcgccggtcgtgcctagcctcaatccacacccgccgccgaggccattccatggacaccaccgccgagacctgcctcggggtccttcgccgccgacgacatggggattggtagggagagtagaggcgccggccaggtcgtcagcatgaacagaggagagggagtggccatgaggataaagcagagaggggaagatggattttatcttcttttctggattctaggttgttgcaaattttggacctccacacaaattaaagaaaatatgagaactgaaaaaaatgctaggggctaaaatataaaattaaagtcattcctagagccacttacaatgtgaagaattcaaattttgtacacgtaaccctagcttacgtggcactccgaggctcctcgtatgagggcaacgtattgtgaacacccttataatgcttttgtacttcaggtgtacgataacatatatgaatattcatgcgtgtatttgcataggctcatttttctgaatgtgcaaatgagggcactcccaaccctccacatcaaccagttctcatgacatttaagtatattgccacataagaaagagccgaggtaagagagttaacgaggagaggagaaaaatgaaaaaaaaatcgtttctcatgtaaataattagctctacataaaaactaagaataaaaacaaagggatgcgtggataaaggagatactaaatgataggtgtgattggatgataatttattttcaagaaaccatccattgagttagtttctacaaatagtgtttgtacgacattgcaagaatgaaaactatttaatagtttttgagctaggattgtcctaaatgtgcccactatagaatagcttatttgcgagtagtaagagtgatcctcgttgaacgaacacatctcctaagaaactaataaattatgagtactatgctaccgaccatttttagacgaacgcatcaaagagcatgtataatgagaaaaaataattataccccggatgaaatagcggaactctctataaaacacgcatttaaacaaatttattacatatattttataaaacgaatcaaaattcaattgccagcgaaatcaacccagatactatagtccggtctctctgtcccccagtattccattgttggtgttccgcatcctaattcataagaccaaatgttcgtaatacttgcatcaagggtatttgagtaggacgatgactttggtacaaaggccatttccccttcgcgagtgacaagatcaacatgaattgtctcaggccaattgtagaacctcgggaggaaaactttgttctccatccacttaaatttgggcttctttattatcgttgtcagcgacccagtgaacactacttgaccatgcaggctctccaccttctcccactccattgtttcctcattaagcttcaaaacatggaccgccttcccacggcgttcaatgagtacaaccatcaacccatattggctggaccggagcaagtagctatcttcacatttgaacccaaagccgtcaggcttgtcaagaatctcaaatccattgtcatgcctgcaaggatcatagaccagcaacctcccatcttgagctagaagatatagcaagccgttatggaggaccgggttggtgtccggtgatacccgaatacgtggcaagtcagggtgatattccgtcaacttccaatcctcccactcaccactgctgtttcggatagagctagcaaccttaatggtaagaatcgcctcgacaccaaatagcctctcatcaccgtcagagacaacaaaattgaataatgcatgaggttttggtggcaacacttcaacaagggcgccagtgacgaggtcaatatcaaacaccaaggactggtccacgcacatactcagatgtcgtccggtggagcaacagatcttcgcgccgggcaccttgagcagtccatcgacctcgaaattcttgtcgtagtaagggctatagtaccggatgttggcggtgccaacgccggcggtgctgaggaggagcggggtgatccacgctgggtagaaggacgacagcgacacggcggagcgccattgccggcacaccaatgcggcgtttgggtggctcgaccaccgcagactccccaggatccggacgagcacgtccgtcgggagagacgaccagccccggacccgcgacgtcgacgcgacggcctccatctaggttgctctcgccactactatatgcacgtgaccggtgttttctgccgcttttctcgtggtgggtcgcgtgccggcttatgtatatataggacgcgtgcggggttattgcgagcaaataccaatcagtttaatgctatgtgcacgggagtcctcgccaaatccgtgtcgaatactgaatacacagcacagcgcagcagggcccatatccatcgatatcgagcccgcgagagagaaaaaagggaaccgcacgtaacgtaattatatgtacgggagccacgagcccgcacggtagctctgctgcacgcctgcactgcacgtacgtatggtaacttgcaacggtgaattgttccaaaaaaaaattgcgaaagaggaggatgcacgattactttactttagaaaaactttttttttaaaaaaaaggccaacggattttccttgtaaaagggtatcctttatgtgcaagccaatcacttcatatagatggggtacgatgaaaactgtcggaatcggtagtcctttatggaagtaaattctcggtcgatcgagaattaatggtcatatttatcaattttaaaatttgggtatcaatttataataatttagtgtcgataataggatcctcaaaacgttgcaattttacgactttacatgaaataattacgtagcactaggtcaaccatatatgaaaaacatgtgtagcactcggccaaccacagtatctctatctctactattaaaaaattaaatatgtttttgccagtattttggtacgtcatccgtgtttgagtaggttttaaagttcgttatcttttggaaatacaaatccgtatttgaatcagcctttaagttcattcagttttagaaatacaaaaggagtcgtataagaaaacttttttaaaaaaactcacgtactaatttgagatgaaagtcggactcctaattgcagctcataattaattttctaaaaaaaatatccaagcgaattcacacaatcctcccgcatcgggcgctcgaaaacgagcgttttaattaatacggtgaggtgagttgttggtacttagtgttaggaaacgatagacaaataaacgataaaaaacaatagatcaatcacagaaggcacgagattttaacgtggaaaaccctcccaaaacaggagagaaaaaaccacgggcgccagcgagcaaaatatcttcactatatctggggtgagattacaacgcctcacggtggcttaccagaggtatatatatggtggaaccctggaagggatgacgatccgtttcgtgggggctccgcccccgcaccccgggcgtccccaggtgcacggcccaatgggcctccgctacgcaccggcccaagcctctcggcgacgggcctccgctccactacggcagaagctggcctttattaagtgcaaataaatttgtatcaaaactcaacacttagtgatcttgaataacatgtgttgcacataatccaatttgatcataccaattttcatccatatacgtgcatacgtctctcaattcatctatctacttacatatatacttggtcaatttctatatatcatttacatgttttggtaatataacattctatatcatttaacggttgttaaaattgaacttgcaatcatgatttgcacttccatttacattgcgagcttaattgtttgcaacaataaatttgcacaccttgcaatgcgtggacataatactagttcaaataaaaaatgatatacatatagatatacgtacgatcataagattcgactaatgcagaccctgttttatatcccaccccaaaatttttcaccctgtcacatcgaacgtttgaacacatgcataaagtattaaatataggctaaaaaataactaattgcacaaattgcgactaatttgcgaggtgaatcttttaagtataattgctctatgatttgacaatgttgtgctatagtaaatatttgctaatgatgaattaattaggcttaataaattcgtcttgtggtttattgatggattttgtaattagttttttattagtgctcgagcaccccatacgacactctatataatatccaatgtgatgtgacaaaactttacacccttagatctaaacacccccgtagtatatgactagggctaagccttaggtggtgtttggatccagggacttaactttagtccctgtatttagacactaatttagagaattaaatatagactacttacaaaaataattcaataaatgaaagctaattcgcgagacaaattttttaagcctaattaatctataattagaaaatgtttactgtagcatcacataggctaatcatggattaattaggctcaatagattcatctcgcgaattagtccaagattatggatgggttttattaatagtctacgtttaatatttataattagtgtccaaacctccgatgtgatagggacttaaaagttttagtcccatctaagcagggccttatgttgcacacaacaaatgactgacgtcgtgatgaaacctcacatgtatttgttagcgtgcctcacgctgcaatataggctgtgtttagttcgtgtgccaaattttttttaagtacggatacacatttaaagtattaaacatagactaataacaaaacaaattacagattccgcctgtaaactgcgagacgaatctattaagcccaattaatatgtcattagcaaatatttactgtagcaccacattgtcaaatcatgacgtaattaggctcaaaagatttcgtctcgcgatttacatgcaaactgtgcaattgtttttttcgtccgcatttaatgctccatgcatgtgtccaaacatttgatgtaacgaaaaagttagaagtttaaataagaaagtttgaatctaaacacagccatagtcggacagaagtcgtatgtgtaatagctcttaatttgaatacctgtttgaaaaaggtactaaaaccatttcccctgttaagaatagctctttgcttttatcagcagaattcattcgaaaaagacatcaccaattgataattacatcaaataaaaaaaatcattggacagatcaaatgcctcctcggcaagctctttggcactttctttgcttgtcctcctacgaaagaaaccgcggcgcgccgcgtgcgccggcgaccgtggcgtgacaagtcagaaaatcttcatgttcctcaccgattgcggcagcttccacccgccgccctccttcttctgcgcgtcgcgcccgcactgcccggcgctcctcgcggcggccgcggcgccggcggccttcgacgccgcgccggcgcctgcgccggcgcacgcgtggtcggcggggaaccggtgcttgaggcacaccttctggccgcaccccttgcacccgctcgtgttggagaacgtgagcgtctccttgcaccgcggcacggggcaccgcggcttgcgcttcctcgccgggtcgcaccgccgcgaccgcgcgtgcgccttcagcacggcggcgtcgtccccgcccccgtccccggcccgccgctcgatggcgtcgccgcaggcctcgcagacgacgacggtgcggccctggtccgcggcgcgcgcgcagccgtggtcccggtacgtccggtgctccgcgcagaacgtcttgccgcagccgtcgcagtcgaaggggaggaagtcgagctggttgcagtcctccctgtcgcactgcgcccccaggtccgggaacgcctccgtgccccgccgcgccatggaaaatcgatcgacgatttgatcggttgccttgatgattccttcctcctcctcctcgagagctctgaaacgattcgcgttgacgagcgtggatttatagaggcgggggtttgccgtttccgattccgacgcggtttgcctttcttttccggcaagaaggttgggggcagtttggtccggattggaatagtccggtctgctctggaggcgcctttacttagcgaaggcggttttgggtttcggttagtttagtttagccgcgtcggccgtgacgtgtcgtgctgggctggtggggccgtgtggttggtttctttctaggaggaggagaccgagtcggatttgggggtgtttgggggtcgaaggcagcatatgtgagtgagtccggattattgagacggctcgtttagtgaaggcccaattaggtgatttctatggcccaaaattgcattaattgcagatttcaaggcgtcaatttctattggaataagttcaccggaggtccctcaacttaacaacgagattttttgaggtcctttaaccacaaaacccgaaacagagatgctaaaaaacaatcgacagtttttggggcaaaaaacagtcaaatgtaactataatatagttatagtgtaactaccatgtaattacactatagttacactgtaactatagtagttacactatagttattatagtgtaactgtagtgtaactacgttataatctctatataagttagatatgaagttatatttattattttaatatttatataaaagttatattatagttacagtataactattacaattatgctatagttagatttgaaagttttttttcccaaaaaactgtcgacagttttttttagagagtcccaaccagaaatgtgcacccctaaacttacacaaaccgtgcacacaaggtcatatgacagtatatgtgggtggtttcgctgacgtggcatcctagtcagaaaaataaataaataaagtacatggggcccacatgtaagtgagagaaaacgatgcgagccccacatcccttctttcttcccctttcttctcttctcttgtcttcttcgacgggtcgagacaggcggagcgacggccggcgagagcggcggcgggcagcgggcgaccgcggcgggaggtggggcgggatccgggacgggttcctcgacgggctcctgctccgggaggggatccctgcggccgacggagatgtcgccgctggtggcggaggagggaggacgcgatccagacgacgatggacgcgagcacctggtagtccgggaggaggtagtacgccgcggcgaggagcgccatggccgcagcggcgtaggcggcggcgtgggggagggagcgggatggttggctgcagtcctggacagggcacatcaacgggagccacgtgaacaagaccaccgcgacgagcagccacctcaacgacgcggccagtagcgcgaccacggaggacgacgaggtggacacggaggaccacagtgggcatgcgcggccgccgccgttctcccccgccgcccctgcctgcttcgcccgccgctctcgcccgccacccagtggcgaagccaggatttagagatggggggtgccatctacgagacatggtaattcacctaaggttcagtgaacagtgattttgtagtgttgatgcatgatcggtaactcgatatcatacatgttacagcgattagctacaagagataacaagaacccatatatcatgattcgccaatttaaaattcagtaatatttttaatatatggatgattgaacagtttgttccattaattggagtcttgcaatcacttctaaaatgataaatcagttagctaagtcatttcagaagtcagttgtcctatatcctatatagttagtctcatctgtaactaatgatataattaatagctaaattataagtgctaatcatccttgggagaagagaggggaggggaggtcacataggggttaggggggtgttggccctccctggcccctacgatggcttcgccactgccgccacccctacctgcttcgccagccgccaacgcgttcgcctgccaccgccatccctgcttgcttcgcccgccgccacagcgctcgcctacccccgccgctcatgcctgcttcgcctgccgccgccgtgcgccgtgctcgcccgctgccgccgccgctctcgccggccgtcgccccgcttgtctcggcctatcgaagaagacgagagaagagaagaaaataaaggagaaaagagaagaaaggggaagaaagaagggatgtggggcccacatcgttttctctcacttacatgtgggctccacgtactttatttatttatttttgctgactaggatgccacgtcagcgaaacctcccacacatactgtcataggactttgtgtgcacggtttgtgtaagttaggggtgcgcatttctggttttgtggttaagggatctcaaaaaatctcaagagtaaaatacaccgctggtccttaaacttgaagcgtggtgtcacttagatccatgatcttgtaaaatcgacattaaggtccatgaacttgtttaaatgaatcattgcggtccaaagcacatttgacaggattgaccgtcctacgtggctgtacagcgtggccccatatttgcacttaagcccctacacacctgatccaaccctccactactgctgttgaccgccgctggcttcacctgctcgccatcggctctactctctccctcctcctcctcaccaccttccctctcccctttccctttccctccggagacgcggttctcgccagtgagcgacaagacggcctcccacgccttggtcagcactcgcggacgcctcccggaccttcgccatcatgtcgcccggcgccgccgccaccgtcggcacgccctgcgccacgtcctccttccgccgcttcaccacaccagagatcgtcacccccttgtcctgctactgcccaatcgtcggctcgccgaaggcaagggtggtggaggcgtccgtgtcctgcgcggcgccctatgattgcaagctgccgccgacgcctgggatcacggtgccgatggactgcatcaccagctgcaccttgccagccacgacggtcccgacaccgacattgggtcgttcggcacatccacatccggcttcccgacgccgacgtgcttcgggtcatcggagacgctcatcgaatcgaaggcacggacgatgggcatcgcatcaatgtcctcaccttcctgtggcatgcgcactggttcatgtcactcatcctatgcgctgccacatcgcgttcatcctcctcgctgctgctgttgctgctgctcccgccagtgctgtcgccgcccttctccctgccaccacgccgccagcgaggtgtcgcgtcgcggatccggcagtaaggttggatgcggcgccgacaactggcgagaaggccagatccaacgttggcaactaggcggagctcgacatccatcactccggtggcgaggcgtcgcggcgcggatccggtgccgacgaccagcgagaagcgagaccggcggatctggccgtcagtgaggcgtggttctccccggtggtgcccctctcttcggcggcgatggaggaatggctccggcaagggcgtggggcggcgggaagggagactgagccaggccgtgactacggctgccttcttctccgtcgagctcccgacggctaccttgtcgagctcgagcccgacagtggcggcaagagctcgagggctcgcaggcatgatccacctcggtgacgacgaccggggcgagctcgccggccggctcacctgcagggccgtgaaaaaagagagaaagagaagaaatagaaaaggattttggggaagaagagggtggattgggcacggaggggtctaacagcaaatatgcagccacgctgtacagccatgtaggacggtcaatccgatcaaatgtgctttggaccgcaatgattcacttaaacaagttcatggaccttaatatcgattttacaagaccatggatctaagcgacaccacgcttcaagttcaaggaccgacggtgtattttactcaaatctcaatgttaagttgacggacctccagtgaacttattctattgctattagcagtttgaaaattgtttaggcccaactttgtgtccaaaaaatgttactccctccgggctgataatacttgtcgttttgaacaagggtgaggtcaaactttagaatctttgattatgaatcattttcaaaatatttgtctttcaaatatggtgaccacatgtatagattagtcttaaaaaatactttaataagatcatatatttgttaatacttttttacatattatgatagaaaatgatggtcaaagttgtttttcgaagaccgtgctcttgtccaaaacgacaagtattatcaacccggagggattagttgttagtgcttactctgtactagaggtggccaaacgggccgggccaaaacgggcggcccgaggcacggcggaacctgtagccggcacggcccggcacggcctgctacagtaacgggccgtgccggcacggcacgagtagccgtgccgtgcttgggccgccggccgagcccgcgggccggcacggcacggcacggctactgtagtaagtccgcatctcatccttccgcaagtccgtatctcatccctcccaactgacggcccagcccgctagccgcctccgcaagtccgttgagcacccctcctagctgatggcccagcccgccagccacctccgcaagtccgcatcgcatccctccgcgccatttcggttcctgggccaaccgtgccccgtccacggcccatttttcattcacgggcccgtactgacacggcgggccacacgcatgccgtgccggcacgggcacggcccggccatccacgggccgtgcttgggccggcggctcggcacgtgggttgggacggcacggcccgtttcatgagccgtgcctaacgggccgtgccgaaacgggccgtgccggacccgtgcccgtgccgtgccgggccgggccgcccgtttggccacctctactctgtactcgtactatggtgatggtgcaaatgcaacgcacggcaatcatgttacgtctgcgtgaatgcatgcttctgttctatctgcgcagtacaagtcacactatctttgtggatagaaaaaaaatagaagagatataaaatgcaagcacgtcaaagtataaaaatcacaaaccccatttctctgttatgaccagccatcttcgtggcatgaatgcatcctccttgccgctgaaaagtttgggaagaaaaaaaatgacattaccaacctcgaattaaggaggaaatccctaaaaatttcaaattatagatgcaaaaagggaccgctttgtctctccctccccccgtcacggccatgacaacgctcccatagtcccacatttcactggcactattcattggtgacagatgagaatcgttttcagccccttcattgctcgttgatgaaacgcccggggtccaatccaacaacgcttatcgccattcgcctcctcatccctccgtttcagcctcgaccatggcagccggtgcatgcaagacgcgaatcatatgctgctgctgctgctgctaagacagtcacacatgtttacaattccagtgaaatccggtccaaaatttgtaaaattcagacaactcggaccagttggaaaacacaaaaccccttgatttttcgatcaagttctaaaaaaaattaaaactaaattttaatttttttttcatgagatttatttaagagttcatcatttttttgttagtttataaacggttttcatgaaatctctggctagcatatacggaagcttgggggcaggtaaggtaggtaggtactccggaggagccgggcgaagggtcactactcacacttcactctcactctctcgtaccgaagcagtcacgaaagttgtcagcgtcatcacgaacacgcgacgacgcggacgccgcaacgacgagctagccggtgacctcagcggcgggcgcccctcgcgtcacccagccgctgaccaatctcgctctctgcagcctgcacgcgctccatgacagacggacggtgctcgctttccctacctttaccggccttgcgctcagcggcgggacacatctctgcacatggctccgcccgcataaatccaagcagaaaccaccacctcgttttgcctggccgctctgctcaacttccaagctccaaagttaagcaggcagctcatctgtttccaaaccaatccttagctatgctatggatgtgtttagctctaggatataaagtttcgatgtttcaaatcggatatacatacacatatttgaagtattaaatatagtctaataacaaaacaaattaatccgcgagacgaatttattaagcctaattaatctgtcattagcaaatatttactgtagcaacacattgtcaaatcatgacacaattaggcttaaaagattcgtctcgcaagttacacgcaatctgtgatattagttatttttttcgtttatatttaatactccatgcatgtgtctaaacattcgatgtgatatggtgtaaaattttatcacgggatctaagcaggccctatatgtgtgggccagccgaaagcccgaaattgaccattgccaggcgtcaatgcgactgtgaatccaggtactctacaaaaatgtcaactgttatacagtttattcgttagcaacttggcatggtcaccgttttgcctgtaataaactagtaactagaagtaacactaaaagtacagtaacagcaaggtaaacgacaacacttggcattacgcgcatcagccctgatataccaacaactcgtgaagactactactactacagctcgtgtactggattgcacggccgggcatatagcaaagggctaacttcctggcgcatccaaagcatgcttacccaatcgaaatgtaccctatccgttgcttacattacactacaaacaaagcagaacgaactgttcatcgtcggaggagggaagctaattagttgctcgtgtgatggcttacttaatccatgtttgttcagaatcttctttctttaagtacgtcccattcactgcctgtagtgcctactccgattgaccccttcacatgcagtgcatagcttacctaagcgttgaacttgcatgactgtcagacaaagttccaaatactcctgtcggtccaccttttgcattcttttctcgacgaaaaggtttttgtttgttgccgcccttcatggtcaggcgattggcaccactcttgagttagttttaggtgctagattccaactaataatcacccttttcttgttgccagatgcacacttttctggtatggaatctagcattttgccaccaccattatgtttgttgtgcatctgttatgaacttcctatctggttttgtccttgcagaaattcagattgggagcagattagcagctcctcaggttactggtatagaatatcattatacaaccaccatttgttaaaataggttgtgtttagatccaacttcagttcttttccatcacatcaacctgtcatacacacacaacttttcagtcacataatctccaattttaaccaagactgtgtttagttcagcgcaaagtttggattttggttgatccaaactttagatctaaacacaacgcaaaatctaaacttcgcgctgaactaaacacaactatgattaaaatccctatcaagttctgttcctgcagaaattcaagattcttcggccttcggagcaatgcgtcacagcgtcagtgagaaaagggtctgtgtcttatgacatgggcaacatccaggaatcaagtggtacacgggagaccgtggagaaaagggtcaggcttgcatatgaccctacaggaaatgtagaccatactgtactacctttggtaggggacaagcatggcctcgccgtccttgtcaaaaattttaaaaaaggataaattccatatgtagatccgtctatggacagctaggattgaattctttcatccaattatcaagcgctgccgaggtatcggcagccactgatttctttgattttccatgaccaatcaccaatgaacacatcggtttcatctacaattcaggtagctttctcactttgtacagaaaaaaaaagaacctgggtttgccaaactttcatgaaaaaacctgtgaaattatgtgttagcagcagcagaacagagaaaattcagtcatctgatgcaacaacgtacagtggtaactgctaagatccaacagaaaatttcacacaaagcaaatatcacaaaatagagtatcaagcattagaaaggtgctaagcactagtgtaattggattggatcggagcaaaaggattttgatcttatttacagatgcagaaattcagaagaatttcagacacatgcgtctttcttcctgaacaatgcctaagtttggaaagtacacacagaacaatgccattactctggcttgcaagcaacacccgccacacgcgcgtcgcgagccctgtcaactttacacatccgagcacaaagtgcactacacatgggagctcgccggcgccgccgccgccatggcgacctcgccggcgtcgaccagcgatggcagctgtcgcaatccgcgtacctaattgcctcaactgtctaatggtgtactaggtattcggtggaatcaatcaatcacacggtggtggtggtggtggtggtttagaattcggccgtgttgccgcacgacgaggacccgagctcgcgctgccggcggcggaaggacatgaggccgtcggacacgatgctcccggcgcagtcgtcgccgtcgccgcactcgaggctgctgccggtcaggtcggccgcgtcgtcggcctcgttccgcatggcccggagcgtcttcctcgccatgtcgcgccgcacgatgcccggggcgcactcctcggcgacgcggcggagggccgcgtccgcgccggcggcgcgcgcgaggccgcggaaccggaggctgccacggctcatggcgtacatcgccgcgacgcaccactcgtcgagctcggcgctgcgggtgtcgtgggagaggatggcggtgactgccgccacagcgcccgcgtccatcaacgccgcgcggtcctccgtgcacgctgccacgttgcatacgaccatgagcgccagcctacggatgggcatccgctctgcggtgctggacgcgacggcgaggagagcctttggcgcgcccgggaagcgggcgatctttgactggttgacggcggcgagggagaggtggtagagcgccatcccggcgtcgcggcgcgcgggcgcggcgtgggcgggggaggtgagcaggtcgaggaggggaggcaccgcgccgagcacgccgatggcggcgcggttgtcctcgttcagggcgaggccgaagagcgcgccggccgcgtgctcacgggcctccggcggcgacgtgctcgagcggagcacctcgacgagcggcggcacggcgcccgcgcggacgatgcgcaccttgttcgccggctcgagcgtgaggttcaccagcgcggccgtcgcgtcgacacgagcgctggcgtggcgcgggatgagcagcacgcggcggagcgcgccgagcatccgcggcgtgcagagcgcgcgccgccgctccgcgctctcccgcgtggcctcccggaggccggcaacggccaagaccacctcctcctcctcctccgcatccatcaccttggcaaccaccacgtcctcgagcggatcaaccgccatctccacctgctcccggaccgcatccttgtttgtcccctccttcacgggcttcacaccaacctcgt

SEQ ID NO: 83099 - DNA, 20799 bp, Oryza sativa
  unsure (1)..(20799): unsure at all n locations
gtcgacaagattcaccgtgattagtttcacccctagtttagcttaatgaactggctagttcaggtggtggtttgggcctgttgcaacgtggtgtaacgttggacagtgattggttaatatggattaattactacaactgttttactgctttcaactactgctttgaaatgccggctttatgcaaaagaacctttagcctcccttggatatatcttgcatcatacctcctcttccggtgtgacttgctgagtaccgtgggtagtactcagtcttgctctcttttcccccacaccagagttgaagtccttctcagttgaagatgtctcgaagaggttggtttcgtcgctgccgtcaaggattgcctgtggaatggagtcgcccgctgcaggagtcaagtcttcaggcttagctcgcttttctctttttccgctgcatttgtaatcttttatatttttgtaagacgtggatctgtatgtcaacaattgtcgtttgtgtaccctggctggtcctggacaggggtttaatgcacattcagcttagaaattctggttcgtgaatttctgggcgtgacacaccagcacctccacctccacctccattaggggcagcagcagcacctacacctgcacctccccttccccttccccttccccttgtagttccacttgcactagcactaagtaatgcaaaaaattagcaatgacaaaataaacaaaatcagcattggattagttaaaaacaaggaaaaatgctagtagcaatgaatgattcacactgatgtgggtgcatcacttgggtcattgatcccctctcctgttccactttgtgaagatgagagcttcctcttttgacttgctgtgagacctccctggcaatgcttcgctgtatggccaagctcatgacattcactgcattttttccttttactagtgctagcctcatcagaagctcttatcctagccactcttggtcttccaggtttccttctcaacctaggcttcttgattttatagcntagatcaacatgtgcccactcatccttagatgccattggattgaactgtcctgcataagccattttcaacatctctatagagaagcacttatccacaaaatcatccatttgtacctccctattaagctttgcaatgaaagccaaagcatgatcacaaggctttccactcacttgccaagccctacaagtacatgtcctttccttcaaatttactgcatgtgtaatggtgcccacagttacttcaacagttccagacccacatatcaatacctcatggtttttgagggtcttgctttttgcattcagagtgttagtaatagatgggattatcctttcatccattttacaagcaagcttggctcttgacacaaacttgctaatgatcatctttcttatggtgtcatgcaagtcaacaatctgacgatccttgatttttgagacccaactattgaaacattcagagaggttgttattgatgtaatctaccttgcactcctcataaaacttgcttctgctccaaatgtatggatgattgtcatctaaccaggttagggcttcagggcacctctcctttatcttgtccatgtggtaggtgaacttcacatttgtgaagctcttagcagctgcccacatattttgggcaaacagaggaccatggtacttcttcttcatgttcttccacaagtgtctcatacattccctatgttccactcctggatatacatcatctacagccccctctattcctttgcctgcatctgtactaataaccaaacctacaatggtacaaaattgtagttagcaactggaataatatgcaaatgcaacatgaaggatgaaagatgaaagatgtaagaaaaaatacgaacctgtaggggtaccaatagcttccttcaaattttggacaaaccaagtccaactttccttagactctgtctcaatcactccgtaagcgacaggaaatagcctgttattaccatctattgcaacagcggatgccaactgccctctagaccttcctgtcaagtgagtggagtccatggcaatgtatggcctgcatccttgcaagaacccatcaatgcatagtttgagagctactaagaacctcctaaagcacacatcaccattattctcttcagtgtccaacttaactacactgcctggcactgatctcagaagctcatcttgataagtaggcaacaagttatagctgtcatcccacctcacatttatcatgtcaagtgctctctccttgcctccgaaaacccttaaataaggtatattcactgagtatttcttcttcagctcttccttcagtttcttaggtcctaatgaggggtcatcccgcagcaactcaactactcggtcagctacccatttatttgaagccattgtttcaccgcaattattaaaagaaccacaagtgtgctttggtccacttatcttaacctgcagccatagagtgcatagacaaaattcatgttaagtaaggacaaggctgaaattacttaatgcagaaaagaactaaaaaaatacaaatctgaacttaccttacatccaatgtacttgggactagtagatgcaaaaacagccacttgcaaccttgatccgcactcttgcatttggctctaaatcttttcttgtctttcttgataatgtcaaaagcatgatcattcaagatacaatgatgtgtaactgctgacttgcattgattcacatctgggaacaccacaccaacatcaatacatggatcatgaacatcatatgcaaagacagggacatcatcgtcgtcatcctcatcaactatttcttgatcaggatcaaactcagggtcagagcagtcaaattcagaatcaaatgattccgccaagtcagagtcatagctgctatcactctgtgccacaagtgattcggtgtcagagtatatgccctcatcaacaactccgactgcctcctcatcacatggacccctttttttggatttcttggctctctcattagtggctgtcacatttgtggctctctcattagtggctatcacatttgtggctctctcatttgtggctatctcatttgtggctatctcaatagtggctctctcattagtagctatctcacttatggctgccctattcctcactgaaggatgatacctacgttttgtgggtgaaaattgcaatggaccatcaaaatcaattatttgggcatcaatgcatacaacccccttctctaggttcagctgaaaccaatctagcgattggtcatctaatgtaatctcaacagagtcaccatccatagaacaccacaaagtcatgtattgcttagaaccccatatgaagtgttcagctatgaaatttactaattctagcaagccatagttatgcatgtcaacaagttgggttggcgatgttttaccctccatataggtctttgacccttcatctagcaagctgaaaaacgacccaactctaacaactaatttcaactcattgtgatttgtcctacaaatcatagcaacaaaaatatacatttagctaattgttgcatgttacctgtcgatgatatgggcccgggggtatcaggtttagagggaggaggccgccccccgataccacgtggccctcccccgaggggagtcaggcccaaggtggggtggcggccactccttcctcaaagactagtcggaggaggctgccccccgattccacgtggccactccttccccaaagactagtcggaggaggctgcccccccgatgccacgtggccctcccccgaggggagtcaggcccgaggtagggtggcggccactccttcccagagactggatggaggaggctgccctccaatgccacgtggccctcccccgaggggggtcgggcccgaggtagggcggcggccactccctggccgagactagagggagaaggccgccccaagtgccacgtggctccccccagaggggggatcgggcccgagttcgggcggcgaccgccccctcccgtgactagggttcgggctcccccgaccccctctctacgtcaccacgtacagtgggttaggtgtccgcctccaggtgcccacctacccgcatttatggcgtcctgagcggtcgcgccacaccgcatttaatgcggtgtgcagtcgcactcaaccggtctgtgaccggtcgaatgactgatgggacccaagatgtcaggcgcaccatcgcgtgtgtcaggcgacgtgcagcccgacatatcccatcaaataatgatggtgagaggttctcatcctcttatcccaaccggagtcggtcctcccgctctggtcaaagcaaggctcccgtttcccggtgtaataggagctcagaagtcttcacccattaaatggtgactgacaggggcaccccccgtgtcaggcggcaagatttgacaggccccatcatcaagacgacgtgtgcttggcttcccaagtcaggagacaagacatgcatttaatgcaaagattataatacttctccaccggagctaggttaggttgttgggcccatgtggtaaccccttgaggtataaaaggaggtccaggcctagtggtggagggggggacttccgagcgaactggcgcttgggtctcgcaaccccaagcactggtgttctacattcaatcaatcatgcataggagtagggttttacgcttcttagtggcccgaacctgtataaacctctttggtctgatcgtcttggagtggcctaaccccatcaagaccacacagctccgctcaccaagccctcgaatctcacccgctgcccccggccgaactcacaaaggggggcctcacggttccctggtggaggagttcattctccgacacctctggcacgccaggtaggggacgtgttgtgatttttgaggttctttcgagcgccggcgtggtgagtgtcgcaccgccgctacgggggaaggcgcagcatcctcaggagtgtcgcgccaccccaggcagggggcaaggccccccacatccccaccaggtaagcttggctaccatgtctttgtggcgagtcttcggaatgtccgaggacccccaaagctccagccctgcctcaccgagaagtacgatgatggcgccgacccctccgagtccctccagatctgcacggcgatcatagaggcggcggagggtggcgaccgggtcatggcgaacgtcttctccttggccctcaggggccaagcgcggggttggtccatgaacctgctgcagcctcggttcactcctgggaaacatttcacaggggtaaaaaggtagttcactaaatcaaaaattctttattttcttccataaattcagtcccactaacctccatccaaaacaggggcaaacatctctttcagttcaaaaaaaaagtgggggcaaaaacgaaaaccccaaaaagtaggggcaaaatcaatattagagatgaaaatgggggcaaaaacgaaattatcccttattttagctatatttggtacttgatttaggtctcacttagagcattgtacagggcatacaaatttgacggcacagccctgcctcaaccaagctgggactctaacatatgatggacgccaatgctaacggagcattaatggtagtacatgagagtaacttatatagtatatgatccaaaatataagtccctttagccttatatattcccccgttctaaaataatttcattttttatctatcccatacatatcaatacaaaaccccaaaagtctatgatactcccgttttatcaaatttcaatgtaatcatttctctctttatatactcaaaatatatttatactctatttttataaactctgacgtaataatgtctttaaaaaaataaacttattatagggcaaatggaatggaagggtctaaaacgaagttattatgagagggagggagtaattactaccacatatattatgagttataggttaaagataacctgattttgagacatcatctttttttttcttctttgccgagtatatgtgaaagtcaataatgtcgctagttactcctaaattttctaaaagcaacttaaactttagttatgatgaattattggcttggggatattgacttcaaatctaatattgaacgggttccacttaccttttataagaacaatgcgatgcgtgacggtgtgaggctttgtaagatattctatttgttactgacgttgtgtactacgcagtcgtccagaagtcagatgctcaagtcatacgtatagcatttcgcctttatatggataagtatatccaacctagtcagacatagatagggtaacaagcagagtaaaattcatctggatacggtttagaattgagatcctcggcagcgcgcccgtgcggaagtgcatcttgcgcggaaaccatcgtgtctctcggatttgtacgacaccggtgcgtgtcgaatttgtactacggctcagcgggtttccctgagtttcaccgccccaaaaccgcgagcatccgccgttgcacgagccgttggccgttgcgtctccgccgcgtgcgcatgggcgtggctcatctggggaagcggatcctctgactttgggttgcaaagtcacaggcgtgcagttctgctctatccaccgttcgttatcatccgacgatccaaaatcgtccccccagttcctttcttcttcctctgtttccttgctcctatttctgcgtagcttcacggttggccgccatggctgtcactcttggccaacaaagcacacaatttctgccgctcaaaaggtgtagacatgttgttgaaaattttcttttaaggctacagcttctgtcttagtcagattgttgttgcaacaagaaaaatggcattcgattattgttgaagcttctccctttgcatgatcttacccaaagtctaagaccactgaatttgaacatcactttctccagtgaaggactatcatcagtacttaacgagctgacatttcaacgacgcacctggtatcgtgtccccatatcatcaccaagctctattcgcgcaatgatgcggggatgcgtggggtacgaggctaaaagattgccctatagcaagccccttttcgttttctgcatcggccatgatgcgattgaagtttgttgaaagccgacaatggcaaccggccatgaagctatgcaacgaagggagcaaggaacggaggaagaagaaagaaattaggagaatgagtttaaaccgtctgatgataatggacggtggatagaatggaacttcacgctcatgactttgatatgcaaagtcagaggatccgcgtccgctcatctgtcatctcgttcttctcacgtcaggaatctccagagggacccacccggccatccacgtgactagttgtacattttcttaattcccttatcctttgtctgccgtacgccgctgattttttgttacccctaaaaagtctcctttccaagttctatttggactgagactgttacgtgggccccatcgacatggttggcttggaagtacacttccgatcgtataatgaacgtcaacgtgtgcaataaaagatatcttgttgattttgttttggagtgttttcttgttaattggatcacgccgcaccgcacttgtccgtgttggcctcccaaaaatccgttataaattatcttttatctttagaaaaatcactcacctcaaaagataatttataaccaaaagaccaaaaaccaatcgcacaattgtcaagccaaccaccccagatctacttacgacaaacacccaatccaggccgtccattcccaaacaagagcggatctgagccgtacaaatcctgagtgcggatccgcttatggcgcaaaggcgaagggtactcgaggctaccggttaaaacgcccaagtcagtggctctcgtcctcctttctcctacgcggccggagagaggaggggggaagagaggatctcgcagagcgccatagcctcggatccagaagcggaattcggtggaggtctcgggcacctggatcgatcggaggaagggaaggcggagcagcggtgatggggaaggcggcggcggtggggacggcggtggtggtggccgcggcggtcggggtggcggtggtgctggcgcggaggcggaggaggagggacctggagctggtggagggagccgcggcggagaggaagaggaaggtggcggcggtgatcgaggacgtggagcacgcgctgtcgaccccgacggcgctgctgcggggcatctcggacgccatggtcaccgagatggagcgaggcctgcgcggggacagccacgccatggttaagatgctcatcacctacgtcgacaacctccccaccgggtaagcgcctcgattccgatctgatgtctgattcctttcgtttttcgtattatgtttcctttcgtttttagtattatgggtttggaactttgtgatctaaaaagtttggaattgggaaaggtctcgtattgatgcgaatcgttcgggaacaaatctagtagtgacgcgcgtaaccgtgggaatttatctccgtgctctgattaggaccgactgaccttttgatgggatggtaggaaatgtgcgaattctttttatgatgtttgtacgaaaatcagattcccccgaaaattgcgcctagtggtgatccgaagagaatggaactataatctcccatttgatcttcatgtggttttggtgtctcgtattcgtgaattgggattttttttgtacgttccgatcgaagctagatcaatcctagctttgccaaacaatataagccatttgttataactgaaataagttatgtaaccacaaggaaacgcttgctctcggactctgctgaggagagccaaggcaaattggctcataccagtgattgaaggaaaaatgtggagtcgtgggcatctgaaattgcttctcatgcaccaggacgcaggatttcggtgatgggggtacagagttactaaagcatcatgcaatgagaaaaaaaatgaagtgctagtatgtgttattaacacaaacataaatcattgttatagaaaaaaatataaagtagccaagagaaaatgataatactcttgacaaggatgatttttgtgcttgaaaatgattgttttaatttagctgattgtgcatacacatactatacatacatgttatagattatagatcacatttgtttgctaaaacaatttgcggggtaccggattacgaactgtacccctcatgtccttgtgtaaacaggattctacatagaactcaaacaagatagataaattggcctatctaagctaggaaagataggtctcccgtcaacatatcctatcgttctcagatgatcttcggttttgtgatctatagtagatcgtccatttgttcctaatttggctctttaggatttctgattatgatatgtgattaattaatttgatcgtccatttgttcctactttggctctttaggatttctgattatgatatgtgattaattaatttcttgttggtttgatttgttaaggcttcagtgacaggtaattaactaatgtatggcagagagtttctttgcattgtggtttccttgttagcaatctgaccaattagatccatcagtcgagcttatctcatggtatagttggtctggtaataagtttctctgtaacctccacatcgttaagctaaatgtggcaggcacatcctgaaggaagtttcttaaatataatgattcattcttattctatcggatccttctaccagtctgttagaactcactcacccataagcatacaatgtttcctgctgccttcttccaaaagtagtaatttcattctttgatcataatgatttccctttgcagaaatgaacaggggttgttttatgcattggatcttggaggaaccaacttccgcgtcctgcgagtccaactcggtggcaaggagaaacgtgtcgtccaacaacagtacgaggaagtctcaattccaccacatctgatggttggaacttccatggtaagcatttgctgcttgattttaaatttcttggagctgtacattccatgcttgtcttatgtattttctgactattaatgcaggaactgtttgattttattgcttctgcattgtcaaaatttgttgatactgaaggtgatgatttccacctcccagaagggagacagagagagctgggcttcaccttttccttcccagtgagccagacatcaatatcgtcaggaacgctcatcaagtggacaaagggtttctccatcaatgacgcggtaaaagtcaaaaataacttttggacataccctgactagaacacaatcctgatccttctttaaacacatgaattatgtcacaaggttccttgataaagcttgattgaatatggcaatggagtatttcaattagctatttgctacaatctccctttgtgtacattgtaatcaacttaactaggttagtgaaaagaaatatcgaccttgatcaggaagcatatttaatttgaggatctttaatagtactcagtattatgtttgcctggttgatcatatctgtgtgaactgtcaagcatccaataagaataatttgattttgctatattatctcctgaattaggttggcgaagatgttgtatctgagttgggcaaggccatggagaggcagggattagatatgaaaattgcagcattggtaagttaatatatattaatttcgtcaatttcttacttccacactatatctatgctcagctccgttatctgaggcattgataatcatttgtatcctgatgctgcttttggggtattcacatctgatgatgtgatgcaaacattgttgacatgatttaccactgatgttaggttaatgacactgtcggcacattggctggtgggaggtatgcggataacagtgttgttgctgctataatattgggcactggtacaaatgcagcatatgttgagaatgctaatgcaattcctaaatggaccggtttactgcctaggtccggaaatatggttagtgtgtgaataccttatgcttgggattatcattagttgtctatgtcttatagatgatcaatgccaacactcttgaatgttaaccctacttaaaaaaatatgtaaacgtggaattatttggtattctctaggtaatcaacacagaatgggggagctttaaatcagataagcttcctctttcagaattcgataaagcaatggattttgaaagcttgaatcctggagagcaggtattctatccccagtattttcctctccttttagttttagccttttaggtggaccgcattaacttgtatgtattttccaacagatatatgaaaagttgatttctggcatgtatcttggagagatagtgcgaagaatcttgctgaagcttgctcatgatgcagctttgtttggggatgttgttccatctaagctagagcaaccgtttgtactaaggtatatttctgtaccatctctcttttgatcttcattccttccttttgtcatggcaaaagccgttttactttgttgttaactatcatgctggtcaagttttttttttcacgatttctgtgactaccccttggataagagtgcacatgatataaagacgttggcatcgtttccattataatattcgcactgttgataatatacccagatagattatggaaggggaagttgtttgtatatcttgaaattatcatgctaaatcagttagcaaatccatggaaggtgacaaacatacactttgttgttttatccattactactttcttctggttctggttgattctcataattgtgtgcaactagaagttatctagcttggataattagggtggtttggtttttgctcaccagtttttctttatgcttctaacccctcaatcttatgcaactctggtagaattttttataagtatctcaattgttgtatcacaggacaccggatatgtcagccatgcatcatgactcgtcacatgaccttaaaactgttggagctaagctaaaggatatcgtcggggtatgaaatttcttgacccaaagtggatacgcaacatccaacactgttcaatgagtactggttgcttatttatgatttgatcttttattcaggtcccagatacttccctggaagtaagatacattaccagtcacatttgtgacatagttgcagagcgtgctgcacgcttggctgctgctggcatatatggggtcctaaagaagctaggtcgggacaagatgccaaaagacggcagtaagatgcctaggactgtcattgccttggatggtgggctctatgaacattacaagaagttcagcagttgcttagaatcaactctaacagaccttcttggggatgatgtctcgtcttcggtggttaccaagctggccaacgatggttctggcattggagctgctcttctcgcagcctcgcactcccagtatgccgagatcgactagctttaaggatgatcttgatgaatgatgaatcaaactccgtttgtaggttctcatttcccccttcaaaatccacataatactcctggctccccccttgaaatcttaccatctttttttggctattctgagggcaaacataagtgcctctgcagcgggatatagctagtatagcgccaatgagtttggaggttttctaatggcataaaacgttggatggcagtagcagactaacagggaaatggaggcacaggcaatttccattcctgttctgtcagattcttttcccccttaattgatgttgagaaccaagatttttttgctctgtattttctcttcgtaataaagaaggggacataatctaattgctcttgtttgatctcatatatgtatgtgactgcactctcactgtcccaaaattttatagatgcatttacaaagttacaatactcattacatgcaaataactgaaggatggcgaatgtatttgtctggtatctacctgctctcctaactagcgtgccatctctcctagatggtaaccattggatcaggttatacttcttattgaccattgttctcatactatgctgtccaagctgccgttgccgtcgtcgatgcctttggtgtccgaaagctgcttccggcggctgccacccctgatcggcagaaacggcgcgccgtcgccgtcgtactccgccaccttcccgtccacggtgttctggagcgcctgctcgcacctcaccagaatctgcagaacgtccctcattgtcggcctcgtcgccggctgcgcgccggtgcagatgatgccgagcttgaacacgacctcggcgtcgtcgccgtacccggagtcggtgatgcacctgtccaccgcgtcggcgatgctcctgcccgattgcaggtgccgccacgcccactccgccagcgagccgtgctcgccgccgtcgtgggcttccctgccggtgatcagctcgaggagcaccaccccgaagctgtacacgtcgaccttctcgttcaccttcctcgtgtacgcgcactctgcacgagacgatcgtggtcagcacaaggtaagtcgctgtgctaagagaagaaatcaagggagaatcgtgagacgagcagcgaggttggttgaggtgaattaccgggagccatgtagccgaacgatccggcgacggcggtcatggtgtccggcgtcccggcctggaccagcatccgggcgagcccgaagtcggcgaccttggccatgagctcagcgtcgagcaggatgttgctggacttgatgtcccggtgcacgatcggcggcgagcactcgtggtgcatgtagcagaggcccctcgccgcgccgacggccaccctgaccctcgccagccagtccagcggcgctcgccggaccgacggcgccctcgccgtcgcgccaccggccagcaatttgttcccgtggagccacttgtcgaggctgccgttctccatgtactcgtacacgaggagcttcgtctccgcgcgggagaggcagcagaggagcttcacgatgttggtgtggcggacatggccgaggatgtccacctccgaatcgaactcgcgctccaggttcttgtccagcttgccgccggtccatatgcgcttcacggcgacggtgccgccggcgccgccgctgctccggctggcgtacgcgacgcggtacacgcgccccgcgccgcccttgccgatgaggttctcgtcggcgagcccgcgcacaagggaggcctcgctgaagtcgaggggctggaatggggtcatcttccatgccggctctgtccgcgcgagccgcttccgcctcttgatgtcgcggacgacgaagaaggcgagcgccccgatcaagacgacgagggccgcgccggcggcgaggagacccgaccggagacccggcgatacgccgtcggatgccttcgcggcgcacgagcgcaggcccgcgaagttacccgccggcgccgccgatacgcagagaccggggttgccgaggaagctctggtcgtaggcggagatggcgagcgcggccgggatctcgccggtgagctgatttgacgacaggttaagctggttaatcttcagcgatcccagcgacgtcggaataccgccggagagcttgttcgacgaaaggtcgagcagggtgagcaccggcatggagcccaatcccgccggaatatcgccggtgaactggttcctgctgaagttcatctgcgacaagccactgagcgacgcgatgctcaccgggatggccccggagagctgattccttgacaggtccagctcctgcagcaatggcatcccggcggcgaacccgtcaggtatctcgccggagaacaagttgttctcggcgttgaacttctggagcttggtggccgtcgccggaagccggccactgaaacggttgttgtggatgtaaagcctcgtcagattccaatacagcttctccggcaggcttccggtgaggtgtccattgttctgcaggagcacggtgatcagcctcgtctccgtccacagcgccgccggcacctcgccggaaagctcgttgtcctggagctggagactcagcagcgccgggcaagtggcaagactcgccggaattgagccgttcaaccggttgccggcggcggagatgatccacaaccggcggttgtcgcagaccccctccggtattggcccggtgaggtcgttgttgtcgacctcgatgtctctcagaaatggcgagtgcttcccgagctccgccggaatctgaccggtgagattgttctcgaacagcttcattatcaccagcgatggaagctgagcaaggctcgccggtatctcgccggagaagttgttcgtcatcaaggctaagttagttaggttcatcaaacttccaaagctctctgggatcgttccagtcagctggttctcagatatgtcgagataaattaagctcgctgctccaatcttgccattgacgacgacgtcgccggtgagctggttggtgtacaggaacaagtactgcagctttggaatgttccaaatcccaggaggtatgcttccggtgaatgaattctgggacaggtcgagatactccatctccatcatctctgtgacgtagctggggaaatcgccggtgaggttgcactgcgccagccagaccgtcttcaggctcgtcaagttcttgaacgatcccggcagctcgccgggggtgaactgattcacctcgagcttgagcgtctcgaggctagtgagctcgccgagcgccgccgggatcgtgccggtgagctggttgcagttgagggtaaacaccttcaggttcttgagcttcgacaccgccgccggtatcacgccggtgaagttgttgttgttcaaggcgaggtaggtcaggttcttgccgagccggtcaatgtcggcggggagctcgccgccgatactgttcatcgagaggtcgatggaggtgatcgcggtgaggttgtagaggaacgccgggaacacgccgccgacgctggtgttctggaggttgagcaccgtgagcgccgtcagcccgccgatggcgtcggggacggcgccggcgaccgcgacgttggggagggacagcgacgtgacgcggccggtgccgccgccgtcgcaggacacgtacacccagcggcagtgcggcgccgcgtccgtccacgacgcgagcgccgcggggtccccccacgcgcgcttgacctggagcaggagctgcttctcgtcgacgccgccctgctgcgccgcgccgcgccgcgcgacgaggcttggcaggatcgcgagcaggaggaggtggaggtagtaggctttgccgctcgggaatgccatgtcttcgcgtggtttcttggtcgccgccggcgagcgcgtgcgttcactcggtgaggcaagcagccatcgcggactccaccgtgagaaacatgggtgggccatttatatgcagtgtgaacggcacgtgcagacttttcttcctccattatcctgtttggttaaatgattgaatttgttaggaatttaggattagtttttgggtgctgcttgcttggaagtttcagccatgctttcctttataatttgatactagttcaccagttggtggtttagctcatcttttgtttggtttttgctggtcagatggtggcgttgtttgaaagggatatgttctagatggtttgtttatgcagctactactaagttaagttaaggactaagctgagcaacgtgtacgaattgcacagctcgtgacatggtttctttatgggagttttgcgatcttttcatgatcaaggtacgacaatatgctccgttggcttggactgtagcatgtgccggcacattactctgccgtcggatgaatggtcaaactattcggaagcacagaggtgtcgatcacttgcgacaaagaggagtggaagatgttgcagatcgcgcgatcttattgctatcacccatggccaccaataatttaaacatctaattttgctccactggccgtattgtcgctgttgaaaccatttcttttagtatatcttcaaaccgattagaactagtatcacactatttattagtcttcaaagaaaaagaaaactattacgagagtcgagattataaccggtcaagcacggcaagtaaatttaaagtggaagcaattagcaaatgatgataagctttttgtttccactgattttacagggggatcatccacctgaggccgggaatgtgagtcgtcagcacgaggtcacgggttcagggtgagttgggcccacgatgtcagtgtcacatctagatgtactcgtgcacaaatccctggtctaaagttgagtcaaacagaaaagtcttagataatgatgtggctctggcgcctctgggttgtctttaaactctttgtggtcattcgttgactagtcgtaggcctgaaacggtaagtgaaagggagcataagatactgcactcaataccacacgtgcatacagtatatagtcggtatatatggataaataccacagtgaaaagtttatccggtttcttcacttctagaataccgagtatagctttggatactccgtttttttttttaacctgaaaatgcacaccgtataggtgctcgatgacaatgctggcagcgacaggaaatgcttctggatgatgcagctgtgcagcccattgacccgtctcccacagagagatcccagcttcgatctcagccgcacgttcggtgatccagtggctagcgatgagtgagagtggccacgaaggaaaggagcaggaagtctcatgtgcaacgtcagaaactgaagaaaatttcaaagagcccggctcgcctttgctgactgtggacttgtgcgtagactagcttcagaaaaacacataaaggatgtcactctgatgcccactgtctgtacaactcctactacctaccagcacattgttgcgttttatattgctaaacattagtactaactattctggcagtaagtccatgattagtctgagttttggtgtagtaggctaggacattgtagactctgaaactcgttgtgttgcagaattcaccgcttagcacactgtccgcaaaggaaaaattgcgctgcagatgtagcgaatttggtttttcgttaagagttcggcactactctgtcagttccttctgtactgaaacttcaacgacttttttgagttttgagtaaaaaggttgtggacagagatgcaagctactgtatggtccaagtgtacccgaagactatatgattgattcgcttccagagagtaacagcttgtgtttttgacttttgagaaaaccgcacgcgagatccagacagggattgtaaccatcaagattctagaacggcactatctgctagatgctactcctcgatttcacaaggcttcagatgttgatatgaggacaggtcactaacaagaattcatcgttctgaaagaaacaccttctagtcctagaatcaaaattcagattttaagcctcgcttcacagtttttctagaagcccgtagaattgatcaggatgtgctcaagcccagttgagcaaggcaagtaatgggcggacggcggatttttcctgattattagctttctctgcaggacattcagcatttagcactttggtaataggaaattaatatccaatttcctggggtctagaattttggactaataatattacagtgcagttcataataccatcatgacagcatgctggacgccttcactcatacgaaattgtccaaagagaagcattatcgcatcatgacagcgtgctggacgccttcacctacgaaattatccaacacaagcatcaaattctgaaatatatatagcaaaatctgaaattgtgcagctctaacatgcatgacgaattgtttgctgcaacatgtcaaatttctactcctacctgtaagtgacaaaaatatctgttacatacgtatttattagtgtagatcttctaatgtgagcattgcaagcgaagagaaacacgctggggttagttaacatggataatccctcaagccattacggccgtagtggccaaattcgtcttcgtgctccaggtacccgcgcgcgaacttgcccgggctcggatggacgacgtcggagtagtggtagcacatcttgcagacgctctccgccaccatgtgcccgcacgggaactcgccgatcaccttcctcttcagccagtggtgcgtcacgcggaggccgcggcggcacgtcttgcagacgcagtcccacctgccgctccggcgaggggtcgcccaccggcggatgacagggattctggcgaggaagccgccgaccggctcgtccggcatcgggatgcacgtgatgacgccgaggtagtcgtcgccggacatgtgctcgaagaagaagagcgtccgcgtggcggggaggacgaaggcgaggcagcggcgccattgccgccggcggcggcgagccacgaagttgccgtgcgtccaggcgccggtgctgcagtgcgagcgggacagcgtcacgtcgccgccgggtgcgaggtcgtgctcgtcgcccgggtgcagggcgttgtagtggtccaggcactcccgggcgagccgctcgttggatcgcttctccctgagggcggcggcgacgcggtcgtacgcgcggcggatggggtgctccactggcgtgtttcgtcgcgaccatagcgctgcctcctcgtcgtcgtcgatcatggctctgctcctgccgccgatcagggcctcgccgagggatcgcgcgacgcgatcgaccggtgaatccgggagcccttcatcattgtgggcttcggtttcggccttgatagttttggtgggctggatatttcggggcccaaaactgctagttttttttcctttttgggctagaaggggagccgcgcgcgcacggcacacacccccgtgcgctgccggcggtcttcccgccgatcagctcccgctccggtcgacaccaccattgccccgatccggatgttcggttctggttagacacttgtctacggcgcattgcacactagtgaccgatccgtggactctgcgcgtcatgagaaatttggatacatgccatcatcaaaagtaggcttcgccgaaatgccgttgtaaaaattccaatttgatttcgtggaatgctatttccaacttaggggccgatgccagaatgacatttcgaaatttcttccaaattaaaatggtaacccaattttcctcacatatgcccataccgaaatgcctctagctaatttatcctctcgctccccactttgtctggcgaccggtggtgatcgacgccgttcatcactgcaggtagcctgtcctctccatactagctccactcttccaatgctggactctctactatcttagatctctttcctttgctagaaagttttttttttttgaacgactcgcacgagacggtgcgaagttctattgatagagcaggaaaaaattacaagattacaaccaaatataccaccacccacacggcgacatcgccaacaacaagcccaggagaaggctaacaccggaccggccgctgctaagcgtgaccgaccgccactagaccaacaaagggacacatgcgagattgcccctataggatgccaaaacaacgtcttcaagaagagaagcgacggaaaaactgctgccgtcgtctgtcaagacttaaaagagccaagactgggctttcgctcggcaatcatccttgaggggtgagacagcgcaacaactccctcaggacatcgttgtcagtccgaccaaggctggactgggttttcacccaccgttcaccacctgtgaatccacggctgacgcactgatgctccaccacc

SEQ ID NO: 83100 - DNA, 896 bp, Oryza sativa
cgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacagagggttgactaccactagcctcctcctcctggttcctctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaaatctaattacaaataaaataatcttataataaaactcaaataatattacatgctaagactaaaatagtcatgtatatgctaagtgtttcgtgcgtatatgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagt

SEQ ID NO: 83101 - DNA, 1506 bp, Oryza sativa
tggtttatatgggctcgggaggggcggacgaggccgggaggcggccggatttctcgccgacgtgggggatggagagagagagagagagattcgaattcgaatccctccgttgcggggtgcacgcgcgagtgggaggagtggggatggtgggtggcgacgtgggcgcggggcgcggagtggggcgcggaaggcgggggaggcgggcggcgtgggcggctcggcggttgccggcttggggagcggcggcgggaggttgaagaaggggccgacaggtgggccccacctgttggtgacccggaggggttagggaggagggaggaaccggcttgggccggcccagccgaggaaaggccggcgcggaaggtgaatggactgggccgacggcccaagaagagaggaaaaaggaggaaaaagaaaaagaaaaagaagaaaggatttttccagagatttaatattgccctttgctcattttaattggttaaaattatttccaaggctctgaaaattccactaaaaatcctgttagcgtattttgacacgtagaatccaagaaaaattccacatgtcgattccgattattatttgcatttattaattagggattcatctctaggttaaattaaacaatttcttcggacgatttattttatgaatttagagcaagggaggggaacttcagggcgtgacagggggcaggccggtgggcgtggcgaagatgtcagcgaactcaaagagtcagagaggaggtcgtccagcaggtcttgagtggtggcggcatgcgccaccagcggcgcaccggtgggcagactgcgccacaacaccatgtggtccttgtgccagaaagacatggtgagttggccaaaatcccacaatatttggcccagggtagacagccactgcatgctgaggacgaggtcgtagctgcccagtggaaggacgtataggtcggtgacgaacacctcggagtcgatggagatgcgggcgtcctggaacatacccggtgaaggcacctagtcaccgttggcgacggtcacatgcaggcccgcgcgttggatgagcggcaagcgcacgcgtgcggcggactcctgtgacaggaaattgtgcgtagaccccatgtccaccagcgcgtggagggtggcgtcgccgagacgaatggagaggtgcatggcgttggacggacgaacacatgtgacagcatgcaggaagatgcgaagcgtctctggatcggcggccggtgtagtgtccccctcgtcctcctcatcatcatcataagccaaatcaagaaggaagaggcatttgcaaaccttgttgtggccgcgtgagtaggtctcgtcgcagttgatgcataagaccttgcgtcggcgttcatcaatctccgacggggtcagacgacggaccgtgcagccagccacctgagtcgacaattggcccaccgaagatgcagtatccgggagcgaaaggatgggcgccaccgaagaagacgctggctcccaggcggcgcgacat

SEQ ID NO: 83102 - DNA, 2918 bp, Oryza sativa
atggcgaactctatggtggtgagggtactgcagcagcacgtcgatgctgaggggttcttggagtcccgtggtgaagaggtccaactgctgatcctccatgagaggtccatcgcgagagagcaagtcgaggaagcggtcgatgtaagcggccaccgtcgtcgtgcgccggtaggcgtcgagctcgcccaagggcgcctggcgcaggggcggcccaaagtgtagattgagcatgtcagagaaacgacaccatgtcggggtgcccaagtcgcgttcgacgcgcatgtaccactatcgtgccccgtcgagcaggtgatacgacccgagccagaccttctcctcctccggtgtatgctgtccttggaagaattactcgcaacggtcgaggaaatgaagcgtttgccttggccgtcgaacttgggaaagtcgatctcgtggtagcgcggcggccggtctccgtggcgactgtcacgtcgtggtcatcatcggcgtcgcgacgcggggagcgatcgcggcctacgcattccagccgctggatggcgatgtggtgcgcttgctgctggttatccaggtcagagagcttgccctggatggaatcaaggacctcagcaaggccctttttccaatcttcgccaatgttggtgacggtggacatggcgcggcggcggcgaggtcgagcaggatcgtggaagtctgataccaagatgttaggagggcgaggttgcagtgttgcacacctcgccgccccggagccgtggtggaacgaacaggaattgtgataactttcttgcttgattcattaatctgatcaaatggcatatatagccttacaatgaaactaatctgctacttaaaaggaactaacaaaccggcaacaaacttaatccactaacaaacttgatctaatcactaatcttaacaaacttaatccactagctcatggtgcatgcgccggggccttcctcccgttcccggcgtcgatatgaaattccccacataagagcacggctaataatacagccgacctgctggctataagattctttgtagccttctttcagcctgcccatataatagttagctctttacaattaatacagggcccacttatctctcacacagggtttcttggctcctgtgtctaagccggctataagtttacagtctgcttctcttctctctcctctcttctctcctccacctcagcatttagccggcttatagcctactattatacttgctgtaacacagcctgaagtgaaacaaacagtgatattataagtaatgataaagagcgttaacttgcatagtagtgtgtccttttataagtgaacaaagtgacgaagcctcaaatgacatatttgtttgtacaaatgaaataaagcagcaataaataatcaattgtctgaatctaacacagttcttgcaacaatccctgcaggctagaacaaagagctttcaatacagatgattcaatcaatatgtggattcatttaccatttaaaaaatttccattgggcttataccatagtaacttcaatgcaagcagtacgcctaaatcctaatgtagtgataatattattactggattagtcaactaatgtttggtagccaacccagctcccctgtaaaacagcaaaaagaggaaagaaaataagaagatatcgatgtacaagaccagaaatgcagaacggtggaattgaaaccacaacacaaatatcatttcaaagctaaaacgtgtactaacttctacttgttcatctaaggggtgaacatggaaaaacaagcaggaaaaaaacaaactagctttcattaatgaaaaatccaggcagggatgttccccattcccagtgttgatcatcaaaaaaacaagcaattttagcaatagtatatccaaggttatggaaaaaaagcgttggtatttactctttcgatccggcgcataaggcaaaatacagggattgatgaaaaaataaattcattgctgaaagtgatggaccaaatataaggtgagttgcttgatgcttcatggtgtcactttatctagcttttgtcccccatttagcatttttattgttttagctctgagatagacaaacaaatccagctttagaacccgtcattgggcaagcaattataaagaaaaatagttataagaaattttaattaccttacaaagtagaaatacttgtatactattaaggttctatctagtgatgactgcgcatgtcacagaaggcgagtcccacgaactttgaccaccaatgtaccccgaccaaggtggtaagaacccacagattttgacaacctatctaccccaaccaagaatcttaacatagatacatgtattgcagcaagacatcagtacatgttaaaccagcagtacgacaaattaccatgaaacacgggtggagaagtgctttttactctcggttcatgacccccctgtagtcccggtttttcaaccgggactacgaatccgggactaaagatcgctatctttagtcccggttcaaataaccgggattaaagatggatctttagtcccggttggtgttaccaaccgggaaccgggagtaaagagagaatagcggcagttccagacggtccatttttcttttttttttaattttcttccaaatcaagtgggaagcatatcctcaaatcaaagtaacatcccaaatccacatcacaaataaagtaacatcacaaatcttaaagttacatatacacacaaatcaaatacatcacaaatcctaaaaaattacacacaaatcaaatacatcacaggtcaaatacatcacaaatcctaaaaaattacacacaaatcaaatacatcacaggtcatctcagatccatccaataaatcacaaaattatacatgtgaatcacaaattaaaaaaaaaagagaaaataacgct

SEQ ID NO: 83103 - DNA, 3857 bp, Oryza sativa
ggggatcagatgaggaaggggagccggtgcaggggatggatcgggatgaggatggaccgatggaggaagggagtaggaagggagagattcgatctatggaggagaggataagggatagggattatatactacgcttcgaattttaattccggttggtgttcccaacctggactaaagatcggtttgatctttagtcccggttggtgttcccaaccggaactaaagtggtgatctttagtcctggttggtgttaccaaccgggactaaagatcctcggcccccataacatcaatttgacagaggatgaaccgggactaaagatgatttttagtcctggttggtatagaatgtctctgaggttttcaaccgggactaaaaatcatctttagtcccggttctttttagaaccggaattattgtggttttgggtcgacccagcaaagatcatttctccaccagtgaaatctaaaatctccagtttgttcttatcagtttgtgattggtttgagcgaacaaataaagtatctaattgaactagctagatatatgaattaatttaagcaatgtagtgaagtcccagaaaaaaactgtgtcaagaggggcttactcataaggatattgcgcctgccaggcatgggaaagaaagtccccggacagtatcgcatatgctgtaaacctgtttccattggttggagatcacaagggtacgagtagactcgaggtaatcttgtgacaggggtccctctgttgtgtatgctctaatggtgagaagctccttggtgtgctcaggtaaagatgagaattggagagggtcatcgttggaccatgtaaatgaacagaagccaggtctgtcagggaggtgatcgaggaaaataaatctgccagtgctaacaatctcctcctcatcctcaaagttggtcaccattcggatctcaacaattgacaaggacaggcaccctgtaggtgtgatgcttgggcttgcaacggcggaggctggacaggcaccctgtaggtgtgatgcttgggcttgcaacggcggaggctggactgcagagacgactttgatcctgtaagcagtgattgcattggtagtgttcgataagccaagatagagcgttcctgttccctgaagagggacggcacgtccatgaaacggcaggtcattgtcgtcgagtttgcgccattcctccgtctcgacgtcgaacatgtgggtgcccgtctgcccggttatggacagcagaatgtaggaggcaactgctacatgggacttgacggtgaccaccggcgggaagatgtagtcagttggggtgaggtcccaggggaagaatggcgggcgaggcagtggtctccactcgcagcccaccagacggtccgaggcatcgtcgtccacccgagccacggagagatcgagcacctcgaaccaggggacgaaattgacgtcccccgtcacggctggcctgcgcgccagggcgtagatcttgtcgccgaatggtagcaagatcgggcagagcttggtcgacaaaagcttgggtcccgagatctccttgcgcatcacggtgtcgaagacgatggtctcatcagggccgtaattccgggctgagctgccgccgacgccaacgatccacggcgcgtgcctcctcgaccgcacggaaacgaaagacatgtagtgcttgccggtcaggtgagcgaggtagggcaggaggggtagcggggtgtcgccgccgtcgtcagcgttagctggaaggtgtgggttcaccttgaacaaggagtaggaagggcgagtgactccatggccgaccaccaggtacaccgacgacggagactccgtatctctgatacgagcatcttcttcatcttctttggccagtttctgcttcttgctccggcggagcatctccacccgccgccgctggttcgcaagttggggttgaggatcgatctctctgtctctctctcgtgaatagtttttttttttttatcttctctcgtgaatagttagggttggggattgatacgcatggagtgaccagtgtgcttatagatggccaaaaggcccgtccggcacggcccggcccaggcacggctgggatcggcacttcatgccgggccgtgccggcccatgggctgcacctcccgcccaagcatggcccaccagctgtcgggccatgccgtgccggcccgaaggcatgggtggcccatgggcctttttttcaataagtctagctttcgtccctcctcttagggctattacatatgtatagctaaaataagtctatttttcgtccctcctctttgggctgacatatgtatagctaaaataagtctatttttcgtccctcctctttgggctgacatatatagataaaaaaagtctattttgcatccctattctttcatccattgctataatatgtcatttttattcccctagtttcttgtgtatcgggcctggctgccggcccatcgtgccgggccggcccatcgtgctggtggaggggcccaggcacgaccccgacctccgtcaggccgtgccgtgcttgggccgggccaaaatgccgtgccatgggcctggccgtcgggcctcgggccttttggccatctataagtgtgctatgtccaccgtaggtttgcatcaggattcggacgtcctagctaagatgggggttagtattttcatacgtgggctatgtattctcattttatgtagggaaaaagtcctatctaactctccaccatcggtgctagttgagaacccctttggtgtcgattttcccaatcagtaccacggaggcagcatgatgacttcggtcatcggtgccagctttcgaaccagcatctatatggataaagatgtcggttttttatattttaaaactggcacctttaaggtttcacgaataaaaaaagctggaataaaaaaagctggctcgatgcatcagcttgattcgagccgagcagctccctttcacccccaaacaatctcaagattcacatgaacaagaattcttttgcatgaacaagaacaagaacacatgagaaacaacctgaccaacactacaagaaatatgaccttttgtgatgaattcctcgtgacatcggaactattcatcattagcacattccattttatgacgattagtatgagataggatggcttagtgacgaaaaaaaaggtgttcgtcgttaataccaactagaaattgtcataaagtattttaatggaacattgtgacgaatattaatttgttataaggggcaaaaatcaaacgtcacatatttatataatacatttctagaaaaactatattaaaagttaaagcaatttactcaagtgaattaacgaggaaactaaaattttcctttaaaaatcatggtcggaaatatttttgtaatattctatgtggtctaaattattctctaaaattttccgtgaattttcagagctcaataactagttttaataccacaaagttcatttaacctattgaaataaatagaaaacaaattaaaatccctctctttgtgcttgggcatttttcggcccaagtgttactctctccctccctcagcccacagcctctttctctctctcctcgggccggcttccccttcccctcctccctcttcgggtcgtctgcccagcccttttactcctccctcgccgagaagtacattttgcctccctcctctcaattcaaataatttttcgggtagtaaatgatttcaaatgaaaaaattgtcaacaacaaagttgtataactcatcaagatctacaacttttgttttggtcatttttgctatatgactttgtttcaataatttgaatttgaatttcaaattatgacaacttcaaacaa

SEQ ID NO: 83104 - DNA, 19266 bp, Oryza sativa
  unsure (1)..(19266): unsure at all n locations
attattaaaacaaagtcatatagcaaaataaccaaaacaaaagagggcgccaccacctccaccgcggcacctcgcgccggtccgacgcctcccctcccgggtgaatctgccgcggctgcctccaccgatgttgggtgttgacggtcgttatcgatcagtttcgaccgtcaatattaccaaaatagaggagaactagtgatgcttgccatgcatatatatgttagaataataatattccactagtattaggtttactaaccttggcagagaatgaccataaagtggacgaaaatcgacatcaacacagaaaataaatcaatcggacgatgtcgagaatcaaacttatgcatgaatgggccaataactcagaattgacacgacaaactgggacaaaattcacaagtctgcagagaagaacaactgaggaggccacctgccgaatttgggccaggttgggcaggcccctggttcggccgaaccccctggcgccgttggatgcagggttgcggctggacagtgtggattagctcccaatgacggttggagggtatttccgaccattccaaccatcacaatcgtcattgggaggctatataaacctgtcaccttctcacttcactcacacacttcaagcaaagctctctcatattctctcaagtttagtttagtagtatcaagctagtggaataggaatagattagaaatcaagagtccggaagtctttggaagagttcgggtatggctctagtagctttcctttcctcttttgaaagctttgtacttttattagaatactcttctatatacatttatggtattgaaatactttccgagtatataaatgcctactttacattatgttcatgttatactgaatatgctgctagcttatctgggagatgctttggtgcgggtataatgtttgcttatgcaattactctatgtcatgacgatgatattagagtagtatctagtagtttagacgtggtgtctagattacgggatatcattatttggggttatatgctgcggatgagaggtgtgccgctgatgatgatagctcagtacgggtattcctccgcgcgtgtatataatcctaagttaattccctggggagggtactcctccgtatttagcctcggtggcttctcgaagtactaggagggcatcggatagagggtattagctagtatatcggataactagaatgtatgtatactatgtatactagaagtataggagtagattatctttctcttttctttccacttagcttagataatatattatgagaatgagtagctactgcttgtgtgtcactctacccttggattatcttaacctctgcttagaatatgattatcacaagtaacatataaattattagtcaagttctctctacatgatcttcccacgggataaaataaatacgatacccttggaatactctcgggtgaaatgctacaatggtatatccgtgcgtttgtggatgaactctgtaaccataatataccaggagtatttctgcgtcattgctgggaattatatttctggtaatgtcattaagaaataccaacactgggtgcgcaagagggctgaggagagggagggatgaggagaagaggtgagaaagagaaggaagaaaatttctattgaacggacgcgtgtgtggcagagagagagagagcagtggatggataaggagagacagagagcgcggtgcgggtggatggataagaatggacgcgctcccccgtgtggcttggctcggttttacgggttgtcggtttttaaaaaactagcacctataatatattatataatatattacaggtgtcagattttttaaaaaaacggcaccttttcctttaccacaaatatgtcggttctttggtaggccccgcgccaactaaaagatgccggatttaataaaaaaccggagctttctttgacaggggtaaaaggacaggggtaaaaggtgccatttttttaggagataaagatgtcggttctcgactttttggcgggttgagataggcactataggtgccggttttaccacttccggcacctatagtgccggcatctatttgatgttttgtagtagcgctcgtcgaatctgatttgtatccctcaatagaaaaattaggtgtaaccgtgtaagggctcctccaactattaaaaccatgcaaaatagcttcctcggtagtgttaacggtggttcttgctcacgtggcagtccagtctcctccaactattaaaaccgagcaaaacggctccctcggttgtattgttagtggtttttactgacgtagcgtccacgtggcagtccaaacatcaagaaattaaaaagaatgtaggctccgcctataaatgacaagagaaaataaaaataaacaacacttgcctatccgctcgtgccgccggcttctggcgagtatgcttagccgcccattcgggtgcacgacggtgtccgtcggcgacctccccaagcgttgagcttccactcctcctgctgcttcgccgctgcctcctttcccctttcccccacgctacacccgtgatcgaggatgacggggcgggaatgaggagtcagctagcacgggcaaaagaggagtcggctagcatggccccaactttgtcgtcgtcgccctcccaacctcatgtcgatgccaccgccctcccaacctcgtgtagccgccacctttggagaagacgaagccgcaacgagtcagagaagcaaaacggcagtggaaaggtagcagcagcggtagaacggcattttggaagagtagcgaccactgcctcatccttttgcgccttccgctccctccccgcctctgatggcctcgccgtgccaaccataggagagaaaggagggaggccgctcctcgccgcggccttccgtgccctccccacctctgatgatcccgccacccaaccatgggagagagaggaggaaggcctctcctcaccgccacctttcgctccctacccgcctctgatgtcccctccaccttgaccataggagagagaaagaagggaggccgctcctcgccgtggccttcatacccacctcgagcatgggcgagggacgcatggacctcatccaccaccacgagcctctcgttgagcctacaaacatgggggagctggactcggagctctagtgataggagaaagagatgagagggaggtagggagagaagaggggaggaggtgctggtgcccttcccagctttggttcgccgttactgcagccaccctcctaggtctcagcctctctgttgtgaaagagggaagagaaaatggagagggaggggggatggggaagaagatgggaagggagacttacatgtgagccccattgtcctttttttattttctttcctgattatagtgccacgcggacaccacatatgataaagactatgttaacacgcgccacgtagaacaaaaccgctgtccaaagcacctgaggaggcaaaatgaaccggtattgatagttaggggagttgctatatccgttttttgcggttgaggaatatgaaatagatccgagctatatttgagggagtcaatttggacattttcctttatgtggctcgcatttagcgtgcgcagggtccactgtgtgtacgacggaatcatgcgctgacctagggatgcacgtggactaggttgacctagcccaggaaatatggggccaaaatcatatggtttacccatcaaatttcatgggtcagcatagatcgacccaccacggcccatggtatgtgggtcgacccacctgcatccgctccactcagtcgtgtgaaactatgttgatatttcttaacgacattattagaaatataagttaccaacaatggcgctagaaatggtcctggtatatatatggttacagaaggaatccgcaagcgcacggatataccattgtagcatttcgcctgagagtattccaaggtatcgtatttatttaattccaagggaggattgtaacagagaactatgctaataatgtatatatgccacttgtatgatcagagcctaagcaggggttaatatatttataaagggtagagtgacacgaagcaaagaactcatatctctcattaatcaatcctaaactatgtggaagaagaaataaaaaagcaatcatttcctataattctaatatacactcaatcttagtttatatatgctagtatactatcatgtagccaatacccctaatagtgccctcctggtgtttcgagagaccacccccggttgccgagttccttacgacaacctgttatggccgaccaaccggagctaaatacggaggagtaccctccctaggaatgtttcttaggaatatatactatcgtggaggaatacccgtactgagctgtcaccatcagcgtcccacctcgactgacctgtagcatatatgcccagataatgatacttgataatctagacaccgcgtctacattatcaaatactactctacatcccccgagatgacatagagcagccgaataatcggagactaaacccacaccactgcatctctctagtaggctaactacatgactgtaccgatacaaatataaagcaaagccgatactcagataaactaaagtaccgagagtatataaagaataacatttcattactttcgaaagtcttacaaaagaaataagaaaagctactagagccatacccgaattcctccgaagactctaaggactccatgagctattctattctactccacttagcactaggatactaaactaaagtgtagagagatatcttgagtttgcttgagtgtgtgaaggagtggaggaggtgaaggccttttatagctgatgaaatgactattatgacggttggaaaggtcggtaataccctccaaccgccattaggagtgaatctccaccgtccatccgaagccctgtatcaaacggcgccgaggggggttcggtcaaacccatggttcggccgaaccatgggttgggccaacctggcccattttcgacagacttactcctcaactgcttctcagtccagaacagtgaattatgggcccatttaatcttgtcatttctgagttgccggcccatttatccacaagtctgattctcgacagcgtctgactaattcttcgagtgttttgctgtcgattctcctccatattatgtatctttctctacaaacaaatagaatccaagtacaagaagaaatagattattctaaaacaaatatgcattgcaagcatagctagttctcctttattttagttatattgactgtcgatattggtctataacgaccatcaacacactagcatagaaatgcagatgcttgctcgcaactgttgccgtcgcagcctgcatccacctcatgcccctgcgctgacaccgccaccttcgtctcgcccctgctcacctcaacctaggggcccacatgttagcctctaggagaaggttgatggagagaggcagtggctctggttcagccgaaccagggtttggctgccctcatccccaccctccacgtgacgcttcctcagccctccctaatgacggtcctcggtgaaccgacttggataactgccttaatcaactgtcattggaggctataaaaggagaagaatgtcacactctcaacacactaatcaagaagcaatccctctatttctcatttgtattactctatagattagtagagtttaggctaagagtagttcttcggtttcctagtcttctcaaatgggtatgtttttagtacttttctctcattgtaagactttgagcatagtaatgaaattatcttctttatttatcggtgtttatagttcatatactgctttggcaattatatgttctatgagtagtttttacttttttggtatgctttacatgtgtaggctagtcgatatatgtcacgatatcggtccaataatcttaacggattgcactagttcttacttgtctatccgaaaagtgggagtcttaggaaaagtaatagtattatttagcaatgtaagcatggtgcttaggttgattaaatgtcattggatgtgggtgtgctccacgggttgtagaggtaggcgacaggtggtgataaacgttgtatgccctttgtaatcatctacgttcaggtttgacgtaagagttcgtaaaatgtcgtaaccacgttggcagaccagtatagggagtgctctctctctcggtagtgtctggatgcatagaactaagtcataacttgtaacttgtacatgtatgtgtttgtttgagtataatcgaagcatcctaaatatataagtatataaacgaaaccatagctctcttttgtctttctcctcaatcaagtttatctttattgagattattcttctatgtcacactacctatgcgtgaaactacgtgtgcatgtcacacaccaagtggtcaaccatgggaggacctaattgccttgtactttcatgcatgacgaaggtgatggtcgaggatttgctgcatgggccatggaattgcactagccagatgtagttaggtgcctgacaggagcaacagtgtcaccacaccggcctccgctcactctgctttgcacgctgacatcaatgcctgaactgctggtcggtggtcaagaccgccaattgatccctagctagcgaatgtgcctaccttggtgtcatcgctggcgccgtagttcttgacattgaacgttgggttaccgtggtacatcgccttagccaatgtcgacgacatgttggtggcggaatatagcgtagcagcaacgatgacgaccaaccgttgctgcgtctccatattcatagctagccctctccacagctcacatctgtgcggcggacatgagagagaaattaggggatcgatggggtttccaaaaatgaagacgtgtttccgtctttgagcgatggggatgtgtgatggagtagccatagtcaatgcgatcttaggtgcaagcgcgatttggcggggacagaatcatggataagttgtgtgcagtggctgatgggaggagggaatgatccagagcgttgtacctggtgttggtgtgaataatattgggcgttggatttgatgaatgaagtatttagtagtagaaggacttgagttggccaactatccggtaataaatactacctctgttatataatagatgacgctgttgactttttgtcatatttttgaccattcgttttattaaaaaaattacgtaattataattattttattgtgagttgttttattactcaaagtatttaagtatcatttatattttatacatttgaataaaacttttgaataagacaaatggtcaaacatgtgttcaaaattcaacgcgtcatctattaaaaaaagaatgtatgggactacctatacatttgtcgacaaatttttccctaaaaatttgacagatgtaattatagtacaatcgtagtgtaattacactgtaacttatatgtaattacactgtaacttgcatgtaactacagtgtaacttatatgtaagtttcacataattttgaatcgttggatctattacaagatttgttttggtgaggaagaaaacaaatcatagcacacacatatgtgaaagaatttgttcccacgacctccattttaccgaaataacatgtaacggagagatttttgaaagttacatacaagttacactatagttacagtgtaattacatgcaagttacagtgtaattacagtacgattgtactgtaattacatctgtcaaattttgggggaaaaatttgtcgacaaatatatagcaaaatcgaaccagaaataacaaaacgagcaaaaagaaggaaaacaacttccttccttccctcctccctcccttctccaacctgaagacctgaccgccagatctgacacctcaagctttggctcgcttcgcttccttttccggcctcccagatcccgatctctccctccccatgcctcctcctcctcctcctcctcgcctcccctaacccccgccgccgccgcgcgccatggcctcgcggcctccgctccgcaccacctccgcctcctcctccaccctctccaccgactcccccacctccgctccccccggcggcgtcccgcagtccatcaccgcgctcctcaacaaccctctcccctccgcctcctcctcctcctactactggctcacctggccccctcccaccccgctccccgacgcgcccccgccgccgccgccccacccctgcgacgtctcccgcgccgacttcgccccctacctcgccgccgtcgccgaccccttcggccgcttcgctgatatccggctccacgcctccgcggaggagctcgcggagtcccaggacggcgccgccgccggccccgcggcctccggcctcgccgcctgcctccgcgaggtccccgcgctcttcttcaaggaggacttcgcgctcgaggacggggccacgttcaaggccgcctgcccgctcggcgacgccgcgctgcaggagcgcctcggccagcacctcgacgtcgtcgaggcgcacctcgtgcgggagatcgcgcgccgctccgagtccttctacgaggcgcagggccggctgcgggggctggacggggagatcgtcgccgcggtcgggaggatccgggagctcagggaggtggtccgggtgctcaccggcgatctcgtgggtgccgcgcgccaggtgcaggagctcaatgcgacgcggggtaacctcgtcgcgctgcagcagaagctcaccgtcatcctctacgtcagccaggcgctcgctgctctaaagctggtgagtgggcaaactgagcattgcgaaacaagatatctcccgcattgcattttctctgctgatcagcaatgtgaatgattccctgaactggttgggaactaagcttagctcagtgatgtgctaatctcttattaatacccaaggcgtgtgcttttgctggcatttccctcacttttctttgagtcagttggcaatttggttagtgcgagaatgagaagtacgatagacaataaaactgcatgcacacgctgttttcttagtttgatagtctgatgccatgcgttatggtttgttcacattattttgttctcggtgatttatatgttgatgaatagtactgtgcatggaacgccagaaaagtgctaggctgtctgtatctcattaattttctggcaacaatctcggtggatttagatcttcctaccttggctgctcaattatgaagtgccaatgtaccttgacacggaaaatgaaacttgatggttctgtatgagagttctagatgagttacgactttaatttggagggcttatagactaacactaggcaagcatatacctaaaagctcaaacaaactcaattattaagggaacaaaactttgatatacttaaggtttagtttattgtgctgagtcctgtaaggcatgtaggttgacatgtgggccaaaagataggctagtcatggtacccaaagataggcttgtgaggctgaaatgaaattgtatgcgccttactggcttccatctcttccattgtctctctattctttgatgatccttctaatttcctctctctcgatacctacatccctttcccaacctctgctcagtagtgaagcagtgtcacaacaaaattcagtaaaggagaggggaggactagaggaggatgttaagggttgagattcacagaccaaacttcagagggtgtctaacaaggtgtttgagattcagtgctttatgctgcctataccatttatgttgcagcctagagcaggttggtgggagactgtgaggaggacgtgcatcagaagttcagagcatgaagcaaaaggatgcaggaggcttcgctagttcaattcttcacaatgtactccatggagtgatggaagatggaagggagagaggacaggacagttgctgggaccaaggagttaggaagaggaggcagctctagacaccatgatatgcgaggaggatccacacagtcgggctgagtggaggtgatgcgctgagtggagtgtgcctgcttgcagttgggaatagttgggattggttcttgtatttgggtacgctgttgcgatgctctgctcatgagcttctattataggggtattgcaccaggagagattgggaagtattggagctttacttatttattttttaaaactgtaattaatggtactcgcttcgatctgtgtccagataccaatttggctcttcacttgacattctagactggaataaatgttttttatactagatcttttagtcattgcgttaaatctttttcttacatttcaagccctttattttatcgattcctaattcagtgctttgatttgttaatcttatatgtgcagcttgtggcagctgcggattgtgctggtgcccttgacgtaattgatgacctgcaaaacttgctagtaagtttcttatacaacaagacgccaatgtttccttttgtattcctctatggcagctttacccttcgtcaaccatcttttttaacattgtgaggtctaaaagtaaagacgtgcagctaaaaagataaagttaattatcatacttctaattcattccatgtcatcaaagctgagatataccctactattattaaatatattacgtgggtctgttggactggggatgcccaaaagttaacttcaattggcaattttaatatctaatgcgtcggtttagaataatttcttagttaacccaacaaaagtgtttagcttctcttttccccttccctaaagtaagtactctggagtacatgcatgcattttggtaaaaatagcaagactgtcagagaatttggcctcatctctatttgcttgctgattgtctgtctctatataaccatgatatattaatggtatgggattacaacgtatcaaattagttgattgaaagatgtgattaacttgtaaatacgcctttttactcccatctacttgctcatgtctgcagcatatgtaacttgtattgttatgataatgttttccttttttcaaacaggatactgatgaactcactgggctttattgctttcgaaatattcgtgatcagttggggacatcactagattctgtcaacaggtactctcttagaacttgagcataggttcctatgatatgagcacaccttttagatttcaggagtattagcacaaaatatctgatattgagataaaaagcctttttgtgcatagaaataaatcatgaatcagtgaattgtgatcaaaagctcgtggcatgttgtagcaatgtaggtaagctgatcaatataaaaaagaaataattagtgattgtactcaaatggcatgtttgttgatactgaaaatgtgcctacacccggagggtaaattttaatgtcgttattaatcttgggctatatcaggatattgatattttgttttttttttcaatattatgcccatcagtaacttgctgtttgacttgataatattcattcttgtagcattctttcagcagaatttgtgcgggctgctgttcctgatggaaaagctgtagacgcattgattcaagcaaatgtgaaaagaaaggcttctgtcccccttaatgggacggagcatgaagtatgtttcagttcacagtttaatctatctcttaattggcttatatttactggattatatatgccgatgcactactatctgtttattccatcgaaatttctactaatctgtattttctatgtgttgtctgttcactgttaacttattctaggttgtcatttgttgtatcagtgcattctcactgaaatgtaaactttcactacaacaaatgaaccagaaaatttgaacattcctgctgtatagagtatttttttatatagcatagtgaatgctgttcactttttggacccttctgttaggttgttaagaacaatgattaatcataaattcataattgaacaatatcaatttagggacttgccatattgaggccaaattgtctgcttttaatgtttgttttgttgatgttaaggttcaatgcatgataggaaagcaatgttatgcggtaggaagtgatcatgaactaattaccatttaatactaattttgtcatggctatagctattcatattcttgtggctactttggccatttctaggcaaattttgttcttttccaatctttgagtgaattgctctgtagcaaacacagtttagcagaatatgtagttatttcgtaaatgtttgacgcgtttaatattttcatcagattgcattaatacaccgtttatgttatttcttccatttggtgttccatgcttacagtactgtggtactttaagtaaaggttttcatcacattttctctaattttcggcatgttcattggtttaccgtaggtaaacatagatgaggaagaaagcttcattctcagagatcggcttctccccctcattatttgcctactgagaacggttagttctgtcatttactttcattaaattgatattgcagcgtgcacaaattggatgcacaaatatatctttttcaatactgaatgcaaacaatgagaggttttagagtgataaatattccccaaacaccttaaaggcatgttcattggtttgtgttgatgaataaaagcttgtattttgggcttattacttgcatccgcatgtctaagtaagatgctgtttcaaacttgtattggatagaatatcaagttccttttttcgcaaaggctgatctcctgtgagtatatttgattagtagcagcatcatgtttctttattcctggatgtaacttgcctttttgagggtatattagttagcagtccatttttttggtggaaactaaatggtatggttcatttttatattttgcaggacaaacttccagcggtgctaagaatttaccgtgacacactaattactgttatgaaagcttcaattaaagccacagtagctgagctgctcccaattttagttgccaggacaatagattctgattcagtaactggagacagagctgctgattctgatggtgtcatgttttctccatttatcactatttctttcccatgctatttcttccactaaaattcttacatagtttgaacttcaattttttcttaactgcagctggaggccagtctttagcaaataagttgcggagtctatcgtctgaagggtttgttcagcttttatcggctatatttaggatagtacaggtaaaatgattataagaattccatttaacctgttcgaagtggaggccatgcatcaaatttaatctcaatgaggatatacttttatagtatttggtagtgtagatattttagccttgcattgatttatttgttagctttagttatccactttttgactgcatttattgtatcagcttaattgttctatgcaattattatcagcattaaaggagccatgaaattggcgcaagtcccttactacatgctctgtatttgctgattctattggttggagaaccaaataaaaccagaatagattgtggagttagctatagaagttatgtactagcatgtagcatcccaacttccaagtccaatttctctttaaaaaaaccttccaagtccaaattgaatcagtgcaaccaattggttcgcctttgccccccgcgggggnngngggggggggggggcaggtggtgaacctgcctgtccgccggttctgctggctaccgtactaggggtcttcttgaagtcatcacctatatttgtatttctatttttgataaaagatatttagcagtggctggctggttgcttgaggatgtggggaaaagagttttgaacattgctatgctacatgtaactaaatgaaaataagagttgttaacttttaactataatttcttgtgccttttcccatctgaaaaccatgtagcattgacctaatatttttcagcatgcttgaaatgtttcttgtctacttaaatcatgtacaatttctgaagatttaaagaaaaaacttgaggtaatcagtattcttttgtcaattcaggtacatctagtgcaagcagctgaagttaaaagaatagttgaatggatcatgggaaacctcgaggggagcttaagttctgatgcttcaaattctgtacaaaagcacagtggctcggtttctgatttttcccaagaaaatgaccacggtgtcacttcacgggtgtctaatactcttaccaggagtaattctaagtttcccttctttcaaggaaaaacgaatgacatgtccagtacaaattcaataaagaatgtccggtaagttaaggtgcaactagttattaaatcttgcattcacatgggctagatatcatatacatccgcatcaaaactctatggaaaaacatatttgaacttttttttaggtttggaataaaaatatttttatgaatagatccaaaattaaaaattaggagctacaaaagttatatatagaatccatccgaatatagtttttgttactttctgtttttctggttattctgaaatttgaaattaataattacaaaatcgtacctgacatggacttttgttgtaatctgaaccactgtaatttcgtcccaccttgaagaatggctagattttatttttcacctttttctgataaatgcgaaaaatacctcagtttgcctaaaagaacctccctttgtcccaaaatatagctagttctaaagtttttcacttctatattttgggacacccttttgtactctagaagtagctatagtttgggacaaaaaattgaatgctagaagtagctatattttgggatggagggagtagatatgctttttatgttatgttagctgatgtcatggtagtgctgtggacagattcaatacaaaattagaatattgggtcaaattctaggctttacctcttttatatcataattatatttgacaacacaattgctctctaatatttgcctttggtacagagctgatgtcttgagagaaaacacagaagctgtttttgctgcatgtgatgctgcccatggacgatgggctaaacttcttggtgttcgtgctgcccttcaccccaaattaagacttcaggagttcttgatcatctataatgtaacagaagaatttgtagctgccactgaaaaggttatttcttttcctgtttgaaaaatatgcacaaacgctcattatgctcatcactgcatacatgcaagttatgactttattgtatcttcttattcctgtagattggaggcaggttgggttacaacatccgtggaattgtacaacaacaatcaaagcaatttgttgactatcagcatactgtccgggtgagtgataaaatttgttgactatcagcatttgttgaattctacaatggtaaacaacttgcatgagtttactgatgatgaaaaattaaaaggccattcttcaaatgtcatctataaggagagaataatattaaatataagactacaaagcatcattgtacacaaacttcaatggataattgtgctattttgaaagaatataaatcactcaactttatccctgacccctcagttatagatatccatcaaattgaatataatgctgtacctttattatgctttttaattggagaatattacttgcggaaagtgcatttcaccatcaaataccctgagtaaaatggtagtgcaaacggagaatgtaaggcttaaacaagtacttcctccggttcacaatgtaagtcattctagcatttcccacattcatattgaaaaatatgaatgtgggaatttcaatatgaatgtgggaaatgctagaatgacttacattgtgaaacggagggagtactactcaacaattgacactatagtttgtgaaacaattaacattattaggtgtcactgctgcttttttttgctactcaacaatcatcataaatacaaatttcaaggttgtgcaaacaactgtgatttggatttcagactgatatgtactttgtctgcagttgatgcacaacttatagtatttttgtgcactaaaacttctaatattcttttgaagatggcaaaaatcaaggcagttcttgaccaagagacatgggttgctattgatgttccagaagagttccaagcaattgttctatcactatcatccacttattccgttgctaatggcatggagatgcctagcactgatgacagctcaaagctccatgaaaatcgggttacaagtcaagaaccagtaaattcagctgaaaataatactgataatggcaacgcagtatctacttctccttcgactgaaaacaatgttgggcatgctagatcaacacagcaaaccattgtgcatgggggtgtaggctatcatatggtaaactggttagtcatctatattttctacttaatagttcaggtcaagttgcattctcttcttgcgcaccttgcagtgttgcaacgtgacacttttatttcccaacattttgatagctagagtcgtaaaccatccctctattgatttgtggtcaaccttgttttatttgttgtgtctttttgttaacttgtgttctcattacgtgagattctcaatttaaatcatgttcacccttgcagtggtttgatattgttgaagatgttatcggaatatgttgacatcagtaaatgcttgccatcattatcttttgaggtggtccaacgtgttgttgaaatattgaagctcttcaacactaggacgtgccaactggttcttggtgcaggtgccatgcaggtagtataactgttacatgcaatttgagtcattaagttgttaacagtataaagtcttttctctatatctgtactcatttaaaagggagtagcggtggtggtgagtctgccaccacccccaccaccaactctatttttttgtgagaaggaaggacaatgtaaggctagaggacccacatgtcagtaacaaatatatccagaaatttagagatatatgcagaaaattatggtaataacaggttaatgataattttctttaatcaaaactagttgaatgcccgtgcattgcaatgggaattaaataagaaaaccacaccgtacactctaaagcctcaaaaattaaaataaaactaccctcattctaaaatcttagggtcatatatttgtcatcattttcacctcacttcaaaagaagtttttcctgtttgatggcttgaggttaggaagggacaaaagtccatccacctcactgtttgggggacccacatggtagtggtggtgggtggtggcagatttaccactcaccaccaccattgaggtctttgaaaagagtatatagatcctgttgtaacgcgagggcgatatgctagtttttttacaacatatgtaaacacaactctcgtgttttcatgggtatgtaacacgggttaaggacactagaagttcttatggatcatctgctcacttaggctgcattcatttctggagattgagagagaaacccattcgttttccacacccacaatacttttttgcaaaaattttctataggaaagttgctttaaaaaatcatattaatccatttttgaaatttaaaatagttaatactcaactctccttgtgggcaagattttaccatcagttatgggttagtgtgctatcaaaagcaagatttgcatgcttttatcaaatgctaaccttgcttggaaaagcatattgccttagcttttagatccatgcacaccttaaggcttggctgggtgtccttggacataagtggtgcagtggcaccatggaaccatctgcgcctaaggcagggagggagatgggattatgagactaatgaacttctgtttgttcttgtttgattaagatataatgatgtccttttaataggatagccttaggctggacatagcacctcgtttactgaatgctgtacctcatagcgtaccatgtttttccattgttttgtgtaatctttatctccattctcgaatagtatgagttgtttatgctcaatgaacaatttgtatcactttgttgcacaaaaaaactatttgtgcaatttgttctacctatatggaaatgctgttgcaaacagttaattattctgtttgaacaatcgtacttcaatgtctgattagtttaaatgcttctgatcctgatcaatctcgatagctgattttgtgtagctactcaacttgttttccactagttcggattggtgagttatattctccattgttttgattttcaggtgtctggtctgaaatcaattacgtctaagcatttagctttggcaagtcagataatcagctttatatattctttaattccaggtaagcactgttttttactcttctataaagcatgatgtgatggtactctgtcctggtgttggctatgtccatgtttgctcactcaacattttcatcatactgcagatatccggcgtgtacttttcctgaaaatacccgaggcacgcaaacaactgttaatgtctgaactggatagagtgactcaggtatgatcattaatttacatactaacattttgttagttcaagcaactcatgaatgctactactatcttttagttgtttttctatcaatgccatttcttacatgtttcaaggaataacaggattacaagattcatcgagatgaaattcacaccaagctagtccagataatgagagagagattactagcaaatctgagaaaattaccgcaaattgtggaaagttggaatgggcctgaagatactgatttgcagccaagtcaatttgccaagtctgttacgaaggtacattgtttaactgttatcgttgtaaataatgttatcatatggttgcatatttctacttgtatgtggttgtttaaagggttttgccatgatttaagtaagttaagttcacgtgttgctaggtgaaaataacacgtggtttatggtctttttgttatgtgaccattactttcatttatctctttggtagtttgaatccacgcaagggatatgttttttccaggtttcaggtgttttaacttatttatgctaactgttaaattttttcacaaaaaaaactattgcaggaagttagttacttgcatcgcatcctttctcaaacattgcttgaggcagatgtgcaattgatattcaggtattttttttatactttttactactgactttagctccatgctatcattataatcattgcaccattttatatttcagatgagtgatttttagctacaacatatgcaggtctttacctgttttaatt

SEQ ID NO: 83105 - DNA, 6522 bp, Oryza sativa
gcgcgcaccaggtcccaatcgccgccttgagcgccgcgttgggtatcaccgcgtcggaggcggaccccatcccgggcggcaggaacgcgagctccgcgcaggcctggaggcaggcgcgctcgtacgtctgccccgacgggaggatcaccgggtcggccatgagcgcgcccaggatcgagcacacgaactcggccggaggcgcttcttcctccgcaacaacaacaaccgccgaacgcgcaggcgagtggggctcggggtccggcggggaggagggagacgacggcgcgctgcggtggaacggcagcttccagcggcgagggcggcccgcacccatgaaacgcgcgcgcggctgcgggggtggtgttcagcggcggcggtggcggcgaggggaggaggagctagaggagctaggaggtggaggtagtgatgcttttgctgtggcggccattgggtctcggggggtttgggtttgtttttttatttttctcttttggggttcgggtggtttgtgggtgccttggctggaactgaggtcagtgtgtgcgcgcttctcctcggttttatgcggagacaaaccttagccaggaagggatcgcgcgcgggcgggtgggtctccgtgtcgcggttttttgcggtggatttgctgtgattttggctgcgtttcacggtgggagtacggggcgggggtggtgcgccgcgcgtttgttcagcggctggggtgggcgtttttttttttggccggaaacaccggttgcttggttggttcagcgagtgagctcaggcgagtgcgccgcttgactgacacggtgtctcgtgcaacgcacgaatgtggtgtaatagaagaatatgaaatcgctggttgacctgacctagcaagatcgttttgcggcgagtcgtagcacacgatgcgtctccgactcgtgcacatctctatcagaaaaccgaaagaagagtcagaaaaagaatgaggctcccatcgttggatggtctaatcagtcgaaaaagccaaattttaaatttttaagtttaattttgagattgattttgaaatattttcaacgtactttcttttccaacattgatttttaaatcaccaaaaacccatttataaaagttttacctataaatttatttttatttcctactatggggatctgatcttatatcaactgccatttcttaccgatgagggtctcaccgtctcagggaagacacgtcaaacattttccctttttctctcggaattccggacggtgcagaatgcccaccgaacctcgtgagatgcggcttgctgctgctgccccctcgtttcactgttcgtgccagccaaacttccccaaggcgcacaccacaaacgtgagatcgttttcaggtctcgtctgcgagctcggaaagacgctgcgctgagccaatttgctcggcgtcgtggacgccgcggacaaacgcctcaacgtccggccgccagagagcgctgccctgctgcccctgcaacaacggcgaactcccctgcgcacaagaagacgatcccatcgtcctcaattccacaggagaggaattggtgccgcgtgtgaaccggataggccgagtcaaagcaaagctccatcgatgtctgcatctcggggaatctgacacatgtgagcaatgactcgttatcccctcgcaaaatttttagtattaaatatataaaataataactaattacatagattacgtgtaaattatgagataaatcttttaaggctaattgctatatgatttaacaatatggtgctacagtaaaacatttgctaataatggattactcgcagtttacaggcgaaatatgtagattttttattagtctatatttaatatttataatgtgtgtctgtatatacgatttgacacgccaaaagatctaatcaccccctcggtggagtaccggagtagctccctttgtttatgtgtgtccgtcaatccgtgtgtgtagccgtgtgggggatgtggctggccgctggtgaattgggctagtgtttttttttaacttttttagtgaaggatatttttacccggtatatacatccaactggatatatgtagtctttttaaattagtaacctagcttatcaaataaggaacttaaccctcaaataactcaatctgaaattcgcttatacgaagatttgaaatcaagactttagaatgctaatcagttcactgcaccaattgatatacatcccctttcacctggtaaatgaattgggcgagtgtcggggtgtccgtgtttatcttcggtgtcttgcttcgcctggtaaatgcactgtcacttttgtcgctgcttgaattctcttctgctgcctagctcgctgatcaagatcacttgctcaggctctctgtttatttagttcccatatactttttcctaaaaacatcacatcgaatctttgaatacatacatacataaagtattagatatagataaattaaaaaactaattatacagttagggaggaaatcacgagacgaatcttttgagcctaattagcccatgattagccataagtgctacagtaactcacatgtgctaatgacggattaattaggctcaaaagattcgtctcgcggtttccaggcgagttatgaaattaattttttcattcgtgtctgaaaatcccttccgacatccgatcaacgtccgatgtgacaccaaaaaattttaatttcaaaaaaaacatgccctcagtgtcaaagactggctgagccgtggcagattggccgatcagtgtcaaagtgttgctatgtgttgagattgggaataattaattatttatcactctcacaaatagttataaagaatttatcactggacccatatattatagacacataagggctcatatatcatagacagcgagtgacaaataataaattgtcacatcttaaagtggcaaaaagtttgtgtttagttcagcgcaaagtttagattttgattgaaattgaagatgatgtgactgaaaagttgtgtgtgtatgacaggttgatgtgatggaaaaggactgaaatttagatccaaactttagatctaaacacagccttaaatgtcccgcaaagggcattaagcagaatgaaaacccaccgcatttctacccaaatcgagacatggttgagcggattgttgctatcattatttatttaattgtagagataaattaaatatcataataaataaacttaataaataatataaaatagatgttcttagcaatataattacagaagaaagtttttatagaaaatgtatttttagagcttgagtaaataatccgtttcaacaatccgacaaataattaaaaaaggtagggcattagattaggatgaaatccaagcttaggacagctatatatatcactcaactttggtgcttagtggcccaaaatataatatttgcttggagacaaacgaaaatttaaccccatccgaggtacagtttggtggcattcatgcaagtataagcttagtccattcctaatcaccaacccgctattaaactgttagtagcttcggttattaggtcactaacctgtcatggcggtggctacattgtagactagtttaatttacacaatctacttaccaagtaccaactgggtagctcttgtctcttgttatgaagtacatttcttttgccacattttataaaaaaaataatgatggcggttcatggcataatgatgaggccagactgttgttagtatgttaagcattgggcattaagcaaaatgaaatgcttaagagttaagacagtggcttgaaagatgaatcaaaatttaatctcatctgaggttgtgaggtggcattcatgcaaatatcaaaaattcagtccatcctattcaccaaccaggtattaaagtactgttacaatcactattattggttactacgacatcagtagtacttaggttagtaactcggcatgcatagcacatggctatgtggtaagattagtttaattaatctggattgcaaaagtaggctcccgtcctgattctttcccccgggtagctcttgtctcttgttgtaaacaacactaatcacttgccatcttccattaaacaaacaaatgacggtttcataacataatcccttgtggagatgtgggcactaagattatatatacacacacatatgcaacaaagtattgttggcactgaagagtgcagcagcaaagacatcggtctcttgcgactttaagcagcctagatagagggtgccttgcagagaaggtttattccttgggctcagtagaagtgtagtagaacactagaacatgttctctttttttcctttcaccaacaaaaggtacaccctctggctccacatgttttctttctcctttgttgagtactccaataccccccctcatgttcttctgttcaatgctctggtcattgaaatacgcatatacttacattactagtccctaaattgaacgtacgtgtgtgggccaagagaaacatccggtatggtgatctattgatctgggtgtattgtgacacttcaagcgcctgcaaaaaggatggctgatgcatatatttatgttgcaacttgcaagttgcatctccctctcttcaaaattttagacaactaggccttgtttgaagtagtttatagagcggattatatctatttaattgtaaggataaattaaatagtttaaaaataaacttaataaagaaataagtagtccaagtaatacgacagaaaagttggttttttagaaaatgtaactttatgggcgtggatctatagtaataatctggtgaagtagctaaaaacgtatttttagaagcgtgtttgtgtatttgcattgtaaatgttctaagacgatatgttctacaatttactaactacttcctccatttcacaatataagtcattctagtatttcccacattcatattaatgttattgaatctagatagatatatatgtttgaattcattaatatcaatatgaatgtgggaaatgctagaatgacttatattgtgaaacggagggagtatttgtgattgtagcactgatcaaattttacatttactcattaatacttgcattatttcagttctcaaaaatgaaacagcatgcttatgtagcatgctacataccccaattgcaaagagtggcctcatcttgatgcatgcccatgatccgacgttcttggaacaaacgcaaaggacacaagaatgcatgctcccaatctcccatatgccgagttgctgatcgatcaatcaacgatgtattacacacatcaacccagcagcacgccatggcgaacgctggagattcccatcatggcttctctctgcaacttggaacacatgtagccattgcaacaatatgtttgtgggtgaaggggatcattcagattccatcaggctgaaagcctgaaagctaagctatatacctgcatagtatgatgcaggctcgtttgcttgcttgctagatctatagctagttcacatcactgactgatcgttatcagtaacagaaatcatttcacgcattgccgttctgcagccgcaagtgacgattaattattgcatgtgttgaactccgactctctcctggatgaagcactgagctgaagaaaggcagatgcatgcaaaagcaggcagggaagaaaaggcaggcaagagagagctttacaagagccaggtgcacgctgaatgatatatgcctgaaaagtttcagttgttcacaccaacatgtggtaattacgaatgttagtaattagtatcagttgttcacaccaacatgtgttaattactacttaattactagtagtttcctttcctctcacaaatccatccatagcatcattcattccatcactgcaacatgtgttatttttgactgaatgaaatgggatgtttaacagttgaatagtaatagaggaatgattcgagggtacaaccaaataaattaactactatagagtttaaaaatagatttgaaataatattttaaaaatatatgtagaaagttttttaaaaaatcgtactacctccatttcaaaatttagttatttttagtacagtagcttatcttaaaatgaaactatttttccacctatctcctcctctcaactaatcacaaccatctccttcatctactttctctttttaactaagcataacattttttctatcattctcacatacttttttaatacatgtgtcaatctaaaaatgcttacatttcgagtcggaggaagtagcgtttagaaactcgtatagtgtgtgttttacttgtcatattccatcccattataaatggggaaaagaacaaaccaagcaagaatctgacaggatatactgtgtatacctagtgatttcttcaggcttcagaatcttgacagatattgcagtagacagtagtgcattaatctacgactttgtttgcaaagtgtcattttttgctagataatgtaatgcaaagcgacttgtacacacctgctttggataggaagagggctgcaggaat

SEQ ID NO: 83106 - DNA, 40745 bp, Oryza sativa
gtgtttgtttctctacctgcattgttgcttcatcgctcatccaagtttttattacaacttgtattctcacgtatcaaccgacaaccataacaatatacatgaatacgtccacaggtacaattttttttttcaaaaacgcatgaacatagaaaagcatgagaattataagaattaagtagcgtaccaaggcttggtttagttcccaactttttcttcagcttccaacttttccatcacattcaaactttcctacacacgtaagtttctaacttttttctttaaacttctaattttggcgtgaaactaaacacagcccaacttgaatcgtaggcaattccaaaacgcacaaatctttcgagttgttatgaagcctcaaagaaaaatattaactgcaagatttgggagtgacaaagttaatttcaagcagttgaacgtcgtgttagaaatcgtccaaaattctgatggtgtttaggtaattcaatgggattcctattagttcatttctttgttcgaaatgaccacatgagaaaatttcccatatactaattcgtatcctatgaaattctttaaaaatcctaaattccaaataaacctctgaattcttctcactaccctcagttactgtgattttcctgtcatttactcatttacattaacattggttgtctctctcaatttacagaaccaattttgctttgccccattttctcatctctcccttgccacatcatcaatatcaccaactcttgttgtctgatgaaagctacttcttctgcataacacccatgaactaaatcctgcatacctctgctcattaaaaccgctgccattgttgctacacacatgaatgtacaaacaacaacatccccaaattcaattttggcatcgcaaatctgtcttggtcccatctgatctgacacacccagcccaagaaccatccacacaaacccaagagactactcctaccaaagatcaccagggaagaatcccagaaggccatatgagaattagaattaagacacaagggcatatgttggcagtacggccatgaaatgtcattgtcctgtatatatatgagagagagagagaaatggggggccctcagtaattaaggtagcaaaggctacacattttgtgccgcacaagatgccgcaggaggtcactggctgctacagtggatcaggtagatccgtggattatacaacggtgacgccgcatctgctgcctgattatcagtgagtggccgggacgcctgtgtctccggccaaaagcgtccccccccccccccccccggattctctctgtccctatgcttacctcgcacgcatccaagcgcagtccatgaccgcgaaaaaaaagaaaagaatcatccaaatagtcgtgaaaaattctgaaaatgatctcgattgcgtgtttgttctccgtggagtaaggaatttcactcgtaagacgagtgttgttttcggtaatattcaaatagttatgaaaaaaaaaatcagagaggataacatattaccatataagcttagtttttgtgtagtaagaaattttgctcctaagtaagtcgagttgcgcaattcggattcgggtactaaactggggaggagggggggggggtggagctcaggtgttgagctgtacatcgacggatgttagcgtgtcactgttgctccaacttgctgtcctccagggtggtgtgccagaattttgacaaatcacaagtggagatcccacttgggttgtgtcatggtagctaccatgtaatactacaagaggacaccagattttgccaaatgacacaagctttggtggaggagtgggggtagcatatatattcaggcatttagggacattggatcctagatgagaggaacatgcatgattggtactactactggctagcaaaggaccagtgtctaattaaggctagtacctacctagagtggcttagaagctgtgtgatcagggacacttagtgacaggacaaggttgttggtttcagcaaaatgttctgaaggagatcaggaaattccagtgaaaaaggttttactttgaggcaattttagctgcaataatgcaggtttcttatcaggcttccataggcaaaggttcaaaagtatgtatcaatttcttttttcttctgacactataatttgatccaaactgttgatggcttgcttagggaagtggtatggcataccagctaaatgttgaaaatacatgaaaaccagggtgtagaagtgaaggagacttctgttcaacacagtaccaaacaaatatctgaatttgcattccaagcatgcataattcattatctgaaaaaatagagtaaattccttgtgtgtgcccctgaaaagttattcaatcccttacatgcccctgaaacttactcgattccttctatacccttgaatttttgattggatcccctacatacccctaccgttagattgagcagcattccctggttagtttggttgaaaatgtctataatacccttgaggttggaggagctgaaaactaagaacatgtttggcagctgggtttgaaacattcatgattgcacagtatgtattccatgaggctaaaaaattagtgcataaaattaatttcattttcttttgttatagcattcagtattttataaaaaaatataacatgatattggatctttcatgaccactaaccgacacagcctgggggtaaaagacagtacccctagccgtttactcaaacaccattgcaattcatcagcatatcaagaggatcggtagcaccatttaataggaagaaaatgaaaatacatctaaaagcattcatacaccatcagcagtacacaaatatattactttttacatcatgagcataatggcacaagcccataacagttcaaggcatccgcctgcataaagtcaaacaaatcaatcaagaaacactagcagcagcagctattcgcattttgctaatcaacgcaagggcgtatcattaccgacggcgaggagcagcggagcaaggaggtaataggccggcgtcggagcccccgagaagagggtgaggtgacaagagggagggcgcggaggaggcagggaggagatggcgtcgccatgaccgcaagcagagtcgaggccgcggcgggatgcggactcgtcgccgcggcgggatgcaaagccgccgccgcccaccagatgcggaccccgccgcgccactgatgggatgcggacctagccgccgccgctgaccgcaagcagagccgagaccgcggcgggatgcagagccgttgccgccgccgggatgtgggagaagggcggcgatgcgcgtgcaacgatggctgaaagctggcgatgtgcggcaccgtgcgtgtgggaactatactattttggaggatttggggatcggatgtggccctgtgttacctagggttgacaggggcattttcgcattttatgaaaatactgacaagctaacacacacatgaacacaaacatctgacggaacccaaacggtaggggtatgtaggggatccaatcgaaaattcgggggtatagaaggaattgagtaagttccaggggcatgtaagggattgggtaacttttcaggggcacacaaggaatttactcgaaaaagaaaaaatagggcatattgcataatttcattttcttttttgtacattgtgtcttgattgtatgaaatgagaaatatatcttgctcatcttgtatccatggcaatatggcatttcaaacagattaaaccatgtgaaaattgggctatgcaattgcttcaagtaattgaactggactttctacgataaaatcattttcaggtttagcttgaactgaagggaaatccaggacaggagttgccagtttctagcttcttacaatcaggctaatgtcagtggtgtcgaagctgctgctgctgccgtaacttatttgcatttcctgccgcgacgggaaggtgatgatttggttttgcttggtggcgaccgtgataagactgtcactatatataatctgaatgatctctgaagaacctgaaccttgatggtatttttcgaagcatgtaagaaagagaagaaagcgaacaagtttgtaactgtatatgcatgactcctagctccccaaattcttttgattgtgtggtatatatacatacatagcaggaatggaattgttttcttttgtgtgttcatagctctccaaaaccctgttccttttttcttttagaaacaaccctgttctttattttaagtggccgtgtggtacatgttttactactagttgttttgatccaactagaatggtttcgacgaggagtatagagagagagagtaatttcatatgttacttagttaagatataacattggagatagctttaccattgtatgattagatgaaatctgcattaacaagtcatttaaccactctccataagttgtagcaaggcaacagatacacgaggggaggccatttcaatatacaggtttaatgggcttggaccttactgttttatttcctgaaggaaataatttcactttaggtccctcatcttgacgtcgagtttaaaattcacctctgaactgcaataccaggcataccccaacttacaaaaccggtatcccctgaaaaacaagacgcgggacttaaaatgaacttattcctttcctgaaatgatgatcaagtccattgaacttatggccttttggcccattaccaagagaggtaatcccaaaacccaaacggtttagcccacggtggtgagtgagaagagattttctttgataatggaatagaatattccggcctttgctcaacgaactacaaccaattattatagagtagcacacaaaataaaaagcttctcacacaaaaaagaagacacctaccaacgcaagataaggagtacacaattattaaattctgtttgtgaatctccatcaaaaattggtaaacagttgcataaccgttgcctcaagattacgacatgcaacttttaaacgctcgccctcttcatcacacttttgtagcagtgcccaagacctgagccaatgtattgccctgaaaattactttgccctatggtgacgaaattaaacaaaattgtactatgcatacaaaacagtgaggaagaaaattgctggatgaagtgtcctattttttttccaagcgaagtgttataaccttgtcctatttttttccaagcgaagtgttataaccttgtatgaaaaagtgaacccaaatctttcagttagcaaatgggcttgtttggcagtgctgctttgcagctagctgcaacagtagctgggttgtacctacagtaaaactggagaaaattttccatgtttgctgcagctgcaaagcagccacaacaatctctgctgaaaaccccaatgatacgactcagagaagcaggtcgataagtagaatttacttgacgaagaattcctctgagctgggtatcttttatctcttgaatttgtaattgggtggctcatgaaatggtagtattagggaacaaatatgcaattgatggcgattttgtaatgcatggtgagcctgcttgtcttcatgaattggtagccaacgatttatcaaataaaaagggaaaaagataagtctgaattaccttctgaaatatcgaggttatctgaggaatccataaattacagcaccagatatttcactgtccatagcttttcataccagaatatcttaaatgtattatactacattcgtcccaaaataagtttatttttcaccaatcacacattctaatacaaaagcaaaaggacaaactaaaatactcatactttatgaaaccctaatgaaactattcattagagcaggtacaatagcaggctattagctagccataaacatattttaatgatataaacgatgagagagaagagcagcgggctacagatctgtagccagctgcagcacggactccaagacacactgtgtatatgacaggtgggaccatatactaatagtatagtaagcaactattgtatgaattggctattagattggctatagatgaattggagctggtagtgggctgtactattagacttgctcttactttatctacttctaatacaattatgatgtaatgattactttaaaaataaacttattttcggacaaatgaagatagctaaaaataaacttaatgtgaaacggatgaagtatataagtattatagttgtagggtatctcaaactacctaaatagttgaggagtaatttagatttttcttttaaaaaaagagtgaagccaaatcctaagtgtgaatgctataacagaacaaaagtctgaataagttatcaagtactcaagattccgaaattccataaacagtcgatgtgcacggtttatatattattatatctctcattttgcaaatttaagttgtaagtccgtatttcgagctacagtcccagaattagggccccttttttttttgaaacacagtacaaacgcaggcgctcacaacgtgcgcacactcacccctatgaacgcacacacgcacactctacccctatgagcacctccggaagacttgggccgcatatcttgagattgacgaagtcaccacaagcgcctcgctgtcgacggttacgtcgcctaccactgaaagaataattagcccgaaatgcgagcaccgtgttaaatctaggatttaaacccgggtgggctgggttccaccacaaggaacctaacccagttgagttatgctcacttcacagaattaggcccctttgattcaaaggaaattcataagaattttaaaggatttaattcctataggaattttttctatatagccctttgaatcaaaggaatgaatcctatggaatcctataaaattcctatggaatgcctcttcccatgcaaattttgaaggaaatttaacatgaggttctacctcatgtaacctcatgttaagaatcctttgagtctttctctcttcttaaattcctatgtttttcctgcggctcaatcaaacggtcattcctatgttttttctgtgttttgcaatcctctgttttacacttgtatttctatcagagtcctatgtttttcctatttctccgtttttttattcttatgattcaaagggggcctatagaacattgcggcctgtccttcaaaattcacccgccatcgttgttcgttgagcatttgagtttgaaatcaccaggcaccatgacaccacacagtagccgtgcaacgaatgttcaccgcatagcaagcaaagtcgtactagtacgttggtgcgtgcgcccctccgccgtccaccgaaaaccgcgtggacggccgctacttaagagcaattttttatagtatagctaactattgactattagctcctgttggagacaataacacagtacttcctccgttttatattataaggctttctagcattggccatatttatatatatatgttaatgaatctagacatatatgtgtgcctagattcattaacatctatatgaatgtagacaatgctagaaagttttataacctgaaacggaggtattaagtatataataggttaactgtaagatttactctgtttatttttctcctctctatttctttcactataaatttcatgtaaatattttgaagattatgtaaaacaatctattgtatgagaaccaaaacttctcatctttttctctttcttttacataagcttatattttctccgtggctttgtcttatattttaagagattttaggtggacgtaacatttcctacactccggtggtgtttggatctagagactaaattttagtccctgtcacatcagatgtttggacacaaattagaaatattaatcatagactaatgacaaaacatattccataaccctggactaattcgcgagatgtatctgttgagcctaattaatccatgattagcctatgtgatgttacggtaagcatgtactaattatggattaattaggcttaaaatgtctcgcgaattagctcttatttatgcaattatagttttattataagtttacgtttaatacttctaattagtctcaaacattgatgttacaggcctaaaatttaggtggtgtttggattcagggattaaactgtagtccctgtcacgtcggatgtttggacactaatttgaagtattaaacatagattacttataaaactaattacataaatgagagataattcatgagataaattttttaaacctaattaatccataattagagaatgtttacggtagcatcagataagctaatcatgtattaattaggctcaatagatttgtcttgtgaattagttcgggttatgaaatactagtaggttttatcattagtatatatatatattttgagcgaatcattagtacatattcaatacttctaattagtgtcagggaatttttttttttagcacctcccgtctcctcattcctcaatcgtcatcctcctcccaacccacacggtccagtcctcctcctcgcgtagacgcggcggccgaggaacaagtccgtcacgcgaaccttccagaacctcacacgtcacgcaacctcctcctctttattacgactactaccaccccctctctcctctccgttccaccgccggattcagattcggagagagctactcctcgtcgttagccatggcgtccaagcggatcctcaaggagctcaaggacctgcagaaggatccccccacctcctgcagcgccggtgagatgcatatccctctcatcacctttttttgctgcgtaattaagcttcgatttactagccgtgctgtgcttctgcttcctgctcgatcgatcgattccatgcgcgacccgtcgctagatctgaggatcaggtaggttggtttgctgttggtgtggacgagtggatgatgatcttgttgatttctgtgcaagtggagggggtgcctgtgcgagccaacccggattttctttttcagcctttgatctcgtcaaaactcagaaatttcgatgataacgtagtaataccgctttttagtttcacttttaagtaaacctaaatgtacggcacatcgtataagatctgcaatccttagctttgaaaacaagcgagaactgtattctgtagcccaatgcaatatcagatcagttaaatttgcagggagaatgagctgcgtagtggctatttatgcatcacaattcagagagctaccgaaactttatttaagcacatggagatggtccagatggagtggcttactctgtaatttttaaatggttgattgttcacggataaagagtttttatccccctactttgggatggctggtcataagatcactagctatgtttaactttgaataagtctaccaactaagagcattggtatatgcattagggcattagtgcttccaagaacagaacaattacgcataccatgcttgctcaattttaaggacaatgttctattgtatcagttcacttacttcctatatactccgtatgttggaagttggaataagctaggtgtttcatgctctgctggaagatgtaacaacctgtcgtactagtattcctttgatcttcattctatacaaatgcttccttagttgtttacgtatacgactgacatgtatgtattcttaacctaccaggccctgtggcagaagatatgttccactggcaggcaacactgatgggtccatcagatagcccttatgctggaggcgtgtttttggttaccattcattttcctcctgattatccattcaaaccgcctaaggtaaggaaacattacatcgtattcaacctacatattttaagatagcttccttgttgcaactatgaatgctggattgttcaagtgaatgggaaaactggatactgtgaaaatcttacacaagatcttttcctggaagtttggaccttttaggcgatagtaggtgtatcaattttctgaagtgggatatgataggaagtataaactgtgatttatgaaaaccattggtaggttttagtgcatcaatatcaaatgctgcgtccataccgttgaacatgttattctaagcacatgattgccttttgaagatgagagttaattgtgttcattttagtggtgtaggtggcaattctaattaatttcacctttacttccctgttcctgttctggtattatgaaatgttgtttggttgtccttaatggaagcagtcatttgtttttgttgcttctgtattgtgcgtccatatggttgaatgtattattctaagcgtgtgattgcctgtagatagttcttgtgcaagttttttaactttaatggtgtaggcagcagttgttccatttaacttcacttttccttgttcttgttcttgcttagcccttacagaaccggtcatttgttcttcttgcctaagcagaatcagtcctttgttaattttgctttagtagaacaagttatacaattatcggtttgtttgttcgtgagttttatcttctcatgccacaagtgagatgtctttagtgcatggtcgtggcagagtgcagcttgtgatctggtgtcttttctggataaatgtagcataagggtgtgaaaacatccttgacaatttctgaacctaaaggcaattgtttcccctgaaaaaacacccttgtttaaaagtggcgccaactgcaatccttgtacagagttatgctttggttattcattggcaatttggtaccaaagtttgtcatatagaaaaggtctcggttgtacaggacctagatgtttctcttaactcaaaaacgtaacggttcatgattgggaatttgtagttgggactcagagttccactaccttttcttgctcttttctgtcttaagtttaattatttttgttctacagaacaattacaatcagtagtaaaattttcaggtggcattgaagacaaaggtgttccacccaaacattaatagcaacggaagcatatgccttgatatcttgaaggagcagtggagtcctgcattgactatttcaaaggtaagtttgttcctaatatgatgaacaattgaagtaagaaaggagctgctccctccggtcataaatatttggcatttaacataagattttggacagatttttaaaattttgatcatcaatagtttcacaggtcctttgcttaaaacaaggacaaaatggtatatggatttgtctaaaaagtatcatcataatattgtaaatatgttatattacaaatttgttctgatacaaaattgatggtcaaagttttaaaagttttgaccgaaacttgtcctaaacattgacaatttatgaccgaagagagcataaagcttggtagtcaatcctctgttcttgttcagccgtgttcgcaatcccacgtgcaccattctgggtttggggcatatgatggacactgaagtagttcagttcctctgatcttgttcagccgtgttcactatcccacgtgcaccgttctgagcttttggggcatatgctggacactgaagtaaacttcagttctaatatcttccatttcatttaggtgctactctcaatttgctcgctgttgacggatccaaatcctgatgatccattggttccagagattgctcacatgtacaagactgatcgggccaagtacgagtccaccgcaaggagctggacccagaaatatgctatgggctagaatggttaacaataagaaatgtgagatatgccattgtattgccttgtattctcctgtaactctttcaacatttaagaaacagcaagaatcaaattgaactctcgagttgttgtatggaatcctactatagatgttcagctattgtaaattatgtagtgggtggttctattgattgttcgatgagcacttggaatggtacttttatgttccagagtaactgtgacaaaatagtctgtattgatctcctgaaaggctgaaacccatcttggactgtttagtgttttattaatttcattctagaattagaaattaataattagcactatttactgttttattagtttcattctaaaattcgaaattaataattagcaagtttgtaactaacgtggactcctttttttaattgtaagtagctataattcaaatgtacagcttcattttttgcttattggtttatcagtcgcaaattaaaatttaaaaatttaaaacctaattttaaagttaattccgctatttgcttgccaaaaaaaaatctctcaattctaatgtccctattgatcaagaaaacattatttccattagttgagcgcaacaaacataggcaattgttagatttgaaatatgaattttgaatggcgaaagcagtaactccttctcatggcatcctggacccatgttacaaacagagtcctgctctatctttagtggcaggtgatcctaaggccatgtatagatgggattaaaacttttaagtccctatcacattggatgtttggaaattaattataaatattaaacgtagactattaataaaacccatccataatcttggactaattcgcgagacgaatctattgagcctaattaatccatgattagcctatgtgatgctacagtaaacattctctaattatggattaattaggcttaaaaaaattgtctcgtgaattagctttcatttatgtaattaattttataagtagtctatatttaatactataaattagtgtctaaatatagggactaaagttaagttcctggatccaaacaccacctaaaagctctatctttagtggcaggtgatactaaaatttcaccttattactcagtggtagtacaactgaaccaaaaaaaaaatcaataattctgtgcttaatcaggggacaggcagagaaggatttcagggtggaggccgtgacgatcggctgtgttcagcacaagaatctggtcagcctactgggtattgcagcgagggagctttgtaggtatgcatggtgtaattttaatacgatttttgaaataacaagttgtgctctctgtacaactttactctgctagtgatgtgtaaattgagttcttgcaatttttgataggaagctggtgaaattgagttgaccaatttggactgaagaagtgatctcagataggggggttgctgcctggaagagtaggaaaacaatgcagagagagatggttcaaccctttgaggccaaacatcaaggttagtctcctcttccttgtaggtttcacacacattgtatatccaactaaaaatacttcttttgccggcatttcaaaattcttgtcttgtatacagttaagatcacttgatttgtctgatagatctgttgatggcatgtaggcatagatagctgcttagtcaacccaataaaatgaggctataacaagttctatcattgctatgctgcatttttgccaagtctgcaatctatcaatcttcatccgccgagtctctgaacataaattactacatctatagagggctcaatttatctttagctagacaatctattagaagatgatgagggatttgggactcttgtcatctgttaatgtgttatgcaatctccttccaccagctaaatgaagcatgcgagcttctttagattgattgtttcagactttcattatcttagattggactcgtgcaatgtctaatgcaatgtttttttttgtcactgatttttgaagggaacgactccttgcagcctctgtgctgcatcggccaccatcaccggcgagcctgtggcccttctctttgtgccatcggtgccacgagaacatgaagaggccattcgcagtcaccgcaagaagaattagtgtcacaacaacaagaagcatgagcgccttcatcaatgggggacagtgagatccattgcaatggccatggccatgagaggatcctgatgtcatctgccacgatatgtcagcactgaatggctgggggcctgtcggggttgatgaggtcggccggactgcacagcctgagagcaggcagaacatattcagatgagtgttgtttgcaccttgcaatccaccctgcagtttcgctaattcttggggaaaatgatgttttgatttctgtagcaacagctttaatttgttgaacgaatggatcccatgtattttttttctgggctttgaacaacaaaagcacaaaaagggacagaagcccatgttcgacccaacaaaccttttggcaggggtgcttgatgcacgcacagcacgcggggaggaggtgggagatgatgacacgtgtcatatcctatggtcaaaagtccagctgatatctcaaaaaatttcagcaggatggtactagacagtccctaagtggtacttaattcgtttcacttcagtaaagccgcgtataatatgcagagtccagagtataatctgcatcagtagacctactgatatatgatggctcagtagcatcctgtagagtttataatgtggcaaatgtctgacgacataatataactcctcaaaataacgttaaattaatttgggacctgcttttgcatttgcttcctcaaatcaaattgtttcctcgagttcaacatagagattctgcagaccagttattacagtccaatgcattttttttccaggtggtttccaagacaaattggtgttccatcggacgagtaatgcagccaccatctgtcgttatatcttgacagagccgagaaggaaaatcctccagagattggccaccatttgcatggtcagttgattctccattaccctacccttcttgttcctatagaagctcagaagcgggcaagcggcttgttttgcgacgcaccactgacactgtctctgttcatcactgcagcaaccggatggcgagcaaggcgacagagatgggaatttttttcgtttttagattttttttaatatttacagaaataatctatcggcgagaaaaattgcaaaaatagaccctgccgccccaatggtgggcggcaagctgacgtggcaaacgggggaggaacggacggtgacggagggtggttttttttgcatgaaaacccttgccgccctttggtggggcggcaaggggtccgaatgcaaaagagccgcaggggccggccattttgcaggcggccccttgccgccctctggccgggcggcaggccttgctgcctataaaaggtctgccgcccagcccccagccctcattcctcacccctctcaaatccagtgaaaaaaaaagaagagaggggaggagaagagaagaaggggcgaagccctgccggatttagacgccgatttcaggtaatattcatagatcctatatgtgactattgagttaaatagtgtgtatttttaaaaaatttgtttgaataaatgcattatatttttagggtttcagttgtactaatctagaagtgcgtattgtagatatcggtaactacgtagatctgctagtttggaatcaatactttaccgttgcattggcttacacaagaagatattacgttgtagatgtttattgcatgaaagagtaatatgatctagttaattcgttgacagatatgtcgaacaaacaaatattccaagtttaccatggaccaggaaacgtccattacgggccaactggggtagatctgtcagattttattgtatcagaaaggggaattgatagaccggctgagaggagtgtaccttctataaaaggatggttaatgaggggcttgagagttgatccacagacaagtgacataacaatcaatgttatagtaagtcgggcaactgagggtttttattaggaactaatgccagttcaaaactctcaagtgtggagatggtatgtggaaaatgcaatgcaacgcgggtggcctctagctttggttccgtttgtgcacccgaaggatccaggtatgcagatgaacatggatgatggcaagggaccaagtgctgaagtaaatgagacttctgtggaggaggtcaacgcaggagaggacaggggcgtagtagctccagtgggcattcaaccaggtggagtggccgacaagggggagactgtcgcagccattgtggatgaaatggagagggaggattctgacaacgagcgtgtagaggaaggtgattcgtcagatgaggagacggatattaatccagcagaatgggctagttaggatttttctgggctgatcgtctctgaagaggatagtgtgagatgggagtacaaagaaaatgaggttattcagggagcgatttatagtagagcagaagatatgaaggaggcggcaaaacattttgcagtgtcacttcatagagagttttgggttgccaagtccaaccggtcgcaatatgaagttcggtgtgttaaggaaaaagatggttgtccatggagagtgcacgcgtataaggggaaatggaaggattattggacagtgtcagtcgttaccaagcatacatgttttctacctggtgttcagaaataccacaggaacattacatgtgcatttgttgcatctgagatgtatgcgcatgtcatcgataatctcacatatgaaccaaggtcaataatccgacacatcgaggagacatacaagtatactattagctatgccaaggcctggagggccaaacagaaaataatagagataagatttagaacttacgaagcctcgtatgacaatttgccacgcctgcttggtgttatcgaggaaagaaaccctgggagctcttacgaagtgaagaaattcccatcaattgaacatcctggcaagagtgtgctgcaaagggcgttcttagctctacatgcatgcaagatggcattcgtgaactgtcgtcctgttctctgcattgatgggacattcttgacaggaaagtatcggggccagatactgacagcaataggggtagatgggaacaatcaggtattgcccttggcatttgcttttgttgagagtgagaataccgacagctggtactggttcctaaaattggttaaaacaaaagttgttggtatgaggccaaatgtgtgcctgatacatgataggcacgctggcattctgcgagcgatagaagagttgcagtttgggagcatggaacaaggataccctggtgtttgggacgatgtacagagtaggtggtgcatgcgtcatatgggagctaatttcttcaagcaattcaagaacaaggagctcatgaacatgttcaagaggctgtgcaatcagaaccaggagaaaaaattcaatgagctttggaagagattagatgagttgacagccaaatgcagtgatcagcgtgcagcggctccatcgaccgccgttgctgaccctcctcaagctcttggacctctcccaacggtagtccaactttggttagaagaactggattggagattaggaaattttctcagtggattctgcatgaaccaaaagagaaatgggccaaggcgtatgacacaggtggtgctagatatggaataatgacaacaaatttggcagaagtttacaactgggtgatgcgcggtgtccgtggactgccactagttggcatagtggagttcattttacatgggacatgcaggtattttagggatcggttccaggcagttcttccctctatgccgaacaacagcatttttttggaactttcatacagaaaaagctagaggagttgcgtaaaaaggccatgaaacatcgagctgtagtgcaaggtacccacaacacaggtttgagatactctgtcaagataaggcaggcaggggtatctaccacaagagagtgaagcaggagtgtgttctgaaagccgacgacacatgtcattgctcttgttcaaagccgaagctgctccacaggccatgcacccatgtcattgctgccgcagcggagtgtagcataccagatgtagtatatgtgtcacagtacttcagtaagcaagcaatatattatacatagaacggcgagatttatgggttcggcatagctagggagttcacagagactaacgatgaagtactcaatattcctgacccatcgaagctccgaggcaaggctggaaggaggaggactcgtcgcatccgcaacgatatggacgagtcggaggctggcagggtgaagcgttgcagcaaatgcgatgaacgtgggcacacctacaagcattgtcctaaagacaaggagaaaccaagtgcggcggaggcaggactatcaggatcagcagcagatggagctcgccctacgggtgaaggcactacctccactcgaccacgtcctaggcgtcgtcgtgccacgtctggctacgtggtgtagttcttatgttctatgttggcatgtgggtttgcttgtaatatgtttcgaacttatcgatgtgtttatgtttcgtcgtgtaatgtcagacttcggcatatcatgtctttaggtctcgtgatgtaacgtcagactaaggcccctagtgtctttagatatgctgatgtatgtcggacttcgacacgtaatgttatgttatgttatattatcgaactctacataaatgttaaattgcacgtcatcgttatgtaccattagtaacgtttgctttatttaaatagcctgtaatcttgttgtacataattattctcatgattttattactatttcataattttgtgagtcatattttgttttacattactacgttttgaattgttataacacgaaacactatatttttcagagatggcacgtcaggatacacctcagctgttggacccggtgatagatcaccgacaccggtctcaccttactgcggtgcagggggctcagcttgggacgttccgggcacggacgtgcggtgagctactcacggttgacgactcctttgtcgagaggtacgaacagtgtattactataaattagttgcgctgtaatattttttataatgacatattaatttcttattgtaggctgcgtgaggccagcctcctaccgatgtgtcggctggtggaggctgccgccggccacgcggacccggccagacgatggactgtggacaggtccctcctagcagctttggtcgaccgatggagaccagagacgcacacttttcacttgccgtgcggtgaggtagcccctaccctacaggacgtatcgtacttgttggggctaccgctcgcgggagacgctgttgggccagtgaccacggctgtggattggcaggacgatctgacggcacgtttcgcactagtacagcgcgcaccgcacctcccgctcgagccgttggcacaccaccgcaacaccggacctacgaagaggtggctgcttcagttcaccgtgagtgtttttgtaccgaaatgacaagcgtactacatatttattccacatgttaaggttcctaacattttaacgaacgcttgcaggtcgatcagctacaggcggaggctgacgagtactcctacagccgctgtttgaaggcgtacttgctctggcttttcggctgggtgatgttctgtggcggtcacgggcacgcggtcgacaagggactcgtgcactacgccaggagcatcgccgacgccgcggtaggcgaggtgcctcagtggagctggggttccgcgttgttggcggctctgtaccgtggactttgtgaggcttgcacgacgacggatcccagcgcgacctttggtgggtgccctctctttctttctatctgggcagctgagaggattgcgatcggccgcccggaggtggaccagcacgcgtacgaggagtcactgtacaaggagcgaccagaggtcgactaccctacgatgggtactctgtggtgccgtcgtcaggtacgttgcatcgatcttctcgtattgttaagttaattgctcagttcattatatatcaaatcgatcgtcccgtattgcagcgccgatgggctcacgtccaggttaggcggtcgtatcctgagtttgttatggagttcgaccgccttctgccgactgacgtcgtgtgggagccctacagtgccgcggctacccaggctcgtgcgccgttgggtctgtccacactctgcaccagggaccaggcgtactggatgactacggttccgatggtcttcgacatctgcgttgagcctcacgcccctttcggcgtgatgcggcagttcggcttccgtcagccctttccagtaccttttccgacgaccgtcccagctgctgttcagcggtaagatctttcactacgctttccgttattgcattaaaatctacctgttcacaataatttgtaacatctctcgattcacactaatattacacattaattcgcaggtactcgcgcaagggtcagcagtcagctggcgactggcccgccaagttggcgacttttgttgaggactggttgctcgcaaccgaggaggtcgtggaccacgagggagagccgcacactgaggaggcgtacaggcctactacgctggtaccagccacgcacccgtactagggtcaccttcgctcccttggaggagcagccccacgttgcgagcactagagacctctacgccaggcaccgcgaccaggacttcgctcgttgtgtgagtaccctgcatcgcaccattcctttatgttttcgtgtctttctcattgtcaaattttacgaatatgtatgaataaattaaccatgcaggctcacgacatcaaccgggtcgtcgttgacggttcaacgacgatccaacgtttaggcgcggggattccggtacccgtagaggagcacttgacgacgtacacgcggatggtggagtcgatgcgctcaattctccgagtgctcacctgtcgtgcagacgacgttgctcgggcagacgcagctgtacagcggccacccgtaccgactggtccccgtccagctgcgcacgttcctaggccaactccccctccgcacggaggtaagtatttttaaggatttttctgtacatgcctcgcacatatatgtgagccgtttcacttgccgattgattcagggtttcgtgcaccgttcagcaccccgccttcctcggctaggccttctggtgtgccccccacaggtacttaaaaaacaacattacttcgacaataaatttacatgcatttaatgtcttagcttacaaggtcccattgtcgatgtgtaggtttcgcccagttcgctatgatgcaggacttctcccaggctacagggtcagcgtctcaggcagctgtgtcgacctcgcactcagcgcagttctgccagtacaccggtacttcgtcacaggcagccggcacgtcgagtcagggtccaccactggaccatgctgggacctcgtcggatcgcttgctgccttccaccgtgctcttcgacatcactgacttcgactccgcttcaggctcggcagaggacgtcatcggcccctcacagctgggaggcgcaccgccggtgtagacgcaggaccaggcgcaggccactcctccgccagacactcgtgctacctgtgctgtgccaccggatcgtttcacctactcccaggaccacgtgcgagcacaggcccggaggaccaagcgtggtcgcggcgcggggcagggccagtagagcagtcttctctttgtttatttgcttcactttccagtactgtatgcttgtgtaatgactacgttgttgttatatgtgcacgatatctttcggcgcatgcacgatacctttcggcgcatgcacgactactttctgccgcaccgatgcagcctcctttattcgcgtgcgatacgagtatttgcccgccatttgccgcatacgaccaatgtaactttcggcgccgatcaggcatgcaacttcggcgtacccaccatgccccaccacgttcacatgtcaaggatatcactcgattttttgcgcctatataagtcgccttaacgagtgaggcctcacgaactcagtcacattcagtactctcttccctacttgcttcattacaaatcctaccggctttcgtcaatggctagacgccggagtgttgaggatccaaactggcgcagcgatccttatgtatacctactaccaccttggtgccagcgtcctctctgcctatgcggtgatcgatgccaactaatggcttcgaggaatcctgatattcgaggaaggcgcttttttaggtgccctaactatgaccgtgaggtattttattatctgcatatgcttattcattccgtatgggtaatcgctttattcttcgtaacactactctattcggcagacccgcactatggcttgcacatacatcgagtgggtcgatacagaaaatcccgttctcgacctaaccacttgtttacaagaaggtcgctggtatttcgcatccgaaagtaccgagcaatacttacagagaaaagcggtttatgaacgacaatatcgtgaacaacagagcgactggcgggtgctaactacggcactccctccatgggaagcccgtccaagatgcaggtgtggtgatcgttgtcaggttcttcgttctataaatcctacaacattgggtcgaaggttctttgtttgtccaaatattcttgacgacgatttcatggtaagaatattttgattacatgaatccttattttctcacaacatttactaactttgctcgctttacatctattctttcctcccaggaaccaccaaggagatgtcaatacagagaatggatagacaccagaagggttctaactccacctagccgtgttgtgcagcttgaactaccagagcaatacagggttactaaagcgcggtttgagagaggagagggatcctcacgtaggggttagctattatcggacaacttggcatattgaaatttctactgtcatgcttccttgtcccattactacatcgtcgttgtgttcaactattgcactacctccctcctagttcgaatctaatatcatctatgtaaccgcaatggaaatagttgtatcatgttcaaattgtactactatttcttcatcttacataattctccttgtttaagttcatataatgtttctacgaccgagactgcgataggcctatattaattatccgagtactaatacgtcgaataaggtacaaaataatacctcacttaacatatgaaattgcgcaacaaccaacttcaatacatttttataacaatattaacaagttttaccaacaaatacttctttatttattattaacattacatagaaaaatcttttgaccgtactttttacatctgggtcccttgccgccctctattggccgcaaaaagtacggccgcaagctctgagggggcgtccaaaattgcaattagccccttgccgccctctgtatgggcggcaagggtctaatcgcaattttggccgacggcggcagacggcgcggtcgacccaccgtctgccatgttagcttgccgccccaatggtgggcggcagggtctatttttgcaattttgttcgccgatagattatttctgtaaatattaaaaaaaaatctaaaaacgaaaaaaattcacagagatggcgccgggggccctctccaatgggctgtggcttgcctgggccggatgcgcgcaaacaaatcagcccatgtgtgtgtttggggtggtggcccggctcttgggcttctcctctctactccacgcgttgcaagcgtcgacgccgatgccatccgccgtcacggtctgcacaagcatgcatctgctcaggcgcctcgcgctccctctggcgggatgatacgcttttggatcattggatggcagcgggtttgttcgagggataggtttttgcttctctcgaggctcgacggataagttttagtagctgattggtggtgttggcgtgggtcgttcagtgatgggttcacgtctaggcttagcgctctctgatcttgcttagcggcggttggtgcggtgttaattttgttttatcacctgccattaaggactcctgatgctgtaccaataattgcagagcaattgccatcgtaggagcaggattgcaagagacgactgacttgcagcctttcttgactgctttactttgtttgcattttattagtttatttaaaaggcctgatcacggattagtggttagtatgtaaaaattcatctgtatctagtgagcagccatcaccgatggggtcatctttgtcggatctaaatactccatccatctacttttgatagtcatattttatcttggcacacatatcaaggataagtaattctacttatcatccatttaaatatgttactagtcattcctcgtaaacaagcgattaattaatatttacatttctcaattcccatgtagctaatcatgtgtggaagaatgaagagtcattcattaaatccaagaaagtcgttaagataataagttgttggattgaaatatgcctatcaaaaataaaattttcagatttggaaatatgactatcaaaagtagatggagggagtaaaaacctattactgataaggtttgactcagcgcgtgaggcatcctataacccatgatgggctccaactcttactcgtcaaaggtgactttgtcatccgactaagtcttgctctccatacttgatccaacatgtgttctccttcatgaattctggacatattagatgagggtgtatatctactcttccgacaaacatcttctcattttttttcaatctacacatgaacaagtcatataatcgttgttccttctttctctcctcctccgcaacgtttataaaatttgcaacaccatttctatactcttttctatgtcgatcaattatgtacatccaatttccgtccatctctacaaatgcgaacaaatattatatatgtgtgtgtgagagagagatttatattataaaatttgtagagatggtttatttattattacatatagagaaattttccaaattttcttttttttcttagaaaagacaaaatttgtccctctagtcctcccaccacaaatgtgaaataatacatttgattgggataatcattacatgaaggtgttggagtatttatagtgtggaatatcggtaacgaggcgataaatgaaacccatcaataaccaccttattggtgacgggctttatagctatctttgttgggcctgtagatctggttgcgatccgtcaccgatgatcttcggcgggccgcaacctaacctcgtcaccgatgagggtcatcgctgacaggtccagccatgaggtctcaggtgagtgtttctatgggtgcttctatgtcggagattattttgggccgttaaaagtgagtgcctatgcgattggtcgtaggtctccgttatagatggtccatttgcgatgtctagttctatattagtcgtcgtttgatgaaacatctgtaggatcgaatactaagaaataagccaaccagagggggggtgaatggttgatgtacccaaaaactaaaacttttagcggaattaaaagttaccctcgaatcgacggatcacggtgtgaccgaagtagattggccggtctgaccgcctggatatcgtcggtctgaccggagttgatcgttcggtctaaccgccccgaagaagctgtagtcacctgaagctgccgccagtctgaccgccgcaatgctgccgatctaaccgacggtatctcgccggttagaccaccgaacccgagcaaacacaaatcgaagaatttttgatgtagacgacaactttattacttctctctgtgtttacaaagtgcaacaacagcactcctcatgaaaatctcgactaaactcgaaaccttaactattctctcaactcaatgctctctaaagtgataccgggaggccacaccctccctctctatttatacataaggtaaggcagcctaaagccacgaaccaaactcatacaagaaatccaaatccacctagaaaaccttcccgtacaagaaaccaactttacaaactccaattgtaccaaatttggactccttccaatttcgactccgcatcccatacgcacacaatatctccatcgtatgccatatggaatcttcaccaaccacgtacattgatctttagcctaagtatcccgcatgatatctgactgtccggacgtcaccttatctccaagttgactcccaatccatcaccggcaatactctcccgagacatcaagacacctacacatgaatcaaacaaagaaaccatattccgagaccaagttatctccaacttgactcaatgttagcaaacaacagtattacgtacgcatagtatccatctagaaaccataaacatgaaacattcacggatatccaatgaaacaacccgaaaccgaaaccgacatagtgtcggccggtctgaccgcttgatatatgctggtctaaccggcaaccactgcccggtttaaccggacccgacaatacaacggttcttgttcatcacctgaaaatccaatcatctcaaaaaccacttcgccaataatctccaaatatcaaaactaataatctcagatgctaattgttcacagaataagaattaaatacactttgattttacaaccttgaccaaataccgtggacagctttttccttagcaaaattttactcacccatttcacacagtttagtttgctatgcaactctagggcttaatccttacctatgatattttgggatagcctattacatatggtggtgccaatggcggcgtgtaggtgtacgttttggcatcggcgtgcaaacttattcctaccatagccattttttttccctactagcaagattttattcatccatttatacagttttgccatgaaattgttgggattgattaatcgcaaattggatattttgggatatatctatagcagagcacaggataaaagagtatcaaagctgttctacacgataagatataaatgaactccctcttccacaataatcactggaacagtaccgcttaccaaatgggatgactaaaagtcgtcgttgatcacttcagcgcagaatatttcaggtcatttgtagtctcatagcatatagttttatcaataagttttacaaaattatagccggagaacacgcatgccattttcattcataattaaaccatctttctgctactaacttgtgttaagaattctaattttagccatgaacctcgttgatgcaaatgtttgaacctgtttagtcaaaacagaacaattctttcatgtcgctaacaggtactgttgaaatttgtgtgtgctgtttggactgaagttgaaatttccacccttgtgttcagaattgaaccatcttgtgttcaaattctgaattttaccaatgaaccgcattgatcaaatgtttgaatcggtttggtcaaaacataaattctttgatgggactaattattggtagtgatgaaatttgtgtaaacggaccaaaggtgaaacttctggccctatatctcgactaaggaggatcttagtatcaatgttttcaagaaaggagatggtgagcacctgggtgtattcgaacccaggccgttgattgactagctcccggcagctccctgccaactaagctacacaacgttctcatgtttttcatccagacgttaaatcatgattcacaagtgctttcattgatttctttgcatttatacagaagtggtgcaagggaatgtagttgaagaaggtgactagaatacttatctgcaacctttttgtgttgtttctctgaaactttttcttcatgaagctatactaacggtagcaagtgagtttccattaagatgtgattttttttatcgtgtgtgtcctattataatcgagaaattttacaatccttgagacgttctaaaaggtatcaaaatttttagtacaaatttggtaccttctagtaccaaaggtatcgaaagatgctaaattttacactataatggtaccttctggtaccttttgaaggactaatcgttataatcaagatatggagctgaaataggatactatagtcaatttacttttataacttattctagtactccctccgtattttaatgtatgacgccgttgactttttaaccgacattttgaccactcgtcttattaaaatacggagggagtaagtattaatatagttattgctgattattcttgcttatttatttagaaaacacttccaccttattgttacctataagtgcctatataacatggacaattttcctacccaaattttcactcgtccatttcacacagttttgctatgaaattgttgggcttaatgagctcacattggaaatttgggatagcacggttactattatgcacctgcaccagtagatgcagatgatctgtcactacagggacagtgacgttgcccccatttgtgacgactggcaaatcgtcgatcgtttcagcgcagagtagtcttaggaaatcacatccatcaatagcgttgtcaatccttcgatgaaacgatcgttgtcatttaaccggaatcatttatatcgcagtagaagcaggcccgggcgccgggctaccagaacaagtataattccttgtgtactcatccagctttcaatactacataaaacattattgaaagtctgaaacacaagtataataagaccttgtttagatccaaaaaattttggtcaaaaacatcatatcaaatctttaaacacatgtataggacattaaatatgaaaaaaaacccattgcacagtttgcgtgtaaattgcgaggcgaatcttttgagtctaattacgccatgatttggcaatgtggtgctacagtaaatatttgctaatgacggattaattaggcttaataaatttgtctcgcagtttacaggaggaatctataatttgttttgttattagtctacgttttatacttcaaatgtgcgtctatatatttcaaaaactttacacccaaagaactaaacacaccctaagtttggcccgaggtggatacgggacgcttgtatagtgatggtgtttctctttgcaattcaattttgcgtggctcatacacattgtttagatggtaatcagatcgagagatgctagtccaactcaattatttgtggagtgaataagatggcaaaaaacattgacttgttcaggagcaacccttgcgtacacacctgactgcttgtctgaatgcaaattcaaagtaattgtgtaggggcctacctgttgcagattcaagtgtcgttgcgcttataaaagcttacaacattcactccctctcactaaactgtggcatgttctctagccgcttgtgatactcgcaatcctaaaccacgagagaaaacattgcccctatagcagaagggtagatcgatggaggcagccatcggcgcagcgagctggctcgtcgacaaggtggtgacacagctgtccgacgagctggtggcggcttacatagccagcaccgagctcggcctcaacatggagcagatcaagagggacctcatgtttatgcaagggctgctccatcatgcccgggagaggagggacaagagcaaccctggcctgcaagggcttctagaggaactcagaaagaaggctgatgaggctgaggacgtgctggacgagctccagtacttcatcatccaggaccagatcgacggcacccatgaggccacccccgtggtagacgatggcatccgtggccaagtcctccatggccgccatgctcttcgtcacaccatcggtaactgcctttcatgcttttcttcttcttcttcttcttctgtaccagaggatgccaattatccacatcacacagccaagtcccgtagtgatgaatctgactatgttggcaagttgacattcaatcgagtagacatgtccaaaaaaatcaagtcggtaatcgagggcatatatgacttatgtagccatgtatccaatttgctcaaaattacccaacctgaagaaagaagggttctatcactgaagcgacctcccaccagctcaacaattacacagaataaattatatgggcgggaagacatctttaaccagactcttgatgacatgtgcaccatacgtagtgaaacactatcagttcttcccatagttggccctggtggaatcggaaagacaacctttgcccaacacctgtacaatcacaaaagaacagaggcacacttctctggcaacaagacctgggtttgtgtatctactaattttgatgtggttaggctcacccaagaaatcttgatgtgcatatgtcaaaatagaaatgaggaaagtagcggagcacatgaaacatccaacttggatcagctccaaaaatccattgcagaaaaattggattctaaaagatttttacttgtcttggatgatatgtggagatgcagcagtgagggtgaatgggaaagcctactagctccattgaaaacaggagaagccaaaggaagtatggttattgtcaccactcgttttccatctatagcacaaatggtaaaaacaaccaagccaatagaactgcaaggtctagaggatgatgaattcttcacattctttgaagaatgtatatttggtcaggaaaaacctgcgtgttatgaagatgaattgattgatattgcaagaaaaatttccaagaaatttaagggtttcccactagcagccaaaaccgttggtcgattattgaagaataacctttcccaggaaagttggatggaagttcatgaaagaaatgagtggaaaaatcagcaagatggtgatggcataatgccagcactacaaataagctatgactacctacctttccatctgaaaaagtgtttttcttattgttccctttaccctgaggactaccggtttggtaatttagagattacttatttttgggaagcattaggcatcatagcttatggagatcaaaataataaagctgaccatgtaggattaaagtatttgaacgaactagtaggtaatggttttctcatgaaggaaggtgatgatagtaggccatattatgtaatgcacgacttattacatgatctagcacgaaatatttcgtcacaagagtgcattgacataagttcatataactttaggtctgatagcatcccacaatctattcgacatgtatctatcaccttacaatatgatgagtatgaccaaagttttgagagagaattagaaaaattcaagacaaaaatagacatagtaaatttgcggactttgatgctttttggaaaaggcaatgcaaacatgacctttttcaaagatttgttaaaagaaacaagaagtcttcgtgttctatttatgcatgcaaactcgcccgaatctttcccacatgactttttcaaactaatccaccttcggtatctaaagttgaaaataccttatggcgtagaactatctctaccaaatgcaataagtagatttcatcacttaaattttttggatctagggaatagtatatgtattttgccaaaagacatgaatcgtctattcaatttacacctctttcttgctagaaaagaactttgttccaatattcctgggattggtaaaatgaagtatttacagaggttggaagagtaccatgttaagaaagaagacattgggtttgatctgagtgagctaggggatttgacagagcttggaggtgaactgacaatatttaatcttgagaatgtggcaacaacggaagaaggtaatcaagccaaattgcagttgaaaagaaatttgagaagattgacgctaatttggggtgcggtgcaacagacgacaggatctgatgttcttgatggcctgcaaccacattataatcttagagcacttggcataataaaccatggtggtcccactggtcctggttggttgtgttccgatatctatctatctattatatactaaaagtccattaaactttctataaacgctctcaagccgccacgtggctttctacaaacgctcctaggtcaccacgtggcattctataatctcaccgtcgattttcttttaaatcggtggacccactaattttaactattagatcttcattgaaaaaataaatctggtgtccccactattttttaaaaaaattgccgtgtttgccatcgggcaaggaacgtaagttcttttttttttcccggcggcatacgatacgtactccacgttccacgttagtattatttttttccttttttttattttgcaaacagttctggtgtccccactatttttaaaaaaaattgccgtgtttgccatcgggcaaggaacgtaagttcttttttttcccggcggcatacgatacgtactccacgttccacgttagtattatttttttccttttttttattttgcaaacagtactttttctttacaccttctgaaaacagtactactactacgcacatcgtacatacactaggggagtttaggagaaagtgttaatagatatgtaaaatcacatcttatcgatttaagtaaaaatccatagttaaatattttttctttttcttataatttttaataattcttttaatttagagatatgacatgtggtaacctaccagcttttatatgagtgtcacgtggtagcttaatagcgtttctaaaaagtttaatggacttatatatagtaaaagttaatttaacttcctataaatactctcaagccgccacatggccttctacaaacgttcctaaatcaccacgtggcattttttaatcacaccgtcaattttacgaaggtaaaaaaaaaaaaacgcagtacgtactccttccaccctccgaatctcccatcctctcctattttctagctaacttatcatattttctcattaacactcaatatatcaaaaaataattcggacatctaattgatcgcgactctcaaattataattttatactcaggtttttttcaattgttatgttatttataattaaatataaaattcaaaatccatatcactcatattttgttatctaaaaattagatcatgctgccgttctaactacaaatgtcagggcctaatggtacgcccataaacacttctaagtcgatctcgccttgtaacactataataaattaaaataaatctataagtatgacaaatgaaaataaaacatctaaccattgctctccacttaaatcgatggatccactatcttatatggttagatctatctttaaaaaaaaatcccaaaactccctcacattcctccattcctctgattcctctctccctaccattccttctctgttctttttatctccatagtaactaaaaccaacattatctttaggataaaaaaactccaaaaatggactccacctaacaagtctagctagctttccctctataatgtgcttttcttatctttctcctcaagctagcacttacagaaacaatataaactagactttaaaacactcataaaattttaaatcgtatattcatttatgatatttctacactattttaatttttaattaaataaataatttaatatctgtattgacttacattgtggaccacatctatccacctttaagcctccaataaataaaatagaacactaaaatttctcattaaaaattaaaatatctcaccttatgtttttaataaatggtcaacccattatttataccatgctagacatctaatctccttcttccaactccttatgtttcagattataagtcattttaaattttgtcaatgtcaaattacttgaattagtttataaaaaacatagtaatattttctacacaaaacaatcatattataaaacatattcaattttgaattcaataaaaataatttggtgttgtaaatattgatatatttttcctcaacagtggaaatagttaatttctcttaacatgcatatatgggctatttacttatatttgaacttaattagatgcacttttatgaataaatgatctttttagggataaataaacgttcctaagatgatcataatatctaaattatacatatgatatctgatgtcactaatagattagagaaaaagcttataattatatcattttttcgtgtcataacgtgtaccccgtctaggatctatttgtcatacacagcacattgaaaatatttaagggatacctttatcccatgccaagttgtatggccattccaaattgcagagatcaaaacatttaagagacgctcgatggaatggaaatctataaaaaaataacatgataaaaataattgaagactgaactttttttttctaaatttaacatttttttaaaaaaattgaaacccattctaaatagcaatgttttaatattttaggagtactgaaataatgaaaataactaaatatttaaataaaatataatagaaaatttgacccttttcagcattatgttggaaacaaaatctaatataactaaactacaacttgggagcgataaaagtctcattttctaatatattttctggttgagaaaaacatttactgctaaactgtagtttcatactgcaatactatatacatacaattaaatcaatatttcaacaaattcagctaatttaattagatgtagtcgtattaggcatatttttaatagaaaatatcttcaattaatatatcctaaaattcataaagacatatatattataaaaagaaaaattgttactcagagtttagaaagtacaaaattatgttatgctaaatattttaaaaaaagaaacgcattatgtacaaatgatatatagtttcatgtatattttttttataaaacctaaactgcattgttttaagtaattttagtttacaatttatacggtggcgatggttactagcattaagagaaacaccacacaaattattgaaaaattaaagatgtttacgatagactaatcataaatatttctaatcaaatttttaacacacttaaatatgatgcccgcgcatttgcgcgggctaccttcctagttcgtataaatggcctgaaatgtctacatttagagggcatatcttggagaacactcccacctttggggcaactaatgcatttggaggaacttactttgatcaatattgctgggatgcgtcaatttggacctgattttggtggtgttacgaagaagagtttcttacacttgaagaaaattgaacttgttggtttaccggaacttgtggagtgggttgggggagatcattgccatatgttttcaaagcttttaagcatcagatgtgaagattgtcctaatctcaccgtgctcctgctgccatcgtttgagtgctctatctctgacacaaaagacataaacaccatatggtttcccaacttgtgttctcttaagattcgaaattgccccaggttgtcactgcctcccctgcctcacacttccatgctaacctgtgttactgtgaaagaagatgatacagatttgatgtattttgatggaaaaagtctgaggttaaatcgctacggtagtgctttggccttccataacctgaacaaagtagaagatatggaaattgtagacatgccgctcgtttcatggactggtctccaaaagctgaactcccccagaagcatgcaatcgatgggtctgctctcaaacctctcatctctcactcatctagaactagtaaattgtgataacttaagagtcgatggttttgatcctctcaccacatgcaacctcaaggaaatggcagtttacaatagtaaaaaccatcacccctccatagcagcggatttgttctcagtggtggcaatgatggaagtaatacctgcaggttccttccagcagctggaacaactctcggtggacagcatctcagcagtgcttgttgcccccatttgcaacctcctggctagcaccctctgtaagatggaattcccgtatgacatgtggatggaaagcttcaccgaaacgcaggaggaggcgcttcagctcctcacctccctccaatgcctaggattctatgtgtgtccccgtctgcagtccctcccagaagggttacatcgcctttcttcacttcgtgaactaattatccataaatgtcctgaaatcagagcgcttcccaaggaagggttccccgcatcactgagatatgtatttgcatacgagggcatcagtgttgatctaaaggatcaactcaagaaactaaaagcatcaacgccaggtttacgtggtaaagcatgtcctctcctaattcctgtatttgtcccttattaaatctgtaaattttcatatttaactaatttttgcctgttttgctattaatgatttacctcatgtggagtagtggtttcatcgctaaccaacttagtaaattaatgcgagctacacaagattacatgaaggccagcaatctagaggtcagttcatggaaaaccaaggcagtccttcattttgtggtttctttctaagttcaggcagctgcttttagtttagtccatatggttgagctgttttctttatctgctatctgaatcaatgctatattagttagcttacattctatatatccttacatatttttttcatctcaaacagcatcacaacagtttgcacgcatgcagctgcgtaataaatctgaaacccgcccgccctgctatggtctgatgtcatcagatccaacagcatcaattaagccatggtggtcagtagcatcacttctgctcatatcgtttgtttttttttcttttctgtagtttctcctgaaactagtactccatccattctaaaatggcaaaatatatcaatatcaacgtagtactacgaatgtagacagccttcatcgtattaggtggtgtctaatctattattaggacactatattttgaaacggaggggatagcttttgtaatttctctcgatgtcctgaaatcagatcgctgctcaaggagcattcctctcttcattgagatatccaagggcaagaccgcaagaggatgcagcatcgtctacaggatcaactcaagaaaatagctaggagaattagacccacatttggtaaaagtgccagggtgatccaaagtgaaatttaggtaataaaaagtgacctaaagtgcaattcactcaataactttacaacgcactgcagaagctgatatgttctctgttatctttggtagcggtggaggcagcctaggaaaatctggctatactgagatgtttgtcatttaaaaagagaagtctatcttcaattaaaataacaccaaaatgcctttatgcattcatcaacgagccagggaagcatttcaaggtactagattcaacaattcctgtaggacaaatggtcattccactgttcatgggtattgagagtatagatagccatgtgggccgcccggcacagcccggcccaggcccggccgtgcctaggccgaggcttgtcaggccggcacggcccgaccgactcaccgggccagcccacgtgccgcactcacggcctaggcacggcccaacacgcctcgggctgtgccgggctggcccgaaggcacgatgggccatcgtacgtttcctcagaataagtctaactttcctccctcctattgggctgtgacatatatatagctaaaaaagtctattttacctccctcttatttgggctgtggtatataaatagctaaaacaaactcaacgcacccattggtgcgcggactaatgtatggcccgtcaccatcgtgagcttctctatatctcaatattttttttcatatttatttgaaattgcctgcgttagttcgtttgggttgggaacccatcttctccacatagaaaacataacggtccattagcacgtgattaattaagtattagcaaaaaaaaactttcaaaaatggatcaatatgattttttaagtaactttcgtatagaaactttttgcaaaaaacgcaccgtttagtagattgaaaagcgtgcacgcggaacacgagggagagaggttgggaacacagagtaaagaagtgcgttttttgcaaaaactttctatacaaaagttgctttaaaaatcaaattaatccattttaaaaaaattttctgctaatacttaattaatcacgcgctaatggaccgctccgtttcctgtgtggaggagatggttcccaactcgaaggagcgaacagagggttgggaaccactcccctttgcacgcaaaacggagtgatggattaacgcatgattaattaagtattagctataaaaaacttgaaaaatggattaatatgatttttgaaagcaacttttctatagaaacttttttccaaaaacacgcgccgtttagtagtttgaaaagcgtgcgcgcgaaaaacgagggtgatgcgttgggacataggggaaagaactaagacagggggtgtttagataattagatctaagggtgtaaagttttggcgtgtcacatcgggtattatacagggtgtcgcatggggtgtttgggcactaataaaaactaattacaaaatccgccagtaaaccgcgagacgaatttattaagcctaattaatccgtcattatcaaatgtttactgtagcaccacattgttaaatcatggagaaattaggcttaaaagattcgtctcacaaatttatcgcaatatgtgcaattagttatctttttagcctatatttaatacttcatgcagatatttaaatgttcgagttcgacttgacagggtgtaaaattttggggtgggatctaaacagggccttagttttatgccagtaaaatttgtaacaaaaaattcacacatttgaaatgatcccttcaatacttccctcatcacttacaattttaataatttttttaaagttatgctgaatacctaaaatagatattattgtatattggcttacaaatttatatctaaaggaaaaaatgtagcaagtgaagaaattcaaccacctttttcagtcctttgtcagttcaaaattaccttcagaacccaaccaggacgtacctatgtatttgactccaacctgtctgataactaaaaaaaaaatgtcctagactccatgatgtaaaatttgctaggttaaattagaccagattttattttaagaattgcatgtaacattttctttttttaaattattcttaccttaatttttcctatctaatatttaatctgcattaattttgcttgtaaaattttcttgatggctaacattagttttttgttcttttgcctgtcattctcctcttacatgcagcgcaggacttgcccgtccagtagggcacccaagacccagcacgcgcgcccaacgtcattcgtccggtcgtcgcacgtcctttgcagccgctaattttcctccctcctattgggctgtgacatatatatatatctaaaagtctattttacctccctcttcttgggctgtggtatataaatagctaaaataagtctatttaaggtccctattctttggacaattacatttatatgtctattttagtccctatactttatgtgccgggcctagcctgccggcccatcgtgccgggccggccggtcgggccagcgtgccggtggggaggcccagacacggcccggcagtcgggccatgccgtgccgtgcttgggccgggccaaaaagccgtgccatgggccgggccttcgggcctcgggccttatggccatctataattgagagcgattttttttttctgtggaaatctaccaatccagaagcttatccacaaatcatcaatttaacatgcatcatatatggttcggcaccattcagattcgccagtggaaactgattctatgtacgcctactaacttcaaaatcttcttattttcataggcaacctgtccagctgttttcgataacagaggtacatggcgatgtggttatgtttgtagctttcttgggagttctgaacaaaccatttgtaacacattagcaggtgattacatggcttgttttcccacagaaattacagttttgttgttaaggggcaatacccgaattcttggaggatcattgtttccatttcatttcgttcaaaagaaatttgtttccatttcatcatctggtagactggtatgttcatagtgttagttagcatgaaaggttcggatcatgtgatcacgacctgacagcttgcatgcatgtagttgttgaggttagtttggattaggttagtctatccatgcggatcaggttagcctttcctccacatgcgataacagatgtttgttagagtttgttttctgttttctgttactgcatgcagtcgtttcatcaatctcggcttcggttgttctcagctgcgccgaactctgtatcgccacgatgggggctgttcccatcacatatatattaacacgaaggcgacgcacaggattagtgcgatcgtttccacccaaactaattcacatggtatcagagcgttgatcaattccctaatagatcaatactcatggcctcgtcgtccagtacggctgccacaaatccgttccaaggccacccaatctcagagaagcttgggaaggcaaatcatgcgctctggagaaaattgacatttagccattgtcaaaacggggtttcgctggaatgccactcccaaaaatggtttcgttaaaatgccaccctcaaacaggggcaacttgttgcaatgccattccatccatttcttctcagtttaatgttttttgtaatgtttttcttgttgagatgaccaaaatacccttatcctatctcatctctcctctctgtcttcctcctctccgttcggctcggcggcgcagctagagacggagacggcggcagcgtggccggagacggggaaggcggcagcgcgcttggggatggggaaggcggcggtgcggacggggacggtggcgacgcggatggggacgggaaggcggcgacatggctggggatggggacggc

SEQ ID NO: 83107 - DNA, 3581 bp, Oryza sativa
cttcccacaactggcatgcgcccaaaccccaccgaaaacaggttttaggggttttgaaaggggaagagaggtgtatgtccaattccaccataaaccaacaattccatagtgtccaaatgatatgagaattcccaaagtctaaagttataaaatcacctaatgttgcctaattaaccagcgaagcatctacctaagttcatactagtggaaccataaatagagtacccactagttggggttttattttcctagggtgaacaaggtaataataacaatagcaataataatgtcttaacaacgataaataggcatggctaaataaaacagtgataacgcgggaatttaaataaagcggtaatgcaataatttaaatcaaaataattttataaactggggttcaatatgctcaaggatgatgtgacttgccttgctcgctttcccaaacaccggcttcaacttccacgaagagcggatcttccgaagctgcagcgtctacacgactaacgaaaaagaaaaggcttttactctactaaactccacataacagcagaaacaaagcacaaaaatgggttcttgacttcttaaggaaaaattagagacttgaacggtccaattccgagttcaaatggccaagttatggccatttgaagtttatatgctctttaaatggatatttgcgaatttcttcatttaaattttaattaaaaatcgggtttattgcgtcagccgagggagagggcgcgcggaccgggtccacgggagtggggcccacgcgtcagcctctcggtccacggtggaccgggagcacgcggctggcggcggccggcgccgtgggtcccacgcgtcagccgcacccgcgggcgcgggcggctgacggccgggcccacttggcagccgcgagggcgcgcccgaaggcagcctcgccggcacggccgacgggagggggacgcgcccgcgccccgatggtcaccgccggcgaccaccggcgcggcggagcggcacccgagagagaggagggaagggggaagcgaatggagcggtcttcggctcaccccggtcgacggcgacgacgggaacggcggccgaaacggaggaaggcggcggcgcggttcgggacgacgaggacgacggcgctccgacggtcggcgagcgaaacggaggagcggacggggtcgacgacgacgcggcgaagccgaaggaggcgacgccgagaggggaggaagtccggagcgacggcggcggcgaaccggaactcgtcggcgacggcggagagagaggaaagcggcgcgagcgcgattccgacggtgagagcgagcggcgaacggcggaaacggaggagagaggcacggggaacaattaaatagcgtcgggagagagggaaagcggccggaggagatggaaaccggcgcggagatctcggccgccattgattgcgccggcgaggatcgcgggcacaaaatcggacgaatccgagggagagagagaggggaaagtgggggaatcgggagagggaatcgcggggaatgattcccccctcattatggtgcgcggggacggcgggatgcggcggaatccgcggcggcggcggcgctagggcacgggcgagcggcgggagcggcgggaggaaggcgatgacaggtgggccccacccgtcagcgagggtggcgggcgggcccgcctgtcagcggcgcgcgcgcggggaggagccgatgggccgcgggggagaggagagagagggagggagagaattgggccgagccggcccaagaagggaagggggggaaagaagacttcttttagggtttttctttttataaaacctttttaactttgtttatttcttaataattattatttgtgctctgaaaattccactaaaatttgagggctccttttagaccaaggagaatttaacaaaaattctccgggccacatttgaatttttcttgtacgtattttagtgtttgccaatttctttccgaattttaattaattctattattccttttagaaaatgaattttaatttcgggatgaatttatcaggacgtgacaaatccaccccccttacaagaatctcgtccccgagattcgaggaggctagcaagaagataggttgggcggtcttctcttcttgtctgacttcttccgtcgcgtcttttataacaacttgcctagcaaaacttctctactctggactgcttggctcaatctcctgttgcagatggaatcttctcttcacctgacttgtccctggttgaacctttagctgacttcgactgggttgcggcacttgaagatggtgcttcagttccagaacttcgcatagttcatatttttggcgtcaacctcatagaagttacccatttcacgttatgcgtcgagatcagctcgtcattactaggataccatgcttgtcatcatgagcatatcatgcttgtcatttacttctaacctgccaccaactgcctcatattagctttcctagtctccgggtgataactacttctgctatttgatgcaagggtcgataactttgcctttgaattatgtttcccaagagaaccaacttatcccacttgacatactttgacgtcttcccaaatggctttactgctggatttgttgatgtctagtcattatcctgccaaatctgaggcgtccgctagctagatgcgattttaatctgacctctgtagattatcttcgaacatatcacttggttcataactgggaatagctctcacgaacaagcaactcggattcactttctttacatttggttcacttcccactattctcttcatgttgtcatcatttagcattcaacatattcctttgcaccttccgccttgatgtgttctttctcgatggatcgattggtaggaaagtgcgttgagcgatactagtgcaagtgctttcattctagtagcatctgatacaaagcccaaggttgaaccgagctttagattccactgttcaggttttacttattgacttcttggtcatgtcacaaaagtttccatccttgtccccatagaagtacttctacctgtggtcatctctcttactcgtgaattcacctattttaatgacagggcaactgttgtagggttgtttgctatcgggagtcttccttgagtgacacaaatcatggttctcgttatcctttatcaatcacctttcgacctacttcttttcccagtaaccaaacatcttttccgatctcttccattaatcacctttcgacctttctcaaccaggtactcttcactccgggtgttgaggatgcttctggggcaatgaggtgcttgggcgtgctgtctttcagagaaaccttgaagtagttcgtcaaaagctagactgacgattgttgcctttgatccgaagagacacatctgaaactcttagtccaaacaaatgcctctttggttgatcacttgattttcttcgccatcaatcgctaggctatttgattcctaacagattatgggtttacggaaatgagaccctaggtctccctaatcaacaacaaaatgtgcacaactcacagcacttgcactcttaacatggatccttcat

SEQ ID NO: 83108 - DNA, 12105 bp, Oryza sativa
  unsure (1)..(12105): unsure at all n locations
ggattaaaatacatgggagaaagctcattacgactggaaaaaaaaagcattgccctggaaatatgatggaagctgggctcacttagtgtgtcccagccgccactctgactccccacactgataatcatcttaagcttgtcgtctgccctgctctccacccttccccatcccaacattccttcgccctcctccctgccgcctaacatctctacccgatctcccgctgctcttaccttgctttgttcctagctgatggctcctgggtatgcatcgagcttaggatcctggatctgcacaacagcagcctcattctgcctcaccaccacacccatcgtgtaggagtccaacgtgttccttaattctgcagcaacagcagctactgcgacactggagacatgctctggaccaaggtgtggaaccagttttggccagtggatttcggttggaatttgttgctgacttttactgttttattttgattattggtctgcaattcgataatgttcactatttactctttcatgaattgattctgagtcctaaatcctcctgctatctaatcttcttgatgatatgcacttgatagtgcagtggcaaggagtgtgtggtttcaactttgaggtcccgtgttcaatccccaacacgctcacaatttcttaaaaaaaaaaaagtttggagggacgtctctccttccaaatctcatctaatcttcttgatttccacatgcttgttaatatccataatccaaatggtcagtatgccaggcatttgtatttcactggtaatggtaattatgggtaacacgaaattactcttgtatttcaatcacaatattatataaaatacacaactcccaagcaggccatatttgtcatgagttatagaaccagcatctgtatttttgacttttatgcttgccctgaacaagttttcatctgttcatataatatgtttataatctactgttttgctgcaaggtaatattgcgtgccgctgatttctttctaccctcttgttcaatgcaggcaagtagttcaaatattccattcacatatcacagaagcattttcgaagttagaactcagtacacctcaggcaaagaacaggtactcctaaacttgttgcactctctcccacagggagatggaaaaaaaactaaatttgattctccttgtgagctgtgggtgttctgtaacatttatatttgacccgttattcaatgattgatgaaactcagattgtgccgtgatgtccaacatattcttgtatgcattcggaagttgcctgctgagaacttcagtgcagaagctattccgaattatggtcttcttgatgatttcttggctgaaaagtttgggacaaaagttgatgaatgactgacctgtacattaggaactgactgtgtctgcaaatgttcagtactcatatggtacatgggaagtactccaagacatcgccgttattggcgtgaaatcctgtgcaggtaacaactggaaccaatctgttctgacttgttgccagtcttcatagatgtcaacatctaatccttttttttcaacggcatatgactatatactccctccgtttcataatgtaagactttctaacattatccacattaaatgaggcatgtaatattaagtttatttggtgctggcttcgtctccccagaagtcatgttaaataatgtatatcaaagttcatttgttctattccatgtttttgaaacccagatagagaaatagtggtattctgggagaaactaattctgtatgggatgtttcataaagggtagattttatacgaaacactgataaccaattttataatgcaggcattgctccccaggatacaagtacatagcacttaaatgacagcggagtacaatgtcaatactcccagtaatgccgtgtgaaaatcatagcaatgtttttgcccttttctgagctgaaattgttgccccatactttaaccatgccaggctgcatttcaattttttaattgttccatccctttttggggacccgatatttgttactagaagttcgtatagagggaactgagttttggcatcacgatctattcattgcagcatgcttcttgctgtgtaggtctggtgtattcaatatcctgtcgtgatggcagcccatgtattttgttcatgtaaggttttgtaattagtctgatgaatgagataataaggtatttttaaatgttagaataggaaaagattccagccatgcatggatatataacaggaaattgaagattactacatatgtccctttctaatgtgatctatgtatgtatgcatgttcttttgtgagtgatgtactgtaattggttaaattctttccttcccgaggtacaaaactagagagttttgttgtaaaccttaaattattatggtcttttttcgtaaacctttaattttggcaaataacctagaacgataataattttgaaaacggaggtaatacatgattagattactttactcgtcaatgagactcctgtcgcgcgagtgcgtgatgcacgcaccaggtcgctgggcgcaccactgcacacaggccacagccacacgcattcttgccatcctaggtgggtcgcgtatcagcttgtaatcatagctcttctctaaagcaaaagacacggaggcagaggcggtatgttgctacctccgttctctcccaataaatggctgaatcatttggtgatcatatttgagtgtacaaataaataaattaactattataaaattaaaaaataaatataaaacaccattttttatataaaaaaaatcacaccgtttaggatcaggaagcttgtctcattaatttgttggctatcattccttctatctaggagtatgtgagtacaattcactaatccactaaatgttatgaacaagttcccaacaaataaacacttgcacattcacaacataatgtaacacttattacaacaaaatgtttaggcaaatgtggcacaaaaataatcaaatcacttctcctggtttgtgaccttgatggtatcttgaccatgttcctccatattgcgctggagagaggccagagacgggggagggactcatggatggtgtttacatggattggagctcatgatcttagataccttatcaggatttacacgacacaagggaagaccaaggttcattggagcagctcctctcgttgagattcccgcagacattagtggggaggaccgaaaggttggcatgtgggatggacaacaaaagtaaacagataaggttgagtaaggttatcaatataccgattgtatcgtacgattttacgattctatatagataatgtatctatatggattttatgtatatgattatacgattgtgatcctacttggaactttcgatgccattggtgcctacagaggcatcaaagcgcttccttgagagctacatcaacacgctactgatggtaagacaacacccaaaggcggatgtaaacaccggcaagcaagttgttagctactacctcggggaagaattgcatcgacaagggaagaaggaaaaggaacccagcgggaagagatggagccgtccaagtctaggatggaccaatttgattgttgttggattctacgatgcatgtgatgatactggaggtttgctcttatgctcttgaagctgaacttatggcctgcaatgagggggtgaaaatggcactgcaatggacaatcctaccagtgataatagagaccgattgcctctctgtaactcaaatgttgcaagaaggcaaaatggacagatctggtcttgcttttgtgaccagggagacgaaggagctcctgtccggaaggtggaatttcacgatccagaagattcatagagatcaaaatagagttagtcatcaattagcaaatatcgctcgaaccaagaagaaattccaagatgtctaatttctggtcgggcgatgattgtaatctcattgaacagatgatccttcaggatcaatctgagattcatgattaatgaaatccctttttccccgcaaaaaaaaaagattatgactttaacaacattggttgggcttgagcatccaaaagtcaagatggtagccatatgatgaaaaggtgaaacggacggtggattgcacactccatgttgcccgatcgcgaagtactataataaagaaatatgtgctagctccaatgtgtagttcgatcataataaaatgtattacacaattaatttcatttttaggcaacacgtggcaccacaaaatatatgttgggcccgctcaattgatatgtgcatgctaaacatcaagcctttggaaaaaaaaacttaatatccggcccatataccaaagcccaaatgctattattctttgcacgactatacgatgtatattaaccctcattttataccctagacaggcagttattgttcccatctcctattttccatgccgccaccgccgccgccaccaccaccaccaccgctgttcgcctactcctctccaatggattcaggtacttcatctccataatatctaccacttgaactgtgaactaatcttggtagcccacatcctccctgcatcaatcgttgttacaccattcttattgattccttccatagatataagacgttttttgctagtcggatattactatgattgtctatgtcattatccctctctggatggcaccggactcttaggtttaattttaagtagttggttatgctcttattttggtctattcttatagtttagagttttttctagaccttcttactaggttatttcaatacaggcaggttagcatttgtcccaactgctatacttttggttgggtgcactatgtaaatatggcgaagatgtgtttttgatcttccattttctaaaaaggaaccactataagtatgatgaattccaatataatcacccggtgaaacttgatttgcggtatgtagaagaaaacaatgatatctccttttgttaaatactatattatagctatctttctatttcccttgcacggttgaaaaatgtaaatatgcttttttttcctaggaaataaggcaccacaacaaatttacacaaacgtcacctatcaggaagactcagataacaaaatgaatcaatatttaatctgttttatgtcgtagctaactcaaattttttattaatttgttcctgaaacatattatttatttttcagttatatcttttattttaacccatgtgtacaaccgaagcagtcgaactggattgaaaaatttgaaatgctatactactgtagcatattactatttttttaagaacagcttatatgaaatttcacatatgtacaacacattttggccatcctggctggctaaaacactggaacataccggatgttgccaacagcaaggcacatctggaatttagaggacgccattattttccccattaatgtaaatacatctgccaactttcgtgcactaatattaccctttttttcctcaaatatagtgagcccacagataaaatgcaaaaccatccacggttttacatgcaaaagtagcaattatttattgtgtaatctggatgatccttgttttgaatgtaacaatctcccttatcatcttagagtggcataaacagcattctttcatgtcataaatctgtacttcaagaaacgtgatcacaaacctggttggcaattaaccttgtgattaatatgtttcatcgaatgaaatctttcagattcagcatatcaccaacttttgatctttgtttggcctataaataccattggcaaacaggagtcccattgcatccaaaactattccaagcaaactcttccagttttctgtttttctcatcttctgcttcccctgtgtagagcacagtagaggttccatcaggtgattctttgctcttctctctttgtttttaattcatcgttgatgtaagagtaatcttgaaaattatttggtggactacggggaataattaatctcttttcattatattaatctgcagcttgctctcatggcgttccaaacccaaggatccaacctgagggcattgctcgttgaggacatcaaagtgaaccgcatgatcctgtcgcagatgctgcgcaaattccaagttgaaaccactgtggttcagaatggaaaagaagctgttgaactattccttggaggagaaacatttgatattgttttgactgacaatcttatgcccatcatgactggtcctgaggtataacttataacttactccaaaagaataatgtatttcctttcattcagttaacaaataaataatcaagtagttctgatactagttaaacacttctaattaatttaagaagttttaattcttgtgtcactgcttgacaggcaatatccaagatccgtgccatgggtgctactgatgtgatgattgttggagtctcagttgacgccaacagcatggaagagttcaaagatgctggtgctgatctatgtgtgcccaagctgaagcttgagattctagagcacatccttcaggagaccaggagcaagaagaacaagagcagcgcttaggtttcagaagaaaatcaagggactatctgtcatcatttagtgtcatggttgttatcttataagaatttaggtttcatggttgattaatgcctggtttggtgtgagttctgatccttttagttatggttgttgtcttgtcatcatcttttttagagtcatggtttgtcttaaaattttagattcatgtttgatttatgcatggtttggttgtaatcctctcggaacaagttaaagttatcaagaatttattattgatgctcagtttatggtgtcaacattccagcaatgctgtgtgaaaaatcatcaactgagagttttggcagcgcacgattttttttggcatatgttaaatgctgacaggcaggtgtattaattcaatacccttttgagatgcatgacagcccatgcattccattcctatatatggtgcatttatggatttatataaccaaaatttagagattattcataaaagaaaataaatttactgattttgtaggaccgggatggcgtctatccaacggggttgagtaatcgtggttactttttcaaaacaacgaagcaaacaaacagcggaaataaaaacaactaatattacagttattctaatattactaaataaacactaaagtaaccacccttatagcaaaaggcttagcacagtaaagaaaccatatgctacaatgccgaacagtgtagcgcaacagtgccgaacagttaaaacaacacgatgcatttaatcaaaaactttagaacttcgccaattcaaatatgtttggtgtgaaacttcaaacacaagttctagacataaactaggttcaattttaatcaataaacatgaaaagtaacagataaaatgttgattattttagagattaatgtttttttttaaacctaattttagagattaatgtaggcttttggggggcgattagcaccaaggctaggagataagagagaaggagactggagattttggggaatttctcacgatgcttctacatccatcccttgctctattccatctatatttatactatattttacattctagtccttgtacacatatataattacacccactaacactaactctcaagatagggcatatacattgtaaagacccatcttgctaaaaaaatgagaaagatttctcaggtaacccttttgtaagaatatcatcaactcgacttgttgagctcacatatggcatgcatattatccctccatccaacttctctttgataaagtgacaatcaatctctacatgcttagtccaatcatgttgcacgggattatttacaatgtctacagctgctttattgtcacaatataacatcaaaggatagctcaaaagagactactcgtacacttgctaatgccttcttgaagatttgtcattcttctagagagtgggcgttagatttgtgtattgggcaccattgtcgtcgaggttcttctctttgagggtctgggcacttagtgggtgggtccgtctgctctgtggacagaacctcagtcccaactttgcgtttccccactggtggagaaatgctttttagtcccggttcgtaacccccttgtagtcccggtttttcaaccgggactacgaatccgggactaaagatcgctatctttagtcccggttcaaataaccgggactaaaaatcaccaatcgggactaaagatgggagcatctttagtcccggttggtaacaccaaccgggactaaagatatttgttcttttttttctgcttttaatattgaatattgatttcacaccatcccctcccatatccaaatcatcacatattacagaacatctccaaatcctcaaacaaatcatctccaaatacatcacaaactcttaaaaaaattacatcacagggttctaaaaaattcatcacagattcacatctcacacaaaaatacatcacagattcacatctcaaaaaaaaaagaaaaaaaatccggccggcggccactgccgcctcccctcctcccctccacgccggccggccagcgccgagccagtcgccgccgagcggccgcccaccgcagccgccgcctccgcgcagcctcctatcacgcccagaaatttagcccaaatttccagactattttgtgtattaaatccctgtccaggaccagccagggtacacaaaccgacaagtaatatacagttccaaacgtaaataaagcgtaaaatacttacagaagaggcacttagtcctcacaccgaaacaaaagcagcagcagcggaaaaggcgatcctagcggggcttcagctccactccacaggcaaaactcaactggggtatgagccttggtcctttaactccatcttcagctcagaagcactacacttctgaaagggggaataatagcaaggctgagtacaaccaccgtactcagcaagccacaccaatgatgcagacgtgcaaggggatacaaggatggtttgtggctatttgcataaaggcggttgtaaaacattttattgagcaaaacagtaaaactgttgagtaattaaagtaactttaaatctccactgatcaacgctacaccacgttgaacaggcccaaccaacccacctgaactacagtgcattgagtcgatttattaaggtgggactaatcacggtgaatctggtcgaccgcccataaccgcgggcacggctattcgaatagttttactctgatcagaggcgtacaactgtacccacaagacacagccccacgacacgtttccgtgcgccgacatgccaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacactacaagcccagccgttgcccacgctggcttgtggtaagtacgataagttcttccagggcatcccgcgaaccggtccttaactgccatgggtgcgaccagcaaaaccatgcacccacagcccaccattcagttgcattttagttggataattacgaccatgaagcatggccagatgtctcgagcacgcagctcaatctgatactaaaaaggtctaatactgtaattatcccatcaactgagctagtggtaattaagcatggctaagcatatagttctagctaggtcacataagtaacatgagctagtcgattcattacccaaagttgacaaagaacagatatcaagtaaacatagcacaagcgaacagataggtaatacccggatcccatgtaattagcaaaatatgcatatttatttgcaaacagtaaaacatttgtaaattgggatcaacatgctcaaggggaatgtgtgacttgccttgcttcttcaaacaatcttccgaactcttttcctcgcgaccgcggacttccgaaacgacggattctacacgctggcacgcaaaacgaggaaaaactctaataaaaaccaagaaaaaagtacataaaaagtaaacaaacatgtagagctcaattttagatgaattttgcaagttgaacggctcaattcggagttcgaatgaattagatatgaattttacaagttttgagccatttaaatgaatttctagaattaaactcgatttattgcgcaattattatttatttttacaaaggaaatggacctcgctgacgtcatcaagggggaggggcggcgccggcaagcgggccccaccggtcagcggcacaagggcgccggtccaccgtggaccgggaccaccgaggcggtccaccgccggtccacgggaaccgacggcccggatcggcccaaagccgatcggacggccacgaggcggcgcggctggggcacgggcacggcatgaagccggctcggccgagacatgacgcggcggcggcaaggggaaggcggcaagggggaggcggcaaccggctgcagcagccggcgacgtggaacggcggcgggcggccggaggacagcggcgcgcacggggacggcgacgcaccccaagaggcggcggtcggcaagaaagggggacgggaaaaaaaagaagggaggagagatcctcaccggaagcggcggccgacgcggaggaagaggacggcgacgacgattgcccaatggcggcttgcgaggacggagggcggacggggtcgcccttgaccttcagaaggagaggagggagttagggaggggaggaccgatgcggggtgactggaaacgaaggccgatggcgatgacaagaggtagagctcaccggcgaccgaggaaggaggagctccggcggatttccggcgaagaggggcggcggccgaggtcctcctcgtccttgcggagctgagggaggcaacggcgcgagtcgacgtcgaccgaagcggcggcgcgacgcggctggagtcggcagcggcggcggagagaggtggttcgcgtggctacggcgctacggaggtggagaggggaaatggagcggtggccaagtttgcccgggcggcggcaaagctgncggtgtcggcggaccagtgcggcggcgaccctagcgacgggaaacgcgggccggagttcgccggagtgtgncggcgcgtgggagtggcgtgaggagagcaagggagggcgcggcggcttggggaaaattggggaaatgagagaggagaccacggggatcgtttttattggctcggggcggtgggatcatggccgcggaggacggaatcgaccggcaacggtcttcggagtgggctccggcgacgtgggcgaagtggggtggttcggcgccggttttggaggggggaaagtgggggaggagagtggaggaggtggggcgacgcggtcccgcggtcggggcgagcgcgcgggtgtagaagaagccggaatcggcggcgacgtggggagaccgtgccgacggtttcggctgagggagccggaggttagggatggccctgacaggtggggcccacctgtcggcggctcggggggaaggagagaggaggagacggttgggggagaagatgacaggtggggcctcgggtcccacctgtcggagagagagggagggagaggccggctggggagacaaagcagacttgagggagagagagagccgagcgggccgagggagaaggccggcccgagagggagagagggggggggggaattgggccgaaaggggcccaaagagaggagggaggattttatttgttttctttttattttaattggttaaatgatcttcgtgactttaaaactatttctcgagctccgaaaattcacggaaaattccggagagtacattagggcacaaagaatattacaaaatattcccggccaatgatttttaagggaaaattttaattctcccattatttcacttgattaaattgctttaacttttatttaatttccagaaaatgcattattaaatgatttttaatcccgaacgaa

SEQ ID NO: 83109 - DNA, 3534 bp, Oryza sativa
aaccgggactaaagatgatatttagtcccggttggtaacaacaaccgggactaaagatcttcctcttattaaccgggactaaaaatcatttttagtctcggtttttaatggaaccgggactattgtggatataggtcgaccgaccaaagatggtttctctaccagtgcccatttcttctgttcatcttcttgctggactctagtgcatctttgttggttgttttcttcccgtcacccgttttgctctttccttccttcctcctgagggtatcatccgcatgagcgcatctgtcaatgatctcgaacaacttgcgagcggaggtgacccgtcttgttgccaactcttgagttgtatagcgatctcggacgcctgatctgaacacgcgaataactgaaacatcggtgatttcagggatcatatttcggcatttattgaaccgccgtatatagtccctcaaagattcacctaggttctgagttaatgtgtggagctcgtccttgagcgtgtggcacttgtatgtcccttgaaaattggcgacgaactgctaccacaagtcttcccatgaagagattgagcggggcgggagatgcacaagccatgaacgagcagatcctttgagtgcggccggcaaatagtttgcgagtgcgttgtcatctgctcctaccgcatagagaaccgtagagtagacgcgtaggaattcctcttggtcagtgctcccattgtatttctctttggctcctggtcgaaacttttcgggccacctaacttctcgtaaagttggagtgaacgccatgcatccttcttcgggtatatggggtggtcggtgccctcgcggtgttcgagaaccgctagccgctgatgatgatgacaaagacgatgaggggtcactgggatttgggctttgacctctgggtcgacatccttgttctcgatccctctgtggatctggggagtgtgaatcccgtcgtcgtctatcggcttggcatcgtcgacctcgtccgttgtcgtcctgagctcgctgcccatggtggttttcgtcatggtggttttggcgatcttgtcagttttggtccccacttgggcgatgtcctcgacttccatcattgtttcgttgtcgatatggtgaacgtcgctgctgatgattagcgtcctcctgttttcgttgttcccccccgacgcccatttaggtggccgtgtaagtcacaattttctcgtggtggtgggctttgctgacgatgtcctcgtggagaggcattacgcggattgcggcctagatcgtgacttgggtgactggggatctccgtgggttcgtggttcccatcctcctgcacctcttccggttgtcctggaagtcgtgaagggccctgagctgctggtccagccgccgctgcgaaagcgctgttgaggttagccattgtagattgtattctttcaaccaaattattagcgtcaaggaacgtgattgggtcaaaaggtgtcacatctagaaatttggtctaaatttccagactattttgcgtattgaatccctgtccaagaataagctagggtacaaaaaatgacaagtaaatatacagatccaaataatacttataaataaaagaggcacacaatcctcacaccgaaaagaaagtagcagcagcagaaaaagaagatcctagcggggcttcagctccactccacaggcaaaactcaattggggtataaaccttggtcctctaacctcatctccggcttagaagcactatacttttcacatacttctgaaaagggggaataatagcaaggctaagtagaggaattagtccggtgtgtccccgggcgtcggctcttgtgccgcaacgagcggttctaaggttagtgtcatccatccgccaagaactgcttaatttgtgacgatatgttctcacttgattgcttacttaggccacagaagttggcggaagagcaccgtctcatcgaagtcggtactcaggaggtgctgtctgagctcgcccttatgagttcaatctccacgtcgtcagatgggcgggaggctcaactcgagagtgaactcaatgagacgtgtgaggaccttcaaaagatgaggaacctcgttgccggacacgaccaacaacgatagggcacctagagtcaatccgggatggcttgaggcaaaattatacatgacttgaccagctggcgcggaacctaggggtaaacgtgaaggtcccaccacacttcgacgatacgacgctggtttcctcgctcatggatcttatcaagggactggaaacagtccatggtaagcatgcggaccacgtaaccgaggaaatctgcaccggcttgcgcaccggtcccagccatgtcctcacttgcgtccggcacatgcaccacgagatcgacctcatggaggtccttgaaaagggtggggccgacccgacgcgcgaggacgtgttgtcgggggtggcggacttaggggaaagcatgatccccttctttgaggagtaatatttttaaactcgatggtttgtattaacttaaatgtaatactttgggcccgctttgtccttaggtagaacaatttcgcatagaggtttttgtattctatagaggtattgttgacgaggatgtccagcatggaggaggtcctgatgttctcgatgtcgagcctgtttctcccgtgactttgtccgcctcgaatgtcaacgaacgcgctctagtggcggtggacccgacaatgtgctcgtcccatctggttagcacttaagctcactcattcggcgtactctaggttgggtcatcagcctctgaatctcagtcttcatagataaccacgaagttggatttgctaaagttgttcccttttgtaggcctcgaggatgcacttgaagagagaaagtgccgtgccacatattggaagacgaaatttgaggtggccaagcttgagctttccatcgagatcgccaaaaaggatcaagacgttgagacgctctgaggacgcaagatctggctgtagaactcgtatctcaacagccattgcgacgccatggcggatgtttgcagggatctacgagtagcgcgtcctcctttggaagaatctgtaaaatcaaaggtgtttttgattattattctgtgatgaacaattgggcattggagattattggttttgttatttggaatttattcacgaagtggttttggagatgattggatttacaggtgatcgcaggatttgtcattttatatgaccggtcagaccgggctctggtagccggttagaccggcgtgtaacgcgcggtcagaccggcgcagcctgcggtctgaccggccgacactgtgtcggtttcggtttcgggttgtttatttggatatccgagtttatttcatgattatgacttctagatggatactatacgtatgtaatactattgtttgctgctaataagtcaagttggagatagcttggtctcggaatatggtttctttgtttgttccatgtgtaggtgactcgatgtctcgggagagtatttgcggtgatggaccgggagtcg

SEQ ID NO: 83110 - DNA, 1510 bp, Oryza sativa
aatggcatgaagccagtcgtgggcctcgattgggttggtggtgcttgagaaggtgggcggcttgacacgaagaaattctaacaatttggactgaggaggcggaggaccaaattgcaggttctgctgctgcggctgtgcttgctgctgcacctgctgcaacacctgatggtactgttgctgcatctgttgcatcatcattgtcatcatctgagtctgattgttcaacacctgagcaattgttgggttctcgggcggtggggacggactgttgtcagatgcaccgttggcacgtgctccattgatcggctcttcgctgccactggcgttgttggagtcgcgtgaaccattccttatctccatctgaggggataggtggaaatatgagaaaaggaagaaaaacagggggctcagaaactaatcttgcttatgaatttaagtgcaattatcttaatcttgattaaaacactgaaaaagaggcacgcaactcctaattgaggcagtcataccactgacacatgatatcgaccgccgactaacccacaagcaacaaacctaaacacgaaaactagcaagcaaacagactaagaaggcgataaagctaagggcggcgactctgaagctcgaggcggcgcttgcaaacgagggataggactgacatctaaagtagacaagggataggaaccaactcatgctcaaatccaaattaaacaaagcaaaagaagactcaaataaataaccgagcatgatgatttttatgcatagaatatttttcatgaactcaaataaagacactaatgcaactaaacaataaattaatgcatagactagttgcatggaaaatgatgcgcataacattgcccccaccgaatatagacacgacctaatgcataacccccaataaattcccgactgactgtcgaataaactccaactaaaatttttctaaagccctaggctgagctcatttttttttttaaaaaaaaaaaaaaaatccgatccgaatgaacgaccaagatttttcccgcaaaccaaagaggcaaaactccaaattttcccaaaacaaattccaagtgcaaaaaggcatatgcagatgaaaaaggggttcagagggctcttaggtttccagttggcttgtcctacggtcaaggtcggctctgataccaacttgtcacgcccagaaattctcgaaccagaatttctaagctgaatgtgcattaaatccctgtccaggaccagccagggtacacaaacgacaattgttgacatacagatccacgtcttataaaaaaaatagaaaagattacaaatgcagcggaaaagataaaagcgagctaaaccgggaagcttgacttcagcagcgggtgtctccactccacaggcaaaccttgacggcagcgacgaaaccaacttcgataaaacagctccaactaggaagatcttcagctctggtgtgggggaaaagagagcaagactgagtactacccactgtactcagcaagtcataccggaa

SEQ ID NO: 83111 - DNA, 793 bp, Oryza sativa
cattggtaaaagattgccatcatcgagtttggtcattacataaagatgctctaattttctaattgtgttagctacaacgatccatagaaacattatcattgatatgggtacgcttgaaaaatgtcaattgtcattggattatttttttacccgttgcaatgcacggggcatttttactagtatataataaaagaacgaaaatatgtctcaccacatcccgttcatgctttctttcctcgtgatctcatttttttctttatctttatctttacatacatatttaaaatatttgtagtgtttctattattcgtcactgtctagcgtacatcgacggttttcgtgtttctgcattggcgccctagcagcacgtgcgagcttgattgcttccaaaccaaaattcaccgcttccacgtcgacggtcaatcatcccatgtgtcagaatccaataggctccacacgcatcacatccgatttgccttcccatgccaagcaattttgtgaatctaccatttaaacgatgtcaaaggatcgccaactcgtgaattaggaaataacaaagtcactaatataacaaatatacaatagtaacaagcctcataatccatatgacaagtggacccataataattagaaaatctaaattaataattaattaaagtaggtccattatgcacccgtggattttatatatatatatatatatatatatatatatatatatatatatatatatatatatatatatatatatatatatatatatatatatatatatatatacacacacacatgg

SEQ ID NO: 83112 - DNA, 2133 bp, Oryza sativa
tatctttagtcccggttgttctcaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattaatgacaattacttcgaaaaattatttttggctgtaataaattaagtggataaatcgtaataagcaaatataattaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgattttaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgtgaactagagccaagtgctcctcgatgtaaggagctaccaatgaagagtgttgcagaacagtgaaatgggctttacggaataaattgttgtctaccgtcgttattgctttccttccgagagttccctttccccgtagtctcccttcatggcgtgattcaggtaccccgattgggcgaaagtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttct

SEQ ID NO: 83113 - DNA, 1326 bp, Oryza sativa
  unsure (1)..(1326): unsure at all n locations
tggtgccanattgaanacatgttgcaangccncctttgtatggacnnnnnnnnnnnnnnnnnnnnnnnnnnnnnnnnnnnnnnnnnnnnnnnnnnnnnnnnnnnnnnnncaattattattaagagtattttaaatcgtatataagtgtgccacatcatcacccactagtaattattatctagagtattttaaatatcatgcaaacataacatatcattcataattttattggatttttagagctcaatatgtaaataatgtcaaatcattatcttacattatttaaacatatacatctaccatttctataatatataacatgcattcattcacatatcccgtagcaaagagcagagtatcaactagttattagacattagtatgccctaagctcttaacaagttagcatagctttggtccatgtggcataggtcgttgctttaactcagtatccgaataagtattccagtcgaatagtatttgcatctgtcttagtacgtattcgctgccgatgatatttgtgtttgtatttatacccgatactatccgtatccgtcctaattttaattacggttagaatatgggaagggtaaaatccaacccaacccaatttctcccgtcatcacgagggctgaatcctcaccctcgcgacacgactatggcgattactacggaaacagtttcgacaaaaggctatgtggcccacctctatccaggtgtgtgcgcgtggaaaatgaccatttttgtgtatggggcacttagccgagtggggaaatagattattcccgacagaccgcttaagatatctgattgcgataataaagtttgcaggcttctacgttaagcggtccacctaggatgatgtttttcccatgcggccatgccaaattagggcctcctgagaagatgcttcttagatatatatatttctcagctatttttaatcaaaatatttttttaactgaaatttcccagttttatattggcacaattctgtagtattactatagactctagtacttgtcaatatataaatattgaatatgtacaagacatataaatattgttttgtgaacttgattacaaattatcattctcagaccgcgtaatagtaaagtttcattacatgtgttttctttcccactatataaacagaagataaactttttactcatacgtgcacaaatttatatcagtttgtcctaagtttattcaatttatgatatatatcgagttcttttaattaatgtttttaataannnnnnnnnnnnnnnnnnnnnnnnnnnnnnnnnnnnnnnnnnnnngtgttcaattcatggggggggc

SEQ ID NO: 83114 - DNA, 7421 bp, Oryza sativa
attcctgcagcccaatcttcgtttcttccctaataaaacctggccactgtttctttgttggtcctgtgagaaaagaaaaacaacagtaacacaatactcttaataccttttggaatataaattcaaccttctcactctaacctttcaatttttatgctattgtcacagaaaacatgctagctcacagtacggagaccaataagaaaggccaagaatattcaactcttcttgatcctaagtttgccccggtgctactatttgttgattacaacttagatgatacacacgatgaggtcaactccgaggatgaagactactccatagaagatgaagatgaagagttagatcacgaggatgataattcatttgacgaggatattagtgacaacgataaggatgatgataaacttggagaggcggcaaatgacatttgtaaaggagattataatgaaaacaatgaggatgctgggacagaggaaagtgacgacaccgatgaccaagaggaagatgtcaccatattcttctacagtatagccagaaaagaactattatgcaaaagaggtgatatattcaattgccactcatactggagaacaccacagggctggttgcttatggtacaccttgaatcacatgaaacattcttatggagtcctttcacagatcaaaggatcaatctacccttggatgaagatagtttccttacaaataatgaggtcgtttgtttgctatcacataaacccacttatccaaattgtgttgtgctagtggtaaattgtaggaacacatcattttggtattgctatcctcaagggcacacatggttcaagcatgagtaccagtcaagtatgatcactactcatgaaaaccgtagaaacgtcattctaacaatgaaagatctcactgcagttggagggaggttttgcacatatttaagtaaggagaaggcaattgtgacacttgagttcttgccaaatccaacatttacaactacgccagttaaggatgcatcagatccaatttattggtacaccacttttactaattgcttgttagaatcttgtggagagttgttcatgttatcatttaaacatccagtggtatgtgctcagaaggttgtgcagattgaagttcataaactcgatttatctagaagaatttgggtgaaagttaacacaattggtaacaaggcatttttggttgagtgtattggctttggatcatcgctcactgcagaagatgttggattgaagagaaactgcatttattttgtgagacctaatgataagggtttgtatgtttatgacatggaacgaggaactactgtaatgcataatccaggggcagacctaccggataacatgacacttcagatcgtggtgcctccattttgaatcgttcacgctggacatatgtttccccttgttttgtttaataatgttctaatgatacatcttgaatgttggttgtttaaattattgaatatacatttccctttgttattttttcttttattataaattataagagaatatatttttttcttttattataaattataagagaataataagtgatagaaaagtactccctttttaacagatgacattgttaactgtttaattgtgtttgacaattcgtcttattaaaaaaaagtaagtgtcatctttttttaaacttttttcattattattgaagaaactaaacgtgatctacatttttacatatttacactaaatttttaaataagatggctgattaaatgttatgctaaacattaacgggttcatctgataataacggaggtagtattagattggacaacgtgtataacttttttacaattaattttgagctttggaactattaataacaaaacttttcttttaaaacaaagtgaggtgcaaagtattatgtatatgaaataaggtgataacgactggttaagaataatcctcgtttcatttccgtgttacataatgaaatcgtgggaaatcgtgcaaatgtctagcttgagccgagtgtccatgttttcaaataatctggcacagccatagtgctctttgatctccatatactacatgactgtcacgagtacaacagcgattttcccgtgcggctggaatcggtttttgcgggcggatctttcacccatctggaatgaggtgtctgcgaagatcccgattttcgcatgcgagtgacgcatacgcacgggaaaaaaaataaaaaaaaaaaaagcaaaaacgccatcaccaccgtcgtcgtcgccgccgccttgcccgaagcccgccgccgtcaccaccgttgtcgtcgtcgttgccgccttgcctgaaacctgccgccgtcgtccccgcggcggcaggcgacggatccggcctccccgcggtggtcggcgacggatcagctcccctgcatcgatcgacgtcttcggcagcatggaggcgcggtacctggcgccagatagggggagctggagatcgatcgaggaagcatagaagcaacacggaagcagatcctctgacttaactgcacatgcagttgagtcactgacatgtgggtctcacttttctatgggccacatgtcaggcagttgagtcataagagccatttctaagcaacacgtagtatcaccatcgctgacgctcgctgctgcatgcttggtccgtgggggtaaggtacgacaggatgccggagttgtggtgcattctttcacctcctttgcttgtcgcgctcaaggttatcagtgtaccggtttgtactctagtatcttattataatattacgatcctatcaaatcaaaacgataccgatctcatctaatatcttaatttttatagtatcatgatcttactattcatttttatatgatcctacgaaatattagtatcctgattctacgatcgctacgatcccgaaatattcacaagtcgatgtaaaggtttgtgtgggtttagtgtttgaccttggcccttacaatgtgtgtaaacaatatactcctattaccatttaaggttgaacatggaatatatctttttctttttcagaattacatggaatgtatctgaatttactgtgtggacatacccttgccatgtttctcaagtcaatgtatgaatatgcccttgcaagtactgtatttttttttcatatttttactttttaaatataaattgtaaaaaacatgccttccacgtgcattattacgagtctttatatatgtatatatatagtctgaatctgttgggtgtgcctaaacttcatgcaacacattttttagccaaaaaccatcggatttcagcctatgagattaaaaccctatatgattaagacaagaaccacatggagtagtaaaatattaattattaataagttgtggcataacttaatttagtcaaaatacaaaaaaaaatccattttagagaactaacaaacacaaaatttacattcaaatatagaaaaattacatatgtaagtgcagtgtaattatactacatgtataatgtaactacactgtaaacaccaggtacatactgtaaaatctgtaattccatccgtgcgaaactgtatacagcccgcggaccgcggcagacgccagacgcaaacatgcaagtgtgaaacatgaagtgtaaaagtgtaaacacagcaagcagcaagcagcgagcagcggtggtatgagcacaggcaacggatttaactggacacgaatcttatagcgaatccaatggccataaaactgactgctatatatggagccataaatctggcgacaaaaatatagtaaaactgtttgtcttatttaatagcaaattagtgctgtgcgttacaacgggaatactcaaattttatgagatgattaacttcactttaagaaaagagtaaatttcataaaactacagatatcatgatcaaactatcgtaaaactacatatttaactcgatgtattacaaaactagacatttaaaatagggtgtcacaaaactacatagttagtaacaaaattatcataaaacgatttagaacaaatttagtcacaaaactaacaatagtgctagagatttaaactttaaaatatgtaattttgtgataactttagtattaaacatatagttttatgatacttaaccttaaatctgtaattttgtgataaatttagtgctaaatctgtagttttgtaatataatgtcttaaatatatagttttatgatattatgatcaaaatacccttagttttgtaaaatttactcttagggaaaaaaaaatctgcagttacaactcataacttacaaagaaatcaatccaaacgtaggtgtcggatctacctttcatgacataacagtaaagcaaggaaagaaaattactataaccgcttcaattcaaagtaggatgctctgcaaaaaatatttcgtggtggatgggactgcatcatcaaaagtcatgaaaaaaaatcatgaagctaactcaacaactagattagctcaaatcccatgataaaatgcttaaaatgaattaaaaatatgcaactcaatgagctcaaatataaggtacataggtcaaaaatcaaatgaaaaagggataggttcttaatcttataacatgaacaattagatagttgaataggtttatttcgataattcttttagaaaaaaaaaggtaatatgattgattagctactcctcctatgtttttttttattttcttcatactttaccggaccgggatgccacattagtgaaaccaacttcatactaccaggagatctaatttaaactagttttctaagttttttttttctggggggggtttcaagatttttggtgttgtagttcagggatacaatttaaacccgacagaaagataagggatgtaaagtggacatattcgtaacaaaaaaacaaaacaaagcaaattttacccaataggcccaatcagctcaactaaaaccaacactaagggttccacccacaccatctacgccgctgcctcagctccgcatcacgcaccactgcctatccccgctccacattgcgcgacatttcattttctcctttgttctgtgtagtgccgtcgtgccccaccgcctcctcttgcgcgattccgccccgccccccctcctcctccatcatgatatcgtctcctcactggccatccctgtccttgtccttgccctaccagggctccgacgctcattgtcgctgcctccacaagtacctctacatctagtggtgatggcaacggaggaagggagccagggtttcagcggctggtagctgatgatgtgatgacgatgatgcatctcatgtggcttgaggtataacaaagattttttttaaggaatttttggatttgcattttagcttcggttcttgtcttttccttgtggtgttatgcattcgatttggttgtatggaagctatgaaacatttattttggaaagtgcttatgtaagattgggttcttatgaggattctgttgttatgattttttccctttatccgattctgatgatacgaaggaactaccaggattaggggcgacgggtgcaacacgtgcgacgggtgaaggcgcattgtgatggacgaaagcgtattagtacgattggaaaattatgaattttaagggatgtaaagtggacctatttgtaacaaaaaaaaaacaaaacaaagcagctctggcagcccaactaaaactaaccctaagggttccacccactacatctatgccgacgcatctcccccactccacacggcgcaacactttctcctctgttccgtgtagcgccgccgacccaccttgatccactgcctcctcttgcacggttccgtcccgcccctacgccctccaccacctcctccccctcctcctcctccatcctgatatcgtctcctcgccagtcatctctatgcttgcctatgccctaccaggggtccgatgatcgttgtcgctgcctccacaagtacctctacatctagtggtgatgggagcagaggaagggtgatgagaacaggggttcagtggctggtagatgatgtgacgtcgatgatgcctctcatgtggatggaggtataacaaagattgggttttcttagggaacttttggttagctttttagctttggttcttgtttttcccttgtggtgttatgtatccgatttggttggataaaagctgtaaaacacctattttggaaagtgcttttttaagattggattcttatgagcattctgttgttatgatttttccctttctctgattctgatgacgcaaaggaacgaccggtattagggggcgacgggcgcaacatgcatgacgggtgaagccgcaccatgacggatcgaagcgtattagtacgatcagaaaattatggattctttagtagatatagatgtgataatcatgaaaataagggtatgtttagcacagctcgagctcttgaaattctaccaaacagtttcagttccatctaaaatgagagtggaactgggggagcgctatcacaaaacgaactagagaggtggttttgggtttaggctgctccataactatactccagacctagggactgtttggtaaagctctaactcctaaatttatctccaggagttgagtctggagtggagttgttgagctatctaaacccaactctacctctctagtttattttgtgagagcgctttactcagctccactccttttttttaaactaaaccagcaggagaactgtcaattatattttcaataagcaggagtaaaaccctagatgggttacaagaaaagaaaaaaaaaacaaccaccggctggctgaataactacacagcacatgccataactcactaacaactgaaaccactaacggagcccaacttagggtatagttaccaagcttgaccgaaaagacataggggttctgactttgcaaccgtgtcattgttgccgagcttgctgccaagcgacagagtagcaccgacttcaaaccagatgcatcatccaaaccaagctcgctgccaaaatgatcaagtggcttcgactttccacgatgaacttcagccaaagccgcgtaagcgccacatcctattcacagccaacaacaacacccctagaaagagaatgtagcatgtcatcgttgcccagctttgtcaccccgacgaaccagctctgactccacctagcaaaatcaaacaaagagcgaaggtcgcccaccgcaaaacaaaaggtgggaccagaaagcgaaggcctcgtcaaaacctaggatttaaaagcttcgaagccaatgcatagaccatcaacgatatccttgcacgaagaagtctctacaaagcgatgcccccaagctggacatgacatagattgccgccacggctcgtcggaagctggagtaaggttttcacccagagagcggtaaggacagtggggctgcaggaat

SEQ ID NO: 83115 - DNA, 1103 bp, Oryza sativa
  unsure (1)..(1103): unsure at all n locations
tgatcagattgaaaccttttgcagccncctgtatgacnnnnnnnnnnnnnnnnnnnnnnnnnnnnnnnnnnnnnnnnnnnnnnnnnnnnnnnnnnnnnnncttaaaatagttgtgttcttgaggccagttgagacgaacagaggatacagaaacaatctgggtcaaacacaagactgctatttttttttatttgtaggaattctacagcagaatggtttgaagttgaatcctaagataaaaccgacctccccagatgtaaccagtgttaccgggacacgcgagtccaaaaaaattttccatgtcgacacgcatccccgtgtcagctcgtgtctgacacggttcgacacgcatcagacactactagcggtgtctctctcagctgccataggcgagcagtgccggtggttgtctggcagacctgtgggagaggatgggaaaaagaaggcagaagagagagagagaatgggatgggagagctcgatgggaaaagtagctgcgtgcgtgcatctacaatgcacaggcatactagtagtactccagagacaactagtagtactcatgagtagtattggtagtggcatgtggatggcaggatagcagtgggtttttttgtgcacaactgcacaagggatcctctacacatgaaattcacttattttggctgtcagtctttgtcctaactaataagaagataggatcttctgtgcagaataatgtgtgacaccatatgttttagtgttttactgactaagagtatgttttatttgatgatatatataatattttcactaaaaatcatatttatggagcgagtccccgaatcctattttttcttagcttgccgagtcggactccgacacccgtgtcagtgtcccggtaacactggataagtaattagcataatctatttgcagtaacctagtcgaatttatgaattgcttgtgaactactacatgagtataatataaaaattagtagagcgaatgaaatatgaccatgtatgtgcctataatcgccatggtgattaaggaataataaaacattcaagccatccatgggcgatagtctactacagttgtacacagccgcatcagtaatcaaa

SEQ ID NO: 83116 - DNA, 27222 bp, Oryza sativa
  unsure (1)..(27222): unsure at all n locations
catctccatcctcctcgacgacctcctcctcgagtgcctcgccggcgtcccttatgcctccctcccgcaactccccaccacttcaccacgcttgtcgcctccgtcggcgcgcacggcgagctccgctcctctctcctcgccctttccgtcacgcccacggcgagccgacgaatgttggcgtggtggtggtgatgaggacgaggagccggcggccaccgactcgcagctacgccccgtcgccgccgctacgctccaccgccggcgactggatggggatcccctttcttctttcccctgcaaagtcaacaaaatgactaggggcaaatatgccagagaatgatggaaaacatttggaaatcagttaaaatggttgaaatggcattatagtaagttggcttcatttgacaatggtattataacgaagccatattcggaagtggcattccagcgaaaccccatcctgaagatggctaaatgtcaattttctctgcgctctggaaggtgcaagtaagcgccgcagtcagaggagcgcggcttcaggggcatctcaccggcgcaaccaagcggccgccggcagagatcgctgtcacaaaagatggcgccaccaagaaggagccgaacccagcccatgaagactgggaagccaccgaccagcaagttctggggtaccttctctcgtcgctgacaagagaggtgctgatgcaggtcgctacaggcgacaccgcggctgaagtgtggagcgccatcgagcagatgtactccgcccacacacgagcaagagcgattaacactcggtttgctctcaccaatacaaagaaaggtaacatgtcaactcctgagtattttgcaaaaatgaaatccttaggagatgagatggctactgccggaggtcgcccgatcgatgaagaggagctgattcagtatatcatcaccggccttggcgagggctacagcgaggtggtgtcggctgtctgcgctcgggttgaaccaatctctgtgagtgatctgtactctcaagtgttgaactttgaagctcgccaagccatctaccgcggcgcacaggaggtcaccgtcaatgttgccaaccgtggaggcttcagccacggggggcgtggcaacagcaatggtggccaaggaggttcgcgcggcggcggcgacggcggcggccatggtcgcggcaacggagaaggtggccgtggtcgaggccgcacaccaggaggcgttgataaaagaccaatctgccaagtgtgtttcaaacgggggcacacggcagcagattgttggtataggtacgacgaggattacgttcctgacgccaagcatgttgcagctgcagcggttaactcctatggagttgacacaaattggtacatcgacactggtgctacagatcatgtcacgggagagctggacaagctcactatgaaggaaaaatacaacggtggtgaacaaatccacacagcaagtggtgcaggtatggatattagtcatattggtcatgctattgttcataatcccaatagtcgtaatatccaccttagaaatgttttatatgtgcctcaagctaagaaaaatcttgtttcagtacatcgcttagttaatgataactctgcctttcttgaattacatcgtgattatttctttcttaaggatcaaatcaccaggaaaactctccttaagggaagatcatggcgcaggctatatcctctaccacactcctccttgaagcaagcctacagtgccatcaaactatctttggaccggtggcatcatcgtcttggtcatccttccattaccacggttaaacaagtagtcaataagtttagcctcccctgttcagatttgtctagtgagtcagtttgtaatgcttgtcaacaagcaaagagtcatcaattaccttttcctatttcttccagtgtttccaaacaccccttagaacttgtcttttctgatgtttggggacctgctccagagtctgttgggagaaaaaaatattatgttagttttattgatgattttagtaaatttacttggatttatctcatacagcataagtctcaagtgtttgacaagtttcaggagtttcaagtcatggtagaacgtcaatttgatagaaaaattctagccatgcaaactgactggggaggcgaatatcaatcccttaactcttttttttctaagattggcattgttcatcatgtttcctgtcctcatactcaccaacagaatgggtcggctgagagaaaacatcgtcatatagttgagatcggtttatctctcctatctcatgcatccatgccattaaagttttgggatgaagcctttcaggcggcaacttatcttattaaccgtgtgcctagcagagttatccataatattagtccccttgaaaaactgttcaaacaaaaacccgattactcctccttgagaatttttggttgtgcctgttggcctaatcttcgcccctacaataaccacaaattacaatttcgctctaagcgttgtgtttttcttgggtttagcactatgcataaagggttcaagtgtcttgaggtctctacaggacgcatctatatttctcgcgatgttgtctttgatgagaatatttgtcccttcactgaacttcatgccaatgctggtgcccgtcttcgttctgagattgatattctcactcctgaactgctaggacccatacggtctgttgggaatgaacaatgcatgcatccagtgactaatccattatctgctgatgtttctgctgctttatctaatcgtgctaatgagccacatagagatggtgcagtacatcccgctgatgcagaagatccgccggcgacgcctcctctggatgccagttctggtccagaaccagaccgtgtcgtccaccactcccctgcggccacgtcatcaggccgtcatccgggtcccacacctggttctgtgccacggggggcagcatcatcgctagcagaggagacagcagaagactcagtgtcgcaggcggtgcaggagcaggagtcgcaggtggtgcaggagcaggagcagtcctcaccagcgcaggaacatgcacaggctgtcacagatgagactaatacattacagcatgcagatgtgactgacacaggttcagaggcaccggcaggaccgcgcaccaggttgcaaagtggagttcacaaagaaaaggtatatactgatggtactattaaatataagcattcttggtttactgcttcaggtgaacctacaaatgatttagaagccttaaaggataaaaattggaaactagcaatggattcagcgtatgatgctttagttaagaataaaacttggcatcttgttcctcctcagagagggagaaatattattggctgtaagtgggtgtataaaattaaaaggaaagctgatggtaccctagataggtataaggcaaggttagtagcaaaaggatttaaacagaggtatggtattgattatgaagatacctttagccctgttgttaaagctgccactatcagaataatattgtctttagcagtgtctaaaggttggagtcttagacagctagatgttcaaaatgcctttctgcatgggtacctagaagaagtttatatgctacagccaccaggttttgaggatcctactaagccacatcatgtgtgtaaacttgataaagctctgtatgagttaaaacaggcacctagagcctggttctctagactaagtaaaaagttgatggaccttggttttaaaggatcaaaagctgatacgtctctgttctttctgaataaaggtgatataactatgtttgttctggtatatgttgatgatatcattgtagccggctcttcagaaagggccactgcagctttacttcaggatctaaaaggggaatttgcactcaaagatcttggtgagccgcccccccaaaaatttttttttaaaaaattttttttttttttttttttccccccttcccggnaaataagaggtaagcaaggttcagaatggcattgtactgaatcaagacaagtatgccaatgatttattgaagaaagtgggcatgatagattgtaaacctgctaatacacctctttcagtaagtgagaaactctctcttcatgaaggctcattgttagggcctgaagatgcaagtcactatcgcagtgttgttggtgctttgcaatatttgactcttactagacctgacatagctttctctgttaataaagtttgccaattcttgcatgctcccacaactgtacattggattgctgtgaaaaggattcttaggtacttaaagcaatgcactcggttaggacttgaaattcataagtcaggatctactttagttagtggcttctctgatgcagactgggcaggctgtttagatgacagaagatcaacaggaggatttgcaatatttctgggttcaaatctggtctcctggaatgctagaaaacaagccactgtgtctagatctagcacagagtcagaatacaaagctattgccaatgccactgcagaaataatgtgggtgcagactttacttgcagagttagagattaaaagtccaaaagctgctaaaatatggtgtgataatcttggagctaagtatttgtcagctaatccagtgtttcatgccagaacgaaacacatagaagttgactatcactttgtcagagaacgggtaagtcagaaacttctagaaattgattttgtttccactaatgatcaagttgcagatggattcactaaacctctgtcagtaagactcctggagaatttcaaaagcaatctgaacctggttaggtccggattgagagagggtgttagttagcatgaaaggttcggatcatgtgatcacgacctgacagcttgcatgcatgtagttgttgaggttagtttggattaggttagtctatccatgcggatcaggttagcctttcctccacatgcgataacagatgtttgttagagtttgttttctgttttctgttactgcatgcagtcgtttcatcaatctcggcttcggttgttctcagctgcgccgaactctgtatcgccacgatgggggctgttcccatcacatatatattaacacgaaggcgacgcacaggattagtgcgatcgtttccacccaaactaattcacacatagatctaagctaagcagttttaggtgagagcactatctattgtttatggtattggtaacatatgtacatgatcattaataagagaactagtaagagaactaggaaggtagcccgcgcatatgcgcgggcacttatttaatgttgcttaattttttattggtataaatgtttatatgtagattatattttcaaaatagatcttcactctatttaaaacatgttttagttattatctagttatgacatattacataaaaccatacagccttgaatttatgataatgacatgaatttataagaacaacatgtgtcacgataataaaacaataatagaataatggagttgtttcatatctatttgtactatatgtgatttttttacctaaataaagtgtttttttaattaccaccacggtaaaatctccaaaggaccatattgttggttatattttgataaatatctataattttgcgtctcgtgtttttcaacgcctattcttcataatcattcataatcacagaagacaccttgaccaattaatttggagaatgaatctattttcccaaacttatttataataactaattgattaaagtatacttctttgtcacatcaatagagtgcatgacatacattcatcgaattatgcctgatatgctggaattcctcaactataagaaaatatagagtgaacttcactgtgggctagtaatttttacccaagtttcattttggactaggggtggacaaatcttttcactttggaccaggtgattttacaaaaatttcaaactggactggccttcttctccatctctcttatggtttttttcttcatcgagatactgccatggattaaccggagcaagcacataactaggatttcttctctcggatccgttcctgagctcgaactcacgaaattaagtcactgggcagcttgttgctgcaactgtttcctgtgagatcacaatcatgtgattttttttcagctcacatgattttggtgggagaaaaagagcaaaaaaagaaaatcaaggtgctggttttttctttattgagatgctgccatggatcaacccaagcaatcacatgactagcattccttctctccgatccgttcctgagctcgaactcacaaaatcaagccatagggctgcttgctgctgcagctgtagcctgtaaactcacaatcaagtgattttttttttcagcccacatgattttggcgggagaaaaagagccaaaaagaaaatcaaggtgctaagtgatcaggatacattactggcgtgtttagttgtttgtgagctaaagaaatcaaggagtgagtggcagcacagtaggtcagaggcaaggaacaacaagaatggtccaatgtgcaatataaggtagcaaatcccggtccaaagtgaaaacatcaaacatagcctagtccaaagtgaaactttggcaataataagtggcctaaagtgcaattcactcgaaaatatatcgtgagtagtttattgcgtatgttacttgattgttcatttgttatcaaaactatttgacaaagagaaagacatacatatgggacaataaatctcatgatggactaaatggttgttttatagcaagatcactggcttgaaatatttttcataattattttttagatttatgtaatatttatgttgcccaattatcatatagttctgaaaattcaaaaaaaatgaaaatattaatctcaagaagtattctattaaatcatatctacttaaaaatacacaactaaattgtgttgttttcaattattttacatatgtagctttaaattagcattatatagtcatcaagtgttatttgacacctggaatatgatgtaaaattatttaaaataggaaaagcctagagccaagtcattatatagtttctcttgtagagaaactcatcacagctttagagccatccactccctggcagcttagagccaatcctaagcaaacactgaccttggcaggcagctccatcttggctggccggctgagatcaatcatcgatggaggtggccgttggtgcggcgagctggctcgtcggcaaggtggtgacgcagctgtccgatagcttggtggaggcctacgtggccagcaccgagcttggcctcaacatggagcagatcaagagcgatctcatgttcacgcaagggctgctccacgaggctcagatgaggagggacgtgagcaaccctggcctgcctgggcttttggagattctcagcaagaaggctgacgaggctgaggacacgctggatgagctccagtacttcatcatccaggaccaaattcatggcacccatgaggccaccccggtggtagacagcagcatacgtggccaggcactccatggccaccatgttcttcaccgtaccgttggtaactgcctttcatgcttttcttcttcttctacacgagatggtgccggtgaccatgttggcaagttgacattcaatcgagtagatatgtcaaagaaaatcaaatcaataatagaaggcatagatgccgcatgtaaccatgtatccaatttgctcaaaattatccatcctacagtaggaagggttctatcactgaagcgacctcccagcagctcaacaattacacagaatgaattatatgggcgggaagacatctttaaccagactcttgatgacatgtgcaccattcgtagtgaaacactatcagttcttcccatagttggccctggtggaatcggaaagactacctttgcccaacacctatacaaccacaaaaaaacagtggcgcacttctctaaaaacaaggcctgggtttgtgtgtctactaattttgatgtggttaggctcacccaggaaatcttgaggtggcatatgtcaaaatggaaatgagggaagtagtgaagcacataaaacatccaacttggatcagctccaaaaatccattgaagaaagactggatcctaaaagatttttacttgtcttggatgatatgtggaaatgcaacagtgaggctgaatgggaagtctactagctccattcaaaacaggagaagccaaaggaagtgtggttatcgtcacaactcgctttccatctatagcacaaatgataaaaacaaccaagccaatagaactgcaaggtctagaggatgatgaattcttgacattctttgaagaatgtatatttggtcaatacggcggtcggccttagagattggacaaaaggcatctgctcagaggctaaattgcaattccatatggcactcaatgtcatccaaagactcgacgtggcacaagagcacagagaactctcccccccccggaaacgcgactgagggcggctctcaagcggaaagtcctaggactcgcttctatagaaagggcaaggaaaaagcaagcctccagggtaactcacatccgtgaaggagatgcgaacacgaagttcttccacctcaaggttaatgcgcgaaggagaaggaatacaatccaaagattgaaaaaggacagtggttgggcggtgacgcacggtgaaaaggaatcgacgattcatgatcacttcgcaagcttcatggggaggccagggccgaggccaaacgagctaaactgggagacgttggacatcacaccgattgatctagccacgctgggggaacccttcactgaggaggaagtgcatagggcaattaaggaaatgccagccgacaaagcaccgggaccagacggcttcactggggccttcttcaaagtttgctgggaaatcatcaaggatgacattctgctagtcttcagctccatctataacctgagatgtgcgcacctgaatttgctcaactcagcaaacatcgtcctaatcccaaaaaaggatggggctgaaagcgtttcggactataggccaattagtctaattcatagcatcgccaagatcttcgctaagatgctagcgctgtggttaaggccccacatgcatgagttgatctcggtcaatcaaagcgctttcataaaggggagaagtattcatgacaactacctcttcgtaagaaacatgaccagaagataccaccgcctaagacgggcaatgttgctcttcaagttggatataacaaaagccttcgactctgtgcgatgggattacctcctagccttgctgcagcgcaagggcttctcgacaagatggatagactggctaggggctttactgtcgtcttcgacatcccaagtcctccttaatggctcgccagggcaacggatcaaacatggaagaggactacggcaaggggaccccctctcgccgcttctcttcatcttggcgattgatcctctacagcgtatcctttccaaggcaacagagctgggtgcaatttcaaaattacgaggaagaacaactcggctgcagatctcaatgtatgcggatgatgctgtgatcttcattaatcccacccggaacgatgttgcgactttcgcgaacatcctacatcgttttggcacagccacaggactcgtcaccaaccttcagaaatcccaggttgcggctataagatgcggcaatatagacctggaagaggtcctccaaggcgttccggcgaagcgggcaaatttcccactaaaatacttgggcctcccgcttgttctgggaaggctgcgaaaaacggacttgcaaccggtctttgacaaaatatcagggagagttgcaagttggagggggaaaaacatggcagtagccgggagaaccacgcttgtaaagtctgtgctttcagcgcagccaatttatctcctcactgccttgaaggtgacgaaggaatccctggagcagcttgacaagcagagacatcgcttcctttgggctggtacgggggatatcaccggggggaaatgcaaggtcaactgggcaaagacatgcttgccgaccagccaggggggccttggtgtcctaagcttggacaagttcacaagagctctgagattgcgatggttgtggaacgaatggagagatccaagcaagccttgggtgggtttggaaacgccttgtgatggtgtggatagggacctcttcgccgcctcaacaaagataactgtgggcgatgggaatacaacgcgcttctgggactccgcatggattaacggccaaagaccaaaagacctaatgccgttggtctatgagatctccaaaaataggaagaaatccctacggcaagggaaagaagacgactcctaggtgcatgacctgaccctcgatgcgggttcatctatcacaatcaaccttctcgatcagctagtccgcctgtgggaggcggtacggaatgtgcacttagacagcgaggagccggatcagattgtttggaaattcacaagcagcggccactatacagcttcctcggctaatcatgcccaatgtttgggggcgccaaacacaaacttcaactccctaatctggaaagtttgggcgccagggaaatgtaaatttcatgcctggctcatcattcaaaatagagtctggacgtcggaccgactcgcgacaaggggttggcggaataacggacattgccccctatgtcgttgtgacaccgagacagccttgcacctcgtcgccatgtgtagatacacgaagagaatctggcgcctcgttgctacatgggtgggatatcagcagttggaaccggcccaatgggaggaagcctggtcagtccatcagtggtgggagagcctagctaacacacccggcattccaaagaagggccttcggtcccttatcctgctagtagtttgggaaatttggaaggagcgaaatcggcgaatctttgatcacaaagagatggcaacaggtgttctcctagcaaaaatcaaagaggaggccagcttgtgggctttagctggggctaaaagattgcgcgagctcatcccgcactctgtatagtgtatagtctaaagatctttttgttttatccctaggggttgtattttctccttctatattcaatgaaaaagcactgctgtgctgttttttccgttcaaaaaaaatatatatatttggtcaagacaagcctgcatgttatgaagatgacttcattgatattgcaagaaaaatttccaagaaattgaagggttttccactagcagccaaaagcgttggtcgattattgaagaataacctttctcaggaaagttggatggaagttcttgaaagaaatgagtggaaaaatcggcaaggtgacgatgacataatgccagcactacatagtagctatgattatcttccattttatctaaaaaaaatgtttttcttgttgttccctttaccctaaggaccactggtttaataaattagagattactcattttttggaagcattaggcatcctatgttatggatgtcaaaataacaaagatgctgatataggattaaagtatttggatgaactggtaggtaatggttttctcatgaaggaaggtgatgatagtaggccatattatgtaatgcatgacttattacatgatctagcacaaaatatttcgtcacaagagtgcatcaacataagttcatatagttttaggtctaatagcatcccgcaatctattagacatgtatccatcaccttacaagataagtatgaggaaagttttgagagagaaatagaaaaattcaagaaaaaaatagacataggaaatttacagacattgatgctttttggagaaagcaatgcaagcatggcctttttcaaagacttattaaaacaaacaaaatgtcttcgtgttctgtttatgcatgcagactcactcgaatcattcccacacaacttctcgaaactgatccaccttcgatatctaaagttgaaaataccttataacgtaaaattgtctctaccaaacgcagtaagtagattttatcacttgaaacttttggacctagggaatagaaattgtattttgccaaaagacattaatcatctagtcaatttatgcctctttcttgcttcgaaagaactttgttccaacattcctgggattggcaagatgaagtatttgcggaggttggaagagtaccatgttaagaaagagggtattgggtttgagctgagtgagctaggggatttgacagagcttggaggtgaactgaaaatatttaatcttgagaacgtgacaacaagggaagaagctaatgaagccaagttgatgatcaaaacaaatctgaaaacattgaagctagtttggagtgtggtgcaacggacaacacgatctgatgttcttgacggtctccaaccacctcctaatcttaaaacacttgtcataataaaccatggtggttcggttggtcctagttggttgtgcagttatatttgtgtaaaatacttgaaatcattccatctagagggtgtctgttggggcaatctcccactttttggtcaactggtgcagctagaggaacttactttgaagagtatttcaggcatacatcagttcggacctgattttggtggtgtaacacaaaaaagtatctcgcacttgaagaaagttgaacttattaatatgccagaccttgtggagtgggttgggggagctcattgccatttgttttcgaagattacaagcatcaagtgtgaaaatctatctatcttctatctatctatctatctattatctattatatactaaaagtccattaaacttactataaacgctcccaagccgccacttggcgctctaataaattagagaaatctaagaaattctaagaaaaaagcaaaacatctgatcctcgattttcacttaatacagcgggcccattattttacaccattagatccatattaaacaaaataaaccccatctcccaaaaatcctctcccgctcccctcatgggcctccactcctcacataaacagtacgtacatgtactaacgttcctccctcgcatcctctcttttctccattccattcatcttctatttttttagataataaatttattatataaaaataattagataactaaataattatatttatttgcaacatattatatttatctatattagccatgtgttttgatatatgagaaatacatcatttgacaaaaactcctacaaatagcaaaaattaataacatatactatcatgtgatcgcaaataatttcatgtcctctttgcttgctcaccttggcctccttaatttctagctagcaaataataaatatccattaaattaaacatcgtgtatcataatatatctatctattatatactaaaagtccactaaacttcctacaaacgctctcaagccgtcatgtggcactcctacatacactcctaagccgccacatgtcatatctctaaagattctacaaattttgaatacaaagaaaatatccgaccgtcaattttcacttaaatcagtgacccattattgccaaaaaaaaggctgaacgctattcatcgggaaaaaagccaaaaagaacgaacatatatgtacgctcacctcaagtaatgaaaaaacacagaaaaatagcataccatccctcgcctgatcttataaaaacattagactattacaattaaatttaagagatgtaaaacaactaaaactgatatttaaaaatcatcgacggttacgaaattatgatatgttactataaatttaccattagatttataacaaaactacaagaaaaactaattccatttatttatttcatcataaaaattataacaaaactaataatatcgattatatcatcatatataacttcataaacatggataacaaaaattatatctatgattattcgaagtaaatatttcattcattatgaaactgtgataagttacaataacattagagtcatgataaaattatcagattgtcatataaactactttcatgtattcatatttttaagtttattgtgaatatactaatttcatgtattcatatttttaatttttattgtgaatatattgcaagaaagaccagatacaaagctcttactatggtacaacctacacagtttatacgtggataacttaaaggtatcaagcatatgtcccgttaatcttgaatgtgtccgacccacttacaaattcttatccaccaaacatcgagctacaattgctaacaaggtatttgtgcatcatatcatatcaaatatctaatatatgatgaacatgtgtaccattagacgcatatagagataaaggacattttataagggacatttgctcatttaacccttttctaaagcttaactaccaatttgatccttttttaaaacaaggtttgctcatttgaccatgtttttcaacatcgaagttgtcgtctgaccctactttcactacatcctgagtttttcatttagaagaaaagaaaaacatgtatttacaagcccaaatgactaaaatgacactgaatacatcaaccttatcctcaagcactcatttgctcattccttatccccccgtctctctctctctctctctctctctcttcaaagcgcgaagggcaggaggagcggtggcggcagcacgacagcagctgcggagtgcccccggctgcttcgcggagggtaggatcggtggcagagaggcaacattgactcgccgacgaggagggccgctggcagtggtcgaagagacggtgacaactcggcagaggggaggcagcagctccatgaagggtaggaggggtggcgtcggctcagtgacgaggaggactgccgacgatggcgaatgggaagcggtggctgtggaggggtggcagcaaccacagatatggtaggaggagcggaggcagagggatggtgtcggctcagtgatgaggaggataggcggtgacggtgaaggggcggcggcacggtgacgaggaggaccattggcgcccacgcacatctccgccattagcttgctaataaggtcaaataagtaagggtagaagtggtatttggggcttttgttaactccgattaatgctcttaagagaagaaggtcagagtgtagcttcggttttgaaaagaagggtcaaatgagcaaagtgaccaaaacatggtcaaatcggtagttagatatgcaaatagggtcaaatgtgcaattgctccattttatattatagattatatcattttgtatcattttataaacatacaaagccaaagacacgggtgatttacttaatctatctaaaaaaacatgtctacggtaataagaatcatagatactgaaaagacagaaaaactcaagagcatataccctaataatacctaatagtaaataaaaattatcaatggctaatccctaggacatataaaattataaagtattattttactagtttattaaatgccctaaagaaccctcctacaacgtctattaaagcctttaacaaataagaggaaactttaaatttcttctgtaatagataaagcatctaaaccttattcctcattaatttaatgctcccattaattttggccattgggccatttcaatgggtatatgtatacacacattatttaataaaaaaacattcatccaagcatgttttctaacaaaaaattatttgagatgtcaggtgaggttgtaatgacctgttgcatggtttagagggttgttgtcaggatgactagcattgagttttactaggttgccagccatccaatgcatcacaaaaagagcccatataggagatatttgtgttttgttgatcgagccaccatcaagagaagccaacatgggaaccccagtacaaatattttttatgactaaatcttctcttaactcaagtatctatgtaatattatttaagtcgtgttggcttgaagcatgcataatttgataacatggtatatctagaaggctacatgttagaacattcaattaacccatcttggaaataataatacttagcaagaaatcaaacaggtaacaaatttctatctttaattttgatatttaattttaatcattggaaagggggagatagagtgaatggtcacccccaaaggttttttcaaacagttatgttaatattgtccaatttgcaagctaaatgtttttttaaaaaaaagagatatagcgggttgattctgaagtattatcgtactattcaagagtagaggaagtagtaatcgtatccaaaatacatacaaagaaccatcatacataattttagcattcagagaaatagagatgcacgcgcaacgcgcgggctatcttcctagttggcctaatttctcttcggtgctgcggccatcctcggagtgctctgtctctcatatacaagacataaacaccacatggtttcccaacttgtgtgatcttgacattcggagttgccccaagttgtccctgccccccatgcctcatacttctacgctgacacgtgttagtgtgagaaaaggtgatgaaacactcttgtattttcgggaagaagagctgacagcataccattatgatggtgctttggcactccacaacctgggtaaagtaaaagctatggaaattgtagatatgctgcattttccattggctgacctccaaaatctaaactgcctaacacgacattctttcgaggattgcgataacattgacaatactgttgttctccattcagttcagtcgctctatctcgatgattgtcatcttactggaaaatcattgacaatggtattaagcatttttccggctcttacctacttcaatttgagaatgtttggtgaaaatcatgacatagaggaaatagtgctgcaggccccaataacctgctcattgtgccatatgtcgatatcctccagcaagaacctagttctgccagttgaggacggaggaggtctgcaggaactctcctcactccagtcactcaggatttcagattgtggcagaatgttctctcgatggtgcatggtcgatgcaggagctcgtaccagcaagcccctcccttcttccctcagggagctcagtatttgtagagagtcaagcatgcagtcgatggctctgctctcaaacctcacatctctcacacatcttacactattggaatgtgaagacttaacagtagatggatttgatcctctcattacactcaacctcaaggaattggtggttttaaataattgttatgagaacaattattcttgttccatagcagcagatttgctctcagaaatgacaaggaccaaagtattatctgcaggttccttacaactggaagcacttaaggtggacaatatctcaggagtgcttgttccctccatttgcagcctccttgccgccaacctccacaagttaattttcaaatctgacttgcagatggaaagcttcgatgaagaacaagagcatgcgcttcagctcctcacctccctcaagcaactatattttgccgactgcccaagtctgctttccctccccgatgggttgcatcacatttcttctctccagaaattgcacatatataattgtcctaaaattggattcctacccaaggagggcttcccctcttcattgagagatctagtgttatcagagtgtagcgtcgatctacaagatcaattgaagaaattggagacatcaaacccagatttatttgtacaccacatgaggtaaaaaggaaagaaaaagaagtgttctctcaactactacttatttcagcatccatctgtaaccttcaatactaaactaaaactgctctgctttgtttcctactttgctgtgaaggatgggccgaatcagtctggagatatagcggactatctgcatccgcatgcgagtaacacaatagcacatgcgggccaaaggatcgatcggttcttccctctgcaacaatctggaaggttcttgaaaaaccaactttttttaattttatgtggtcgggaatttatgatctcctttttttagtgcatgcaagcgaccactctgttattcgcccatgtagttcattgcttccttcacctaaccaatgttatattaactgtcagacagttttggtaaccttggctagagactcagcatggtgataatgcatgcagcaggctgatagctatgcggtaaatttgagacgcgccttgccctggtctgacctctacaacatcagttacacctaggtggtcagtaacctctcctcaactcatctcgtctctctctctctctcttgatctctccaaaatagggaagttagaggatatgtcctttaaaactactccctcagtcccgaaataagttaatataatatggcatgtaatattttcaagtaaagtatgctaaaaaaaacaagtatgctaaaaatgactctaaagtatgtatagggtaaaagtattctaggcaatttttaaaatgcctctaaaaggtgtctacacttttgaactcccgaatttagagacaataaaaaatttttatcccgttttttccttttttttttctacaaaagtgtctcaacataaggtttttgttgtagtgtgagcttggcattgagtgtgtattctttctgtggaaacctatcaatccaaaagcttgtccagaactcatcagtttgacatggtacagtaaagttcagacctgcctgccagttcatgtaatcatttgctctttagcttattagccttagcgaaaatttgaatttcagaacttaattttagggttgattttattaattgttttccatcatagtttgttttctggcattgtgtcacgcccacgcctaccatctttcattggcagcttacaacggacaaatgaagaacaatagaacatcattgcttaaaataaagacagatgatgatcaaaagatcaccacagttgacatgagttctgtggagcatcgattccatttcatcatctggtatgttcatctatgtaagcagttttagatgacagcatcaggcccaaatacgaattatacccttacatactcttttgtccttgctctaagtagaaatttaacaaatagtatattatgattgaaacaaatgagtttatatgttttacagcccatctaaacttttcattgagactggtcccaccaactccaaacaacatagaccacacagctctactagactactaataaactggcaatggattctggtgttggtaacagaggcatatatggtctttcttctttttttttaattgaagaggtgcatatggtcatcgataggagaatcattttgagcttattagtttgttaagtcccatttaatcattcattatggaatgctaaaccgattgcacataatactgatataactggaatgacataatatttcttgactactagataataccccgcgcgttgctgcggacataataaataactttcaaacatgcaatatgtgcataacatttgagaagaaaaaagaaaaaactacttattaccatataattgatggagtatatacagtggtaattataactaaatattacatgatggagtatctccccaggtagcagtggttggccaatgcaactaacagaattacaactcaaatatatggctgttgaccggatagagcaagtattaataaacaaaattgaaggccactaaacattactggaaaatgaaaaatatacaccaataaaattacccaaaattatgtactatgtgtttatgaacatagcatgtatgaaaaataacagtagaaaagcaagtaaggtgtcatactgttgtcctcgttaacttgatagcctttattcagcatgacatttttcctagtaccgcttccctcgctgacccattgatctcagttttggaaattctgtagttaatcttgcaaatgaatgccaattgattcatgaataaggtgctagaatatcataaataattgtggtaagaaatgtttatttaactggaagtagcaattattatgcatatcttatcgtataaatatgcgatgaacattaggagcgcatttgtagttgcatagctgatcaggaatgtagtcaaggcatgtagcaaacctaggtgatgagtgatgactactttacaattacaaaactgataataaccataactgaaacatcaatattttatatgtttaaacatctacaaatatagtccaattatcactgatagcaaggaaatcataactaaggtgtcaaactattatataataatggtagaaaattttcatgcttgagtaagatatgggaagttgggaaaaggattattacctcgtatatataattaagtactcatccttgattaactctttggagtgattttagctttcagaaaactccaaaaatatttatatcaccaagctaattcaagagtgacaaaagatacttaaaaacatatctagagtatacatgatcagaaaataaaatgaactttgagacggaagacaacctaatctatttaagagcaaacctgtgtgtctgtgtgtggagaatctgacatcattcttgatgaggaccttatcaaaagtgaaaagcacatcaacgacatagatgtaccgagatatatatagcttcaccagttaaagaccataattaaaataccaaaagaagaaagctccatccgcttagcagcccatatgattgttacttagctcgatgagttcttagatctgatcgggtgacgacaaatcaaccaatagatgcatatttgccacgtcttcaaccacttaagaatgagaagtggtctataattcaggataaataaagaatatgaatcaactaaatcagtagccaagaacctgaaacctggaaaaagaggatacagcaacaataaaattctctgttgggtatcagatttattgaacataaggaaaggggaaatcggtaggtaacctgtgttagatcattgaagtaattggagaggatcgaccaggtgagggctgcatatgaatccagcaagcagagttgcaagaacggtagtaaaacgccagcagcctggtagagtgtggtagatcgacgaataagcgagatgataaattggatatagatgcagaactgataaagggataagaggagaagaaaacgcattaagccattaatggatttacttgataacagccgtgaagtgttttcctcggtggttgtcgacggttttcattaatcatggcaacctaaaggggcgaacaacctttagacatggaagaggaagggggaagcagcgcacgagccgccatgggggcgacggaaggggaaagcgccacaccctcattttgcttccgtgtggcacgggaggcggatgacatgccagcgccggtacgggcgagcacgatgcgggagatggagaggatcacggcgagattgatacgaagggggcggcggagcgagatgcaggagagggaatcgatgcgagcgtgcaaggggagaggagaggagcgatgcgggagagaggggtttatgcgcgtggggccggtgaagcagcgagatgtgggaaaggagaggagcgatgcgaccgcttgattgagatcgaacggtggggagaaaatggggtgacgtgaagcaccaggaagcagagaattctagtagtgggaatgatttgtataggtatataggattcctgctaggggaaggtaataaacctgtgattccaaccacacaataatcttaattatctagactacagacactggtggagaaaccctttgtagtcccggttcgtaacccccctttagtcccggtttccaaaccgggagtaccaatccgggactaaagatcgctatctttagtcccgggtgaaataaccgggagtaaagatcgatctttagtcccggttggtaacaccaaccgggactaaagatcgagctgacctttttttttttgcatgcccctgttgctgcatggtttatatatatatatatatatataaaccatgcatatatatgtttcaatacatatatatgcatacatatatatatgtatatatatatatatatatatatatataatattatattatatgtatatacatgcataatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgctgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctaaaacgataaaagggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgtgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagtgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgatcttggcggcgtcaactttcgccttctttgttgcccttgtgtgggcaagcggtggagctgggggggcccttgactttgaaggtgccggaagaggagcttgcgggggagtaggtgtaggagcacgaggaggagtcggtgcaggatcctgaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagctcgaggtcctcgtacgcgccttcgaccaactcaacttcgaccttggagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttcaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaacctttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgcctgagaggaggcttccactgcatctgttagtcgtcgcgcagcctcttgtatctgatagccgaagaccagtgagccatcagctgggttgagcgttccaccgtgagcatagtcccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgccttcccttgttcacctgtcttatatgcaacgaactcgtcccagtgatcccttagctttgggaatgtgtcgaagttcggtgtctgccccttcagtatatacttctggtacagatctcccttgaagctctgaaattgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctagttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcatgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaatactaaaatagtcatgtatatgctaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattcctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagataaaaaaaatgtattaggataaatgcgaagtaacatatatatatatatatatatacatgtatatatatatatatatatattgcatttcacgttaacgttcgtccttgttagttcgctcgttcacgttccctagctcgttcacgttcgttcgatcgttctcgctctcgttcgttcgatcgttctcgttctcgttcgttaacggcggtgtggcggcatcggggcggcggttggcgcggcggcgtggcgacggcggcggcggcgtggcgttgtggggccgtggcggcggcggcgtggcgtggcggcggtggcgtggcgtggcgtggcggcggcggcgtggcgtggcggcggcggcattgcgcgcgcggcggcgaaggcggcggcggcgtggcgacggcggcggcggcgtggcgttggcatgcggcggcggcgttgcgcggcgtcgaaggcggcggcgtcgaaggcgacggagagagatcgagatcggagagatcgagatgcatgaagggagatgcggcggctctcacccca

SEQ ID NO: 83117 - DNA, 19313 bp, Oryza sativa
aggcacatggtgacatgatgtggggttgtgtcttgtgggtacagtggtacacctctgatcagagtaaactattcgaatagccgtgcccgcggttatgggcgggtctaacaatgtctttcgtgattagtctcacacctctcatcattgtaaaagatgcttaaactggtaataatttgattagctcctggtttggaatggtacattcctggtttggagatagaactgtgcagccgggatggttgttcagaatggttgggcctatacaacagggtatgttgtatagcgttggattaatattgtttaattacttaactgttttattaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccgctgcttagatctttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaagttggtatcagagctcccttgaccctaggttatgccaaatggttatccatagaagccctctaaaaatattggaaaagtagaactgttctcctccctttctcttttaattaaaccaaactaatggcacatgcatttcataatctcttttaatggttctcattcaaaatttattccagtgttattagtactgtacatctattactgtactaatggctcatttaccagcaaaagttttacaatactgttttatttaatcttgctgcaataaaataaatttagcatgttgattttataattttctttcatttcttttgaaaccagttattcaaaattacaaaatttgtgacctcgtttccaactgttttaacttatctcgcaagcttggtttactttatttacttacctttttactttgattttcaaactttattcaaattaatccaaaaacttgtgctattaattggatagatgtcttaactccctcctttcacctgtctttagatgccgcgttacaagcctgagtacctgtttggtgttgagggttttgtccaggagttgcgtacgatgtcctttgtcattggatttggaactgcccctttttatgcccagattgctcatgatcgtcatgaagagaagtgccgagtcaaagtcaccttgaacagtaatagtgaagatatcccctcagtgatgtttgaagctggaggaagaaactacatccatgcatgtcaggaggtggcaaggatcgccataggagagctccgtgatcgctacagtgatcaattggccgacactgagtatcgctaccatcctcgccaaccacagggaagtgaccgtggcagttaccttgagactgaaggaattgagaatgatgttaccacaaagcatttggttgagatgttgtgggctatggatgaaagtcgtgcggagactgtgttagcagcccaagatcgtgaagattggaatcgtggtaagatttgcaagttagaagacaaggtggatcgtttggagaaggaattagccgcattaaagggagaagcaccgccgcagaaggccaggattcgtcttaccgcaaggaagagagctctatttgttcctcgctatcaattggcgccaaaggttcgtgtggtggagaaagaagttgccccagctcaagcggatcctccggtcatcatcataagtagtgatgaagaagaagaatccaagcgcaacaattccaagattgagtgggtagcaacccaagttgataaagacgagccttcaatcgacctccgatgcttggaagaactagagtgacttgttaagccgttgtcttagatcgatgtgttagtttgcttgttttaagtttgcttgtgtgtgtgggtcttgcatgtgatttacatcagtggtgggatgtaagtgcatgcgtttgtttgcttttgagagttaggaagttggtgagtttagtggtgtgagagtctttagtttgtaataataaaactcagttaagatcaataaaagttaaagtaattctctatcttaagtagtttcccccggtttctcttcttgtgccctgcccatgccaaatggtgaacactcacagcaatgggaatggtcccaacaaccccaataacaacaacaatggagagaatcccactcttgctcaagttcttgctcaacagacacagcttatgaacatgatgatgcagcaatttcagaatcagcaaaaccaaggaaataatcatgcacctccccagaacaagttagcagaatttcttcgtgtgaggccgcctgttttctctagtaccactaatcctgttgaagctagtgattggctgcatgccatagagaagaagttggatttgcttcagtgtactgatcaggagaaggtctcatttgcatcacatcagttgcatggccctgcctctgaatggtgggatcatttccgccttaacaggactactgctgaacctatcacttggcttgaattcaccgctgctttccggaagacgcatataccatcaggagtagtgtctctcaagaagaaggagttcaggtcgcttacccagggatctcgctctgttacggagtatctgcacgagttcaatcgtcttgctcgttatgctccggaagatgtgcgcaatgatgaagagcgccaggagaagtttttgggaggacttaatgatgagctttcttacccactcatggttggagattatcctgatttccagaaattagtggataaggctatacgtcaggaggacaagtacaatcacatggagcagaagaaacgtcggattgctcacttcaaggcacaacagggaaataatcagaagccgcgtcttactttaggaccccagtccatgccacagggaggttcttcgtctgttgttcgtccgcagcgtcagttcttcaacaacaatgctggcaacaacatccgtaatcaagctccacgtcctgttgcagctccagcacagcaacaacctgccaagagagagcaaggcagcaagcccgtggtgtgtttcaactgtggagacccaggacattatgctgacaagtgtccgaagccccgacgcgtgaaggttgtccctgcccagaataactctgctgtaccagcatccaaggctcgtgtaaatcatgtcgctgctgcagaagctcaagatgctccagatgtgattttccttgttaactcagttcctgcaacagtacttttcgattctggtgctacacattcattcttatctatgagttttgcgggaaatcatgggatggaagtagaagatcttagacgtcctttgatggttaataccccaagtgatcaagcactttctttgcaacgtagcccctcggtcagaatagaaattaagggagtaccatttctggccaatcttatcttgttagaatccaaagaccttgatgtcatcctagggatggactggttagccagacataaaggtgtgatagactgtgccaacagaaaagtaactctcaccagcaatgatggtcgagttgtgactgttcatgcattgtcatctgagtctttaaggtcaagactgaaccagataactttggaagagattcctatagttcgggagtattccgatgtgttcccagatgatttacctggtatgccgcctaaaagggatatagagtttagaatagatttggtacctggaacgactccgatccataagagaccttatcgaatggcagccaatgagttggcagaagttaagaggcaagtagatgatttgcttcagaagggatacatcagacctagttcatctccatggggagctccggttatttttgtggaaaagaaagaccatacccagagaatgtgtgtggactatcgtgcattaaacgatgtgactatcaagaataagtatccgctacccagaattgatgatttgtttgatcagcttaaaggtgccactgttttctccaagatagatcttcgatcaggatatcaccagttgagaattaaagaggaagatatacctaagacagcttttaccactaggtatgggttgttcgaatgtactgttatgtcttttggacttaccaatgcccctgctttcttcatgaacttgatgaataaggtgtttatggaatacctagacaagttcgtggtggtctttattgatgatattcttatctactctcgaaccaaagaagagcatgaggaacatcttcgccttgcattggagaagctacgagaacatcaactgtatgccaagtttagcaagtgtgaattttggttgtctgaagtgaaattccttggtcacgtcatctcagcaggaggagttgccgtcgatcctagtaatgtggaatccgtaaccaattggaagcaaccaaagacagtttcagagattcgcagtttcttaggcctcgcaggatattatcggaggtttatagagaatttttccaagattgctaagcccatgacacgattgcttcagaaacatgtgaagtacaagtggtcagaagaatgtgagcagagttttcaagagttgaagaatcgcttaatatcagctcctattttgattttgcctgatccaaagaagggtttccaagtgtattgtgatgcatccaaacttgggttaggttgtgttttgatgcaagaagggaaggtggttgcctatgcatctcgtcagttacgtccgcatgagaagaactaccctactcatgatcttgagttagctgcagtagttcatgcattgaagatttggcgtcattatcttttcggtactcgtacagaagtgtacaccgatcacaagagtttaaagtatatctttactcagccagatctgaacatgagacaacggagatggttggaattaattaaggattatgacatgggaattcattatcacccgggaaaggctaatgttgtagcagatgctcttagcaggaaaagttattgcaatgctacagaaggacgacagttgccattggaattatgcaaggaatttgaaagattaaatttgggaattgtcagtagaggtttcgttgcagccttagaagcgaagcccactctaattgatcaagtaagagaagcccaaattaatgatcctgatattcaagagatcaagaagaatatgagaagaggaaaagctatcggtttcttggaggatgagcaaggaactgtatggttaggtgaaagaatctgtgtccccgacaacaaagatttaaaggatgcaattctgaaagaagctcatgatactttatactccattcaccctggtagtactaagatgtaccaggatctcaaggaaagattttggtgggcaagtatgaagcgtgaaatcgcagaatacgtagcagtatgtgatgtttgtcagcgagtcaaggcagaacatcagaaacctgccggtttgttgcagcctttgaagattcctgaatggaaatgggaagaaatcggtatggattttatcactggtttacccagaacgtcatcaggccatgactctatttgggtgatagtcgacagacttaccaaagtggctcatttcattccggtaaagacaacctattctggaagtcgattggcggaattgtatatggcaaggattgtgtgtttgcatggcgtccctaagaagatagtgtctgatcgaggcagtcagtttacttcaaatttttggaagaaacttcaggaagagatgggttctaagctgaactttagcactgcttatcatccgcagacagacggacaaaccgaaagggtgaatcagattttggaagacatgttgagagcttgtgctttagacttcggtggaagttgggataagaatctaccctatgcagaattttcgtacaacaacagttatcaagctagtctacagatggctccttacgaagcgctgtatggtcggaagtgccgcactccgcttttgtgggatcaaacgggagaacgtcaggtttttgggacggatatcctaagggaagcagaagaaaaggtaaagatcattcaagaaagattgcgagtggctcagtctcgacataagagttatgccgacaatcgccgtagagatttgagttttgaagaaggagactatgtgtatcttcgtgtcacgcctcttcgaggagttcatcgttttcacaccaaaggaaaattggcaccgcgttttgtgggaccttataagattgtcagtagaagaggagaggtcgcttatcagttggagttacctcaatctttggcaggagtccataatgtgttccatgtttcgcaattgaaaaagtgtttaagggtacctaccgaagaagctaatcttgatcagatagaagtccaagaggatctgacctatgttgagaaaccaatccgtatcttggaaacaaatgagagaagaaccaggaatcgagttatccgtttttgcaaagtccaatggagtaatcactcggaagaagagtccacttgggaacgagaagatgaattgaagtcagctcatccgcatctgttcgccagttcttccgaatctcgaggacgagattctgtttaaggggggtaggtttgtcacaccctgaaaattttaaaatttataaattgttgtttaaatggaatttctagaaataatttaaagtcttgaagagaagatcttgttttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaaagtctcttttggctttgggccgaaagtcggcccaaatctcttctctctctcctcggcccagccggcccagtccgccgcgcgcgcgcgccctcgctgtcgctgacaggtgggtcccgcctgtcaggtccttcgtccttctccggccgccgccgccgaaaccctagtttcgcgccgccgccgtttcctttccaaatccggccgttcctttccttctccggccgaattgaaagaggggaaatgatccttgggatctcctctaccttttctcctttggaatctttggctaaatcgttttggaaagagttggattcgagttcgtctcggatttgttcttcccgagctttccttcgccgttgccgtcgccgtgggccttcgccgccgcctccgagcccctttaaaaggacccccggtgtctcctctacccgtcgccaccttcactttcgcctctcgtcgtcggaagagctctagcgccgtgtgccctagcttcgccgtcgccgccgccgctccagccgtgcgccgccgtcgtttcagccgtcgccgtcgctcgggaagaccaccgtcgtgctcgccaagtcgtcgccgtcctcgttcgccccttcgccgtcgccggagatcaccggagcagcttcgccgtcgtcgacccgaaggttcccgccgcttcctccttgtcgccgtcgccgtccgttggtcttccgccgccgtttaggtcaccggtgagttcgccgtgttgtcctctacatcttggtgccctccgtttgcgtcctagcgccgccgtttgccggtgagtgtgcgccgcccgagccgtccgctccgccgagccgctgccgctgtcggtgacgtcaccgctgacgtcatcggggtcgtccgccgtgagccggtcgtggaccgatcgatctcggccgtccgttttggattggatcgatctcggccgtccgttcgcgtgaaccgtcgcccgtgcgcccggtccaccaaaccctagcccgctgacgcaataattctcttttccttttcaaaaataattcattattgcgtcataattcaatttaaaccgatataagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgcagaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggccctttcgtacttgattaccttattccttgataccttgggttattacaatttgactagttgagctttatttatattggttcaactagatattagatataattgcttagccctgcttagaaacattagtacacattcgggataactaatgactcactattatttaatgatggtttcatgatagttcacgatggtcaatcgtgattagttaattaattaatgtgccaactaaaacctggtaatggtgggttgtgagcacatggttttgttggtcgtgctcatgacaattaaggaccggttcacgagtttcggttgtgaaacattaaccgtgccaaccacaagccagcatgggcaacggctttatcttttgtatagcatggttcattgcggggcaccagactgagaagtggcggagataagcccacgggggtcgctggggagtccatgccttgtttataagggggtgattatgatctaggaaggtgcgctgcggtggattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattgtaaaagatgcttaaactggtaataatttgattagctcctggtttggaatggtacattcctggtttggagatagaactgtgcagccgggatggctgttcagaatggttgggcctatacaacagggtatgttgtatagcgttggattaatattgtttaattacttaactgttttattaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccgctgcttagatctttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaaggatccccctggatagggattggtgtagcggaccctttggttagccccctgttgattgaggaaattcgccaagtgacgcttgtgcgactccagttccttgtgcttggcttccaagcggatgctcttgtccaccagacgctggaaatccggataatccccggagaccagacgcacagatagctcagggtccattcctgccaagaacttctcctgcttttcctcatcttcccgaacatcctccggggcgtaccgggccaggttgttgaactcatgcaaatactccatcacagagcggttgccttgcttcaactcccggaattcccttttcttaagggccatgactctggcaggcacatgggtcctccggaaagcggcggtgaagcgggcccaggtaataggctgcccctcgggctgcgtagcctggaagtggtcccaccatagagatgcgggcccctgcagctggtgggtggcaaagatgactttctcctcatcgttgcactgcacggtgtctaacttcttccccacggcatgcaaccaatccaaggcatccacggggttattggagctagagaaggtaggcgggcggatgcgaaggaactcggcgagcttagaatgctgcgggggtggtggtggaggtggagcattatgctgtggtggattttggatgtggtggaggaaagcagccatcatgttggcctgctgggcgaggatttgagtgaggatggggttggtgtctggtggtggtggtggtggcgggggaggaggtagaggtgggccaccttggatgttggggttgctaccttcgggttggttgccatcaccagtagcagcagttctcctggttgtcaccatctgaaataccccaaaacaaaccagccaacagagagaacagactattaaaactaaccacccacgactaccaaaattattgaacttattactgatataaaatgggttcattaaggttcaggatgcttaagccaataaaataaagacaggctccgacacaatcataccacacaccggtacaaccatgccccacacgacttcaacaggaagacaaacgagaaagaacacactcgcaagcctactaactgctcgtctacttctgcgacgggccagggcggaaggtgagcagcagcgcatcctccgtgctaccaatgccggaggtttccccctcctgaggaaccacgggcgcgggctcggcacgaggggtctccacgaagcaggtccacgccagggactaacgaacaagctcaggcctggaggtgctcttgcgggcagtgatcttctggctgcggcagacgcggcggcgcttgggacggcagacctctccctgggcgaccttgagctgacacagctgcgcctccagcgcgtctaggtccttcttcagctgcagattctcctgacgcagctccaggatcttcatgttgttctcgaccatcccacggcgcaccatatgatggaagtcgatacgggccgcgtcgtacgcctccaccatgcgcgccaggtgcatgatggtagcgtcatcctccgagctagcatcccggaaggtggcgtagtcgcgggctcctccgcgacgagggtggtagcggtagggcgagtgctgcaactcgtccgggtagcgctggtgaagagtgccgatggcgaggagtgcggcgttctggcaagcagcggagaaggaatctcctcccgtggtgactgccaacgaagtcctctcgggagagccagtgaggatcactgcagtgacctcccaagcagcatgcgactctgcatcgtcaccctcctgctccgggagctgcttgccttggtagtccactccatgcggataccccaggacaacgcacatgccccgcagctccagaacaaagccggtcaggtccaggccacgacggttgatgctgccggccatctacaagcaaggacaaaaaagagagaaaatattttagagatcagcttttgatgacaaatgaagcagcaagacagagagagactaaaggattttcacaaataagagaggatttttatttcgaaaatattgctaaggcttgggatctaaggctcgtcctagggtcaaggaggctctgataccaacttgtcacgaccggaaataacccaacgggcgttccttacgtgcgtgtattattccttgtcccaggaggcaaggtacaccaaaagttgatacaattcagagtttaacaagcggaagcgtaaatagttaattattacatgggcagcgacggcccaacacactcaaagacaacgaaaaacagcggaagactaaggcgacgaccacaggcgcttgacggcaggcacgagctagacaccaaagccttcatcatccaggggctcctcttctgggtttgggaaaaattgagcaagactgagtacaaccaccgtactcaacaagacacacccacaagtgcagcataaatgcaaaggagtacaatggagttatagtataggggttaggttttgcaataaacagcatttaaaagactcttagttgctcaaagctaaatttaaaacacgatcctagaactatttaatattattaaacaaggccgtgaacccacacgaacctgccttaacccaaggcctacgatgattcagaccgaactggcaacccgaccctgggtcccagctcgtcccaagccaacccaggccaaccattccacattttagttattaagcaggttttaagaatttgaaacactaacttgggtacattgctaggcttgcccataaccgagggcgcggctattcgaataggttttactctgatcagaggtgtacatctttacccacaagacacgtcttcctcacgtgcaaccacgtgccacataccaccacggcatatggacggaagacatgacatagtttccaacccatcctagccatagacaagagtaccgacccaacccacctacggccagaacccccggacaggcaggcagaattgagcccctagcagcaggacaccagccctgtgctatgacatctcgactaccgggccgcagcccgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatgtggccgaggtgctactatcaaaacaatgcaccccaagcccagcctaaaaccattttgagagttttgaatagagggggaggtgtgcatccaattccacaataatccaaccattccaatatgtccaggtgatatgaatattcccaaagtctagagttataaaaccacctaatgttgcctaattaatcagcgaagcatctacctaaattcttgctagtggaaccattaatagagtgcccactagttggggttttgtttattctagggtgaacaaggtaataataacaataacaacaataataaggtcataacaaaggtaaataggcatggctaaataaaacagtgataacgcgggaatttaaataaagcgataatgcaataatttaaatcaaagtaatttcacaaagtgggatccaatatgttcaaagaatgatgtgacttcccttgctcgctttcccaaacgtcggcttcaacctccacgaagagcggatcttccgaagctgcagcgtctacacaaccaacagaaaagaaaagggcttttactctaataaactccatataacaagcaggaacaaagcacaaaaatgggttcttgacttcttaaggaaaaattagagacttgaacggtccaattccgagttcaaatggccaagttatggccatttgaagtttatatgcactttaaatgaatatttacgaatttcttcatttaaattttaatttaaaaatagatttattgcgtcagccgggagagagggcgcgcggaccgggtccacgggagtgggacccacgcggcagtctcacggtccacggtggaccgggtgcacccggctcacaccggccggccccgtgggccccacgcgtcagccgcacccgagggcgcgggcggctgatggccgggccccatgcggcagccgctaggcgcgcccggaggcggccacatcggcacggccggcgggaggcggcgcgcccgcgcccctatggtcgccggcggcggccataggcacggcggagcggcggccgagagaggggagggaaagggggaaacgaagcggcggtccacggctcaccccgggtcgacggtgacgacggaaacggcgaccggagcggaggaaggcggcggcgcggctcgggtggacggggtcgacggcgctccggcggtcggcgagcgaaacggaggggtggacgaggtcggcgaggatgcggcgaagccgaaggaggcggcgccgaggtgggaggtagtccggggcgacgacggcggcggaccggagctcggcggcgacggcggagagagagagcgacagcgcgagctcgattccggcggggagagagggcggtgagtggcggaaacggtggtggggagctcggggagggtttatatagggttggaagtgagagagggcggccggaggagggggaaatgggcgcgggagacccggccgccattaatggcgccggcgaggttaggggagaggtttccaaacaaatccgagggagagagggagggaaaaatggggggaaagggggaggggatcccggggaataattccccccactttattgcacgcggggacggcgggaggcggcgggattcgcggcggcgtcggcgctaggcgcgggcgaggcggcggaggcggcgggaggaaggggatgacgggtgggccccacccgtcagcgagggaggcgggcgggcccgcccgtcagcggcgcgcgcgcggggaggaggccaagtgggccgcggggaggaggagagagggggagggagatgggccgagccggcccattagaggggagaggtgatttttagggtttttctctttataaaatcattttaactttgtttatttcttaataattattatttgtgctctgaaaattccactaaaatttatttacacattttaggcttttagaaaatatacaaaaatcctccaagcccaatttgacttttaactttgcacattttaatttttgaaggctttcacaagcattttaattattctaggcataatttagaggatgtattttagggtcgatttgggacgcgacaattatgcaattgatgtctgaattgtatggaggggctaggaatgtaccctacactagaaaagacataagcaatttcaagtcaaagttggggagcgagtataggagtataggtgtagagatattcctgaaacaattgctcacttcgaggaaatcaaaaaggatgacccaaatttcttctacaagattcaacttgatagggaagacagggtgcagaacatattttgggttgatggagcagcaagaaatgcctacaatgacttcaaagattgcatctcgtttgactgcacatatatgacaaacatgtataacatgccttgtgcaccattcattgggataaacagacatgggcaatcaatacaggtactccttttttttgcaaaaaagtaattctaaaaaatctgtaataactttggaaattatagtacatcataagttacttgttgcattcattgagttacatcaagtcctgataaaagttacttccagtagaatgtgaagttacatttttttaaaaaaaaaaggtaaaaaagtaactaagtttacaagttacatttttagtgtttgttctatagttcaaaattgtactgatttacttccagcaaacacaaactgtacaaactacgcaaaattgtagtaacttacttgcttcaaaactgtactgacttccttatgtgtattatttttgatattcagctgggttgtggatttctatggaatgaaaagacagaaacctttgtatggttgtttcaagcatttctagaggctatggaaggtgtagagcccacaaacataataactgatcaagacctagctatgaaggcagctatagcgctagttttcccacatgctaagcatcgcaactgctgctggcatataatgcagaatgctcagaagaagattggccatatattagatcatgacaaagcattgtgtgatgcattcaatgactgccttgacaacagctggacagagcaagagtttgatgctaaatgggatgcaatgttgacaacatatcatttacaagatagtgagcacttccgacacctttgggaaatgagacggtgttgggtcccagcatactttatgcactgtttcttccctttcctccagactacagcacggagtgagggatttaacgcagtgctgaagcgctatgtaaatcctcaaaacagcatatacaacttatttttgcagtacaagaagattcaagaaaaaatcactgttgcaacagatcagaatgagtttgaagcagaagaaacaatcccttctatgtgggctaactatcccatggaaacaaaagcattggaggtctacacaaggcctatattcaacagatttcaaaaagagcttattgcttcaacatcatataaattgacctgaacttctgaaaacatgtatctagtagaaccgaatggaggtcctgttaggaattatggatcaagggcattcattgtagctgcaaatgtgttggacaggatatacaactgtgaatgctgtaagttcgaaagggatggcattctttgctgtcatgttctgaaggtaacagtctgttattgcagtaagctacttctcactgtgcattaagctacttctcactgcacattaagttacttcttaatgtgcattaaattacttcttatgcattacgcacttttggcaggtaataaaacatatgtttttttccatgcaggtgatgacatttgattttgtgggccaagtgagtgacattccagaacactacatattgcctagatggacgatggttaaagagcctgaattgcctccagttacaagcattggtgaacaaatgcaattgccccctaaatctctgaagctaatcaggtataccaatctgtgcacaaaatttacacagattgcaaaagatgcatcaagcaacgagaaagcctaccgtatggctctacagtgtatgagctcaatgactgatgacttagcagctatgaagcagagtagaaagaaacagaaaaaagcacagccagccccatctgatcctgcaagaggaatttcagatatcccctcagcatcaactaacccaacactacagataaatgaccccccccccatcatacaaaagcaagggagaccagtttcaacgagacgcaagcctggggtccatgcaaaggcgtcaaagacatcagttaggaaaggcctagctagtactgagaagtgaattagagctacgagatgtaacttataatgttgtgacaagattgttgaaacttacttgcacagttgcattaagttacttttagcttccatagtagttacttcacagtgatatgtaagttctcaggaagaccatgctgagttctttgcagaaccaagatgctattttaatttgttacccaacctaatttatgtggctataacttatgtgctggttctggaaaaaaaatgcagtgtttcattactttaccttaagtgtaggatcaggctctttgccccataatacttgcatccattgcacacgatttccttgaaacgagagtatcttgtgtgtaagtagtttcttaatgttggggatgtcacttggttcaaatgctggcaactgtttgccatcccacaactccacaaatttcagcatataaaaaccacaatcccggctgtttttgtttgcaaaaacaaaatagggataagtttgactaaagacaataaatgaaaatcactaactaaaaaaaagcatgttacgtacgtgttatcttgctttgggccatcaatgaaaatcagtgggtaattctagatggttttcttcgaaaacctcatgtaaaacctatcccacatggtcttgatggatgcaacaacaagatgagatgctgaaatcagtgcttcgtcatcttctcccctcagcgaatcataaacctcgaatctttcagctttcagattaaggcacaccacgaaatagtgactagccttatcattcccattacccaattcttggagaatgggaaaaaatgcctgcattcaagtgaaaagagggaggggagtggaaagaaggtttttcagtaaatataatcatgatttagtaagtataaaaggataataaaaagtgattcaaaataacatttcctgtcaatataacagaaaaagttacttccacaaacatgctgagttaatttgcaaagacatttaagttacttctacaagcagacaggaaaaagtaactttacatatcattgacagctggaatatatattttcttactaattctttatggtcaagatggttcgctctcgtttgatcgaagtgtttcttgagctcattcctgtccaactgcgaatccaacaaatatccctgcaccatgtggaaaaaaaaacataaggtgttgcaatgatagtaatagtacattaaaaagagattttaatttgtaaattttatatactcactcctattctggcaggaaaaattctcttcgaattgtccttgatatcagtagacagaacaattaatgccaattcacatgtgttattgtccagtgagcccataggtttgacagagttcgcaagatcgctaagataaatataatattctcctgtatcaatgatcttttggctacatttaccaaaagcaaaaagaaaaaaaataaataagcaaattagtataccatgtacaactactgtagcatgttaaattaatttcaatgacatggtaagttactttcaatgacatgttaagttacattcagtgacatgttaagttactttcagtgacatgttaagttactttctatgacatgtaaagttactgcacaggggtgtgtagaaagtttgtctggaaaaaattgctcggtcgtgtgcagaaccaatatgcacacaacaaaaaatggaaggtatgaaccaaaatgcagttgcttcaatggcatgtgaagttacttatataattttacttctctgagaagtgaagttagttctacaaagatcattttactaaaaaagtaaaaaagtactgtgtacagcaaaaaatatgtgattgtacctattccttcttgacttggttctccctccattcttgcaaatgtcatcatatacctcgtttataactcgagaaaccatgaactgcttcttgttctcataatcaattaagggtgaccttttgaatttcgctggtttcaccacccttttattgtactcatggggcacaggtgtttcttcttctacttcacaagcaataggttccttggagattacttcagcgacaggtgattttgtggcagatttgctggcaatggcctcatctgcttctctcccaaccttttcatagtcttcagtagtaaaacttccatagtcctcatttgtgataattccaggaaattctttaccttgagatgttcctgctgcttcttg

SEQ ID NO: 83118 - DNA, 26892 bp, Oryza sativa
cgccagccgcaccggcaccgcccacctcatcgccgaccccatctccatcctcctcgacgacctcctcctcgagtgcctcgccggcgtcccctatgcctccctcccgcaactccccaccacttcaccacgcttgtcgcctccgtcgcgcgcacggcgagctccgctcctctctcctcgccctctccgtcacgcccacggcgagccgacggatgttggcgtggtggtggtgatgaggacgaggagccggcggccaccgactcgcagctacgccccgtcgccgccgctacgctccaccgccggcgactggatggggatcccctttcttctttcccctgcaaagtcaacaaaatgactaggggcaaatatgccagagaatgatggaaaacatttggaaatcagttaaaatggttgaaatggcattatagtaagttggcttcatttgacaatggtattataacgaagccatattcggaagtggcattccagcgaaaccccatcctgaagatggctaaatgtcaattttctctgcgctctggaaggtgcaagtaagcgccgcagtcagaggagcgcggcttcaggggcatctcaccggcgcaaccaagcggccgccggcagagatcgctgtcacaaaagatggcgccaccaagaaggagccgaacccagcccatgaagactgggaagccaccgaccagcaagttctggggtaccttctctcgtcgctgacaagagaggtgctgatgcaggtcgctacaggcgacaccgcggctgaagtgtggagcgccatcgagcagatgtactccgcccacacacgagcaagagcgattaacactcggtttgctctcaccaatacaaagaaaggtaacatgtcaactcctgagtattttgcaaaaatgaaatccttaggagatgagatggctactgccggaggtcgcccgatcgatgaagaggagctgattcagtatatcatcaccggccttggcgagggctacagcgaggtggtgtcggctgtctgcgctcgggttgaaccaatctctgtgagtgatctgtactctcaagtgttgaactttgaagctcgccaagccatctaccgcggcgcacaggaggtcaccgtcaatgttgccaaccgtggaggcttcagccacggggggcgtggcaacagcaatggtggccaaggaggttcgcgcggcggcggcgacggcggcggccatggtcgcggcaacggaggaggtggccgtggtcgaggccgcacaccaggaggcgttgataaaagaccaatctgccaagtgtgtttcaaacgggggcacacggcagcagattgttggtataggtacgacgaggattacgttcctgacgccaagcatgttgcagctgcagcggttaactcctatggagttgacacaaattggtacatcgacactggtgctacagatcatgtcacgggagagctggacaagctcactatgaaggaaaaatacaacggtggtgaacaaatccacacagcaagtggtgcaggtatggatattagtcatattggtcatgctattgttcataatcccaatagtcgtaatatccaccttagaaatgttttatatgtgcctcaagctaagaaaaatcttgtttcagtacatcgcttagttaatgataactctgcctttcttgaattacatcgtgattatttctttcttaaggatcaaatcaccaggaaaactctccttaagggaagatcatggcgcaggctatatcctctaccacactcctccttgaagcaagcctacagtgccatcaaactatctttggaccggtggcatcatcgtcttggtcatccttccattaccacggttaaacaagtagtcaataagtttagcctcccctgttcagatttgtctagtgagtcagtttgtaatgcttgtcaacaagcaaagagtcatcaattaccttttcctatttcttccagtgtttccaaacaccccttagaacttgtcttttctgatgtttggggacctgctccagagtctgttgggagaaaaaaatattatgttagttttattgatgattttagtaaatttacttggatttatctcatacagcataagtctcaagtgtttgacaagtttcaggagtttcaagtcatggtagaacgtcaatttgatagaaaaattctagccatgcaaactgactggggaggcgaatatcaatcccttaactcttttttttctaagattggcattgttcatcatgtttcctgtcctcatactcaccaacagaatgggtcggctgagagaaaacatcgtcatatagttgagatcggtttatctctcctatctcatgcatccatgccattaaagttttgggatgaagcctttcaggcggcaacttatcttattaaccgtgtgcctagcagagttatccataatattagtccccttgaaaaactgttcaaacaaaaacccgattactcctccttgagaatttttggttgtgcctgttggcctaatcttcgcccctacaataaccacaaattacaatttcgctctaagcgttgtgtttttcttgggtttagcactatgcataaagggttcaagtgtcttgaggtctctacaggacgcatctatatttctcgcgatgttgtctttgatgagaatatttgtcccttcactgaacttcatgccaatgctggtgcccgtcttcgttctgagattgatattctcactcctgaactgctaggacccatacggtctgttgggaatgaacaatgcatgcatccagtgactaatccattatctgctgatgtttctgctgctttatctaatcgtgctaatgagccacatagagatggtgcagtacatcccgctgatgcagaagatccgccggcgacgcctcctctggatgccagttctggtccagaaccagaccgtgtcgtccaccactcccctgcggccacgtcatcaggccgtcatccgggtcccacacctggttctgtgccacggggggcagcatcatcgctagcagaggagacagcagaagactcagtgtcgcaggcggtgcaggagcaggagtcgcaggtggtgcaggagcaggagcagtcctcaccagcgcaggaacatgcacaggctgtcacagatgagactaatacattacagcatgcagatgtgactgacacaggttcagaggcaccggcaggaccgcgcaccaggttgcaaagtggagttcacaaagaaaaggtatatactgatggtactattaaatataagcattcttggtttactgcttcaggtgaacctacaaatgatttagaagccttaaaggataaaaattggaaactagcaatggattcagcgtatgatgctttagttaagaataaaacttggcatcttgttcctcctcagagagggagaaatattattggctgtaagtgggtgtataaaattaaaaggaaagctgatggtaccctagataggtataaggcaaggttagtagcaaaaggatttaaacagaggtatggtattgattatgaagatacctttagccctgttgttaaagctgccactatcagaataatattgtctttagcagtgtctaaaggttggagtcttagacagctagatgttcaaaatgcctttctgcatgggtacctagaagaagtttatatgctacagccaccaggttttgaggatcctactaagccacatcatgtgtgtaaacttgataaagctctgtatgagttaaaacaggcacctagagcctggttctctagactaagtaaaaagttgatggaccttggttttaaaggatcaaaagctgatacgtctctgttctttctgaataaaggtgatataactatgtttgttctggtatatgttgatgatatcattgtagccggctcttcagagagggccactgcagctttacttcaggatctaaaaggggaatttgcactcaaagatcttggtgagctgcattattttctcggaatagaggtaagcaaggttcagaatggcattgtactgaatcaagacaagtatgccaatgatttattgaagaaagtgggcatgatagattgtaaacctgctaatacacctctttcagtaagtgagaaactctctcttcatgaaggctcattgttagggcctgaagatgcaagtcactatcgcagtgttgttggtgctttgcaatatttgactcttactagacctgacatagctttctctgttaataaagtttgccaattcttgcatgctcccacaactgtacattggattgctgtgaaaaggattcttaggtacttaaagcaatgcactcggttaggacttgaaattcataagtcaggatctactttagttagtggcttctctgatgcagactgggcaggctgtttagatgacagaagatcaacaggaggatttgcaatatttctgggttcaaatctggtctcctggaatgctagaaaacaagccactgtgtctagatctagcacagagtcagaatacaaagctattgccaatgccactgcagaaataatgtgggtgcagactttacttgcagagttagagattaaaagtccaaaagctgctaaaatatggtgtgataatcttggagctaagtatttgtcagctaatccagtgtttcatgccagaacgaaacacatagaagttgactatcactttgtcagagaacgggtaagtcagaaacttctagaaattgattttgtttccactaatgatcaagttgcagatggattcactaaacctctgtcagtaagactcctggagaatttcaaaagcaatctgaacctggttaggtccggattgagagagggtgttagttagcatgaaaggttcggatcatgtgatcacgacctgacagcttgcatgcatgtagttgttgaggttagtttggattaggttagtctatccatgcggatcaggttagcctttcctccacatgcgataacagatgtttgttagagtttgttttctgttttctgttactgcatgcagtcgtttcatcaatctcggcttcggttgttctcagctgcgccgaactctgtatcgccacgatgggggctgttcccatcacatatatattaacacgaaggcgacgcacaggattagtgcgatcgtttccacccaaactaattcacacatagatctaagctaagcagttttaggtgagagcactatctattgtttatggtattggtaacatatgtacatgatcattaataagagaactagtaagagaactaggaaggtagcccgcgcatatgcgcgggcacttatttaatgttgcttaattttttattgttataaatgtttatatgtagattatattttcaaaatagatcttcactctatttaaaacatgttttagttattatctagttatgacatattacataaaaccatacagccttgaatttatgataatgacatgaatttataagaacaacatgtgtcacgataataaaacaataatagaataatggagttgtttcatatctatttgtactatatgtgatttttttacctaaataaagtgtttttttaattaccaccacggtaaaatctccaaaggaccatattgttggttatattttgataaatatctataattttgcgtctcgtgtttttcaacgcctattcttcataatcattcataatcacagaagacaccttgaccaattaatttggagaatgaatctattttcccaaacttatttataataactaattgattaaagtatacttctttgtcacatcaatagagtgcatgacatacattcatcgaattatgcctgatatgctggaattcctcaactataagaaaatatagagtgaacttcactgtgggctagtaatttttacccaagtttcattttggactaggggtggacaaatcttttcactttggaccaggtgattttacaaaaatttcaaactggactggccttcttctccatctctcttatggtttttttcttcatcgagatactgccatggattaaccggagcaagcacataactaggatttcttctctcggatccgttcctgagctcgaactcacgaaattaagtcactgggcagcttgttgctgcaactgtttcctgtgagatcacaatcatgtgattttttttcagctcacatgattttggtgggagaaaaagagcaaaaaaagaaaatcaaggtgctggttttttctttattgagatgctgccatggatcaacccaagcaatcacatgactagcattccttctctccgatccgttcctgagctcgaactcacaaaatcaagccatagggctgcttgctgctgcagctgtagcctgtaaactcacaatcaagtgattttttttttcagcccacatgattttggcgggagaaaaagagccaaaaagaaaatcaaggtgctaagtgatcaggatacattactggcgtgtttagttgtttgtgagctaaagaaatcaaggagtgagtggcagcacagtaggtcagaggcaaggaacaacaagaatggtccaatgtgcaatataaggtagcaaatcccggtccaaagtgaaaacatcaaacatagcctagtccaaagtgaaactttggcaataataagtggcctaaagtgcaattcactcgaaaatatatcgtgagtagtttattgcgtatgttacttgattgttcatttgttatcaaaactatttgacaaagagaaagacatacatatgggacaataaatctcatgatggactaaatggttgttttatagcaagatcactggcttgaaatatttttcataattattttttagatttatgtaatatttatgttgcccaattatcatatagttctgaaaattcaaaaaaaatgaaaatattaatctcaagaagtattctattaaatcatatctacttaaaaatacacaactaaattgtgttgttttcaattattttacatatgtagctttaaattagcattatatagtcatcaagtgttatttgacacctggaatatgatgtaaaattatttaaaataggaaaagcctagagccaagtcattatatagtttctcttgtagagaaactcatcacagctttagagccatccactccctggcagcttagagccaatcctaagcaaacactgaccttggcaggcagctccatcttggctggccggctgagatcaatcatcgatggaggtggccgttggtgcggcgagctggctcgtcggcaaggtggtgacgcagctgtccgatagcttggtggaggcctacgtggccagcaccgagcttggcctcaacatggagcagatcaagagcgatctcatgttcacgcaagggctgctccacgaggctcagatgaggagggacgtgagcaaccctggcctgcctgggcttttggagattctcagcaagaaggctgacgaggctgaggacacgctggatgagctccagtacttcatcatccaggaccaaattcatggcacccatgaggccaccccggtggtagacagcagcatacgtggccaggcactccatggccaccatgttcttcaccgtaccgttggtaactgcctttcatgcttttcttcttcttctacacgagatggtgccggtgaccatgttggcaagttgacattcaatcgagtagatatgtcaaagaaaatcaaatcaataatagaaggcatagatgccgcatgtaaccatgtatccaatttgctcaaaattatccatcctacagtaggaagggttctatcactgaagcgacctcccagcagctcaacaattacacagaatgaattatatgggcgggaagacatctttaaccagactcttgatgacatgtgcaccattcgtagtgaaacactatcagttcttcccatagttggccctggtggaatcggaaagactacctttgcccaacacctatacaaccacaaaaaaacagtggcgcacttctctaaaaacaaggcctgggtttgtgtgtctactaattttgatgtggttaggctcacccaggaaatcttgaggtggcatatgtcaaaatggaaatgagggaagtagtgaagcacataaaacatccaacttggatcagctccaaaaatccattgaagaaagactggatcctaaaagatttttacttgtcttggatgatatgtggaaatgcaacagtgaggctgaatggggaagtctactagctccattcaaaacaggagaagccaaaggaagtgtggttatcgtcacaactcgctttccatctatagcacaaatgataaaaacaaccaagccaatagaactgcaaggtctagaggatgatgaattcttgacattctttgaagaatgtatatttggtcaatacggcggtcggccttagagattggacaaaaggcatctgctcagaggctaaattgcaattccatatggcactcaatgtcatccaaagactcgacgtggcacaagagcacagagaactctcccccccccggaaacgcgactgagggcggctctcaagcggaaagtcctaggactcgcttctatagaaagggcaaggaaaaagcaagcctccagggtaactcacatccgtgaaggagatgcgaacacgaagttcttccacctcaaggttaatgcgcgaaggagaaggaatacaatccaaagattgaaaaaggacagtggttgggcggtgacgcacggtgaaaaggaatcgacgattcatgatcacttcgcaagcttcatggggaggccagggccgaggccaaacgagctaaactgggagacgttggacatcacaccgattgatctagccacgctgggggaacccttcactgaggaggaagtgcatagggcaattaaggaaatgccagccgacaaagcaccgggaccagacggcttcactggggccttcttcaaagtttgctgggaaatcatcaaggatgacattctgctagtcttcagctccatctataacctgagatgtgcgcacctgaatttgctcaactcagcaaacatcgtcctaatcccaaaaaaggatggggctgaaagcgtttcggactataggccaattagtctaattcatagcatcgccaagatcttcgctaagatgctagcgctgtggttaaggccccacatgcatgagttgatctcggtcaatcaaagcgctttcataaaggggagaagtattcatgacaactacctcttcgtaagaaacatgaccagaagataccaccgcctaagacgggcaatgttgctcttcaagttggatataacaaaagccttcgactctgtgcgatgggattacctcctagccttgctgcagcgcaagggcttctcgacaagatggatagactggctaggggctttactgtcgtcttcgacatcccaagtcctccttaatggctcgccagggcaacggatcaaacatggaagaggactacggcaaggggaccccctctcgccgcttctcttcatcttggcgattgatcctctacagcgtatcctttccaaggcaacagagctgggtgcaatttcaaaattacgaggaagaacaactcggctgcagatctcaatgtatgcggatgatgctgtgatcttcattaatcccacccggaacgatgttgcgactttcgcgaacatcctacatcgttttggcacagccacaggactcgtcaccaaccttcagaaatcccaggttgcggctataagatgcggcaatatagacctggaagaggtcctccaaggcgttccggcgaagcgggcaaatttcccactaaaatacttgggcctcccgcttgttctgggaaggctgcgaaaaacggacttgcaaccggtctttgacaaaatatcagggagagttgcaagttggagggggaaaaacatggcagtagccgggagaaccacgcttgtaaagtctgtgctttcagcgcagccaatttatctcctcactgccttgaaggtgacgaaggaatccctggagcagcttgacaagcagagacatcgcttcctttgggctggtacgggggatatcaccggggggaaatgcaaggtcaactgggcaaagacatgcttgccgaccagccaggggggccttggtgtcctaagcttggacaagttcacaagagctctgagattgcgatggttgtggaacgaatggagagatccaagcaagccttgggtgggtttggaaacgccttgtgatggtgtggatagggacctcttcgccgcctcaacaaagataactgtgggcgatgggaatacaacgcgcttctgggactccgcatggattaacggccaaagaccaaaagacctaatgccgttggtctatgagatctccaaaaataggaagaaatccctacggcaagggaaagaagacgactcctaggtgcatgacctgaccctcgatgcgggttcatctatcacaatcaaccttctcgatcagctagtccgcctgtgggaggcggtacggaatgtgcacttagacagcgaggagccggatcagattgtttggaaattcacaagcagcggccactatacagcttcctcggctaatcatgcccaatgtttgggggcgccaaacacaaacttcaactccctaatctggaaagtttgggcgccagggaaatgtaaatttcatgcctggctcatcattcaaaatagagtctggacgtcggaccgactcgcgacaaggggttggcggaataacggacattgccccctatgtcgttgtgacaccgagacagccttgcacctcgtcgccatgtgtagatacacgaagagaatctggcgcctcgttgctacatgggtgggatatcagcagttggaaccggcccaatgggaggaagcctggtcagtccatcagtggtgggagagcctagctaacacacccggcattccaaagaagggccttcggtcccttatcctgctagtagtttgggaaatttggaaggagcgaaatcggcgaatctttgatcacaaagagatggcaacaggtgttctcctagcaaaaatcaaagaggaggccagcttgtgggctttagctggggctaaaagattgcgcgagctcatcccgcactctgtatagtgtatagtctaaagatctttttgttttatccctaggggttgtattttctccttctatattcaatgaaaaagcactgctgtgctgttttttccgttcaaaaaaaatatatatatttggtcaagacaagcctgcatgttatgaagatgacttcattgatattgcaagaaaaatttccaagaaattgaagggttttccactagcagccaaaagcgttggtcgattattgaagaataacctttctcaggaaagttggatggaagttcttgaaagaaatgagtggaaaaatcggcaaggtgacgatgacataatgccagcactacatagtagctatgattatcttccattttatctaaaaaaaatgtttttcttgttgttccctttaccctaaggaccactggtttaataaattagagattactcattttttggaagcattaggcatcctatgttatggatgtcaaaataacaaagatgctgatataggattaaagtatttggatgaactggtaggtaatggttttctcatgaaggaaggtgatgatagtaggccatattatgtaatgcatgacttattacatgatctagcacaaaatatttcgtcacaagagtgcatcaacataagttcatatagttttaggtctaatagcatcccgcaatctattagacatgtatccatcaccttacaagataagtatgaggaaagttttgagagagaaatagaaaaattcaagaaaaaaatagacataggaaatttacagacattgatgctttttggagaaagcaatgcaagcatggcctttttcaaagacttattaaaacaaacaaaatgtcttcgtgttctgtttatgcatgcagactcactcgaatcattcccacacaacttctcgaaactgatccaccttcgatatctaaagttgaaaataccttataacgtaaaattgtctctaccaaacgcagtaagtagattttatcacttgaaacttttggacctagggaatagaaattgtattttgccaaaagacattaatcatctagtcaatttatgcctctttcttgcttcgaaagaactttgttccaacattcctgggattggcaagatgaagtatttgcggaggttggaagagtaccatgttaagaaagagggtattgggtttgagctgagtgagctaggggatttgacagagcttggaggtgaactgaaaatatttaatcttgagaacgtgacaacaagggaagaagctaatgaagccaagttgatgatcaaaacaaatctgaaaacattgaagctagtttggagtgtggtgcaacggacaacacgatctgatgttcttgacggtctccaaccacctcctaatcttaaaacacttgtcataataaaccatggtggttcggttggtcctagttggttgtgcagttatatttgtgtaaaatacttgaaatcattccatctagagggtgtctgttggggcaatctcccactttttggtcaactggtgcagctagaggaacttactttgaagagtatttcaggcatacatcagttcggacctgattttggtggtgtaacacaaaaaagtatctcgcacttgaagaaagttgaacttattaatatgccagaccttgtggagtgggttgggggagctcattgccatttgttttcgaagattacaagcatcaagtgtgaaaatctatctatcttctatctatctatctatctattatctattatatactaaaagtccattaaacttactataaacgctcccaagccgccacttggcgctctaataaattagagaaatctaagaaattctaagaaaaaagcaaaacatctgatcctcgattttcacttaatacagcgggcccattattttacaccattagatccatattaaacaaaataaaccccatctcccaaaaatcctctcccgctcccctcatgggcctccactcctcacataaacagtacgtacatgtactaacgttcctccctcgcatcctctcttttctccattccattcatcttctatttttttagataataaatttattatataaaaataattagataactaaataattatatttatttgcaacatattatatttatctatattagccatgtgttttgatatatgagaaatacatcatttgacaaaaactcctacaaatagcaaaaattaataacatatactatcatgtgatcgcaaataatttcatgtcctctttgcttgctcaccttggcctccttaatttctagctagcaaataataaatatccattaaattaaacatcgtgtatcataatatatctatctattatatactaaaagtccactaaacttcctacaaacgctctcaagccgtcatgtggcactcctacatacactcctaagccgccacatgtcatatctctaaagattctacaaattttgaatacaaagaaaatatccgaccgtcaattttcacttaaatcagtgacccattattgccaaaaaaaaggctgaacgctattcatcgggaaaaaagccaaaaagaacgaacatatatgtacgctcacctcaagtaatgaaaaaacacagaaaaatagcataccatccctcgcctgatcttataaaaacattagactattacaattaaatttaagagatgtaaaacaactaaaactgatatttaaaaatcatcgacggttacgaaattatgatatgttactataaatttaccattagatttataacaaaactacaagaaaaactaattccatttatttatttcatcataaaaattataacaaaactaataatatcgattatatcatcatatataacttcataaacatggataacaaaaattatatctatgattattcgaagtaaatatttcattcattatgaaactgtgataagttacaataacattagagtcatgataaaattatcagattgtcatataaactactttcatgtattcatatttttaagtttattgtgaatatactaatttcatgtattcatatttttaatttttattgtgaatatattgcaagaaagaccagatacaaagctcttactatggtacaacctacacagtttatacgtggataacttaaaggtatcaagcatatgtcccgttaatcttgaatgtgtccgacccacttacaaattcttatccaccaaacatcgagctacaattgctaacaaggtatttgtgcatcatatcatatcaaatatctaatatatgatgaacatgtgtaccattagacgcatatagagataaaggacattttataagggacatttgctcatttaacccttttctaaagcttaactaccaatttgatccttttttaaaacaaggtttgctcatttgaccatgtttttcaacatcgaagttgtcgtctgaccctactttcactacatcctgagtttttcatttagaagaaaagaaaaacatgtatttacaagcccaaatgactaaaatgacactgaatacatcaaccttatcctcaagcactcatttgctcattccttatccccccgtctctctctctctctctctctctctcttcaaagcgcgaagggcaggaggagcggtggcggcagcacgacagcagctgcggagtgcccccggctgcttcgcggagggtaggatcggtggcagagaggcaacattgactcgccgacgaggagggccgctggcagtggtcgaagagacggtgacaactcggcagaggggaggcagcagctccatgaagggtaggaggggtggcgtcggctcagtgacgaggaggactgccgacgatggcgaatgggaggcggtggctgtggaggggtggcagcaaccacagatatggtaggaggagcggaggcagagggatggtgtcggctcagtgatgaggaggataggcggtgacggtgaaggggcggcggcacggtgacgaggaggaccattggcgcccacgcacatctccgccattagcttgctaataaggtcaaataagtaagggtagaagtggtatttggggcttttgttaactccgattaatgctcttaagagaagaaggtcagagtgtagcttcggttttgaaaagaagggtcaaatgagcaaagtgaccaaaacatggtcaaatcggtagttagatatgcaaatagggtcaaatgtgcaattgctccattttatattatagattatatcattttgtatcattttataaacatacaaagccaaagacacgggtgatttacttaatctatctaaaaaaacatgtctacggtaataagaatcatagatactgaaaagacagaaaaactcaagagcatataccctaataatacctaatagtaaataaaaattatcaatggctaatccctaggacatataaaattataaagtattattttactagtttattaaatgccctaaagaaccctcctacaacgtctattaaagcctttaacaaataagaggaaactttaaatttcttctgtaatagataaagcatctaaaccttattcctcattaatttaatgctcccattaattttggccattgggccatttcaatgggtatatgtatacacacattatttaataaaaaaacattcatccaagcatgttttctaacaaaaaattatttgagatgtcaggtgaggttgtaatgacctgttgcatggtttagagggttgttgtcaggatgactagcattgagttttactaggttgccagccatccaatgcatcacaaaaagagcccatataggagatatttgtgttttgttgatcgagccaccatcaagagaagccaacatgggaaccccagtacaaatattttttatgactaaatcttctcttaactcaagtatctatgtaatattatttaagtcgtgttggcttgaagcatgcataatttgataacatggtatatctagaaggctacatgttagaacattcaattaacccatcttggaaataataatacttagcaagaaatcaaacaggtaacaaatttctatctttaattttgatatttaattttaatcattggaaagggggagatagagtgaatggttcaaacagttatgttaatattgtccaatttgcaagctaaatgtttttttaaaaaaaagagatatagcgggttgattctgaagtattatcgtactattcaagagtagaggaagtagtaatcgtatccaaaatacatacaaagaaccatcatacataattttagcattcagagaaatagagatgcacgcgcaacgcgcgggctatcttcctagttgtcctaatttctcttcgttgctgcggccatcctcggagtgctctgtctctcatatacaagacataaacaccacatggtttcccaacttgtgtgatcttgacattcggagttgccccaagttgtccctgccccccatgcctcatacttccacgctgacacgtgttagtgtgagaaaaggtgatgaaacactcttgtattttcgggaagaagagctgacagcataccattatgatggtgctttggcactccacaacctgggtaaagtaaaagctatggaaattgtagatatgctgcattttccattggctgacctccaaaatctaaactgcctaacacgacattctttcgaggattgcgataacattgacaatactgttgttctccattcagttcagtcgctctatctcgatgattgtcatcttactggaaaatcattgacaatggtattaagcatttttccggctcttacctacttcaatttgagaatgtttggtgaaaatcatgacatagaggaaatagtgctgcaggccccaataacctgctcattgtgccatatgtcgatatcctccagcaagaacctagttctgccagttgaggacggaggaggtctgcaggaactctcctcactccagtcactcaggatttcagattgtggcagaatgttctctcgatggtgcatggtcgatgcaggagctcgtaccagcaagcccctcccttcttccctcagggagctcagtatttgtagagagtcaagcatgcagtcgatggctctgctctcaaacctcacatctctcacacatcttacactattggaatgtgaagacttaacagtagatggatttgatcctctcattacactcaacctcaaggaattggtggttttaaataattgttatgagaacaattattcttgttccatagcagcagatttgctctcagaaatgacaaggaccaaagtattatctgcaggttccttacaactggaagcacttaaggtggacaatatctcaggagtgcttgttccctccatttgcagcctccttgccgccaacctccacaagttaattttcaaatctgacttgcagatggaaagcttcgatgaagaacaagagcatgcgcttcagctcctcacctccctcaagcaactatattttgccgactgcccaagtctgctttccctccccgatgggttgcatcacatttcttctctccagaaattgcacatatataattgtcctaaaattggattcctacccaaggagggcttcccctcttcattgagagatctagtgttatcagagtgtagcgtcgatctacaagatcaattgaagaaattggagacatcaaacccagatttatttgtacaccacatgaggtaaaaaggaaagaaaaagaagtgttctctcaactactacttatttcagcatccatctgtaaccttcaatactaaactaaaactgctctgctttgtttcctactttgctgtgaaggatgggccgaatcagtctggagatatagcggactatctgcatccgcatgcgagtaacacaatagcacatgcgggccaaaggatcgatcggttcttccctctgcaacaatctggaaggttcttgaaaaaccaactttttttaattttatgtggtcgggaatttatgatctcctttttttagtgcatgcaagcgaccactctgttattcgcccatgtagttcattgcttccttcacctaaccaatgttatattaactgtcagacagttttggtaaccttggctagagactcagcatggtgataatgcatgcagcaggctgatagctatgcggtaaatttgagacgcgccttgccctggtctgacctctacaacatcagttacacctaggtggtcagtaacctctcctcaactcatctcgtctctctctctctctcttgatctctccaaaatagggaagttagaggatatgtcctttaaaactactccctcagtcccgaaataagttaatataatatggcatgtaatattttcaagtaaagtatgctaaaaaaaacaagtatgctaaaaatgactctaaagtatgtatagggtaaaagtattctaggcaatttttaaaatgcctctaaaaggtgtctacacttttgaactcccgaatttagagacaatttgaaattctcttctacaaaagtgtctcaacataaggtttttgttgtagtgtgagcttggcattgagtgtgtattctttctgtggaaacctatcaatccaaaagcttgtccagaactcatcagtttgacatggtacagtaaagttcagacctgcctgccagttcatgtaatcatttgctctttagcttattagccttagcgaaaatttgaatttcagaacttaattttagggttgattttattaattgttttccatcatagtttgttttctggcattgtgtcacgcccacgcctaccatctttcattggcagcttacaacggacaaatgaagaacaatagaacatcattgcttaaaataaagacagatgatgatcaaaagatcaccacagttgacatgagttctgtggagcatcgattccatttcatcatctggtatgttcatctatgtaagcagttttagatgacagcatcaggcccaaatacgaattatacccttacatactcttttgtccttgctctaagtagaaatttaacaaatagtatattatgattgaaacaaatgagtttatatgttttacagcccatctaaacttttcattgagactggtcccaccaactccaaacaacatagaccacacagctctactagactactaataaactggcaatggattctggtgttggtaacagaggcatatatggtctttcttctttttttttaattgaagaggtgcatatggtcatcgataggagaatcattttgagcttattagtttgttaagtcccatttaatcattcattatggaatgctaaaccgattgcacataatactgatataactggaatgacataatatttcttgactactagataataccccgcgcgttgctgcggacataataaataactttcaaacatgcaatatgtgcataacatttgagaagaaaaaagaaaaaactacttattaccatataattgatggagtatatacagtggtaattataactaaatattacatgatggagtatctccccaggtagcagtggttggccaatgcaactaacagaattacaactcaaatatatggctgttgaccggatagagcaagtattaataaacaaaattgaaggccactaaacattactggaaaatgaaaaatatacaccaataaaattacccaaaattatgtactatgtgtttatgaacatagcatgtatgaaaaataacagtagaaaagcaagtaaggtgtcatactgttgtcctcgttaacttgatagcctttattcagcatgacatttttcctagtaccgcttccctcgctgacccattgatctcagttttggaaattctgtagttaatcttgcaaatgaatgccaattgattcatgaataaggtgctagaatatcataaataattgtggtaagaaatgtttatttaactggaagtagcaattattatgcatatcttatcgtataaatatgcgatgaacattaggagcgcatttgtagttgcatagctgatcaggaatgtagtcaaggcatgtagcaaacctaggtgatgagtgatgactactttacaattacaaaactgataataaccataactgaaacatcaatattttatatgtttaaacatctacaaatatagtccaattatcactgatagcaaggaaatcataactaaggtgtcaaactattatataataatggtagaaaattttcatgcttgagtaagatatgggaagttgggaaaaggattattacctcgtatatataattaagtactcatccttgattaactctttggagtgattttagctttcagaaaactccaaaaatatttatatcaccaagctaattcaagagtgacaaaagatacttaaaaacatatctagagtatacatgatcagaaaataaaatgaactttgagacggaagacaacctaatctatttaagagcaaacctgtgtgtctgtgtgtggagaatctgacatcattcttgatgaggaccttatcaaaagtgaaaagcacatcaacgacatagatgtaccgagatatatatagcttcaccagttaaagaccataattaaaataccaaaagaagaaagctccatccgcttagcagcccatatgattgttacttagctcgatgagttcttagatctgatcgggtgacgacaaatcaaccaatagatgcatatttgccacgtcttcaaccacttaagaatgagaagtggtctataattcaggataaataaagaatatgaatcaactaaatcagtagccaagaacctgaaacctggaaaaagaggatacagcaacaataaaattctctgttgggtatcagatttattgaacataaggaaaggggaaatcggtaggtaacctgtgttagatcattgaagtaattggagaggatcgaccaggtgagggctgcatatgaatccagcaagcagagttgcaagaacggtagtaaaacgccagcagcctggtagagtgtggtagatcgacgaataagcgagatgataaattggatatagatgcagaactgataaagggataagaggagaagaaaacgcattaagccattaatggatttacttgataacagccgtgaagtgttttcctcggtggttgtcgacggttttcattaatcatggcaacctaaaggggcgaacaacctttagacatgggagaggaagggggaagcagcgcacgagccgccatgggggcgacgggaggggaagcgccacaccctcatcctgcctccgtgtggcacgggaggcggatgacatgccagcgccggtacgggcgagcacgatgcgggagatggagaggatcacggcgagattgatacgaagggggcggcggagcgagatgcaggagagggaatcgatgcgagcgtgcaaggggagaggagaggagcgatgcgggagagaggggttgatgcgcgtggggccggtgaagcagcgagatgtgggagaggagaggagcgatgcgaccgcttgattgagatcgaacggtggggagaaaatggggtgacgtgaagcaccaggaagcagagaattctagtagtgggaatgatttgtataggtatataggattcctgctaggggaaggtaataaacctgtgattccaaccacacaataatcttaattatctagactacagacactggtggagaaaccctttgtagtcccggttcgtaacccccctttagtcccggtttccaaaccgggagtaccaatccgggactaaagatcgctatctttagtcccgggtgaaataaccgggagtaaagatcgatctttagtcccggttggtaacaccaaccgggactaaagatcgagctgacctttttttttttgcatgcccctgttgctgcatggtttatatatatatatatatatataaaccatgcatatatatgtttcaatacatatatatgcatacatatatatatgtatatatatatatatatatatatatataatattatattatatgtatatacatgcataatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgctgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctaaaacgataaaagggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgtgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagtgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgatcttggcggcgtcaactttcgccttctttgttgcccttgtgtgggcaagcggtggagctgggggggcccttgactttgaaggtgccggaagaggagcttgcgggggagtaggtgtaggagcacgaggaggagtcggtgcaggatcctgaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagctcgaggtcctcgtacgcgccttcgaccaactcaacttcgaccttggagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttcaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgccctgagaggaggcttccactgcatctgttagtcgtcgcgcagcctcttgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgccttcccttgttcacctgtcttatatgcaacgaactcgtcccagtgatcccttagctttgggaatgtgtcgaagttcggtgtctgccccttcagtatatacttctggtacagatctcccttgaagctctgaaattgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctagttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcatgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaatactaaaatagtcatgtatatgctaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattcctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagataaaaaaaatgtattaggataaatgcgaagtaacatatatatatatatatatatacatgtatatatatatatatatatattgcatttcacgttaacgttcgtccttgttagttcgctcgttcacgttccctagctcgttcacgttcgttcgatcgttctcgctctcgttcgttcgatcgttctcgttctcgttcgttaacggcggtgtggcggcatcggggcggcggttggcgcggcggcgtggcgac

SEQ ID NO: 83119 - DNA, 933 bp, Oryza sativa
  unsure (1)..(933): unsure at all n locations
ccgctatgtgatctccatcttgttactgacccaaaaatgacctgagtatggagacggacgacatcgcaaagacatctacagctgggggacctctagaaggggaatagctctcttaaaagcatgatggccatagctatcctcggcgcccaacagtacttcgctcacctatccacacaacatacaaaccggagcgaagctacaatagccagagacgcctactgtgcgtgctaagacacattaaatgagaagcgctcactggccactttacaggcaagaaaactggctcgccagctgacttaacgaatataacatcgctcattaagaagcgtatactgaagtactcactgttacgctacattattcaatgactcaatattctggctggttctattgccgccagcagaatctgctctctcaaaggcaattatacacctattcacaatatcatgcaagaacacactaaggaacatgctatgctatatgacaccaataggccagcaacctgttagacgctcaagatggttgcgagcctcatagacctacaccacatgacaagcatgactatactggactctgatgtcagacgtggccatagccatcagaactatgaagataccaagcctgtacccaagcatgctctatcgtgcccttacatgcgcacgctgtcgtttaccgcaacctagacagctttctcccttgcagacagcgtggccacaccaatagctcacgcatattgtctcgtcaatcggtgcttgcacgcagcgtcaagctgaactgtatgacacacctgcatgctagccttacggtgagcctatccagagatatcgcatagaatacaacccgtatgacacgaatattatcccgtgaggaccancgagacatgatagcggaccacagattctgcgagcctctagatctcatgggtgccgacaa

SEQ ID NO: 83120 - DNA, 9349 bp, Oryza sativa
cattttttttctaatcaaatagataatccacggtagtaatcaggcgaataatctttttctaaggggcccgtagtttggtttggtcttttatgtgtttaattggatgttatttttactcagtaaattcattctatgtttattgcgtttgtacctacgtgttgtttttaataaaatctggccagtgtgtctttgctgtcctgacggaaaaagaaaaaataaaaacaataagaatccttaaattgtttattttccttttaaaatacaattcaaccttttttttgttagtaagagcatgttgtctaaccctcttatttattcaatgatattagcacacttggctcatggtagctcgttctttttttttttaaaaaaagaaaaacaaagcagtctaacctttcaataaatttctgcagcactgtcacagggaaaaaaaatgctatcccacagtatagacagttgtaaggaagaccaagaacatctagctcttctagatcctaagcttgccccggtgctactgttggttgcttaccgcattattgatacagacgacaagggcaacaccgatgatgaatattgtcccatagatgatgaagaggaagaattagatcacggggatgaaaattcacatgatgaggatatcgttgataacgataaggatgattgtgaccttggggatgaagatgacaatcacacgtgcgaaagagattatgatggaagcgatgatgctggaacggaggaaagtgatgacagcgatgatcaggaggaagatgacactcttttcttctacagtatagctaaaagagaattgctatccaaaagagtggatgaattcggcatccacttatattggataacagcacaaggctggttgcttatggtgcaccttgaattgtatgaaattttcctatggagtcccatcacaaatcaaaagatcaacctacccttcgatgaagacaattttcttgcgaataataatgtggtcaagtgctttctatcacataaaccttctgatccaaactgtatcgtgctagtagtaaattgcagggacacaatgttctggtattgccatcctaaaggagacgtatggttcaggcatgagtaccaatcaagtatgattagtacaggagaggacagagaaaatgttattgcaactgtgaaacaccttacggctgttggggggagattccatgcatatttaaatcaggataaggcaattttgacacttgaattcctgccaaagccaacatttacaactacgccagttaaggatgcaccagatccaagttattggtgcacgttttctacttgtttcttgttagaatcaggtggagagttgttcacgttgtcatttaaacatccaattgaatgtgttgataaggttatgcaaattgaagttcataaactcaatttatctcaaagaatttggatgaaagttagcacaattgataacaaggcatttttggttgactgtactggctttggagcatcactcaatgcagaagatgttggattgaagaggaactgcatttactttgtaagacctaaagataagggattatatgtttataacatggaacgaggaactaccaccatacacaatccaggggaagatctaccagataacattgcacttgagattgtgatgcctccatcttgaatccttcatgttgtacatatgttatccttttcttaagataatgttttaacggtatatcttggactgataagttctttaaatcactttattttttttcattttcatattttttattaaattaagaaaataataataagtaatggaaaaaatagattggagaatatatgtatgaaatttcttataattaattttaagtattggaactattagtaaaaaaaaattttctttcataatcttttgcagccgtacatgaactatttaaatttaaagaaaattaatatattgtaggggcctcccatactgttttccaataaaaaaataattgttttttatgaggaatacctctattactgtaaagttatgattaatatttgtgatgaacaattcgctatgcaaattatttaaccaaagaattggttttatagtatgtgtgaatgttggtgtgaatgcgtgtgattcatgtgggttaggttgtgatatctgtacccagaaacgattgttctgtctgattatgtgcagttggcttgaggtccgccttggtcaattgtgaggatcgggacaatgctcagggagaagcagaggtctaatgtggttaggataccatgtgagaaggtgactagagttaggattcttcgaggtcaacttcggtcaacggtggggatcgggactagtcgactcagggaggagttgaggtctagacgatcaaggataccagatgacgaaattaggtacgagatggcacatggcacatgacacatgatggatggacatcgtgtgggagagatcttcgcaacgggtttcacgaggtgtgtgtgcaagtttcggtgtctgcgaaggagattggaagaaattcgagaagagtatatggtgctacagatgggtgaggtactgtagcatgcagatacgtgtgtttacatgtgagcagtatatatgcatgtatgtatgcgtgcccatgcatgtgcatgtgtggctcagtggttctgcatgttgatgcggggacgtctgatgggcgatcgcgatccagcgatcggtcccgcccctcatttctccccttcctcctccccttttttttttcctattacagtacaccacacaaaaattttaaaaaaacaaaacgttagaaaaaatttatgtacaaaaaatttgaattcaaattcaaatttgaatcgggtacgtaaacttttgacttataaactttggatctataaacttgtctataaactttaggcctatagaaatactatatatgaaaaatatttaaatttaaattcaaatttaaatcggaaatttgaattcaaattcaaatttgaatcagatataattcaaattcaaattttaaatcgggtataattcaaattcaaatttgaaatcgggtatataaactttaggtctataaactttaggtgcataaactttagatgtatagaaatactatatatgaaaaatatttgaattcaaattcaaatttgaatcggacataatccaaattcaaatttgaatcggatatataaactttaggtctataaactttaggtgtataaactttagatgtatagaaatactatatataaaaagtatttgaattcaaattcaaatttgaatcagatatataaacttttgacttataaacttttggtctctaaactttagatgtgtaaacttggtgtataaactttaggtatataaatttactaaaataggaaagtaatgcggtgccaaaaaaggaaaccaggtggagagagggagggggagggggagggggagggaaccgatcgctctgggcgggcgagtgatcgctcgcccagtagcatttccggcgggggagcgcccgatccagctccgcccgcgccgggcgactggccaacagcattatcgaatactccgtccatccaaaaaagacaaaccctggtttccgtgcccaacgtttgaccgtccgtcttatttgaaaaaattatgaaaaaaattaaaaagacaagtcacgcataaaatattaatcatgttttatcatctaacaacaatgaaaatacaaattttaaaaaaaattcatataagacggacagtcaaagttggacacgcaaacccagggtttgccttttttttttggacggagggagtacataattgtttagaccaaaagaattcctcacttccggtccaagctctgacttcaggagtgccaacctggttgtgcagaaattgaatccaccaacctggtcgtcttgctggtcagcttctcgccagcctggccacctgcatacaacccttcgcgcaccgtcccgatctcagccatggacgctcgctccgccgtctgtcgccgcttccatgtcctacgcaaatgctccggcgcttccccattgtcctctggcctctgcatagaattcctcctttcctagctcaggccaccgccctcacttccatttgtttcctacgttgtcacgcccagaaattctcgaaccagaatttctaagctgaatgtgcattaaatccctgtccaggaccagccagggtacacaaacgacaattgttgacatacagatccacgtcttataaaaaaaatagaaaagattacaaatgcagcggaaaagataaaagcgagctaaaccgggaagcttgacttcagcagcgggtgtctccactccacaggcaaaccttgacggcagcgacgaaaccaacttcgataaaacagctccaactaggaagatcttcagctctggtgtgggggaaaagagagcaagactgagtactacccactgtactcagcaagtcataccggaagaggaggtatgatgcaggatataaccaaaggaagctaggggttcttttgcataaagcaggcatttcaaagcagtagttgaaagcagtaaaacaactgtagtaattaatcaatattaaccaaacactgtccaacgctacaccacgttgcaacaggcccaaccaacctcctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgccatgggtgcgaccagcaaaaccatgcacccacagcccaccattcagtgtattttaattaactaacaccattgcggtggcaccaacctaaagctatgccaatagacaaagtctaagtaataatgtgatccctttttgtgtactagttgaactaagcatggctaagcatttcctaaaccaacatctaatcattttgatacccaggttatcaatggcatagggtaaccaatatgtggctgaggaataggacccatcccacattacattgtaaaagaatgcaacatttaatagaaatgcgggatatttgtaaattgggtacaatatgatcaaatgtaaagcatgacttgccttgctctcgcactgacgagacctcagcaacgtcttcgagaaaccgtggatcgacgaaacggccgaaacctacgcgacaaacaaagcacacaagcaaaacaggctataagactactgaaacaggaaacaaaaccatttttaatggattctttgcatttttcttgatttactgagacttgaatggacttaaacggagctcggatgaattacttatgaattttagaagataaactgtgtttattactataaaagaaaagccttaatgtatttattgcgcaataagtcccagggctgacgtcagcaaggggtggggcggctgcgccgacaggcgggccccactggcagcggcacaaggggagagggagggggcggctggcatgtgggccccactgggcagcggcacagggcgggagagggaggcgccagccgggctcggctcggcctcaaagccgaccggcggccaaggcgaggcggcggcgaggcacggccaccgacggcggtgaccggcggtgcgggaagcggcggcgacggccgaaaggcggcggcagcggctgaaggcgacggcacacgcgcgaaggccggcggcgcacacgggagagggggaaaaaggaagggggagaggggattcctcaccgatgagcacgacggccggcgcgaaggaagaaagcggcggcgacgaccggcgatgccgaggtgcggatgggcggcggcggcacgctaggagaaaacaaagaggggttaggggtagggagagcgaccacggcggctagagcagccggccggagttgggtggaaatggagagctcaccggcgtgcgagggaaacggcgcttcggcgacgattggcggcaaccgaatggtggccgaggtgcgggcgggctcggtgagcgcgacggcggcgactgcgcggcacggcggtggctatagaggcggcggcgcgtggccggagacggcggtaggcggcggcgcaaggggcgagcggcgcggcgacgataggaagcacgggagggcgcggcgagtgcgaaaaacgagagaggaagacgcggggagcgatttataggtgcgggagggggcggacgtggccggggaggtggccgatttggccggcgacgtggggaggagagagagtgagagaggtggattcgaaatcgaatcccgccctctcgagcgcgcgcgcgggccgggagatgcgggggaatcggcggcgacgtgggcgcgaggtgcgggcgcggagtggaggcgcgacgtggagcggagaaggcggcggcgcggcggattcggcggcggcatgggcggttggagcttcggctccagcggccggaggtgggagacgaccgacaggtggggcccacctgtcggcgtcccgagagagaggagggaggggcggcttgggccggcccacaaggaggagggaccgcgggagagggatggactgggccgacggcccaagaagaggaaaaaaaaaggaggaaaaaggaaaaagaaaaagaagaaaggatttttcctgggattaaaattgcactttggtgatttttaattggttaaaattatttccaaggctctgaaaattccactaaaaatcctgttaatatattgtgacatgtagaatccaagaaaaattccacatgccgattccgattattatttgcatttattaattagggaattagctctaggttaattaagataatttcttcggacgatttatttagccaaatttttaaagcaagcaaaaaggggaaaacttcagggcgtgacatacgtcaacatgcatgcccaattcctcagctgcgcgctctttgccagtacctgtcgacccgcggcggcgcttgcagcacggctgtcccaggggcgtgcgctccgcccgcacaggccccctagacccaaaactctaacattatatatacaacccaataagtaaattggtagctgaacttgttccaaaaatcttttttttttcacatcgttaatgtaggatcgaatagcaagaactaagccaaccagagaggggtgaatggttgtagtacccaaaaccgaaacttttagcggaattaaaagttaccctcgaatttgatgaagatcggtctgaccggagttgatccgcaagtttgaccgtacctatgccgccggtttgaccagtatagatcgtttggtccaaacgctcgcgtagcctcctccttctctgaccagtataaacttgcggccgaaatgaccgatgtgacggcagtcagggagccctgcgcacgcacctactgctagcaggggaggtggtctgcgaccgccccgtctaatcgccattaatgaggggctttttgcctcgcatttgagctcggaccagttcttctcgcaccggtccgtatgagagatccccacccaacggtgggaatgaatggccggaagtcgtcgataattaagaaggaatgtccgcccgtgtctctcggcgtgatgggatgggcccatgccgcggtaaggcgcgcgtggctccacatgtcggaagacaagacaagcattaattgcctgtaaagaatattttccttacccttgaagctagttttgggcctttgtggtaaccttttaagatataaaaagaggtccatgccccagtggagagaggggcgaatcctagagaagaaaggcacttttattctcccacctaaatcaatcacacacaagagtagggtattatgcttccatagcggccagaacttgtataaacctcttgcatttccatcactctcgaggggcccaaccccctctgcctctctctccatcaactctcagacctacaaccgtgcccctggactgaactagaaagggggtccccacggtcccccgcttgaggagttcacccttcgacatgtatggtaggaggacaaaacaggttggcgtgggagaggatgggccggattggtttggttggatggtttgggggcattcttgaaaactttttttacaaatagacccgtagaaaaacttatttcaggagtggttccttttcacggcgccagtgtgattggtgccatgatcaagatggcgactccaatgtcattggtgtcaatgacctatttgtataaaaaattaaaaataattttcaaaaggactaaaatgcaaatatatttcttccaaataggtccttgacttcattggcaccgtcgtccaatatgacaacgctaatgatggtggcaccgagaaaagggtccatcctagagtaagtttttctagtgtatttgcaagatgaacttattcatttaatttgataaagaaggggaagaaaaatgtcatgcagtttggtgctgaagaaaaaaaattaagtcgttcatttagtctgagggggtgtaaaaattttgtgtgaactaaacggggcctgaatccgaagaagaaaataatgagttacattgaattcagtgaattcggagggaaaaaaacagaagattgaattcagtagttagctagtctgaatccgaagaagaaaattagtgagttactttgaataaagtgagttcggagggaaaaaaagaaaatttgaattcactggttgatttgaatccgaagattaaaaaaaagaagagaaaaaagaagaaaaatagtgagttactctgaattcagtgagttcgggggaaaaaacgaaagtttgaattcagtggttgatttgaatctgaagataaaaaaataataaaaatagtgagttactttgaattcagatttgaattcagtgagttcggaggaaaaacaacaaaagtttgaattcagtggttgatttgaatctgaagataaaacgaacgaagaagaaaataatgagttacattgaattcagtgaattcggagggaaaaaaaacagaagattgaattcagcagttagctagtctgaatccgaagaagaaaattagtgagttactttgaattcagtgagttcggagggaaaaaaag

SEQ ID NO: 83121 - DNA, 697 bp, Oryza sativa
tcctgcagcccactccatgtatggcttggtatcggatgcgtcaattggtccgtggctataggagagaaggacttaggcggatgacataatcttttgatagtccacatgctctacatacatagatatcccatttaaaatcatacaagtgtatattatttaaatcactaaatgagtgtcatcaatgtgttaagagcgaagcacaatcatgtatataactagggcggatattacgagtgcatttaaagatgcatattagttatccaaaacctctcgactagacagctagatgtgcgtacacaccaatcaaaaacttcattacagagcgattgcttggttaatcactaatcaattgcatacattgatatagttgatgcgcatgagggataacctgaccacacacaaagaatagggggggatgggaactgaacacttatggggagatatatgcgaagagatcctagatccatattgtgaattgtacgacgagagtatcccaataaacaggtgcttaccgtctgagcttgctgcgcgagctcctgcttactgagagcaactagctaggacatatactggatcgtattaagacatgactacatatggacctatatgcatgtgtacacattttctatgatgacaagatattgtgggcatgtgtctatcaatatacatatgcatctgcataacatatatctgtata

SEQ ID NO: 83122 - DNA, 615 bp, Oryza sativa
ctgcagccccactagccatcttgtcaatcactgagattagacctgagatggtatctttatctttatttccgagggcctcaattgccttctcaagtgcttcttttaggtatttcatttcctctttcttctgcgagtttttagcgaagatataaggcactaatgcgccaagtatagcccccgcagaccctgagaacaattgagactgactgataaaattcatgatagtatcaagagaaaaacaattggccctagcttcggtagcgtaaattttaacctcttgagttgaggtgcttcgcgagtacttttgggttaatgcgaaggttccagctgtagctaatatcttcgaaaatccctttagcgattcaccgagcgaagaaagttcaatctcatgcttttcagcatccaaaccgtcatatctaagtgaaaaattaacatcgtgtaagccagtgttttccatcaacagtccttatatgctttcaccaaaacgtctcatcaggccaccataagcacgatcgcaacaaccgagagcaaagtaaccacgcctactatcagatattctctcatcacccaaacgtctcttcaggccactaaaattatcggcgatatcgcaatacc

SEQ ID NO: 83123 - DNA, 903 bp, Oryza sativa
tatataagaaagttttaatataatgaaaaagttaaatatgcgaacacggcccaaatttataggttctatatccgatatctcttccacaggctttattttcctttttatacacatactactacctcagcggcgtttatgagttctgattttctttttttgttgaactggatcgatggaaattctgaactttgtacatttgtgtgtgtagttggtgtgctaaaattttttcaagtatacggacacacatttgaagtattaaacgtagactaataacaaaacaaattacagattccgcttgtaaactgcgagacgaatctattaagcctaattaatccatcatttgcaaatgtttactgtagcaccacattgttaaatcatggcgtaattagactcaaaagatttgtctcgcaatttacatacaaactgtacagttggtttttttgtctacatttaatgctccatgcatgtgtccaaatatttgatgtgacggtaaagttggaagtttgaagaaaatatcttgaattgtagtactacgttttgtgttctgttttctgggctcccgatgcattgaataagtgaaaaaatggggttgcaaagctgaagctaaaaccttgtaatcccttgtagaaattaggatatatatttttttgtcggggaaaagttaggatatctaggaagaggactatttttcgaggggatagggaagaggacactgcacacattcttttccccctcttaagttcatacgacttgtgacagtgaacttaggctgtgttcaggaggtgagttgggagctcacctcctgcgcacgtaaaacagagcaacacattttcttttgattaattaagtatttacctttttaaaaaatagtttaatatgattttttaaaagcgggctgcagga

SEQ ID NO: 83124 - DNA, 636 bp, Oryza sativa
gcgagttaaattgttactactacatagcccaccatatatattcacgttgagtcaggtaaattttaactgtgtgattcaccaactataatgaacatgacttagcatattgagttattcattaactaaaggaaacttttttttgctcatgccttaatttttttttgttattattattatcatcattattattattattattattattattattattattattattattattatcattattaatactattatcattattattattattattccgtcacataatggttttgcaaaattcaaacgcctacttattaaacggctcctgacatattgaccacacccacccactgcccaccacctgagacagcctgattttctgctcaaggatttataaatcatttaataaattatcaatagaattcatattaaaggtccattaattcacaatgcgaagttaactgcgggaaataaaagtcactatctatatagcaagcctggatccaatctctattaaattctccatgattagatctactctccggaatgttctcagattgttgacagctcaatcactaagtctaataatacaaagaacaatgtaccactcttctaacctataaatgtatcattaaatgatct

SEQ ID NO: 83125 - DNA, 4062 bp, Oryza sativa
attcctgcagccccgcggaggagcggggggaggaggtcggagaggtgcgggtagcggtcggcggcgaggcgcgggaagtccgggaaggcggagagcgcgtcggagagcggggcgggggcctgcgcggaggagacggcgaggagggaggcgagcgcggcgccgtccgacgaggagacggagtccgccacgcgggagaggtagtcggcgatgcggcggtgcgcctctcccatgctcaggtacgccgccatctccggcgcggcggctgcggcgccgccggggggtagggttcgtggtttcggcggcggcggcggcggcgatggcgtcggagtcggacccgaagaagggcggtttctgatttctgaagggtggtgacgatcgccgatcctggccgtcggatgggaaatcgatgcttgggggtagttttggtttttggaagcgatatcagatggatttgggatttgatttgcagtagataaaaacattttggccgacattttgataattgaaagctttattgttgcaaatggtagtatacaagaggccaagagcagagaaaaagggatttaacggcctgttcactttgacgcaaaaaaaaaaccttaccaaaatttagttgccaaaattttggcaactatgccaaaattttagtaggatttcttatatagttactaaaatttggtagcaaactaaatgtagacatttttttgacaatattatcaaaatttggtaaggttgaaaatgacattaaagtgaacaggccctaaaaagatagacatttctcagaaatttcagtaactatgacacaaaataagaaaagttatatgctaaccgacaggaaaccattgaaattaggatatgaagatgtaccactccatatgtgatactcatgtatattttagagaggacaaaaataataacgtagtagttataaaaagccactgttgggattggaaatacatcaacaaaagaacactttagctaggtcattctgtaagtcataaaattctgtttttctcactgcatcatgacacaagagtgcgaggggatggtttgtgccttctttttcatggtttaggtactcgcttttagtaggttttttttctcgtgcaatactaatttgatgcactacaccatattcacatcaggagtaatatttgtgtgatttgccctcgctcgcatggttgcctcatattggttagactatatatttgacggtcccattatatttcttcagttttcattggaaagaagaaattttgtttgttgaatacacgctccattcattcttccattcctcttcttgtggccgatacattttcgattgttatcttttagtttccactgtcaacttatcagtcgtattttgttatatgtatgacgaccttgttgttctcttctagcctccaccaactatgtgtatttacacctatgctataattttgcatatcaccattggttattgctaacattagccggttcttattggcgacaaaagtttggcacatctaatacaatttcggttaattgtccggtctatgccacagtgttcagtgttcgatagtgttgcaacttgcaagtgatcatcaagacgcaaggggagcaaggattaatttggaaattggaggaaccggccagacgaccactgtatcgggaagaactcaccgttagcttgacgaatggctgtgtagacgtttggtcggcattgtatcataatgattagaatgagaactgaaaaatcaggatttatctccatcgtcccttgtcgctttggcttggtcagagtgtcaagaaagtacatgtatttttgcttgatcttgctagatctcccttgtcgcttggattatcctttaatgtacaaagtcatatgtcaatagaaaagacaagagaaactagatatgaatgcctttttaacactaactaaaccaaacatgatgcacgtacggtttataaggatttgcaattttatcctaaatcaccgagatagattaaataagttcatagcgcaatatcatgctaacacatactgtataaatataaaagactttgtatgcgctcttcaaatcatgtctatatgactatatggagatagatgaaatatgaagaagagaagtcttttagattcactagcacataaaagttacctgctatcatactttttcatctccctttaaccaaattataagaagctaactaaaaatcttcaacgtttttaattaaaatcaatgttcaaagttaaaactaataaaatctatgaaagttactatgatgttgtggcctctcaggtccagttgctgatgcaaccgaataggtaggttttgtagtgcagcctagaacactacaagttctatcgaacaatcccatatgttaaaaaagatacattatttaagataacccaaacaaatgtgaacaaaatatcagatacaaaaaatgcagctaaggcctggtttagttacccaaatttttttcccaaaaacatcacatcgaatctttggatacatgcatgaagcattaaatatatattataaaaaaacctaattgcacagttagaggggaaatcgcgagacgaatcttttaagtctaattagtccatgattagccataagtgctacagtaacccacatgtgctaatgacggattaattagtctcaaaagattcgtctcgtggtttccagacgagttatgaaattagttttatcattcttatctgaaaaccccttccgacatccggtcaaacatccgatgtgacactaaaaaattttcttttcgcgaactaaacatgcaccaaggccgagtttagtttcgaactttttcttcaaacttccaatttttccatcatatcaaaactttcctacacacacaaatttccaacttttccatcacatcgttccaatttcaatcaaactttcaattttgacgtgaactaaacacaccctaaagagcgaaaaaagtttctacgtgtctcatcgagcttataaaaagtctttgcattcacacatatttctctccaccaaagtcaatcaaataaatactcatcatccattccgtgtggaaaagaaaacaaaacaaggaacggccaccaatcattccaacgatatcacatcatgcaaccaaacaaaatcaacaaaagcagaaaggacatttctcatgcattcactgtcacaacccataaggccataataacctgcttaaccacaaaagaacagtatagtctttcagcctctcctataagtactccccaactcctcctcctcggttttcatgccacgcttttcaaattgctaaacaatacgtttttttttaaaagtttatatacgaaagttgctttaaaaaatcatattgattcaattttttttaaaaaaattaactaaaacttaattaatgacgtgttaaacgctgcttcgttttgcgtgccggagacactcccgaacagaggctaatagctcatccctgcatcatcatcatcatcatgatcatcatgaatcaatcacccgccgtccgttgcatcggacggcggaggatcgccggacgccaacccggattcaaaacctttccgctacattgactgaccgctccacccccctgcaaaatccccaaactacccctctcctcctcctcctccttcccttgtctgaacggggggagctgtggccacacctctccccccacctcctcctcctctagggtttcctcccaatcccctccatggccaagaccaagcagggcaagaaggacgtcgaatcctacaccatcaagggcaccaccaagatcgtccgaggtacgggccgcttctcgctttcttcatttccggccaagatttgggtctctttagtttcttcatgagggtttgtggtggtggtgtggaagtgggggattgcgtgctgatgcgggcgtcggacacggagaaggcgccgtacgtggggagggtggagaggctggagacggacgggagggggagcgtgcgggtgcgggtgcggtggtactaccggccggaggagtccagggcgggaggaggcagttccatggcgccaaggagctgttcctctccgaccacttcgacaccca

SEQ ID NO: 83126 - DNA, 511 bp, Oryza sativa
  unsure (1)..(511): unsure at all n locations
acttccattttcaccgctcaagccacgcaatcttcttcaagaagctccgacgatttctccagtgttccattgatctactacgaattactttgtaccgttcaattgttttctccttttttttaatgacaggtaatttgtggaagggttttttctaataagaaaaaaggggggggaaaaaaaattttaaaaagggcgcgcctacaagaaactttggtaagtttgcggtttcatgtgcaaggcaagaaattgngcnannnnggagcttnaaaagggtatgatggcatggnnncaaatatgtnggattttgtattgggtgcttttngctccccattttacgaggtatatgtgctaaaatggcgaatatgtgatattctggggtagcctggcatatatttgtcatgattctgaccataagagggcgttgctagtaaatcctgaggctagctaatattctgaattagtggattgattctaagtccaccttagcactgatggggcataacaaaatcca

SEQ ID NO: 83127 - DNA, 2466 bp, Oryza sativa
cagggtgcatgaccatctgaggtttctttagaacttgatgctctgtgcctaattattctctgcctttctcaaacatatagtataaagtgtcagttacatggtcttctgcggatgagatatatgactcaaagaacactttagagctcatattgctgatggaacgtgctagtttctttagtgattgtagccgcttttacattattgtcttgagctctgttttggcaattggcaatttggcatgtatattgttcttttgcttggatttttgaagtattggcttgggctctgtttccgtatgggatacattgggggtgaaggtgccgttcgtgttctacaatatttgtatattttgtctaagaagagtttagaaactgacatgagtacatgactaagaacttttcacaattcgtgcccttccctaatccccaataaatgagtgacgcctgttggtaatgaaactgtcatctcgtccatacatcagtggcaagtatctaacctacctaggatgatgtcaacgaatgcatacatggtgtatgaagttgtaggcatttaatactacatgaatgcacaaagtaaacatcattacaatcattgatcaatttacatacttattgatgtttcacttatatctgtcctgatattatgatagttatctttctgttttcctacttctgaaagcaaacctatttgaaacggatgaatgggtgattcctgtgttgcccttcagagtgtttgctgcaactaacatgctgcgttctgtcgtatttcactgctcaccaggttgtctgctgagcattttttttgcgtgtacttcattgttagatcagtcaactgttacttttctttaaatacaaaatgtttggcaacataaatgctctattccgcatgcctatgtgttgtcatgcactcatgctacacagtttccaatttgctgcaccatttctccaattttttttcttgtttattattgaatattcaacttttaacttgtgcaggttccatccatcttgtatgggaatgaccattgagcaggccaaaaaattagatcatttcctgtgcgcagattgtgtcaaagaaaatggcacgaagagaccttcaaattcatatccagcatcatcaaattctgattctaaggttggttacttaacctctatctcttgactgactgtctaccgatgttctgtttgaagataacttatctttaattctttaaaactttaagcgcagtagaaatttgatttcattgtaattacacttaaaaaaaaactagtgtcttgtttttgcttctcaattacacaggtcattatttgatgttgacagagaaatactcgaacttttttttcaaactttgctgttatgaactccctgaaccgatgcatgcatatgtggggtcttatgttcttgcatgtcttatccttgtcaaaactaatccacagtattgacatcaatttatcgttttcttcattatgatttttcttgcaccttatttcccacacaagtaagttgttgagcattatgttttcaatttcctatggacatttgtattaggaagaaaggctatacacattgcctttgcacaacatcaatgatgttctttattagcatcgtactacgctgttattgataataaattaatttatggtttggaaaagcaagtgtacactctaccattcgtgtttccaagcttctctttgaaaatatcagtaaaaaccttgcaaatgaatcatatggaaacagcagctagttttgtaacctgcaagatacattttttccacccatcagcattttcgatgggcatttcactcagagtaatttcaatatataaaatttctctcacctaccaactgcaggttgagccaaaaaagcggaagaggtaattgctgtgacacgagccatccgtggtgaggagatgcactgtttatggcgtcagctcttcattgctggtgcaaagtcaaaacgtggagggtgtacagtgcagatgaagagctaggctaggtccaagatcgcgttaacttatcatttgcccgaatttgggaacgtttccatcagtctaggcaaaagaacgaacttcattgatgctgttggctcgttcagttgtagccagtgtggactggatgagtgtcagcgtgttttagctttttgcctggtacaggaaaacgttcccagcgtggatgatgttgatgatagcttaactgtagtttcataatttgggtgtccctgagttctgtgacctgtttattgataagtgaatgccgcatgatgatgctgttgctgcaaaattgcaatctttttagtcgatggctcaatgccgagtctacatgctgaaattcacattgtttactgggaagaagtggactacgcacaactaagggtgtgtttgaggagatggggaagatacgcaaaacgaggtgagccattaactcataattaattgagtattaactattttaaatttcaaaaatggat

SEQ ID NO: 83128 - DNA, 502 bp, Oryza sativa
ctccccatcaccccgcacggtagtgcctccctccgatctccctcctcgttccatctgctccccttagactgggtagtagcacgagtagcctccccgtagctagctggcgccgccccgaccgttgtgtgctcgcctccctctgttgtccctcctcggtccatctcctccccttagactcgctgcgtgctcgccgccgctcgctgtgaactcgccgccgtcgccgcctatgctccgtagcgccgctcgacgccgggctcgctcggcgtatctccgcccaatccgacgctagcaacggattcccggagtcgcgtagatgctctagcttgcccgaattgggctcccgtcgcgccgtcgccgtttccccccttctctcgccgccggttgccgccgccgcaatccaccgcagtcgagcagcccccggcgaatacgagtcattggctcgtctcccctagtcccgtgcaacctcccggggtgctcgcttatgcctgtatcgccgtggatc

SEQ ID NO: 83129 - DNA, 22445 bp, Oryza sativa
tccatataagaatgttgtggatagccagaaggcttagataaactttaagtaaactcttaatgccttgacctacaatcacattcattaccatttacctcttgggttaatgctttcaatggaacttatatggaagtggatcatagactttcattgtaaggtcaacgttcctccttgtttcatgtactctgttagccatcctgttgcctgttgtcctttgggccaaagcacaaaatatttttttccaactcgccttttctgataacttgacaggaaaaggtttggtcaccactaaagggtttaaaggctcgtttgctgatgctgcatcttctgctaaggtaatgattcacattacacatgttcattttgcagcagatgtttcattgttcacagctcatgccattattttgtcttttgctctagatatttgctgttcttgctggtgttcaaagtttggttgcctgcactttgagacaactacgtgggaaagatgatggtcagtcttgatatctattgtgctcatttctttctctaggaaaccatgtcccaatccttaggatgtactacaatcaaatgtcaagtacaatcattaacttgtgaatccttttatatctgcagttctcaatgctggaattgcaggctgttgcactggccttgccctgagttttccaggtaacgttacaacacacaatgtagctgtgagtgtgaactgtttaaatttacaacttgttcctggatgtcctggctaggactggtattaatatcaacaagagcaattttcattatgctgagttatggaataggtgatctcaaacggtcctgacattgttcattaagaatgcatgcagcccttttgggagttattaatctctggcatccgtttcaagtttgatgattcaatctctacaattttttcattttcatgttcccttagtttgttcatataggcatttgtatctttatctcctatcttgttgataatgcgtcctaaactaatttggtttggatgcacctgaaatatttgtttattttcactacagttgttattatttttgttctatatttcatttttcttgtcttttgctgtattggtgtgcacacagttttgcatttagagttgtccatttatgtcttcatttttgcactggtaaaatgaagcactacaaaatcgacaatttcttgtgagatcatgagtgtttcttatcattattgagaacacacttttgtcctgtgacaaaatagctccttattcgcatgatgataacattactattaacagtgatatcggattatcggttcttcctatataggaaaatgttaacaaaaagatcatagtttcgtacctattcattaactgatggtcctttttcttcttttggttccaggtgcaccacaaacaatgattcagagctgcctgaccttcggaactttctcatacatcatagagatgctcaataaacaggaacctgcacttgctcgtccatctatcactggcacgaaggatctcaaggctggacacagagttcttcctcccttcacgctccctcttccgcaagaggcaatggagggtttttcctcgtttcaaaactttttgtcgaagttccaagggaagtgaaccaagtgaataacctcaagagggatggtgggtagcttcacctctttcctccgttggattttgtccgtgtaaatgcctcgtcttgagtttctcttttgttccacgagtgtaatgttctagggagtgacggattatgtgaatgttgatgtcattcttactcttttgaataacagctctgtgaatccttatcgtgcttcagctagtgttaatttgccacttgcttcaaacggtttctttactgactcgttgagtacatgatttgattattcgtggtttgttcgcagtagatgttgtcgacactgtcagcgagtttttgggaaaacattttgtgaaagttgaattacggcatagccgaaggaataacagaatcgtttcacactttcgtaacaaaggtcttcttatcatgtttcagacgatggaggcaaggctgatcaaagtgatcaagcacataaacgcatttttttaccatgtttcactccataagcgtctgagattatcacaagtcacgtctagtagtttgatggtacactagtgacaatcagttcgtgcagacagagctcatacttgactacttgagcgattacaggcgaaagtgtgaaacgcatgtgatgtgggctgggaggaggagaatatatactaatgggccgtatcctgatttgggctgcgtcggaaggtgcagcccacgcgcgccgtaccgcgcgggtggcgctgctacccactttagtccgttggatggggatccgatggtttgcgcggtggcgttgcgggggatgtttagtaccacatcggaaaccgaaagacgatggaaccagcttataaacccgcgcgctgtagtcagcttgtctcttcggagacatccgataaaattggaacgatacagagaagattagcatggcccctgcgcaaggatgacacgcacaaatcgagaaatggtccaaatttttttgcgaattctggccaggtccttgcgcgttcggtattttgttcgttattttcgttgcacatatgcccctgggctctgatttcttacatccaggtccttcaagctttgcactttttccctcaaagtttccagatatcgaattatggccaggtccttgcgttcttcattttcgttgcacatatgcccctgggctctgatttcttacatccaggtccttccagctttgcactttttccctcagtttccagataccttacagatacgcctctccttttgcaccctcatctttttgcaacatcctacaggcaggtccatgtcggttcttgatgcgatcttcaggcttcttactgttgtacacaattcactatttctttgcaacaagatatatacggctgtgccttttgtaaccccttctagtttttttaaacaagtccttgtgggaatatggagttttcacttgtaactttctggtttttcgttctccatgattgaacaatttgttcgtttatgtttgccagaagtactggcaaatctccattcaagtgtgcaatcatgtgattggggtgatttttcctcctaagtttttgtttatttccatcggagcataacgccatttttccttgttggatactctcaattgaaatcctctactgttcttatgggagagtgactatcctagttccattttattctttatcatttatcaatttataacaaacaacatctctagaacatattttacctgttttttagaggcatttaactttttgccacttttaagatgtggctattaaggatttgccactcgtagcttagtggcaaatccttaattgttactggtaagtgacaaatagttaattattacccttttctatactaagatataaaaaggaagaatttacccttccaatccaacatgtgtaatctctgccgtccatctgcatctgtattgccctgatctgatccctaccgtccaccgcgatttaaccctctccatctccaccgcacgaatactacgcctccgtgcgaacaccgcacgaagatgttcgcacgaagactgcacctttgcagtactcgctcctcctctcacctcctcctcctcgcgtgtattgctgccgtcggagtgagttcttctctagccgccgccatacccacactccaccgctgcccccaccggagctgaggtcttccccagctgccactggagctgtggctgaccctttccgccaccgccggagccgtggtcgtcccttccgccgctgccgaagccgaggtcatccccagccgtcgacggagctatgactccaccactgcactttccccacgctatgattctgccgccgcgctacttgccgttgcacgtccttgctccgtccgactcctcgcttgtccccgccaccgctgcgctacaccgcatcctgccctcgccgacgtcgtggtcattcctgacggcaaggtccttccccaccaccgacgcacttcaccgcaggcgccgtggtggttcctgacggcgaggtccttccccaccgccgatgcaatccagcacaacatgcccccgccgacgtcgtggtggttcccgacagcgacttacttccccaccaccaccgcactctaccgtagcctgccccaccagcgtcgtggtggttcccccttctaccggagtcccatttgggactgcccctgatggcaccgtggtggaatgcccttccgtcggacccgctgtggaattcctcgttcgtgggtgcgcaatcgtcggcctcaaagccacttctttttagtactcataaaaggagagaaaacctgaaaagtagaatgcaagttcttgcgccaaattcatctgtgtgctcttcgttctactttcgtgcgattgtgtattcgctagggaaatttcactccagggcaccgggatcaaggatccttggttacactcaggagatcacaggtttgtaagatcgccagcaagaactaagccaccaaaggggagtgaatggttgaggtactcacaaatcaaaacttttagcggaattaaaagttactctcgaaacgatgaaggtcggtctgaccaaagtagatgcaccggtttgaccgcacggagacctccggtctgattggcgaagtagcttcggtctacccgcacatcgcgctgatgtcgcttgtcgttgccgccattctaaccgccttaaagccaccggtctgactgccgcaatgctgtcggtgtgaccgccgaacccaagcatatacaaattgaagatatttcaaaagtagattgaacttacttctactcatgtttacaaagtgcaacaacaacactcctctcacaaatctcgactaaactcaaaatactaacttttttctaaactcaacttgcacaaaatcgatgccgggaagtctcaaccccctctctatttatactcgaagtaagcagtctaaaaccacaaacccaacttgtacaagaagtcctaatctcctaggaaaccttcccatacaataaacaaactttataaactacaatcataccaaatttggactccgcatccatacgcacacaatatcttcatggtataccatatggaatcttcaccaaccatgatatcctgatcgtctggacatcatcttcttccaagttgactcccgatcaatcactagtaacactctccccaggcattaagagacacctacatatgaatcaaacaagatacaatatctgagcacaagtcctctccaacttgacttaacattagttcacaacagcattacatatgctgtcggtgtgaccgccgaacccaagcatatacaaattgaagatatttcaaaagtagattgaacttacttctactcatgtttacaaagtgcaacaacaacactcctctcacaaatctcgactaaactcaaaatactaacttttttctaaactcaacttgcacaaaatcgatgccgggaagtctcaaccccctctctatttatactcgaagtaagcagtctaaaaccacaaacccaacttgtacaagaagtcctaatctcctaggaaaccttcccatacaataaacaaactttataaactacaatcataccaaatttggactccgcatccatacgcacacaatatcttcatggtataccatatggaatcttcaccaaccatgatatcctgatcgtctggacatcatcttcttccaagttgactcccgatcaatcactagtaacactctccccaggcattaagagacacctacatatgaatcaaacaagatacaatatctgagcacaagtcctctccaacttgacttaacattagttcacaacagcattacatatgcataatattcatctagaattcataaacataaattaatcacaagtataaaaaaacaatccgaaaccagaaccgacacagagccgtccgatcagaccatcgggctggccgatttgactgcacaacacacgtcggtctgaccagacccaaactaacaaaactcattgttcatcgtcaggtcaattcatcatcagaaaatcttcaaaaccaattatcttcaaaatcaattgttcatctcttctctattattataaaaattgaaaatgtttccgccaatactttgtacgttgtccgtatttgagttggttattaaattcgttcacttttgaaaatgcaccaggagtcgtataagaaatccttttaaaacactcacagctaacttggaacgagtaccgctaattgctttagaattcttgtcaggccctaagaaagcaacgtacagtatatgaccataatcccaacaaaggttctaaattagatatcaatactatcaaaatagaaatctcatatactttttagataaaaaaaataacaataatacgattaaaatagccttcacccgtttcaacgcacgagcctttttttctaatcacaaaataataatcaaaggtcatcttcgcaaatggtgatggatgcacactccgctttcatgagagagagagagagagagagagagagagagagagagagagagagagagagagagagagagagcgcgtgtgccagcaccaagaataacaccacgacgaccagcgtcagcaggcggtatagtgtagtactcgtacatcaccggcgactatgttgggcgagtaccagttccaggacaaactcgtgttgctgtaatgctgcccacacgaccggggacgggaagatgcccatgatgcaaaaggagcagttgtaagcactgacaatggaggatagaagaagtaacacgtggggctgaacaaactagacataattttaaccctcattttataagaaactcagtgagggcttacatagttctaacgatgcttgtgggggcttgagcccctccgtgcccatagtagatccgcccttggcgtcggggttcgcctggccatctggatcgttcgagaggaggtggggagaggtcgatgtgtgcaagccgggatgggttcgaatggaacaagcaagtcagagggagccgatcgagaggagcgatgctgattcgcaactacagatgaccaaatgagccacccggcccgtgcacgaccaggcctaggcccgatataagttgggcaagcacaacccgcttaatgaccgggtcaggttgtgcccgcccacgggcacaacctacggcctaggcacagtcctataagaatcggaccatgctgggccggcacgtaggcacgaccaacacactgtgctcgtccttagaataggtttattttgcattcctcctctttgggttgtgccctatatatggcttgaataagtctagattgcctccctcctctttggactgccttatacacatctgaataagtctattcgcctccctcgtgtgtcgtgccatgcgaagccagcccactgtgccaaggtagcgcccccaggctcagcccaactgtcaggccgggccggcataggcttgacaccaattaggccatgtcgtgcctggccggaccaaaaggtcgtgccatgggacgggatgtcgggccctggaccttttggccattatattcgcaactgcgtcaagtcaagcggagcgaggaatcctatctcacacagacgcacgagcaaactaactcgcacgtgatttggatccactaggccccactctagcctacagctctacactgcagtagcacatttctttttttcctttctttcgcgtgattttttttcacacgtgcttatctccctctccgtccttcgtttttgcgtgcaattttttttctcatgtgatttttcctttttctcacgcgattttttctctttttttcgcaagatagctaggtaagtttcaacctcattttattttgaaaatttttgactcaaaatttaaaaacttctaacacaaaattgaaaactttcaattagaaatttgaaactcttaactgaaaatttaaaacttttgatcaagatttgaaaactttcaactaagatttaaaatattcaactcatgatttgaaaactttcagcttaaactttaaaatttattaacttgaaatttaaatatgaaagataaattttgaaaattttcaactcatatttgaaaagtttcaacttgatatttgaaaactttcaatccgagaattgaaaacttttaactcgagatttgaaaattttcaagtcaagatttaaaaattttcaacacaaaacatttgaaaaccatgtgttgaagattaaaaaaatcgtgaaaggaaagaaaagaaaaaaaaatcgtgaaaagaaagaaaaggaaaaaaatcacttggggggagggggccagctggcgcacgcgttgccgcgccaatttgccacacccgagcggagcaccccgtcggatccgtacgtaatacacgcgtcgtccatcgagagcggtgctgcagaggtggcgtgctgccgctgggatgcatcaattttttttatttacattttgaggcttttcttttcatcgtccgctctgttccattcgccgccgtcctccattccgttcttcctcagctcccgtcggtggtgcttgaaagagtccgttttggtgctggccttcttcaggtcgtcaagttcgccttggcgcgcggtgcttctcttcttcatcgtcaggtggttccctgcgctctcttcatgtcgtcaaattcgtgtcggtgtctcgtgctgctctccaacttgctcagatagagatagttcggtgctggttttcttcaggtcgtcaagttcatctttgtggtacgtgtttctcttcttcaggccgtcaagtgtgtcttagtggaagttcaagttcgtcttggtggttctctgctcttttccggtcatcttggtgtctcggtgctgcccttcaacttcattgccaggttcggtgctggtcttcttgaggtcgttaagagttaagttcatcttggttgtgctctttttcagttccgagagttctcggtggtcgtgtgtcgtgaagcgtcaggtcccattgttggaacttggaagctccttgaagaagaacgtgtcccggttttgaggtagaagaaacaaaagctaagcctgcaaaacatggcggcgagggtgagctgggaaatggccgcccggcgtcggcgtgtggcggaggatattgctccgccctacgccgtgctgttgttcgtcttgctgttggcgtgctgcgtgcggcgccgccgcctcctcctcatgccggaggatttattccggatcggtaaccaatttactggtataataaaacatccggattagttccacaactcttaactagtggattgattctcggtctattattgtccatatcatgcggtccggaataaatcccgatctctcgttgtatctataataaatttcttactattcttgtcactcctagccaggattgaatcatcatgtaaccgaacaagtcctaaggtggtcgtctcctttttaggcggagagggatgacacatatctggttttgccacaaagtgcctcagttttgtaagttgagggatgacacatattttttcggttctggataattttgtaatttggaaacaagatgagggaccttatgtatactttttacacttttatgtcgggttttgtaggcctcctctctcttttctggtcgaagccaaattcagggagatgggcctcacagcccacgttcacgtttattttcttctcaaattgtttttttttatctatatgtactaactttattttcttctcaaatccggcctctacaccaacaaggctgtacacaaacacaggaggtccttcagtacaagtttgaactttacccaagatcacaactgaaagggaacactaaggctctaacccgaaacaaaacaacaacgaagtgcatcgaccaaaggacatacacggctgcaaacaagaaaagccagcaaactatacccctcaattattttcctcatgttccaacccttagcaaagaagtgcacaacggtagtctccaacagtttgcaaccttctttcatcaagatgctttctccctcttttaataaaacagactactgtctcattcaatatattttcctgaaaatgacatttaattaacgaagttgatttttatgccattgagacaatgccatttctagagatccacatcgcccaacatatagctgcaatccaaataaagagatttagtattttagcctagattaatccaaacctttgaactaaactccaaacaagttagcaaccttatgaggcggtttgaaccagaaaggtaatgaaaatgacacatttgaaacacatctaaccacatatatggcaatcaatgaaaagatgttgtatcgtttcatcttgattacaaaagagcacccaacatcgtcgccattccatctccgttttgctaggttatcctttgttaaataccactagaggattttaatttttaacggaattctcagcttccaaaagtggattgatgataaaaatgggatcttcagttgactgcttcttgtttctcttgttgcatctggcgctccatcacatttggcttcttttatagtaacagagaagggaaggaccagaacagaaaaatgaaaaaaaaaagcattgcaatgttatactttgccataccttttatctaaaaactctggctacaaaacatcgcgtggttcgctgatgggccggtctgtgttgcttcagcgatcagcaccgcaagtaaataaagagagccgccggaatggctcaacgactgatacaacacgagctgcatgaatgcacggcgtaactaatttggagccaaattagtcatgggattagctttccggccggatagaacatagtacagaaacgagggtaagcctcactacaccggattaggtcacctgtgatgggtcctaaccatcacctttgaagggccggtttgggcctagtcagagactaatggtcactgttgagtctcagtcacctttgatggtgcccgttagaggtatcaatcacctctgatgggcatgtatttcatgcccgttagaggtatcagtcacctctgatgggcatgtatttccgagcccgtcacaggtgatgatgaccacaccgcagtccgtggttgcaaccccacaggtgacttatctttgaggctgtgacgggtgcattatattcggcctgtcataggtatatcatctttgacggggtatagtatcaaagctgtcacagatgaggtcacctgtgatggattttgttatgacccatcagtgatgaggtgaaattcgaaaaaaaaaacaaattcagaatattagctagcctcaggatttactagccacgccctctgaaaaacagaaacatcacaaatatatgccaggcaccccaaatatcacatattccccattttagcacatatgcatcttaaaatttacatcattcacatatgcagttcaaatgccacatatttgcacaacacattcataccacattaaagccacaaacttgcacaatttcttgccttgcacatgaaaccgcaaacttaccaaagtttcttgtatcctattccttttgaacctccacaatgacctgtcattaaaaaaaaggagaaaacaattgaacggtacaaagtaattcgtagtagatcaatggaacactggagaaatcgtcggagcttcttgaagaagattgcgtggcttgagcggtgaaaatggaagtaacggtgtgaaattttttagggtggtggttgttatttgtaaacatgtgcttaatagtcgaaaggataacactagcaagttgcggactgaaagagataattccactgtgttatataacacatcggaattgggggagcatgtgttaacagtgaaatttggcaagatagactcggatttggagttggatatcgaaacggaatcaaaggagattgatttttgccaaaacagactacgcatcgacttgaaacagagtcggaatctggttgagccgatctggtgggaagccgatacagcctaacttgggctcggtttgggcctcaattgagataactatcattgccgtttagagatagatctcatctaaggcaattgtatctattaattaggatatttatcttggtttgggcctcaattgagataactcttttcttttactttccaacgagttcttgcttcaagtcggggtatcggctgcgatctctcgacaagtggtaacttgtcttgaaggcttgcgctatcggggctattatatcattttaatgtatcaatcattttattgtggtcatttttatcacatatcttagttaatatagtcttagtatctcaatttagtcatatcagttgattctcgttttagggtttttgtcggtattggcttaaatcgtcttactagattagattagctaaggttctaccatcccgaaaagttgttaactccttgattgttttgactttatgtttctctgcgtattttgtgatgcatcatccctagccgtgcttagaatcatagaaactaatccggagttaatcataattaaggatagtatcggagtttcagccgatcttacctaatatacatgacaatgcatgtttcatgatctgtttatgaatatttgccacttatatagatagattgatttatataaatgcatcaagttagattgatctctcttaaactttatatctggtgatcgattgttatttggtacgtttatatagattgatttctttatataagtctgtattagagtattagtcaatacattatttgtttttgctctaagtactggtctattgactattttttataatactgtcttaaaatgattgacaaaaaccaaagagatggtattacaaccgttagggcatatttagggtttgcactttatctattcatctaaaagccacaaccgatttggtttaactgcatcggctgggtcctgacgatacgtcatcggctctatcggccgatcggctatcgttcatctaattatgttttctgttttatcttgctgcttgccgatctcctgcaaaagggcgtgatcgatagtcactcggttcatcctttttgcgcccaggagcttgaaacgacgaaccatatcctcctacactgtgtgttcatacgtcaagtctggcgcctcgtcctgtcttctggttggcgttggctcgccccttcccatggctgctctctttaggtctggtggccgtcttctagggcctgtctaccaaagtgtcttcgcaagggctttgacactctggtcctcctggtatcctggcagctgtggaaggagcggaaagccagtgtttttgattcgtccctttcgccggtctcggtggttctggagtccatcctttagaagaatcgtctttggtctcttgctagtgccgcttcatttggggacctgttgggaacatagggcagcagttactccaccacctctctccctctttataggagcagcattttcagcttgtttttcctcccttcgcggtcctttaccttgcatgcggcaagggtctatctgatttattgcgttgtgaaactaaaactctattttcttctaatatactgacgcatagtatttttgtgcattcatgaaaagaaatctgttttaaggagcgatgcaatattgcaatggtgtgtcaagattatgttccgattaacatttgattagaagtaatcatctgaaacctaatcacattgggcattcaggcatgcaaattctcaaatttgttaagtgtgggcactatatattttaactttcgttcaattcatagcgaacgaaaatcgcgcgcacttccgatggaaaatcccgtgagaaaaaaaaatcaacgcttctacattgatacggtaccatgcaaaaatcgtgcaaaaaatcagcgttccccaacctttggacgcacaaaaaatcatcgtttaaatggggaaaaaaagggcagggttccacgcctagagagagatcaaataatatggcagtaggggtagctcttctagcgcttgttcctctctacctttttgatgaagtttctggtgcggtccagtgtgatagcctggccaattagggcaagtattataatgtttcatatgctgcccctaaatgtgccatattggattgagtgatgaggtagaggagataagtgaggagagaaatggtaaaccacccctaaatgaagaggcaacctccacacaaattttaagaggggtgtgagagtataagagacattggtatttgtgtactagaggtgacatagtgtatagattgcctcttaatttatgagtaaatgatgtggataaatttagatgtggtagtcacatctaccataacacttgcccttaggataaggtcagtatagctcatgaaggtgtgtgcatatgtttagtaccaccttattagtttagtaagggtaaaatcaacttataagtgctcttcctttcaaacatatcacttccgggttaacccttttacacgaagcgaggacgaaagtgtatttgatccagaataggatatgcatatcccattccaaaatgatctattaaaaattatataaagagctattaaaaatcaagcagaccaggtactactgtctactactataccaagcagaccgatgcaaaaacatactactaccaccaagcagatcgatgcagctacggaaggggatttgcgtgtcaaacatacgacgactgctaccaagcaccgtgtcattttcaatgtctagatggtgtttgaatctcctgaagataaaaattatgtattttacgtaaaataaggtgataataacgtgtgattaattgagttttaattattacaaacttagaaaatagattaatctgatattttagagcaactttcatatagaaagttttttatgaaacatacagtttagcagtttaaaaagcgtgccacaaatatccaaaatttcatccacttcttgcagtggaaacgaacaggattttccttggaaaaaatactactagcattacctagttggggggaaccatttttcattgcaaaaaatatggtggtaggggaggctgttatggcgctcgttccgctctacgccgagctgctgctcggctacgcggtggcgcgccggagcggccgggtcacgccggagctgcgcgacttggcggtctggctggtgggcaacgtcgccaaccccttgtccatcttgcacctcaccgtgagggccgtctacagaaatttaaggcctcggagcgaaatacaaatcaaagctctaaattttaaaaaaattcatatatctaatttaatatagagggcataatttcagttttagtatgtattatttcgtgcaatgtttaaaaatatatcaaatattaatgctaaaagagtaggtatcactgctgttctaccgaaaatcatcatctgtatagtgttgtttaaataaaatctttaattgttcataattaataatgttgaagacatattttcagcacccgaatcatactttatctttctagaaggcatgatgaggtgattgacgaaacaaatctattatttttttatcaacaaaagcaaagacatgtgtttgattcaatcaggaatccattcaattgtttgttcactcacaatactgtaacagtagttcgtcaaattagtaaattacctgatgaagtgattagtgaagccggcaagcgcccgctagaagttgctttaggctcggcctccacgctcgcctccggctgtcctcctcgctgatggttgccacgatttgcaccaccaccgccgcccgctcgatcgacgctctgccagctgcgcggcgcctcgcgccctcgccgtctcgatgcacgcacgcacaatacctgggaattataggatggactgctccttcattgacctgcgacacctcgatctaactgacgcatgcgatctccaatcgtttgacgcttgcgatgccttggctttgcttctaccctagctctcattagctgatcgccaggcatgtggcccaccctagatggtggtgtggggcccccaaaagttgggggccctgtgcggtcgtcgttttcgcactcccccgtcgacggccctgcccaccatgagtatcgtccacctctccgacctcgactaccatgtcctccaatgctcaactcatccggtccacgagtatcactcgtcgacatatacttttatcgtatatataaattactttttgatttaactaaattatctcatatacatacataatgctctgagttaattacttttattattatttttagtcaattccattatttgtattgattaaatttcatttctgacaaacccatcactggtggagaagtggttttaaaccacggttcacaacccctagtagtcctgttttgtaaccgggactactaatccgagactaaagatgcatttctttagtcccgagtgaaataacgggaactaaagatggatctttagtcccgcttagtgttaccactaatcgggagtagatattttttttttcctttttttcattaattttaactgcttgcatattgatttcactccatccccaaatcacgaaaaccccaaatcacctccgaatcatagatcaaatgcatcacaaattctaaaagaaacatcacacatacatcacatattcacatcaaaaattcccaaaaacaaattcaacaaaaatatacaaaaacaaattgtaaatccgcccatccgccatcgctccaccaccgcccgccgcctccccagcccagcacgtgccccccaaccccgcccccgcccccgcgcgcgtgccgctttcgctcgctcctcgctgctgcttcaagaaaaggagaggataagagagagagagagacaggaggaaagggaggaggaggaagttaaagatgaggaggagtttgcgatcgaggaggagaggataagtgtgagggattatatacgacgcgttaatttttagtcccagttgataatatcaaccgggtctaaagataataggggacttggctagttcatgtaagaaatactgggaagctgcaacctacgtcttggacgagcaagtaagacggctcccaatggaggtcaagttcatcatccaagttcttcgaaacgtaaacatactggctgctcttgttggtattgtattggctgttttcaaatccactactaaccagaggtacgtacgttcgaatgcatgcattcatgaagaacatctatcataatgaattaattaatgataggatctatcactgtctgtgcctctctctgaattcaattataacaattagagcacccgcaatggtaaagtaaggtgctatctataaaatatgtacatctcagcaatagactagattaatattaaccatctcagtagtatgtctatatgggtatctatagctctctaatacattgcctcgtttttctctatagactatctccaggttagtagatagctttgctctctctttttatttaatctctttcaagtaggaaaatatgctgacatggatctcttatagagagcctatagataaccattgtgggtgcccttagtcgctgaagttgaatgagattaacaattttattattttgttcggataaggcgttcaggttaattcaagatttcaagtagttgagagaaaccatatatacgtatgttttcccctcgcatatggattcatctatgtacgagttattcagccgtagtatctgacgactattgtatctccctccccccccccccctttttttttaaaaagtctttttcacgtataattagcattaatcagttaagctggcgagatttgtcggtccccaaatttttgtcgtttgttgaggttgaatttgtagacggtccacgaagaccaaaactcgagaagccaaaccctatcccctcacataggctcgatcagcccggaggacaggattctcctggattttacttatctttatgatcatcgatctatttttggtagaattattcaaactgaattttgaattttcattcaaattcggtgaaattccgctgtttgtcttcttcttcttcttctttccttttttaagctggaaccttgctccacagcagggttcaaaattttggatttgttctatcggacctcccgatgtgatattatttcggccgaaatttttattttttttcattttttcgtgaatttagtaatattttgatcaaattttattcaataattcatataatttcagaccaaaaattcggtatttcggccaccccgatacaaatgaccaaaccgaaagattaaaccctgcttcgtagtgattccaaaggagggcagccgcacggaccctaaatcaataataaaactataatatgagtggtgagatggcactaaatatcaagtgccaaaatgaaatatgtgctgactgatttgtactcccttgtgtcttttttacttgtctagtacaactgagagagtatcaaatgcacatgttgttaccattctctttgtctaatcatatatctataagaattagtagaaatataactaaaatgccaaatttaacaaactcatttccacatatcaaatcttattatttttttcgatattttagctggtaaagatttttgaggtttgcatgtattctaatacaacaccgaaaaagaacagaggggttatgcattgtaaaagttgtgccttgaatggtttacgctgttctacacggtacatgtgacatgttcaagagcttgggagtgcaactcttgcagtgtggatggcctcatggcaatccagtaggtctgaacagaatcaagcaatattttcattgtcattaattaagcaatagatgccattgtttccatgaaaagtagctgcactggtctgtcactgtcattgttaagttgtccgttagcataattcacctctcaagaaaacccctacattttgatcctgaattcattgctgacatgtcattgtcctgattgacaggctaaatattatactaggctacttggagtctttgatccactggtggagaaaccatctttcgtcggtcggccaaattccacaatagtcccggatgcaataaaaaccgaggctaaagatgatttttagtcccggttcaaaagggtaatgggcatatttgatctttagtcccggttggtcaccatctttagtcccggttcaaatgctgtcagggcctgtcaggccccccgggatctttagtgatcgtaactttagtcccggttggtagatctcggggatctttagccccggttggtaacaccaaccggaattaaagtcccacccctatatatatatgtcttcttcctcctccagctgcccgagcaagcttcaaaatttcttcaaaaaagagggtaggtcatgccaaaatttctagtgaatttattttggtaattacatacaaatcggaggtgcctaaaaagtttgcaacttcatcctccaatgttttttttgtcatattacatttgcagttatgttttgcacacttttttgtctctaaaatttagttgtaagttgatgagagagaaaatttgtgtgggttagaaagaatatatacaaatttagttgatttgataaagaaggttttataaaatagttgagaaggaaaactatagtgaaagttaatcttgaatactagaaaacaaactaaaatgaaaattaaaagaagtaaaacacattaaaattagtttaaaactttagaaatagtaaataagaattatttggtgtaatattttatgatttttgtatgaataaagatgtgtcattattgtatgactgttgaaacagtttgtaattatcttataattattgtatgactgtcattattgtaagaataattatttgtgtacgatttttttcgactcatgtagatggatcggcaatggatgtacgctgaccggcggtccaaagagtttattgacggcgtgcactattttttgagagtggccgaagctaataggcaaaggggttttatttgttgtccatgcaataagtgtaagaatcagaaggagtattctgcatccaggactattcatttccacttgtttgagtcggggtttatgccaagctataattgttggacatcccacggagagcaaggtattgaaatggaagaagatgaagtggaagacgacaatattccggactttgctcagtacgttggatttgaaggaaatcaaacgggcgaggaggaaagggatgctgatggtaacgacgttgcggatgatcttggtcagatgttgcaggatgccaaggaggactgcgaaagtgaaaagggggcccataaattggacaagatgttagaggaccacagaacttcgttatacccaggttgcgagcaggggcacaaaaagttggataccactctggagttcttgcaatggaaggcaaaaaatggggttagtgacaaggcatttggcgatttattgaaactcgtcaagaacattcttccggagggaaacaaattgccccagacaacgtacgaggctaagaagatagtctgcccgctaggactggaagttcagaagattcacgcatgtccgaatgattgtatcctatatcgcggtgaggagtatgagaacctagaagcatgccctgtttgcaaagcactacgatacaagattagacgagacgatccaggagaagttgacgggcagctaacaaagaagagaattcctgctaaggtgatgtggtatttccctataataccacggctaaggtgtttgttcaggaataaggggaatgctagaatgatgcgatggcacgctgaagagcgtcaacaggacgggatgctgagacaccccgccgatggttcgcagtggcgaaacatcgacagaaaatttaaagaatttggaaaggacgcacgaaacatacggtttgatttgagtacggatggcatgaatccttttggagagatgagcagcggccatagcacttggcccgttacgatgtgtatctataaccttcccccctggctatgcatgaagaggaagtacataatgatgccgattattattcaaggccccaagcaacctggtaacgacatcgatgtgtacctaagaccactggtcgaagatcttaaactgttgtggaagaaggaaggtgtccccgtgtgggacaacgacaaacaggaggagtttaacctacgagcgctgctgttcgtaaccagcaacgattggcctgcacttagcaacctatccggacagtccaacaaggggtacaaggcttgcactcactgtatggatgaaacagaaagtacgtatcttaagcactgtaggaaggttgtttacatgggtcatcgtcgattccttgtagcaaaccatccggtacggaagaaaggcaagcacttcgaacataaggctaaccaccgtacgaagcctaaacatcgcagcgggaaaacagtgtttgctatggttaaagatcttaaagtagtgttcggaaaggggcctggaagccagcctatagagagcgaagatggtcacgcggcgatgtggaaaaagaactctatattttgggagttacccaattgggaattcttggacgtacgccacgcaatcgacgtgatgcacctcactaagaacctttgcgtaaaccttcttggcttcctaggtgtacacggaaagtcgaaagatacactggaagcacgtaatgatctgaagcatatggaagaacgcggcgaccttcagccggaaccaaaggagaaaggaagccattacttgagtccagccagctacactcttagtatggcagagaaggaaagtatgtttgaatgcttggagagcataaaggtaccgtctggataccccacgaatatcaagcgaataataagcacgaaggaaaagaagttcacaaacctaaagtctcatgactgtcacgtgttgatgacacaactgctaccagttgtaataaggggtatccttccagacaatgtccgggcaacgataacaaagatatgtgcattcatgaacgcaatttcgcagaaggtcatcgatccggatagattagaagcccttcagaatgatgtggtgcaatgtctcgtcagttttgagttgatatttccaccttcatttttcaatataatgacgcatctgctttgtcaccttgtgaaagagatcagtattctcgggcctgtgtacctacacaacatgtcctttcgagaggtacatgggcattctgaagaagtatgttcgtaaccgtgctcgtccagaggcaagcatcgccaagggttatggaacagaggaggtcatcgaattttgcgtagaatttatcgaagatcttcgctcaatcggggtacctgaatcacgccatgaaggaagactacggggaaagggaactctcggaaggaaagcaataatgacggtagacaacgatttattccgtaaagcccatttcacggttctgcaacaatcttcattggtagctccttatgtcgaggagcacttggctctagttcgcgccaggaacatcggtaagtccgatgcatggattacatggcatcacattgatactttccccgcgtggctacgacaacattt

SEQ ID NO: 83130 - DNA, 2007 bp, Oryza sativa
attcctgcagccctctagtttttttttattggtatgtatgagatggataaaaaataaacttattttggagatagtactttgataaattttggactttctaacgtcacatagagtgttgtacccaagaaaaaaaaagtcaattttattaacccaaaatcgcaacaaaaacaattccaaatttccagaaaagtttggaagtccaactcccaaaactgcaaaatactgttcgaaaacagtagaaaatactgttcaaaatttctatttatatattactactatagtagctgtagcaatcaatctcgttcgttcgctaccaatcggacggttaaaaatatcacaaagttgaagtactgtgcgcctctgacggttttgtcaccatcagaggatctcattccacaggtgcgagcatggtgatgcgcggtgtgtagccatgtgcgcaagttgtcgtcatggtatgtatgtgctaggtagcatttatggataacatattgaaaattttggtattaatagtgtcgtctctacagctgtgcaaaaaggaatgtccagtaaaaagttaaataccacgatggaaaattaaacactatcggagtgaaactcccaaattcaccaaaagtataggactccacctcccaatcaaaacccttcgtcaatatctccccgcctctcaactcctcaaaattgaaattttaatttacactacaacagtcacccacatctcaatcgggtggcaaccctcatctgtgtcgggtatgacgcccgtcacgacgtaaaggtcactgatgtgagactctatcgaggataaggctgtcacagataaagttatctttgtcgggcctaaactaaagtccgtcaccgataggtttcacctagacgaccagtcaaacaaaacccgtcaccgatgacctaatctcaatggaccacaattaatgcccatcacggatgactacaatcccaattgggcttaaactaaaggccgtcacagatgcctcaactcaatcgggttttaacttatgcccatcacagaggaggtcatccctattgggtttaagttaaagcccatcatcgatgagtatttccccaaagaaaaattaattctgtttttttgctagcctcagacctttgctagtcatgctcactgtaaaatgacagaaacaaatatatttcacaatatcccatgatccgtgacaggctcgatttttatgcacatctagcatgtatgtgcgagtatatctttgtcggtctcttttttcggcccgtttaagatgacttcgttgtgacggcccacaaaaccctggcatgtgaggggcatcacagatgagaggatctgtactaataacaagtcttgaaccaaatatttaattcctctctttttccttcaaagaatttttccttaaaaattttctaattgcaaatacgtccggaaatccttcattgaactcctagttttcacgttttcaaaaacatcaaattggtatttaaacctcagcataagtactcaaaatccgttcaaacaatttctctctctctcattcacgccttggcccggcctgctattttcccttttcattttcctttggaataagttcacttgaggtcccttagcttgtcaacgaatccaattttcatccttcaaccataagaccagttataatggatccctcaaccattaaagccggtgcaaactagattcctcggcggttttgatggtggttttggctgacgtggtgcatacgtggccggtttgacttggtcctcgtcctacgtggctggtttgacttggtcctcatcctacgtggccggtttgacttggtcctcgtcctacgtgacagtgatgtggcactagaaccaaaaattaaaaatttggaaaatatggggcccacatgtaggtcccacccttctctctatccaaggaggacggcatgtcgacgcctccttctcctctcttcctccgtcccgaaaatcctccatttctccttgagctccctcgccgactgatgagggcacgtg

SEQ ID NO: 83131 - DNA, 20235 bp, Oryza sativa
tcatcagtatattcatcttcctcagtgtcttccacttcttcttcatcagcaacaaaatcttcatcatcacttgaagttacatctaccaaaaaagaacaaaaagtaacttagtgtattgtaggaagttgtttggacaaatgtaaaaaaactaaaaattcagttgaaatcattgtaaaaaaaacagtgtggtagaacaatgatactaatgagattcaaattgtgcagagtggtagagcatggctaaattaattattctgtacaataattaatagaaacatagtgaaaaaaccaaacctagatcttcatcttgctgaactctttttgtccattgtgcaagtttcttccggttcattcgcattttccttggttggctacccctaggatccacaaaatcaaggccggaaatctgtctcacaaatttcgtgaccaaacctgaaaacccttcacacaaattttgcacagcgatcacaattctgtccttttcctgtataaaaagaaaaaacagagaagttacatatgcagatttcacaaagttacttttgcagtttgttgatgttacatttaccaagggtacaaaaagtaaaacagagaagtggggaaaaaatataaacctgctgctgcatagtattgggcacatttgaatttatgaaggttgaaaaatctacattgctcccaaacaaattggtcccttcatgctgaaaactgctcctaagctatattttcaattataaaatccgtaagttacgaacaaacaaaaaactaaaaatgatgcaagtatgccaactataaaaaaaactcactggtaaagctccaaaggagccgtctgctgatgtgtcagctaatattgcttgatttatcatttcattcgtccaaacagtagctcgataaccctccactggaacattgagatttttaaacgaaagcgagtccaaataaagaatctacaaaagaaattagagcatttagattaattaaaaaaagtacataacttgtttgatttaaaacctacaaaatatgttaacttccagatgtaatttaaatttaaaaacaaattggaaaaaaagatgtggcagggcatatatgaagaagtaacttaatgcacagtgagaagtggcttaatgcacaataagaagtagcttaatgcacagtgagaagtaacttaatgcacagagagaatttacttgacagaaaattatttataacaatttaacagaaagaagttacttcctaggaacatgttagttacttcctggacagcttaacttacttctaaaaaacataaaagttacattgggacagtgatcaaataaaaaaaggcgagcattgttaccatcatatacaggagacatgctgagttggtattcttcccagctttagcagctttttgcaaaatagatatgataaacttgcaccaattaagattcttgacatttccagcatcaacaacagaaggatagcatcttgggctgactgttgttgccgtcgttggtgctaaaacagaagaaatggcgtagatgatccacatgcgcaggtacttgtcatctgctaacttcaacttctccaattgaatcccaagagaagtcagtgatggtgagataccatcattgattccaagcaaattcagcacaaattctgtagcttcagattccatctcatatgagacatccttgtcgcccattgggataccaagtacagacttcactgactcctcgttcacatctatggctccacgtccagggaatacaagctgattggttgctggattgaaatgctccatcaaccagctgcacaaatcaggtctgagcttcgagcacttgagatctacgaggccatggaagccagccccctctattagtcgcttttgttcgccactcatatggggatacaactttataagtttcataggtgaagccctgctactttcttgctgcaaatgtataaaacaacaaaaagaaaaataaaaaaacatcagcatttgtttattttttaaaaaacatatataaaacagttgaaaaaagggtaactgaaccaagaagtaacttgccattaagttagttctagaaaataacttgccctcaagcagcagcatcaaaaatattttaggcacggtgagaagtaacttaatgcacatagagaagtaacttaatgcaaagagagaagtaacttcaggcacatcgagaagtaacttcttacttgttaacagaaaatctcaaagtaattttgacaggaagttacttctaacaaaacagtaagttacttcctaggaacatgcaacttacttccagataaacttgaatttacattccctagttacacagcatgatacattccatctagttgcctctcagagcaatttgaacagaaagttactcgttataaaactcaaaaagttacttcctagaaacatgcaagttacttccaaaaataaacttgaatttgcattccctagttacatagccatgagtactggtgttggaaatctcataggaattttaaaataagtaacttaatgcatagtgagaagtaacttaattcacagtgagaagtaacttaatgcatcataagaaaatatagtgcattggaaaaagcgaaacactgcttgagggcaaaaaatgcataaaaaaaggtggatgcttaatacctttgatctgctcctttttggaggaggttcctctatgtcatctgcatgatcatctccaatacttcttttcttagcacgttgcgaacccccccttgttttttcacttggctctggtttgcctaacatgcctttctgtacaatggtttttctttttcccattcctggaaatacattttggatgttagtaatcaacttgcaactaaccatcgatcaactaataatcaacttgcaactaacaatgttagtaatcattttggaaattcattttggatgttagtaatcaacttgcaactaaccatcgatcaactaataatcaacttgcaactaacaatgttagtaataattttggaaattcattttggatgttagtaatcaacttgcaactaaccatcgatcaactaataatcaacttgcaactaataatgttagtaataattttagaaattcattttggatgatagtaatcactagtaatcaacttgcaaccggaaaaatcaacataagccagagagagagaaatttaaataccttcaaatggaacccgagatccacaagccgacgcttgagggggcgaattccaccgcaaccttgcgctcgccgagaggatgaactagcacctgatgaatgagggagagagagaggggaaatgagggaataggggagaacaaaccgggaggtttgagaagcaatttgcgcagtgaaaaactgcccaaacctctccacctccccggcacaaaaaacgcagggaaaaacagccccatcactccacctctttggctcaaaaaaaccgcaatgaaaccgccacaacttaccgaaaaaaatggccgccggatttggaggagagaaaactacctccgccgcagcctacgcttcccaccgcaactgccggcgcgatgagaggaaaccgtcggctccgccgactctgccgacgccggcgcgatgggaggaaacaacagcaactccccgcaccccccccttcgccacggatttcgccggagattcacgccgcctccgccacagatttcgccggagattcacgccgcctccgccacggatttcgtcggagattcacgccgcctccgccacggatttcgccagagattcacgccacctccgcctctctcactctccgcctctctctctctctctctcgtcgagcgccacccaaaaaatttgaacagtacccttcgctcgttcggtcggaaaaggcgacgcgtgagctcgctcggtcggccggtcgggacgcgcggcgcgcgccgtgatggacgccacgtcaccacggctgccacgcgcgtcgcacgatagcgctaaatggagaggcctctccgtttagattttacgagcttagaatgaggtcaataacatagccaactatcggctgcaatagatgggcacatcatctggagttggattcagcttatctgacttcaaccctcacgatggcaaagagcagtagaggtcatccagctgtccatgttcgatcgaaccgtctgcccaggaagcgcatcaaatacaggtcagccgcatcgtgagtctgggccaaggccggcccaacaagcctcgtcccccagccgtgctcgtactcctcgtctggccaccgccatcgccgtcattcttgtcctcctcgccgccctcgctctcaccgtcgtgctcgtcctcctcaccgccctcgctctcgccgtcaggctgcggtactcggctgagaagatggggaccggaaggcgcgcaagatgcagcgcccggtcacggccacggcgcatcggtgccacgagctcgatgtgcgcgcgcggagctcgagcaggccatgcgccgcgacaggcagcgcgcggcgaatggaggaggggagtgcgcgcgccgcgtggctccatttcgccgatcagaggaagaccgaagctgtggtgcctgagctgctcgttgatctgaattacctgcgtcgggcctcggcaggcagggagaggaggaactcctcatcgccatctctcagcagtgagcgagtggaggaacacagcggcctcctcttcagctccttgatgctgcgtctaggagtgttgctttgttgcttgtctgaccaaaccgaatggcattctgaagatactgaatgttcagttataagaatgatagattgttctttacacgggcagcagaagcagaccacttgttctgaaaaatggggttgcatgtgttctgtaatttgtatagaaagcagaaaaactctataaattgtttgcaatgagaatgacttgtccaacagaatgatgaaatggccatttgtaacttatcactgcaatgaaattatgttccaattctgggcatatggcttgttcaagagaaccaacggttttttttttccaaaatgcacaaacatatatgcatgacccaacctttccatctgatttccttttgtttgagtacctttctctaacctcgaaacctttctgaccaccatagctaacccaaaacatccaagcctcatcaacagtattgaattccatgccaacttcaggtaacaaactaggtagcacacccactctacaggaacaaaaaaaatgatttggtggtcatcgaacaagtaaaatctacccgatcatggtgaaaaaagtaacaaccatagcttacagacctgttttcttccatctcaaatatgtagattttgctggaggcttctttgatgaattccaacagtctaatggaggaggtggaagacaatcaaataatttgctaaaaaaaaggaagagaagaggccagaacttcacctgtgcttgatcaatggttgaatccgtggttcgctgtcccagcatgttgtcagatgatcgcctggggccatggcctcgtttggcgccaaaaaggcgagcgcgaccgccaaaacgcgtttgttcgcggtaaaaaagataggagcgatggcgctgggacgaggcttgttgggccagccttggcccagactcacgacgcggctgacctgtatttctgggcggacggttcaatcgaacgtggacagttggatgacctcgactgctctccgccgtcatgaggggtgaagtcagatgagctgaatccctggagaaagcattatagctaagtgatacaatagatatatcatatacttactgtaacacaaatattctttttgtttttataggcccaccatccctctactctctttcttgccggaggaggagatgcgtgggaatgtgggatccttcacgtgctcaagtccaaggacgaacatcagtacatcatggccgccgcgttcatccggtccggcccgcgtgcacgtctggcgctgctgtactaggagacgacgactgtggtggacggggatggcggccgctgcaaaggcggacgagggtggtaggacgggtgtgtgtgaggacgacaggatggatgaggacgaggatggcgcggcgcagcggatgtgggcgaggacagcgggatggacgaggacgaggacagcggcccggcgcggtggatgtgggcgagaatgacaggatggacaccggtgacaacggcagccgctgaggatgaggacagcggcggccgcgcgggcgacgatggcagccacggcgtggctgatgcaggcggccgggctggacgagaaccacaacggcgacggccaccgccgccgtggacgaggtccgcagccgaggcggtcgcggtgggcaagggccactgccaaggcgagcagaggcgatggagacgacggccatggcggacgagggtggcgacaacggtagacgagggcgatggagacgccggccatggtgcacgaggtggcggcccggtggagcgcgacgacggcagatgagggcgacggagacgctggccatggtcgatgaggcggcggcccggtggagcgcgacgacggcagatgagcgtgacggcaacaacggggaacacaagcggagcgaacgcgctggtggtgataccggcggacgcgggccgagtggatggcgatgcagacgcgctggtgggccccgctgcctcgggcgagcgtgcagtcaagcgactaattaggccatccccaaccaataaactattagtttccatacttgtcatgtcatatagacactatatgtagacactatgtattcaatggatggtgtatctatctatcttctatctatctatcttctatctatctattatctattatatactaaaagtccattaaacttcctacaaacgctctaaagccgccacgtggcactcctacaaatattcctaagtcgccgcatggcactatctaatcttaccgttgattttcacttaaatttgtggacccgttattttacaccattagattagatctattattaaaaaaataataacttccacatgtttataacatacaaacgctagctgctactgtccgtatgtatgagattgtacgatacaaacgctactgatgttctttccgtaacatacaaacgtacatgattgaaaataaaatgatcaagctttcttaaccttcgctggaagaaaaaaaaaaccatacacttgtacataaaaaagacagaaacaacatacatccataaaaatcaaccgtttttaaaatatgattttctacaatataaagataaaatatattacttcacatgtataaatatatttagttaaattaagatctataataaatatccaatcaatgttctttaaaccatcttctaaatctatctattatatactaaaattacattaaactttgtacaaactcttttactctgctatgtggctctcaaataaattagagaaatcctagaaatctattatatacttaaaagtctattaaacgtactgcaaatgcttctacattgtcacgtggcgctttaataaaattacagaaatcctagaaattcagaataaaaaaagaaaagcatccaaccttcagttttcacttaaattagtggacccattattttaaacaatggattagagctcttaaaaataccatgatgctaatctctatcctggaaaaaacataatgcgcttacgtcatacgatcgtctccctcccggaaaaaaaacaaaacttaaatacctacatcatatactataaaaaaaataaagccaaaaaagaacaagaaaatatgcataggtacatagtagaatcggaaacatatactaatcaggaaaaatcatcagtgtcggcactgatttgttgtcaacagcctttaatctacgattttattaaaaataatactacacatatatgcacaattaaacttaatataaacttattatagtgataaatatatcatgacaaatgacgctaacatgtaatagttaatgcgataataatgtttcaaataatttcatatcatattttacagtgtcaaatatcacttgacaaaaatatacaacgttaattttaatctacatgtgtaaaaattaaaaaaacaaaacctatcattgttttttaagtacatctgtttaggtttatttaattttaggagagattgagattctcaaattatttcgaagttttcaaaaattttcttatttgaggtgtgagaagcacaaataatagatagatgagaaaaattaaattaaattttagccagtgataataaaaatatataatttagctttggtttttaagtagacctttttaggtttattttgggtgagattgagattctaaaagtatctgaaagtttttcaaaccttttttattgctatttgaggagtgagaagcatacaagatggatagatgtgaaaaaataaataaataagattttagacagttattttactacaatacaacccgtaattcatcacgagaattatgtatgttctttgccaaatagtattggaaaaaatgaataatccaataaaatatgcataaaactacttatgttatatttttttaattgatagaaattctaatatagcgggtataattgatggacgaatgacatataccactgaaactcagcagtaagtgcactctagcgaattagatagtgtaaataagtttgtgaaaataagtacattattacaattagtaaatgagtctcatttagttataaacaatatatggttaaaaaaatctagcgctaaagtatgaatctttatcaaaatataaataatgatatggtgttttgtagattttcatggtggtacgtctctttagctatagctctttttttctaaatagtgccgaatgattaaccccactcatttgaaaaacataatactgtttgtattgcattaaactttgagaagcacttattactaacttcatatacacattgtctattctctaccaaaaatcgactcgaaacttttaaaaaaattgtttcaatcacctcctttctgtccctctttgtcctttaatgtaaggtgcagtacttgctatgctatcgtaaatattgcatgggcatgcacattgttgagttaaggtactgtccatgaaaggtcaccatagacaatgtaactaaagtgatagacttatcaatataatcatttgtgagtgtaacaatagtaaactaagtgttaaaatagtactctacgatggttttttaggggcatggctacatcgacgtggaacctatatgtttcaaggcattacatatgaaagccttggttggcagatacatttgacttcatccgttagagaggtattcatgtttatttttaaagatgttatcgtattattctgtagatatgttatatttatactatttatacatagatgtgaaaataagtgatgaatttttataatgtaacaataatgtatcatttattttagtggtactaatatagtttcatttattaaaggtgcacctaactcttaaaacaatgatagtaagtaatgatgataaacaaccagtttatatatgactaggacaaaggaatttttatttaaattcgagggacattcttatcacattagtagtatattaaaatctatcgtctattttatggtaaatatatttatttttttactgtaggataatctaaattcccttacactatatatagtgatataatccattttagcatttttttaataaaaaataagatgcccatgcatctgtgagaaattccttaccgatttatattctggaaatgttttccaatttatattacgtcgttatagtgtttgaacacaacctatcatacatgcccgcgcgaatgtgcgggctaccttcctagtttaaattaaattctcatccagtcacatctcttctctctccttttatcagcatattctcttatttttattcttagttcttgtgtagagatggtttcttcatctttttacctctcttctcgttaactttcttgccacatactccctccgtttctaaatatttgacgccgttgaattttttacatatgtttgaccgtctgtcttatttaaaaaatttaagtaattattaatttttctcctatcatttgattcattgttaaatatacttatatgtatatatataatttcacatatttcacaaaagtttttgaataagacgaacggttaaacatatgctaaaaagtcaacggtgtcaaatatttagaaatagagggagtatgatttttgcttatgtgatgtatttaatgctatggaaactagatggcatggagggttggggatggccttagttgtccgctgctactctctcctccatatcataaaaaaaatcttacatggaccttatatcgcccattattgtacccgctcttatggagaggaatcactagacatgatactttttgacacgcgactgttgatcaaattagtgcataactaaaaaacaatcttttccgtacttatgaattgctgcacgacaacaaaaccaatgttttctataattacgaacaaaattagttactactattccttttgcaggatgattatgatttctcgatttgtcatgtaattttttaaaaaaaaaacaaatcagcacaagattgtgtccactctattactagctacctccgcaaaagaaatatatttctacgaatttcagaaagataattataccacctataatcgtatccggttttgtcagaaatacaacataactagcttcagaaaaactaaccgacgatatcccgtatgggggaagtggggacgggatacataatgaacggtcatcgtccttatccgtctgcatccttttccgcccgactcgatccccaatctcctttgtcgctcttctcttgcacctacgcctcgcatccgccgccactcttctccttcctctcctcttcttccttgcctagctagaagcttgaaaatggctagagctcctttctcctgctacacctaccctcctgttccgtccccctcaccatcaacgagccaaggagagggctgccagcaccagatctggagatatctagggcctccccgtcattggatccgcctgagccatgtcagtgatgaggtgatgatcgcaccggcccctgtggcctccacctcgatgtcatgccatcgaggaggatgccgatcgatgtgaatcctcctcccacgcaactgttagtggtgatggagaggagacaaatgaaggtgctagatttggagtttcaattgacaatcgacgtggtgttgcagacatcgtgttgctcgtcgacgttgtgcgcaggtatgtcgtgcatgtggcgtatcaccatggcttagctggtacctacaggtattaggcatggtacgaatggtatcatgttgatacctacaggtttcagggctggtacctatggtatcatggttgatacctacgggtaccagacctagtattagtggtatcatggttgatacctacaagtttcagacatggtacctttggtatcatggttgatacctacaggtttcaaggctgatacctgtggtatcatggttgatactcacaagtttcagacctggtacctttggtagcatggttaatacctacaggttttagacttggtataggtaccaaccaatatcacataggtaccaagtacaaggtataacgtgcgtcactgccgcttgggcaggtggtgagctgtcgaccaccagcgttttgtctcgtcttctcccttctattcctttccaaatctccatgccttttcttctcaatctggtgttggtacaagggtcaccaggctgctacagcctgcagggaccaactttgccacctaagccactactggtactgtggccttctcctagcgcctcgcgcgtgctcctccgccagctagggcgtgagcgcgtagggcggcgctgagtggtggactcgtgagcggataaagtggtggcggagctaacgtcatcaatataaagtatctcgtttagacgggatgccgtaccctagctagcagccctctatagctttatatggaacgaaaataccatatacctagatttatatggaagggtatatatatattcgagtatgaaatttctattggcttaaaaaaataatatgggaattctacgaataacatgtaaatgccattcaatatgtcagaatccaatcgattcgtgtaatataaggtcttatatgctcctatcccacttgtagttttcaagttctaattgaacggtcatacccgtataaatacaaagacttccattgagacatagcatcaaattataaaccatagccataagccagatcgaacaccaactagccatgaggaaacctaaagctagccgccgaggcgccgactacaagtcatcggattagtcctcattgaagactacttaggcttagattagttagcttgcttctaattttataatcggtgtgaaacatcatcgaacgatacatataaattggattagggctatttacctatcaagaggtttgaacaagctagtataaacaatatatatttccgaaaactgaaccagtatatttcttgtctccgtgtcgacgggggatactagcacactggaagaatagggtatagggtatgttggtacgaggatctacacaatacgacatcaagcaaacccggagacaaggattatactgattcagacccctcgtaaggtaatagccataatccaatctatatgagattgatatgaaagaaccacggattacaatagagaaccaacgattccgagattaccagcgagatccttgtcgagatggtttcgacgagatcttctagcgagtaggcttcacgtcctccggattgtaggctatggtggtggtgttggtgctatgattcgatgatctggaccccttaaggggtgtgtcttttataacatgaatcaccttagtctccaagtaaaactcggtgactatggaccccacacgatatagtataacctaaccctttttgagtaggactctgttgttcacttgctcgtgaggataatttccataatctcttgttaatttcctcatcgtatacggaaatatatcgtacaaacgaaggtatgtcgtatccatatattccataaatcgtaggataggagatataccttatccgtaaccatgataggctagtagcattgttttgccacgccagccacggtggcgtggcaagaggctagcatgacaggacagcactgccatgccagctgcgcgtggcatgccaaagttatttggccaagccaggcgggctggagtggccaaaaggttcagattcggacatattttttcgaaaggtctatttataaaattaaaaaaaataaaaagtctaaaaaataaaaaaatttcgcaggtaactggagcctcttatttcttaacagaaaaactctcgaacctctattctagtgtgataggtatagcagttctttcactagatgctaccttgagacaatctcaccagaataagttgattgaacaggtttctgggtactgcaacagtgttttaggaaaacaaattcagccacactccatatattcattgaaatatctcaatacaaattccacccccgggaacttgggccagccagcaggttctaggttccatagattacatagaaccagtgttcacctagtcgctaaacgctagtcggacggtcacctactgactagcgactaggctgattaggcggcgactagatggattaggcgaattaggcgttttttatatttctttcacagaaaaatactgattcttgacattcggtactcagtaaatataggcatttagacaaatagcattgggtttagtacaaattcataggaatagcgaacatacattagtatatatatatagcatagcaggctaggggagtagcagtacagcatcaacaccaacaaatcacatacatacagatctaaggagctggagctaggagagaggaagaaaaatttatctggaactggaagaacagaagagatgaggtggtggaggggagcctgatcccctgatggcctgatctagggttggcgcaggctgcttgagtggttccgtgcttgactgcttcaattggtgtgtttgccaccttccattgacggtaaggatgaaggatgagagggagagcagtagtagcagaggaggagggggaagaacgtggagcagcagaggaggagatcgggaagaacgcagcggcacggtggaagatcgatgggcacggtggcggagccgtcgctcgtggcggcgtgaaaaaggggagtaggtaggggttgcgctctctctctaggctctcaaataaggtaacctaaatccccttctataccgagctggtcccgcgcggcgtttctaaatttaattgtgcccaaattttgatttctatcacctagtcgccgcctagacacactgtcccattgtccaattgcgcccaggcaccgtcctgtccaagctgtccaggccgcctaggaccgactaggaccgtctaggcggtaaaacgactaattcactgcctagggtataaactggacaaattgtcgccgactagcgattaatcaccgtctagacgggctaggcggctgtttaggcgaacactgcatagaacagaacttatcacacagcagagatcaaaaactcaggttgtcccatcaacatagcaacatgtttgagaattcaagcatggtaattcagagcattgttccagatccaacgcccagcagcaaagcaacacttcgtacatcttcttggtcctttattctcacaaaaaaatgtttcccatttcatcacccatattaccatataaaatgcctataaaatatgtcagacagccaaaaaaaatcgatactcatgtgagaagctccacaacaaccacctctgatgcagaacaaacatcggagcggaggtactcatgtgagaagctcccatccagcaggtaccatcgatactgtccggtatgaaatctgagccatccaatcagctcaatcggatggtggaaaatctgtggtacctccaggtacaaatttgcccatgaggtggtaccggaatatttggagtggtggaagggtaattttgtcttttcgcgtagaagtgtccaggggagggaaatagggtcttctaccaaatcggcggcgagcaaatatccccttcccatccgatccgatccgatccgtgagagtaggcggcgtcggcgacttgcttcgtcggcctggagttgctccgcgggaggcggcgggatccgtgggaggcggcggcgacttgcttcgtgggagatggcggcggcgtcggcgagttgcttccgtcggcgcctacttgctttgtgggaggaggcggcgtcggctgatccgtagccgccggcggcggctgatccgtttgaggcggcggcgaggtgctccgtgggaggcgaggcggcggcgggggaggcgaggcgacggcggcggctgatgtgtaggaggcggccggcggcgaagtgctccgtgggaggcggaggcggcggcggcagcgggttgttcgtggcagcgaggttgtggcgggcgcagtggtgcctggcgcggcgaagccctggtgctgcggtgctgctggtggcgggcgcggcggtggcctggtggcggccgcgttcacgaggtggcggcggcggctggtgcgtgggcagccttggctgcgaggtcgtggcgtgcgcgatggtgccggccgcggtgacgaggtggtcgtcgcaaccggtgttgtggcggcagcgggtttgggctttgcgcggctgcagtggcgaggtggtcgtgtagtcttcttagccggcgacgaggcagtgtatgcatcgattttttttcatccaatctaaatcattagcttctgttggttgcagcggtagatactttcattttctgggctgcatatgctcttcttcttcattgcttataggatttgtattgtacgatttattggatgttttaatgagctcagtcgttgcttgttctatgtgaattttcaaatgttcaataacctcccctatcaatgagtgactgcaaaatgataataggatagaagaaagaaattgttgatagcataacgagtggtacactgatgagttgcttgttttaacaaattgttttcccagcatacttctatggtttattcagggaacagaaactaacctatcaggctatcacaggtggtagccagcctaataaattcttctctgaatctagtttttcaaatccaaaagatataacacaagacatgtagaatctggaggtcgacatatcatttctgacaatgaaaataaaagatgaaaccaccttatccacatcctatacacacactttagatagaaattctgtcatgggtatttcatcgaacaccttttatgcgaaataaatacctaatgcttatcagagacatcctctgttacctctgtaaattgcaacatcacataatcacgcacagaagattcaaattttgtgaaaatcttactgacttttgctagataagaaatgccatcgaattcccttaacttggataaacaggagaatagcatatgcataaaaattctgtgatgttctctaaacaggagaaacattgcaagtagttacaatgatgtctatctgaatcttagcctagagctagttgccttcatttgcctcggtcactaggcgtttaatatcttgctgcacttcaatcacttcgttcatagtagaattaatgaggttggctgcaaccttatgtttgaaagtggtggttgtatcctgaaaagcaagttatgaaaaaaatatcaagtaatgtcattttatttacaaagagtactgattgcaatttaaaattaccatttcattgaactcaggggagagttcttttccattccaatgctgtatgaatttcaatgtgtgcaagccacatgaccagctgttgcaagcatgtcctttgttagtggtaattcgttatagataatttgcgacaaaaattaactgtttgtttgacctgtcactttgctgagggactttcattgggcagaatggccaattggtaatcttggtgttcttccatttgttttcaacttcatcttctagccttgcatactggataaacttttcaattccttttatctgagttatcaaatagagtattacatatctaatgtaacaagttagtaaggaatagtgatgaatctaaaggcacaatgtagcatactgtattattgaggtctttatctttgtcgtagtagctcttgtccatgcgcatcgagtctagtatttgaattttttctttagcaccattgagaacagccacgtaccaatgagttgagtttctattgagtggtaggaaaatctacatagaaaatgaaatgtaagtcatgcagttattattatgaaggatatttgaggacataatataccatatcatgttgcaaatattttgctgtaacttttgctctcttgtcttgatattgcttgttgcgggttccaatttgttcaccatttgttttccaggcctggcaatgtgctgtactttctagaaatgcagtaccattctctcttggactttcacattgcatgtctttaatcaacataatgtatgcatctatgacctgtgaaagaataaagaacaaaatttagatactgataatattatgttgtatggaaatggctgaccggctttcagacatggaattttcattcaagaagaagttgtccaagcagaaaaaagagactgatgacattagaaattggttcgtaggaacagtagttgtagctgtgttccttctcatgaagttatttgataatatgtactatgcttgccgttgttgattttctacatgtcagttagctatgttaaggtaacagactttttagtttgtcatctcatttgtaataaacgaatatcaggcccttgattgccctctaaattgattagctgtgcattgttcattttggttgataagtattggatggatggttgctgcaaaactggaaaactggaatgagatactgtgtaataaacgaatatcaggccctttattgccgtccaaaattttcagatgtgcattgttcattttggttgatgagtaatggaaggatggttgttgcaaaactggaatgagatactgaaagaagtgtactacaaaactgtaaaacttaggtgtactgaatcattttgtacatttttaaggtgtacttagccttgttgtgctactgaaatgacatgtattactggaataagtattactggaaaactggaatgagtgctctcttttgatcactccacagaatggcatgtatttcacaggagttcgagtaaaaacagcacaatggtgctagtagacaaacaataaacaatgtatgctctgttcacagctgacagtaattaagacaaaagctccattcaatgatatacatgctttgttctccagcaaaagcttgtgcttttcacacaaattcattacaagaaccatgacagattgaattgttcattaaaaaaaactagaccacacaatataatcctctgtccaacaatacaacttcccaaacaaggcagattcaacttccaccagtgcaaagaaacacttcaaactccagattcaacttccaccagtgcaaagaaacacttcatacttctcatacatcttcttctactttgctgaaaataaaatcacagatcaaattagtaatatatagagagagtttacataaattgacatattcaaaataatcatattatatttcaccttaggaaaattggacaggttcgaacagtgtgcccatggccacgacaataaccacaacgcctaacacgcttctccatgaatcctcgtagtcttttttgttggagctcctttaggcacaatttccataggatcatggaccttatcatgactctcaatgtctgtacgtgaactttgagctagcacatgaccacataaagtcaaatctgagttgtttgtctcacattcatcagtttctaagtctaatttttctagcatctccatcaccattaaagtagtttccttagacaccgaacacttgaaaaacacttctgtgcccatgctacgcagcctgcgatatctctccatctggtctgaccatgtatatacttcgccatacctatcagaaggaaacatgtgtttcgctttaattgtccacctacgcactatgcatgcttcaggaatggcatcgagcttcaaatgatgcataattgcaaccatatgctcacatgggaggcattcacgatccatttttctgcatgtgcaatttatgctcttcattgttgattccatatatgtacaattcaagatttgtagcatctcagaatcacctttcatggaaataacatacttaaccaagttgtcctcttctacacaatctatcacctcccaatccatcgacttagcaataaccaacttcaacttcttaaaaactgcaggtgcaaatatacgggcagcatctttctcagtaagactagcatcattagaagtgaaagggattgattgtgaagctttacaatctagatcagcctccctatacctcatacgtgataagcaatgctcataatactctaccaaaaggacaaggctcattttacgatccaaatacctatgaagtttagaattcagactttcactacgttggttgcttttcatcccaagaaaaaacaaacctttagtgtacgcagtagcccatttcttcctcaaattgtacatcctcgcaagccattggttgtcttcacaacctttatgcttcaccttaaactcgacccactttctctcaaactcttcatgatcatatggtgcgtggacaagtgctcgaaaatctgaaagcatatcaggacgaagatgtcttgccatgttctgctcaatgtgccaagtgcacaaccgatgctcagaatccggcatcacagctgctattgctctatgcatggcattgtccccatctgtgatcaatcctctaggatgcttctgatacatgcaatctagaaactgcttaagaatccattcataagttgcaaccttctcatcagctacgatagcacatccaaaaataccagtggaaccatggtggttcacaccacgaataggataaaaggtaagttatacctattcacccggtatgtgctatcaaaaactacaacatccccaaatgcatcataatcgatacgggattgagggtctgaccaaaataaccgtttcaaacgaccagcttcatccgtctcatactcaaaaaagaactccatgtcatgtttttgcctccattgaaaatactttataacacgctttgcatccccacctaaaatatgtttcttccttagcctagtaaaata

SEQ ID NO: 83132 - DNA, 40718 bp, Oryza sativa
taaatatcttttcccgctatttcgaaattctttttaaacccggttagggttaagaaccgggactaaagattataccactgcatatgattttcgcttacatatgtgtttataaaatagaagttaatgcattaacattatttaaagtacaaagattgatgacaattacttcgaaaaattatttttgtctgtaataaattaagtggataaatcgtaataagcaaatatatgacttataattaataaaaattccaatatatatatattcttagcatatatatgaatgatattattatattggtaaaaactctaattaagatattaatgtacatactgcatgatttaaaattaataaaaattgtaatcatcatatgtacttagcgtaggaattatattaaattaaatactaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactaacatatacatgatttaaacttgttgacgctcttcagcgtgccatcgcaacattctagcattccccttgttcctgaacaaacgccttagccgtggtattatagggaaataccacatcaccttagcaggaattctcttctttgttagctgtcacatcctgattttcgtttcaggatttataaattatttaataaattaataatagaatttatattaaatgttcattaatttacatgtgaagttaaatgtgggaaataaaatttcctaaatataaagcatggatggatttaattttttattaaattctccatgattaagtcaactctctggaatattctcggatttttcggagctcaattcctaatttttaatcttacaaagagcatttcagtaattacccacatattaaattaatcattaaatggtctaattataattttgttaagtactttgagtgtccaagtattttcaagatttttcttggaattatttgagcataggaagtatttttcacaattcaaagatcatttcagtgattaatttaattggaaaagtatttaaaatccccttctccttttcgggccgaaataggaaaagttcagcttctatcctcggcccattctcccttcctttcggctggccttatccctcctccaaagtctgctttgtgtccctttttcaatcgggccaagaagtagaagcccagcaaaaagtctagtttgcctccctgctacagtgtcatcttcaatctccagccggctggagacagagcccgagccagccgcacagtacctgtatagccgcggttttcccctccaaatctgacctttccccttgtgtttttctaaaattagttgaggggaaatattcctcttatcctcctctatctttacctccaaaaatcggagcaaatcgttgagtatcttatccgaatcaaactcgttttcgagtttatctccaaaaccgagtttttgatttcccggatcgatttcttgcgggaggagtccgatctcttcaatccaaggctataaataggaccccctagtcctcctctttcgtttgccccctctcccgtggtctcccgtgcctcgtagcgccgccgccacgtgctccaccccgccgtcgtcgccggccgagctccatccgcgtcgcgccgtcgcctccgtcgtcgccgccggtcgccgtcaccgccgtaaggtgcgccgaggtgtggagaagcccggccgctctctccccgctgtcgccggtcaccggagccccgtcgccgccgtcgaccgaagccgtgccgccgctagacctcgtcgccggccgtcgtcgttcgtcgtttggttcgagggtgagtaccgttgggttcgtctcgtcgtcctctacgtgttcatgtcctccaaagtcgcagccgaccatccaatctccggcgaggtcgccatcttggtccggccattgatgaggtcatcatgacgtcatcatcgtttttctttttcctgtttttctaatagattaaatcttcggaaattcataactaaatcatcgtaactcggttttgagtggttcaagttgctaaattcatctaaaatcatgatctacatgtttgtttactttatatgtactgtttatttggtttttattagtctttttcttcgttttgcgtgttagcttgtcgtttccgtcgttgcgaaggttcgtgagtgcgccggaagtattcgagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacctattcctttgttatggccagtttgcattgattaccctattccttgataccttgggttattataacttgactagttgggctttatatattggttcagctagatattagttatgattgcttagccatgcttagaaacattagcacactattgggataacttatgactcactattatttaaggatggcttaatgatagttcacgatggtcaatcgtgattggttaattaattacttgccaactaaaacttgataatggtgggttgtgagcacatggttttgagagtcgtgctcatgacaattaaggaccggttcgcgagttactgttgtgaaacatttatcgtgccaaccacaagccagcgtgggcaacggctttatcttttgtatagcgtgattcattatagtgcgccagactgagaagtggcgagaagtccacgggggtcgctggggagtccatgccttgtttataaaggggtgattatgatccaggaaaggtgcgctgtaatggattatgttgtgcaaggggtattgtcacaactcctttccgaggtaccgtggtggtattgaggcacatggtgacatgatgtggggttgtgtcttgtgggtacagtggtacacctctggccagagtaaaactattcgaatagccgtgcccgcggttatgggcgggttgagcaatgtttttcgtgattagtctcacacctctcacaataattatggatgttatacttggtaataatttgcttagctcctggtttggagttagatctgtacagccgggtatggttgttcaggatggttgggcctgtgcagcatgggtgtgctgttcagtgttgattaaaatttttaattaattactctactgttttactactcttaactctttgctaaatgctgctttcgcaaatgagcctatattatgccatcctttggtatccttgtgcacttgcatatttgctgtgtggcttgttgagtatgtcatatgctcattcttgcaataatcaatcaaacctcagttgaagataaaggatccagaaggagaagacgtttggcttataccccagttgagctgcctgtgggagtggagctgaagccatcgctagaccgttaattccgctgctgttttcttttcttttgtaagtatgtaacgttattattatgatggatttgtatattaaattgtcagtttgtgtacctcggctgattcctggacgaggattttatgcacaaataagttcggaaattactagtgaatttccgggcgtgacattagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcttccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatagacaacaaataaaacccctttgcctgttagcttcggccactctcaaaaaatagtgcacgccgtcaataaactctttggaccgccggtcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaatttttattttagtttgttttctattatttaatattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccgggatcattagtcccggttggtattaccaaccggggctaaagttaagatctttagtctcggttggtgctaaagatcccgggggggcctgacaggtcctgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctccaccagtgagagtacaaactgcatatgcagataatactgatgtacgatggattgatggctcagtactagcctacgaaggaacttatgatctagcagatgtttttcgtcctaactcaatgcaaatgttatatctggagtttaccatgcattagcctcgtacttttttttttctttccaggtgacttccaggacaaaattggtgttccatccaacgacagcgtgtaacgcaacctgcactatctgtctccatatcttgaaagaggcaaagagctgcttcttcgttccgggcattccccctgctgttcctactgaagatcacaaaagagatagccggcggtggcgatggtggtggcggaaattgagagccgcggcctgaatgcggggccggcggtggcagacaagcggaggcggcggaaaatgctcgtcaacctggtccgctgggagacgagcagtttccgcgcgtggggttcggctggcgggcgacggcgctctgctctgggtggtggcacactggagagatgaaacatctagagggaaaatggaaagagggggagaaatttgttttgttgccaaaagaaaacaaatttcttcgagtacatattatatatacagtatatcaaatggctctgatttcttcttgtcttggaaattacagcctaacttattagcttagaaggacgcgactataccgagaccggtatcacgatagggctatcgcgcgacgcgcgcatctggcgattccgcaccgcgcgcgcgccccatgccaaaaacggtaaccacctttttcccgggcccccgcgcgtgccatcgctaaaaaaggaaagcacgcgcttgcgcgcgcaagcgccgtgcgatgcacgcctcgctagctggcgtgggccccacctaaaacagcgcgatgcgcctctctccctcactccaacccatccggagacatcaatccacacacagccgccacggtggtaaaaatcagaaaaaaatcgccatcttggaagaggagaaggaggagaagcaaatccaagaaaaaatatccaagtaaagtacacatgaagttcaaattctgtcttctgtgagatccatccacaaaaaaaaactaacctagaaacttttagatcttctctgtattcttcgacaaacaaattgatatgaatctgtgctgtaattttgtgagtaattttgtgagtaatgagctgtagtcttgttttctgtcttccttcttgatttctgtcttcctttataccccaaattcacattctagtgctactcttgatttctgtcttcctttataccccaaattcactttctagtgctgctgagaaaaaaagttgtagagaaggcatgagtactggtgtttcaaaaaactcagagcaatttctaggaacatgcaacttacttccagataaacttgaattcacaatccctagtttacagtttagacagcatgaaaacatcccatctagttacctctcagtgcaatatgaacagaaaagttactttacttcccaaaataaatttgaatttgcattccctagttacataggcatgagtgctggtgttggaaatctcatagcaattttaacagaagtctcagtgcatttttaacagaaaagttacttctaacacttcaatgagttacttccaagaaacattaagttacttctcaccgtgcattaagttacttctcactgtgcattaggttctcatagcaattttaacagtctcagtgcagttttaacagaaagttacttgtaacaattcaattagttacttcctagaaacatggaagttacttccctataaacttgaatttacatttcctagttacacattttgtaccttgtgtctatatacagcatgatgcatcacctagttgcgtctcaatttcatcttgtactgcatcaaaacaaattgtgaaaaaaaaattcattaatatagccactggtcttaatttgagaaaattgcttcctagaaagcatctaaaaaagacatgctgcaaaaactaaaagttacttcttcccccctcccccccaaattactgaattacctcaatgaatgctctgtataaactaactttgttactaatagcctgaaacacatgcagcaaaaatggactttgacctcaacagtatcccggaattagtttctggtgaaaatgaacctccagtacaccatttactagttgatgatgaagacagaaatgaaacatacttccctataaatctgactgacactagcatggagattcctgctataaatttggacgacacttttgactttgaaactatgtatactactggtgatgctggaagtttacaagcacacaatgtagccaatgatgagatgcaagtatttgaagccaatgatgagatgcaaatatttgaaggcgatgatgagatgcaagtatttgaagaaatgtcagatcgtgcagacacaatgcatactagtgttgcaactggcgcaacaactgctactgccaacacaatttcaagtgaagacactggaacagatgattcagaagcacagtcagcgccatcacaggatattccgtgcagcacacaagtgccgtacctcaccttgactttcaactcagaggaggaagcaagggctcactacaacaggtacgcaaagcgcgttggattttcaatcaaaatcaacacttcaaggaagtcagccaaagatggagaacgtgacaaagtaatgtttgtttgcaacaaatgtggtccagaagaaaaaacgggtgaagcgtgccccccaaagaaaatgaaaagaagtagaacaagacaggctgcctgcaaagcaaggatgacagtgaagaggaaaggagctaggtgggaagtaattcagtttgttgaagaacacacacatcctctggttagaaagttttcactcaagaaattcctaaggtcacatagagcaataccgaaagaggaaaaagatttcatcacaatgctgcacggagttaatctctcagctggtacaattattgtcacgaccggaaataacccaacgggcgttccttacgtgcgtgtattattccttgtccaaggaggcaaggtacaccaaaagttgatacaattcagagtttaacaagcggaagcgtaaatagttaattattacatgggcagcgatggcccaacacactcaaagacaatgaaaaacagcggaagactaaggcgacgaccacaggcgcttgacggcaggcacgagctagacaccaaagccttcatcatccaggggctcctcttctgggtttgggaaaaattgagcaagactgagtacaaccaccgtactcaacaagacacacccacaagtgcagcataaatgcaaaggagtacaatggagttatagtataggggttaggttttgcaataaacagcatttaaaagactcttagttgctcaaagctaaatttaaaacacgatcctagaactatttaatattattaaacaaggccgtgaacccacacgaacctgccttaacccaaggcctacgatgattcagaccgaactggcaacccgaccctgggtctcagctcgtcccaagccaacccaggccaaccattccacattttagttattaagcaggttttaagaatttgaaacactaacttgggtacattgctaggcttgcccataaccgagggcgcggctattcgaataggttttactctgatcagaggtgtacatctttacccacaagacacgtcttcctcacgtgcaaccacgtgccacataccaccacggcatatggacggaagacatgacatagtttccaacccatcctagccatagacaagagtaccgacccaacccacctacggccggaacccccggacaggcaggcagaattgagcccctagcagcaggacaccaggcctgtgctatgacatctcgactaccgggccgcagcccgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatgtggccgaggtgctactatcaaaacaatgcaccccaagcccagcctaaaaccattttgagagttttgaatagagggggaggtgtgcatccaattccacaataatccaaccattccaatatgtccaggtgatatgaatattcccaaagtctagagttataaaaccacctaatgttgcctaattaatcagcgaagcatctacctaaattcttgctagtggaaccattaatagagtgcccactagttggggttttgtttattctagggtgaacaaggtaataataacaataacaacaataataaggtcataacaaaggtaaataggcatggctaaataaaacagtgataacgcgggaatttaaataaagcgataatgcaataatttaaatcaaagtaatttcacaaagtgggatccaatatgttcaaagaatgatgtgacttcccttgctcgctttcccaaacgtcggcttcaacctccacgaagagcggatcttccgaagctgcagcgtctacacaaccaacagaaaagaaaagggcttttactctaataaactccatataacaagcaggaacaaagcacaaaaatgggttcttgacttcttaaggaaaaattagagacttgaacggtccaattccgagttcaaatggccaagttatggccatttgaagtttatatgcactttaaatgaatatttacgaatttcttcatttaaattttaatttaaaaatagatttattgcgtcagccgggagagagggcgcgcggaccgggtccacgggagtgggacccacgcggcagtctcacggtccacggtggaccgggtgcacccggctcacaccggccggccccgtgggccccacgcgtcagccgcacccgagggcgcgggcggctgatggccgggccccatgcggcagccgctaggcgcgcccggaggcggccacatcggcacggccggcgggaggcggcgcgcccgcgcccctatggtcgccggcggcggccataggcacggcggagcggcggccgagagaggggagggaaagggggaaacgaagcggcggtccacggctcaccccgggtcgacggtgacgacggaaacggcgaccggagcggaggaaggcggcggcgcggctcgggtggacggggtcgacggcgctccggcggtcggcgagcgaaacggaggggtggacgaggtcggcgaggatgcggcgaagccgaaggaggcggcgccgaggtgggaggtagtccggggcgacgacggcggcggaccggagctcggcggcgacggcggagagagagagcgacggcgcgagctcgattccggcggggagagagggcggtgagtggcggaaacggtggtggggagctcggggagggtttatatagggttgggagtgagagagggcggccggaggagggggaaatgggcgcgggagacccggccgccattaatggcgccggcgaggttaggggagaggtttccaaacaaatccgagggagagagggagggaaaaatggggggaaagggggaggggatcccggggaataattccccccactttattgcacgcggggccggcgggaggcggcgggattcgcggcggcggcggcgctaggcgcgggcgaggcggcgggggcggcgggaggaaggggatgacgggtgggccccacccgtcagcgagggaggcgggcgggcccgcccgtcagcagcgcgcgcacggggaggaggccgagtgggccgcggggaggaggagaaagggggagggagatgggccgagccggcccattagaggggagaggtgatttttagggtttttctttttataaaatcattttaactttgtttatttcttaataattattatttgtgctctgaaaattccactaaaatttatttacacattttaggcttttaggaaatatacaaaaatcctccaagccctatttgactttcaactttgcacattttaatttttgaaggcttttaattattctaggcataatttagaggatgtattttagggtcgatttgggacgcgacaaacctacccccttaaacggaatctcgaccccgagattcggaagaactggcgaagagatctggatgggctgccttcagctcgtcttcacgctcccaagtagcttcttcctcggcatggttgctccatcggaccttgcaaaaacggattacccgattcctggtcctgcgctccatggtgtccaggattttcactggtctttccacgtaggtcaagtcttcgcgaacttcaatctgctctgagtcggcctgctcggatggcactcgaagacatttcttgagttgcgacacatgaaacacatcatgcacgttgcccaaggaggcgggcagctccaactggtaagcaacttctccgcgtcgagcaatgatgcggaaaggactcacgaaccgaggggcgagcttccctttcgcttgaaacctgtgtacaccccgcaacggcgttacccggagatacacaaagttatccactgcgaattccaggtcacggcgtcggttgtctgcataactcttctgccgagactgtgccacctttaggttttcccgaatggtcctgaccttcgctttagcttctctcaagatatcggtcccgaacacttggctttccccaacttggtcccacaatagtggtgtcctgcatttgcggccatacaacgcttcgtatggtgccatctgtatgctggcttggtagctgttattgtaggagaactcggcgtaggggagactcttatcccatgtcttcccaaaatctaggacacatgcgcaaagcataacttcgaggatctggttcagacgctcggtctgcccatctgtctgcgggtggtacgcggtgctgaaatttaatcgggttcccaactcttcctggagtttcttccagaaatgagaggtgaactggcttccccgatcagagacaattttcttaggaatgccatggagacttacgatcctagcgaagtagagttcaactagtttgttccctccataggtggtctttacgagaatgaaccgtgctaccttggttagtcgatccacgactacccatatagaatcatatccgccttgggtttttggaagtccggtgataaaatccatcccaatttcatcccatttccattctggcacttgtagaggttggaggagtccggccggtcattggtgctcgactttgacacgctggcacacatcacaaagggccacgaactctgcaatttcccgcttcatactaacccaccaatatttctctttcaagtccaagtacatcttcgtgctgccaggatggatggaatagggactttcgtgagcttcctgaagtatcaactgtttaagttccctgacgtctggaacgtgtggacccccgtttttataacaggaatcaatcgtgtaaacagtaccatttccctggatcaagtagtttggtacccacgaattcatagctggaataccaagtgcacatacacgagtgtctaatacgaattattacatcataggcccgcaggcatagtcttaaatcatcggaccgagcggtccggaatacatccaaaaacagaaatagataaggtagcggaattcaggcagcggcatgccattgccacaggcaacgaccgtactaagacctactgggcaccatcgtcttcgtctccctcctggtagtaggcatagggatcctccgtagcttcatcgcccgcttctgattaattttatatttgcaagggtgagtaccaaccgtactcaacaagccaccacagcaacaatgcatatgaaagggggagagttcaaaggatggctatagttcttttgcgcaaagcaagttttgtaattcttttcacaagcctaagacctagcattgactgatcaaattttagtaccagagtttgtatttaaacaacgacggttctgtccaccatccagtgtgatcccaaggatagtttctcgccattgattcgtcatggttttcggaggacgtccaccttcctgcctctcaggaagtggctccaacggcatagaaatcatcatgcaatatcccatcccacacaggttaagaatttagagtctagccaagtgtaatacatgtcccggtgctcaataaccgcgagcacggctattcgaatagatttggtttacttacactgcagtggatgtacactttacccgcactccacgactgcccaacatatgagcctcgtcccaacacatgagacgcgtcacggcaaagcttttcgataacctcgcattggcagtacccgctccatgaacttaaatcctcatgcactctaggcgtccatgtttctagcagtgagaggagttctggcgctcccgggacagagaagtctcacacatattaaattatggttcaagttaagttctctctctcacacactcatggcagtcctaccaatggcgacaccgatgtagggcacgcctctcggccctacctcaacggctgtcccatcgtagcgcacctgcctcactcaggggtgaaccatctatgcagggatactgcctccgctcggctatctaatccgctaggtctatactcattcgagaagtacggttgtacgggggtcgtttcatgcttaacttcatggctcggtccttaattgaccggggacggtactagcctttcccagataccacccaaatcctccgtccgccccagtcgaaaacaattgtttaattttattttttctttcacaaatcatgtcatcaacatcatggcaatgtggcgctcatgtctccacatgccgcatctcaattaccttcccaaaggtaattgcccaagcatatagcatttgataattatgagtatgcatgattctagaatagcatttctaagcatttgtcatagttgactagggactcatacgtaaacatggttacaaagatttaagggtaaacaataatcaaggcatggcataatcacaagtaggatgttcatcattgcatgcaattttatttgtaaacaaaacaatttcgcaattgggatcaacatgttcaaggaatagtgatgacttgccttgctcgaggtcccgcgggtcttgtccttcacctggatccgcggctccctcggtctctatagttacgtgcgaaaattgatttgaattcggttagaattcaaataaaaatccaagtaaatccaaatggaagtcgaatgcgaaagtcgattcttttatattaactttactattcgcgaactagggcaaaccccatttcaatttaaactattttgcgagtataaatattttgttgtcatgagtttttaatttaacctacccgagcaacatatcaattaataggttagaaatttctatcgcgagctaaacatcggacgaaatcctagaatattatacgacttaatttagtctatgattaaatataatacacggctaacatcctagtaattaaatccgaatcgctaccgttaatcgattacttatagagattacccagaaataatccataataatttacgagaattcatacatttgtttaattattaattacatctaaattaataccgcgaattgattccttatggagagtaataaaataatctataatctataggaattcatccaattatattttcattaatcctatatttaaaagccagtgttttaggtatttaattagtaagatttcatctaactatattttcattaatcctataattaaattctaatatttgcaaatattttaaatttcccccaaaatttttcctttttcttttccctctctctctctctttatttttttcttctcttttctttcctttcctttttcctctcctctcttttcttttcctcttttcttttcttttcattctctcctctcttttcttttcctcttttcttttcttttctttcttttctttcttttctccccctctctctcttttcttttcttcttcctcctcctggctcctttctctcttcccttctcttctctcggaactctctctctccctacccgtggcggcggtgacgacagcacgcacggaggaggggggggggggggcggcggcttaccgacggcggcgggggcgacggcggcgcaaggcggcaacgcacggcgcggtggctccggggcggcggcgcggcggcacgatggcggcggcgcggcggcacgatggcggcggtgcgtggagaaggaggaaagggagggggaaatggaggggatgggtgtgggatggagaagggaagggccgggttttataagggcacggggaaggggcggccggcctaatggcgacgcgacgggcggcacggttggcggtgatggcgacgagcgggcggcgcggcgcggggctcggcgcgactcggcacggggctcggcgcggcgacgagacgggcgagcggcgcggcagcggaacggcgatggggacggcgcggcagcggcggcgcgcggctcggagcgacgatgggacgcgcgcggcgacgggatgggcggtgacggggcggcagcggtggcgcgcggcacgaggagggatgcgatggtgacggcgacagcgcggcagcggcggcacggggcgcaaggcgacgcgacgggcggcagcggcgacgcgacagcgggcggcacggcgcggggtgcgatgacgcgataacaacggcgacggcgacgcggcagcgacggcgatggcgcgcggcgggacgaggcgcgaggcgcgacggggacggccgagcggcgcgcggcgcggcaggcgacagcggcacggcggcaggcggcgacggcgacggctcggggcgcgaggcgcgcatggcagggaaggggaaggggctaggggacacggtcgagcacgtggcggccgatgaacagtgcactttcctatttttctcattttagtctattacttttataaatttgattccacaattcctaatttttgcataaatgaagtttactccatatttgtgttatcctaactaaaaaaattcaccctaatttaatatcactcatattttgtttatataatttatttaaatttttaattagggttaattctcatttcatcatactaaaatttaattattgctaatatggttgcgataatattttatttattttccaatcccacctaatctttattttaatttatattttaattatttatttagccaacttgatttttagggtttattcctagttagttattcattattcgcgattaataaattccgagatcaaaatccaatgaaacaggcgaataaaatcatgatgcaatttattacttaaaatgttttgaaactccgtatttttggtgttttgattttgttggtcgaattttcagggtgttacagaacgcatacccgattcccgttccatagggttccgtgttcatcctctgtgaaaccagcggctttaccctgtttcatgttcttgaggagcccatgcatatccggatcattcttctgagcctcgcggatttgatcgagcaaggtaggcttggcttccaacgtagccaagaatccacgaccaactatgcttaggttcagggcttccaactgttgattaagttccggtggaatgccacggacgccaagagtgttgcaatggctttttcgacttagagcgtcggcgactacgttggccttgccaagatgatagtggatccccacatcataatccttgatgagttctaaccatctcctctgccgaagattcagatccgactgagtgaagatgtatttcaaactcttatgatcagtatatatttcacagcgattcccaatgagatagtgccgccagatctttaaagcatgaaccacagcggtcaattccaaatcatgggtagggtagttgccttcatgaggccgtagctggcgtgaggcataggctaccacatgaccttcctgcattaatacgcaccccaatccttggcgcgaagcgtcacagtacaccaggaagtccttgcgagtatccggtaagattaacactggcgaggaaaccagcttttctttgagagtttggaatgctttctcacactgcggactccacacaaatttttcttctttcttcaacaactgtgtcatgggtcgagcgattttggagaagttctcgatgaacctccgatagtacccggccaaacccaaaaagctgcggacttgagtgatcgtcttgggttgcttccaatcggtgacggcggtcaccgtttcggggtccacagcaactcctttagcagatatcacgtgccctaagaacttgacttcggacaaccagaactcacacttgctaagcttggcatacagttgatgttcccgcagctttcccaacaccagacggagatgctgctaatggtcttcctctgattgtgagtacaccaggatgtcgtcgatgaagaccacaacaaacttatccaagtattccatgaacactttgttcattaagttcatgaagaaggcaggagcattggtcagaccgaacgacatcaccgtgaattcatacagcccatatcgcgtggtgaatgcggtcttcgggatatcttcttcacgaatacgcaattggtgatatccggagcgaagatcgattttagaaaagatggtggcacctttgagctggtcgaacagatcatcgatccgaggaagagggtacttgttttcgatagtgacttcattgagagctctgtagtcaacacacatcctcttcgtcttatccttcttctccacaaaaatcacgggagcaccctagggggaagtgctcggccgtatataccccttttccttcagctcttccaattgcttcttgacttcggcaagttcatttgctgccatacggtagggccgtttgtacagaggagttgttcttggagcaagatctatccggaactcgatctcccgcttgggcggcataccgggtagttcttccggaaacacgtcaccgaactcactgacgatggggatttctgacaatcctatctgatgaagttctgaactgccaacagaggttgggggtgcaaagaacacaactggttgttccggccctcggtacagagtgacagtgcgccttgcgcaatccactaccccttggaattgagccaaccaattcatcccaaggatcacatccaagttcttggtgtccagaagaatcaaatccgaggggaaagggattccctggatttctataggaacggccgggctgtaatactttgctgtcatatcccctccaggggtggtgatgagcagagggttcctaagccgttctacccccagttgatttcttcccacgaaaggcacagatataaacgagtgggaagctccagagtcgaacaaaatggtagcaggaatggaatgaatgaggaacgtaccaacgatgacgtccggagttgtcagcacatcctcggcagtcacgtggttcacacgaccccgagcgacgtccttaccaccgttgttggggcggggaggcgcttggccttgctggcaccgcggcttcgggcatttgtccgcaaagtgtccgggctcgaagcagttgcagcacagacgctgctgtccttgagcgtctctgcggccttgaccaggctgcacagctggcgcaggaggacggggtgcacgggtcccttgctgaccctgctgttgctgcggctgtgggacgcgcaccacgaattggggtcggggcgcggagcgaggttgctgctgctgctgctgcgaggaggattgtcacgccctgaaaattttaaaatttataaattgttgtttaaatggaatttctagaaataatttaaagtcttgaagagaagatcttgttttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaaagtctcttttggctttgggccgaaagtcggcccaaatctcttctctctctcctcggcccagccggcccagtccgccgcgcgcgcgcgccctcgctgtcgctgacaggtgggtcccgcctgtcaggtccttcatccttctccggccgccgccgccgaaaccctagtttcgcgccgccgccgtttcctttccaaatccggccgttcctttccttctccggccgaattgaaagaggggaaatgatccttgggatctcctctaccttttctcctttggaatctttggctaaatcgttttggaaagagttggattcgagttcgtctcggatttgttcttcccgagctttccttcgccgttgccgtcgccgtgggccttcgccgccgcctccgagcccctttaaaaggacccccggtgtctcctctacccgtcgccaccttcgctttcgcctctcgtcgtcggaagagctctagcgccgtgtgccctagcttcgccgtcgccgccgccgctccagccgtgcgccgccgtcgtttcagccgtcgccgtcgctcgggaagaccaccgtcgtgctcgccaagtcgtcgccgtcctcgttcgccccttcgccgtcgccggagatcaccggagcagcttcgccgtcgtcgacccgaaggttcccgccgcttcctccttgtcgccgtcgccgtccgttggtcttccgccgccgtttaggtcaccggtgagttcgccgtgttgtcctctacatcttggtgccctccgtttgcgtcctagcgccgccgtttgccggtgagtgtgcgccgcccgagccgtccgctccgccgagccgctgccgctgtcggtgacgtcaccgctgacgtcatcggggtcgtccgccgtgagccggtcgtggaccgatcgatctcggccgtccgttttggattggatcgatctcggccgtccgttcgcgtgaaccgtcgcccgtgcgcccggtccaccaaaccctagcccgctgacgcaataattctcttttccttttcaaaaataattcattattgcgtcataattcaatttaaaccgatataagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgcagaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggccctttcgtacttgattaccttattccttgataccttgggttattacaatttgactagttgagctttatttatattggttcaactagatattagatataattgcttagccctgcttagaaacattagtacacattcgggataactaatgactcactattatttaatgatggtttcatgatagttcacgatggtcaatcgtgattagttaattaattaatgtgccaactaaaacctggtaatggtgggttgtgagcacatggttttgttggtcgtgctcatgacaattaaggaccggttcacgagtttcggttgtgaaacattaaccgtgccaaccacaagccagcatgggcaacggctttatcttttgtatagcatggttcattgcggggcaccagactgagaagtggcggagataagcccacgggggtcgctggggagtccatgccttgtttataagggggtgattatgatctaggaaggtgcgctgcggtggattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattgtaaaagatgcttaaactggtaataatttgattagctcctggtttggaatggtacattcctggtttggagatagaactgtgcagccgggatggttgttcagaatggttgggcctatacaacagggtatgttgtatagcgttggattaatattgtttaattacttaactgttttattaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccgctgcttagatctttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaagttggtatcagagctcccttgaccctaggttatgccaaatggttatccatagaagccctctaaaaatattggaaaagtagaactgttctcctccctttctcttttaattaaaccaaactaatggcacatgcatttcataatctcttttaatggttctcattcaaaatttattccagtgttattagtactgtacatctattactgtactaatggctcatttaccagcaaaagttttacaatactgttttatttaatcttgctgcaataaaataaatttagcatgttgattttataattttctttcatttcttttgaaaccagttattcaaaattacaaaatttgtgacctcgtttccaactgttttaacttatctcgcaagcttggtttactttatttacttacctttttactttgattttcaaactttattcaaattaatccaaaaacttgtgctattaattggatagatgtcttaactccctcctttcacctgtctttagatgccgcgttacaagcctgagtacctgtttggtgttgagggttttgtccaggagttgcgtacgatgtcctttgtcattggatttggaactgcccctttttatgcccagattgctcatgatcgtcatgaagagaagtgccgagtcaaagtcaccttgaacagtaatagtgaagatatcccctcagtgatgtttgaagctggaggaagaaactacatccatgcatgtcaggaggtggcaaggatcgccataggagagctccgtgatcgctacagtgatcaattggccgacactgagtatcgctaccatcctcgccaaccacagggaagtgaccgtggcagttaccttgagactgaaggaattgagaatgatgttaccacaaagcatttggttgagatgttgtgggctatggatgaaagtcgtgcggagactgtgttagcagcccaagatcgtgaagattggaatcgtggtaagatttgcaagttagaagacaaggtggatcgtttggagaaggaattagccgcattaaagggagaagcaccgccgcagaaggccaggattcgtcttaccgcaaggaagagagctctatttgttcctcgctatcaattggcgccaaaggttcgtgtggtggagaaagaagttgccccagctcaagcggatcctccggtcatcatcataagtagtgatgaagaagaagaatccaagcgcaacaattccaagattgagtgggtagcaacccaagttgataaagacgagccttcaatcgacctccgatgcttggaagaactagagtgacttgttaagccgttgtcttagatcgatgtgttagtttgcttgttttaagtttgcttgtgtgtgtgggtcttgcatgtgatttacatcagtggtgggatgtaagtgcatgcgtttgtttgcttttgagagttaggaagttggtgagtttagtggtgtgagagtctttagtttgtaataataaaactcagttaagatcaataaaagttaaagtaattctctatcttaagtagtttcccccggtttctcttcttgtgccctgcccatgccaaatggtgaacactcacagcaatgggaatggtcccaacaaccccaataacaacaacaatggagagaatcccactcttgctcaagttcttgctcaacagacacagcttatgaacatgatgatgcagcaatttcagaatcagcaaaaccaaggaaataatcatgcacctccccagaacaagttagcagaatttcttcgtgtgaggccgcctgttttctctagtaccactaatcctgttgaagctagtgattggctgcatgccatagagaagaagttggatttgcttcagtgtactgatcaggagaaggtctcatttgcatcacatcagttgcatggccctgcctctgaatggtgggatcatttccgccttaacaggactactgctgaacctatcacttggcttgaattcaccgctgctttccggaagacgcatataccatcaggagtagtgtctctcaagaagaaggagttcaggtcgcttacccagggatctcgctctgttacggagtatctgcacgagttcaatcgtcttgctcgttatgctccggaagatgtgcgcaatgatgaagagcgccaggagaagtttttgggaggacttaatgatgagctttcttacccactcatggttggagattatcctgatttccagaaattagtggataaggctatacgtcaggaggacaagtacaatcacatggagcagaagaaacgtcggattgctcacttcaaggcacaacagggaaataatcagaagccgcgtcttactttaggaccccagtccatgccacagggaggttcttcgtctgttgttcgtccgcagcgtcagttcttcaacaacaatgctggcaacaacatccgtaatcaagctccacgtcctgttgcagctccagcacagcaacaacctgccaagagagagcaaggcagcaagcccgtggtgtgtttcaactgtggagacccaggacattatgctgacaagtgtccgaagccccgacgcgtgaaggttgtccctgcccagaataactctgctgtaccagcatccaaggctcgtgtaaatcatgtcgctgctgcagaagctcaagatgctccagatgtgattttccttgttaactcagttcctgcaacagtacttttcgattctggtgctacacattcattcttatctatgagttttgcgggaaatcatgggatggaagtagaagatcttagacgtcctttgatggttaataccccaagtgatcaagcactttctttgcaacgtagcccctcggtcagaatagaaattaagggagtaccatttctggccaatcttatcttgttagaatccaaagaccttgatgtcatcctagggatggactggttagccagacataaaggtgtgatagactgtgccaacagaaaagtaactctcaccagcaatgatggtcgagttgtgactgttcatgcattgtcatctgagtctttaaggtcaagactgaaccagataactttggaagagattcctatagttcgggagtattccgatgtgttcccagatgatttacctggtatgccgcctaaaagggatatagagtttagaatagatttggtacctggaacgactccgatccataagagaccttatcgaatggcagccaatgagttggcagaagttaagaggcaagtagatgatttgcttcagaagggatacatcagacctagttcatctccatggggagctccggttatttttgtggaaaagaaagaccatacccagagaatgtgtgtggactatcgtgcattaaacgatgtgactatcaagaataagtatccgctacccagaattgatgatttgtttgatcagcttaaaggtgccactgttttctccaagatagatcttcgatcaggatatcaccagttgagaattaaagaggaagatatacctaagacagcttttaccactaggtatgggttgttcgaatgtactgttatgtcttttggacttaccaatgcccctgctttcttcatgaacttgatgaataaggtgtttatggaatacctagacaagttcgtggtggtctttattgatgatattcttatctactctcgaaccaaagaagagcatgaggaacatcttcgccttgcattggagaagctacgagaacatcaactgtatgccaagtttagcaagtgtgaattttggttgtctgaagtgaaattccttggtcacgtcatctcagcaggaggagttgccgtcgatcctagtaatgtggaatccgtaaccaattggaagcaaccaaagacagtttcagagattcgcagtttcttaggcctcgcaggatattatcggaggtttatagagaatttttccaagattgctaagcccatgacacgattgcttcagaaacatgtgaagtacaagtggtcagaagaatgtgagcagagttttcaagagttgaagaatcgcttaatatcagctcctattttgattttgcctgatccaaagaagggtttccaagtgtattgtgatgcatccaaacttgggttaggttgtgttttgatgcaagaagggaaggtggttgcctatgcatctcgtcagttacgtccgcatgagaagaactaccctactcatgatcttgagttagctgcagtagttcatgcattgaagatttggcgtcattatcttttcggtactcgtacagaagtgtacaccgatcacaagagtttaaagtatatctttactcagccagatctgaacatgagacaacggagatggttggaattaattaaggattatgacatgggaattcattatcacccgggaaaggctaatgttgtagcagatgctcttagcaggaaaagttattgcaatgctacagaaggacgacagttgccattggaattatgcaaggaatttgaaagattaaatttgggaattgtcagtagaggtttcgttgcagccttagaagcgaagcccactctaattgatcaagtaagagaagcccaaattaatgatcctgatattcaagagatcaagaagaatatgagaagaggaaaagctatcggtttcttggaggatgagcaaggaactgtatggttaggtgaaagaatctgtgtccccgacaacaaagatttaaaggatgcaattctgaaagaagctcatgatactttatactccattcaccctggtagtactaagatgtaccaggatctcaaggaaagattttggtgggcaagtatgaagcgtgaaatcgcagaatacgtagcagtatgtgatgtttgtcagcgagtcaaggcagaacatcagaaacctgccggtttgttgcagcctttgaagattcctgaatggaaatgggaagaaatcggtatggattttatcactggtttacccagaacgtcatcaggccatgactctatttgggtgatagtcgacagacttaccaaagtggctcatttcattccggtaaagacaacctattctggaagtcgattggcggaattgtatatggcaaggattgtgtgtttgcatggcgtccctaagaagatagtgtctgatcgaggcagtcagtttacttcaaatttttggaagaaacttcaggaagagatgggttctaagctgaactttagcactgcttatcatccgcagacagacggacaaaccgaaagggtgaatcagattttggaagacatgttgagagcttgtgctttagacttcggtggaagttgggataagaatctaccctatgcagaattttcgtacaacaacagttatcaagctagtctacagatggctccttacgaagcgctgtatggtcggaagtgccgcactccgcttttgtgggatcaaacgggagaacgtcaggtttttgggacggatatcctaagggaagcagaagaaaaggtaaagatcattcaagaaagattgcgagtggctcagtctcgacataagagttatgccgacaatcgccgtagagatttgagttttgaagaaggagactatgtgtatcttcgtgtcacgcctcttcgaggagttcatcgttttcacaccaaaggaaaattggcaccgcgttttgtgggaccttataagattgtcagtagaagaggagaggtcgcttatcagttggagttacctcaatctttggcaggagtccataatgtgttccatgtttcgcaattgaaaaagtgtttaagggtacctaccgaagaagctaatcttgatcagatagaagtccaagaggatctgacctatgttgagaaaccaatccgtatcttggaaacaaatgagagaagaaccaggaatcgagttatccgtttttgcaaagtccaatggagtaatcactcggaagaagagtccacttgggaacgagaagatgaattgaagtcagctcatccgcatctgttcgccagttcttccgaatctcgaggacgagattctgtttaaggggggtaggtttgtcacaccctgaaaattttaaaatttataaattgttgtttaaatggaatttctagaaataatttaaagtcttgaagagaagatcttgttttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaaagtctcttttggctttgggccgaaagtcggcccaaatctcttctctctctcctcggcccagccggcccagtccgccgcgcgcgcgcgccctcgctgtcgctgacaggtgggtcccgcctgtcaggtccttcatccttctccggccgccgccgccgaaaccctagtttcgcgccgccgccgtttcctttccaaatccggccgttcctttccttctccggccgaattgaaagaggggaaatgatccttgggatctcctctaccttttctcctttggaatctttggctaaatcgttttggaaagagttggattcgagttcgtctcggatttgttcttcccgagctttccttcgccgttgccgtcgctgtgggccttcgccgccgcctccgagcccctttaaaaggacccccggtgtctcctctacccgtcgccaccttcgctttcgcctctcgtcgtcggaagagctctagcgccgtgtgccctagcttcgccgtcgccgccgccgctccagccgtgcgccgccgtcgtttcagccgtcgccgtcgctcgggaagaccaccgtcgtgctcgccaagtcgtcgccgtcctcgttcgccccttcgccgtcgccggagatcaccggagcagcttcgccgtcgtcgacccgaaggttcccgccgcttcctccttgtcgccgtcgccgtccgttggtcttccgccgccgtttaggtcaccggtgagttcgccgtgttgtcctctacatcttggtgccctccgtttgcgtcctagcgccgccgtttgccggtgagtgtgcgccgcccgagccgtccgctccgccgagccgctgccgctgtcggtgacgtcaccgctgacgtcatcggggtcgtccgccgtgagccggtcgtggaccgatcgatctcggccgtccgttttggattggatcgatctcggccgtccgttcgcgtgaaccgtcgcccgtgcgcccggtccaccaaaccctagcccgctgacgcaataattctcttttccttttcaaaaataattcattattgcgtcataattcaatttaaaccgatataagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgcagaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggccctttcgtacttgattaccttattccttgataccttgggttattacaatttgactagttgagctttatttatattggttcaactagatattagatataattgcttagccctgcttagaaacattagtacacattcgggataactaatgactcactattatttaatgatggtttcatgatagttcacgatggtcaatcgtgattagttaattaattaatgtgccaactaaaacctggtaatggtgggttgtgagcacatggttttgttggtcgtgctcatgacaattaaggaccggttcacgagtttcggttgtgaaacattaaccgtgccaaccacaagccagcatgggcaacggctttatcttttgtatagcatggttcattgcggggcaccagactgagaagtggcggagataagcccacgggggtcgctggggagtccatgccttgtttataagggggtgattatgatctaggaaggtgcgctgcggtggattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattgtaaaagatgcttaaactggtaataatttgattagctcctggtttggaatggtacattcctggtttggagatagaactgtgcagccgggatggttgttcagaatggttgggcctatacaacagggtatgttgtatagcgttggattaatattgtttaattacttaactgttttattaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccgctgcttagatctttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaaggatccccctggatagggattggtgtagcggaccctttggttagccccctgttgattgaggaaattcgccaagtgacgcttgtgcgactccagttccttgtgcttggcttccaagcggatgctcttgtccaccagacgctggaaatccggataatccccggagaccagacgcacagatagctcagggtccattcctgccaagaacttctcctgcttttcctcatcttcccgaacatcctccggggcgtaccgggccaggttgttgaactcatgcaaatactccatcacagagcggttgccttgcttcaactcccggaattcccttttcttaagggccatgactctggcaggcacatgggtcctccggaaagcggcggtgaagcgggcccaggtaataggctgcccctcgggctgcgtagcctggaagtggtcccaccatagagatgcgggcccctgcagctggtgggtggcaaagatgactttctcctcatcgttgcactgcacggtgtctaacttcttccccacggcatgcaaccaatccaaggcatccacggggttattggagctagagaaggtaggcgggcggatgcgaaggaactcggcgagcttagaatgctgcgggggtggtggtggaggtggagcattatgctgtggtggattttggatgtggtggaggaaagcagccatcatgttggcctgctgggcgaggatttgagtgaggatggggttggtgtctggtggtggtggtggtggcgggggaggaggtagaggtgggccaccttggatgttggggttgctaccttcgggttggttgccatcaccagtagcagcagttctcctggttgtcaccatctgaaataccccaaaacaaaccagccaacagagagaacagactattaaaactaaccacccacgactaccaaaattattgaacttattactgatataaaatgggttcattaaggttcaggatgcttaagccaataaaataaagacaggctccgacacaatcataccacacaccggtacaaccatgccccacacgacttcaacaggaagacaaacgagaaagaacacactcgcaagcctactaactgctcgtctacttctgcgacgggccagggcggaaggtgagcagcagcgcatcctccgtgctaccaatgccggaggtttccccctcctgaggaaccacgggcgcgggctcggcacgaggggtctccacgaagcaggtccacgccagggactaacgaacaagctcaggcctggaggtgctcttgcgggcagtgatcttctggctgcggcagacgcggcggcgcttgggacggcagacctctccctgggcgaccttgagctgacacagctgcgcctccagcgcgtctaggtccttcttcagctgcagattctcctgacgcagctccaggatcttcatgttgttctcgaccatcccacggcgcaccatatgatggaagtcgatacgggccgcgtcgtacgcctccaccatgcgcgccaggtgcatgatggtagcgtcatcctccgagctagcatcccggaaggtggcgtagtcgcgggctcctccgcgacgagggtggtagcggtagggcgagtgctgcaactcgtccgggtagcgctggtgaagagtgccgatggcgaggagtgcggcgttctggcaagcagcggagaaggaatctcctcccgtggtgactgccaacgaagtcctctcgggagagccagtgaggatcactgcagtgacctcccaagcagcatgcgactctgcatcgtcaccctcctgctccgggagctgcttgccttggtagtccactccatgcggataccccaggacaacgcacatgccccgcagctccagaacaaagccggtcaggtccaggccacgacggttgatgctgccggccatctacaagcaaggacaaaaaagagagaaaatattttagagatcagcttttgatgacaaatgaagcagcaagacagagagagactaaaggattttcacaaataagagaggatttttatttcgaaaatattgctaaggcttgggatctaaggctcgtcctagggtcaaggaggctctgataccaacttgtcacgaccggaaataacccaacgggcgttccttacgtgcgtgtattattccttgtcccaggaggcaaggtacaccaaaagttgatacaattcagagtttaacaagcggaagcgtaaatagttaattattacatgggcagcgacggcccaacacactcaaagacaacgaaaaacagcggaagactaaggcgacgaccacaggcgcttgacggcaggcacgagctagacaccaaagccttcatcatccaggggctcctcttctgggtttgggaaaaattgagcaagactgagtacaaccaccgtactcaacaagacacacccacaagtgcagcataaatgcaaaggagtacaatggagttatagtataggggttaggttttgcaataaacagcatttaaaagactcttagttgctcaaagctaaatttaaaacacgatcctagaactatttaatattattaaacaaggccgtgaacccacacgaacctgccttaacccaaggcctacgatgattcagaccgaactggcaacccgaccctgggtcccagctcgtcccaagccaacccaggccaaccattccacattttagttattaagcaggttttaagaatttgaaacactaacttgggtacattgctaggcttgcccataaccgagggcgcggctattcgaataggttttactctgatcagaggtgtacatctttacccacaagacacgtcttcctcacgtgcaaccacgtgccacataccaccacggcatatggacggaagacatgacatagtttccaacccatcctagccatagacaagagtaccgacccaacccacctacggccagaacccccggacaggcaggcagaattgagcccctagcagcaggacaccagccctgtgctatgacatctcgactaccgggccgcagcccgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatgtggccgaggggctactatcaaaaccatgcaccccaagcccagcctaaaaccattttgagagttttgaatagagggggaggtgtgcatccaattccacaataatccaaccattccaatatgtccaggtgatatgaatattcccaaagtctagagttataaaaccacctaatgttgcctaattaatcagcgaagcatctacctaaattcttgctagtggaaccatgaatagagtgcccactagttggggttttgtttattctagggtgaacaaggtaataataacaataacaacaataataaggtcataacaaaggtaaataggcatggctaaataaaacagtgataacgcgggaatttaaataaagcgataatgcaataatttaaatcaaagtaatttcacaaagtgggatccaatatgttcaaagaatgatgtgacttccctttctcgctttcccaaacgtcggcttcaacctccacgaagagcggatcttccaaagctgcagcgtctacacaaccaacagaaaagaaaagggcttttactctaataaactccatataacaagcaggaacaaagcacaaaaatgggttcttgacttcttaaggaaaaattagagacttgaacggtccaattccgagttcaaatggccaagttatggccatttgaagtttatatgctctttaaatgaatatttacgaatttcttcatttaaattttaatttaaaaatagatttattgcgtcagccgggagagagggcgcgcggaccgggtccacgggagtgggacccacgcggcagtctcacggtccacggtggaccgggtgcacccggctcacaccggccggccccgtgggccccacgcgtcagccgcacccgagggcgcgggcggctgatggccgggccccatgcggcagccgctaggcgcgcccggaggcggccacatcggcacggccggcgggaggcggcgcgcccgcgcccctatggtcgctggcggcggccataggcacggcggagcggcggccgagagaggggagggaaagggggaaacgaagcggcggtccacggctcaccccgggtcgacggcgacgacggaacgggcgaccggagcggaggaaggcggcggcgcggctcgggtggacggggtcgacggcgctccggcggtcggcgagcgaaacggaggggtggacgaggtcggcgaggatgcggcgaagccgaaggaggcggcgccgaggtgggaggtagtccggggcgacgacggcggcggaccggagctcggcggcgacggcggagagagagagcgacggcgcgagctcgattccggcggggagagagggcggtgagtggcggaaacggtggtggggagctcggggagggtttatatagggttgggagtgagagagggcggccggaggagggggaaatgggcgcgggagacccggccgccattaatggcgccggcgaggttaggggagaggtttccaaacaaatccgagggagagagggagggaaaaatggggggaaagggggaggggatcccggggaataattccccccactttattgcacgcggggccggcgggaggcggcgggattcgcggcggcggcggcgctaggcgcgggcgaggcggcgggggcggcgggaggaaggggatgacgggtgggccccacccgtcagcgagggaggcgggcgggcccgcccgtcagcagcgcgcgcacggggaggaggccgagtgggccgcggggaggaggagaaagggggagggagatgggccgagccggcccattagaggggagaggtgatttttagggtttttctttttataaaatcattttaactttgtttatttcttaataattattatttgtgctctgaaaattccactaaaatttatttacacattttaggcttttaggaaatatacaaaaatcctccaagccctatttgactttcaactttgcacattttaatttttgaaggcttttaattattctaggcataatttagaggatgtattttagggtcgatttgggacgcgacaaacctacccccttaaacggaatctcgaccccgagattcggaagaactggcgaagagatctggatgggctgccttcagctcgtcttcacgctcccaagtagcttcttcctcggcatggttgctccatcggaccttgcaaaaacggattacccgattcctggtcctgcgctccatggtgtccaggattttcactggtctttccacgtaggtcaagtcttcgcgaacttcaatctgctctgagtcggcctgctcggatggcactcgaagacatttcttgagttgcgacacatgaaacacatcatgcacgttgcccaaggaggcgggcagctccaactggtaagcaacttctccgcgtcgagcaatgatgcggaaaggactcacgaaccgaggggcgagcttccctttcgcttgaaacctgtgtacaccccgcaacggcgttacccggagatacacaaagttatccactgcgaattccaggtcacggcgtcggttgtctgcataactcttctgccgagactgtgccacctttaggttttcccgaatggtcctgaccttcgctttagcttctctcaagatatcggtcccgaacacttggctttccccaacttggtcccacaatagtggtgtcctgcatttgcggccatacaacgcttcgtatggtgccatctgtatgctggcttggtagctgttattgtaggagaactcggcgtaggggagactcttatcccatgtcttcccaaaatctaggacacatgcgcaaagcataacttcgaggatctggttcagacgctcggtctgcccatctgtctgcgggtggtacgcggtgctgaaatttaatcgggttcccaactcttcctggagtttcttccagaaatgagaggtgaactggcttccccgatcagagacaattttcttaggaatgccatggagacttacgatcctagcgaagtagagttcaactagtttgttccctccataggtggtctttacgagaatgaaccgtgctaccttggttagtcgatccacgactacccatatagaatcatatccgccttgggtttttggaagtccggtgataaaatccatcccaatttcatcccatttccattctggcacttgtagaggttggaggagtccggccggtcattggtgctcgactttgacacgctggcacacatcacaaagggccacgaactctgcaatttcccgcttcatactaacccaccaatatttctctttcaagtccaagtacatcttcgtgctgccaggatggatggaatagggactttcgtgagcttcctgaagtatcaactgtttaagttccctgacgtctggaacgtgtggacccccgtttttataacaggaatcaatcgtgtaaacagtaccatttccctggatcaagtagtttggtacccacgaattcatagctggaataccaagtgcacatacacgagtgtctaatacgaattattacatcataggcccgcaggcatagtcttaaatcatcggaccgagcggtccggaatacatccaaaaacagaaatagataaggtagcggaattcaggcagcggcatgccattgccacaggcaacgaccgtactaagacctactgggcaccatcgtcttcgtctccctcctggtagtaggcatagggatcctccgtagcttcatcgcccgcttctgattaattttatatttgcaagggtgagtaccaaccgtactcaacaagccaccacagcaacaatgcatatgaaagggggagagttcaaaggatggctatagttcttttgcgcaaagcaagttttgtaattcttttcacaagcctaagacctagcattgactgatcaaattttagtaccagagtttgtatttaaacaacgacggttctgtccaccatccagtgtgatcccaaggatagtttctcgccattgattcgtcatggttttcggaggacgtccaccttcctgcctctcaggaagtggctccaacggcatagaaatcatcatgcaatatcccatcccacacaggttaagaatttagagtctagccaagtgtaatacatgtcccggtgctcaataaccgcgagcacggctattcgaatagatttggtttacttacactgcagtggatgtacactttacccgcactccacgactgcccaacatatgagcctcgtcccaacacatgagacgcgtcacggcaaagcttttcgataacctcgcattggcagtacccgctccatgaacttaaatcctcatgcactctaggcgtccatgtttctagcagtgagaggagttctggcgctcccgggacagagaagtctcacacatattaaattatggttcaagttaagttctctctctcacacactcatggcagtcctaccaatggcgacaccgatgtagggcacgcctctcggccctacctcaacggctgtcccatcgtagcgcacctgcctcactcaggggtgaaccatctatgcagggatactgcctccgctcggctatctaatccgctaggtctatactcattcgagaagtacggttgtacgggggtcgtttcatgcttaacttcatggctcggtccttaattgaccggggacggtactagcctttcccagataccacccaaatcctccgtccgccccagtcgaaaacaattgtttaattttattttttctttcacaaatcatgtcatcaacatcatggcaatgtggcgctcatgtctccacatgccgcatctcaattaccttcccaaaggtaattgcccaagcatatagcatttgataattatgagtatgcatgattctagaatagcatttctaagcatttgtcatagttgactagggactcatacgtaaacatggttacaaagatttaagggtaaacaataatcaaggcatggcataatcacaagtaggatgttcatcattgcatgcaattttatttgtaaacaaaacaatttcgcaattgggatcaacatgttcaaggaatagtgatgacttgccttgctcgaggtcccgcgggtcttgtccttcacctggatccgcggctccctcggtctctatagttacgtgcgaaaattgatttgaattcggttagaattcaaataaaaatccaagtaaatccaaatggaagtcgaatgcgaaagtcgattcttttatattaactttactattcgcgaactagggcaaaccccatttcaatttaaactattttgcgagtataaatattttgttgtcatgagtttttaatttaacctacccgagcaacatatcaattaataggttagaaatttctatcgcgagctaaacatcggacgaaatcctagaatattatacgacttaatttagtctatgattaaatataatacacggctaacatcctagtaattaaatccgaatcgctaccgttaatcgattacttatagagattacccagaaataatccataataatttacgagaattcatacatttgtttaattattaattacatctaaattaataccgcgaattgattccttatggagagtaataaaataatctataatctataggaattcatccaattatattttcattaatcctatatttaaaagccagtgttttaggtatttaattagtaagatttcatctaactatattttcattaatcctataattaaattctaatatttgcaaatattttaaatttcccccaaaatttttcctttttcttttccctctctctctctctttatttttttcttctcttttctttcctttcctttttcctctcctctcttttcttttcctcttttcttttcttttcattctctcctctcttttcttttcctcttttcttttcttttctttcttttctttcttttctccccctctctctcttttcttttcttcttcctcctcctggctcctttctctcttcccttctcttctctcggaactctctctctccctacccgtggcggcggtgacgacagcacgcacggaggaggggggggggggggcggcggcttaccgacggcggcgggggcgacggcggcgcaaggcggcgacgcacggcgcggtggctccggggcggcggcgcggcggcacgatggcggcggcgcggcggcacgatggcggcggtgcgtggagaaggaggagagggagggggaaatggaggggatgggtgtgggatggagaagggaagggccgggtttta

SEQ ID NO: 83133 - DNA, 646 bp, Oryza sativa
tatagggcgaattcgagctcggtacccgaacaatttgatacaactaatactactattttcaaaattaattcccctcatgtgcattgctgtatgcattccatcttgtcaaatctgtaattaaattgaccatttatcacacaacagttccattccccacgttaattaaatttgagaacaatttgagatacaaccaataccactattttcaaattaatttccctcatgtgaattactgtatgcattccattccattccatttcattttatttccccaaccacttttgagatttgctagcagcatagtgtggtgccaccccctccctcttgtttgttggagtagttttttttttcgcagtagtccttttcttttcgcaattggttgttgcagtgattttttttttactctcttccagcatacgtatgtctagccgattgcgttgtgtatcaaaacctctatttcttactaatatattgacgtacaatccttttacgtattcgcaaaaaatctgtatttaatttgacaagttaattattaattactcactcacacaacacaggaggtgtacctggtgacacgtgaggagaaagcgaggtggtcggcgctgccgcgcgacaagtacccgaagccgatggtgttccacgacgg

SEQ ID NO: 83134 - DNA, 514 bp, Oryza sativa
tatgctttaaccttcggatcaatgcttattctatcatattgtattgctagccgattggtttatactacattatattgttattttattacatcatcattagccgattgcatttctatcattatctatattggacatatagccgattgcttaaaccctatcgctattggctggtatcggcatcggctattatttgcatcggctggaactactccatcggcttgtcaaccgatcggctatttgatctacggtttacatatcttgtcagttgcaggatcaaactgactggcatgcccgcacctcatcaacctttggacctgcactggagctaagcagatgtcccaggccagtgtgtgtttttcgcatcaacacatttttggcacgcctggtgggaccacggattttatatccacatgtctgaagaagaagtcaatgccaagatcatggtcacggtggagaatttagcggacgaacagaggcaacagatggagcagtttttaactgattttcaaatgcg

SEQ ID NO: 83135 - DNA, 602 bp, Oryza sativa
cgagctcggtacccatgtttttgacctaatgtggttttatatatcctacactttgaccattgtattttatattatattgctcatgatcttgaaattgacatcattggaaaatgtttcgaatatgaatctaatcataccataatgatttttattaaggacaaagaattttgctttcagacttttgttaaattatttgaatgcaattcaggtttggagcgcgcggttgtgacttttttttaaaaaagtaacaagaaaagataaaaaaaattaaaaaaaggctaggcatggcattagaaatgcatgatgaagatgaatactgcgtacctggtaccaaaagggagactgatggcattagatcctacaagaaaccactggagaaagatgcagacaagaaccgggacaatcaggccaagaacataaccggtgtgcctgctgtccctgcagctcccggcggcgtaggcgccgccgagtcccaagatcgccgtgacggtgagcccgtacagcgggaacttgatgcgcttgaggtcaagcttctcttattacacgttgaacgtgatggcgagcagggacgcgatgaaagagatggcgttggagaaaaagaa

SEQ ID NO: 83136 - DNA, 2272 bp, Oryza sativa
gagcccccacccatggcgcttaggcatcgccgacctccctacgtcctccctcctcacccacctcgctagtcgccgcgcgccgctccctcctttaccgccgggcgctgcacgccgccatcttcccatggcatctggaaagaggagagggagagagatgaagagagggagatggggagagaggaggaagaagaagggagggtgacaataacatgtggggcccacgtgggctccaccatttttaaattaatttattttgtgtaactgacatgtggacccgatagtttttattactttccaaattaaattgccacgtaagcgccacgtcaatgtcacgtgtgatgaagaccgagtcaaattagccatgtatgggccacatcagcaaaaaccgctgtctaaactgacttgggacttattttgcaccggttttgatggttgaacgatgaaaatcggattcgtcaacaagttaagggacctcagatgaacttattccttttccttttcttatgcgtggtccggcccaattcttcttactcccgcgcacaggccggcctgctcaaccattcctcttcttttcccgtgaaatactggcccagctagttagcaaaatgttcactcagctcagctagttgtccttgtatcaatttttgtaataatgttgcttcgactcctacacaaatatatgcacaattacatatcattaattaaatgtacatatatatatatatatatatatatatatatatatatatataccactatctctttttttatcgatcatgtccacatatatccgtgcggttaaattttattaacttaattcagggcacaattgtaaaaagatataatatcaaaatatcacactagtaaatttatataacgaaaaatactttcaaactattacagtcatggaagtacgaaatcaggaaaaagctcgcaattattccagagagtgtaccggccttttcttttcgtgagacgtgaatggatggagaacaataattagcctataatatacaccacgtggcagctttttatgaaaaaaagcactatgtgtggaggtacgtacatgaacaaaaaggttcattccgttgctacgtgccaaccgtttagaccaatcataaactacgtcattttcttaattaatgaacctggaaagcatcagtgtttgaatacatactacatgctaacttcgtcccaaaataagtgcagcaatagatatccgtgtccagcgttttgaccgtccgtcttatttgtaaattttatgaaaaaaataaaaaatactagtcacacacaaagtactattcatgtattatcatctaataacaataaaaatactaattataattatttctcaaataagaagaacggtcaaacattgtacatgaacagtgttaaaactacacttattttggaacggaggtagtagaaatcctgcacatataactatataaggattcaaaagtgacggttttaataattcgtaggttctgaggcctgtttaattattattttagttatatatatttttacatagtattacaaaataaaatatttatttttacttcgttgcaccaacacataattaattaatctgaagacaaagcaacacgcacatgacccacctgattaacacagctcattaataagagatcatgtgtgcatgagtatttcacaattgatagaagagatatttatcgattacatttttattaattttgacatacattacaagtacaaggaactaattaggaataatagatacccattgaccgatacaaatgaatacaacagaagcggaaaccaacaccagagaaacacatgcacatacattacacatagcttcccccgtctctagttgcatggcatgcaagaaagatatataataccatcaccatcccaaaatataataagttttagataggatatacggatatattacgaaagttacaggaataaaatgaaaaaaaaaggcagttgggattgattgataagaggagaaatatatatgtaagaaatttaattaatggaaggttacgattgttttataagagaatataggtgaagaagttgctatattttgagataaattttagaggctaaaagtaattatattttgggaaagatgagtaataataattaagttaattaattggtggtagcttgtctcctccaagtttgccctggagttcatattaaagtgtacgtggcacgtggtactgcacacgtgcatggcccatgcaagcacgcgttgaccggccggggaccctacacg

SEQ ID NO: 83137 - DNA, 570 bp, Oryza sativa
ggcaatcctaattgctgcaattaccctccttgaattattgaacacttaaacctccttgttaacgggccttcgggtacgcgcatcggaacaccccccctcaaaatataaaatatccaaccatgggtaaaacttgggttttacaaaagacttggaaaacccgacacctgggtcggtgcttgcgaactaaatgaatttccaaaaaatcggggaccggggaacgtaccgggtgtacggtttcccgctcttgcacttaaggaccgtttccttggaatttcatccgaacataagacaagtgcgaccacatggttggaatgggacacccctggctgagtaactagctaatcgggggagccatgatgccaagagacatgtggattcaacggggtggtgtcggggagaacccccgggtttcctggcacagtatggtctgggacctaatctggtgttggtctgggacccctcttgttggcatatggtgaacctgtgtcggctttcgaaatgccttgtcatgaaagccttaaggtctctagtcgtggccgttctgcacgggctggatgatccaggttagta

SEQ ID NO: 83138 - DNA, 4614 bp, Oryza sativa
attcctgcagccccaggatgttgggaagctgcaaaaattcacacaattttagcttaattacaattcatgtggtcacacacataaatttgaattgagcagtttgtgatttgaagaaataattaggtaattgattgaataattaccgcgacgtatttgtccttgatgagaaggccgtagaggaaccagacgacggcgctgagggtgagcgtgagggagagggagaagggcatgtactccacgctcctcgactggatcactcgcttctgcaatatcgcatccatcgtccatggaagcagttcagttagcaacgagatcgatcgatcaaaccaagacacgaagtaaagatgagctagctagagattgacgacgactgatcgtatatatgcacatacgatgatgctgagcggcgcgacaaagacgctgacggagaaggcgacgcagacccagccgagggagacgacgcgctgctcgccatgggagagcagcagcgtcagcagcaggatcaccccgaacacccccacgttcagcagcagcaggatcttcgtcgtgaacacctgcaaaaacgacgtcgaaccatatatacttgtcaattattatattttactactacaaaacggtaaatatggaacaatcttatataggtgccggttcttgttcacaaccgatgacacctgtaaggggcctctcatcggtgccggttgcgactcgagaatcaaagggtggttcccaagtccccaccggcatcgaaatagggtttctgtggtagtgctagggtttggatgacatggatcgaaccttggccttcttgggggcgtaggcgaggtacatgacgatgtagatggtctcgatgacgcaaccggcggcgttgatggtgatgaggagggcctcgttggacttgatcagcgcgtagaagatccacagcatggcgctgaagagcgccaccacgtacggcaccgactggaacccctccgtcgacttgctcttgtagatccggtagaacgtcgggctgcataaaatattatgcacatatattatcggatacggaacgcggtgcggattgggaattaaaattacacaaaagctatatatgtatatatcatgtagaaattcagttacttacattggtgccagataggtcgtgaaggatatgaggttgcctgcaaagccaaaggaacagaaacaagatcaggattttgtaaaggaaaaaaggcaaagtaatgcgagtaaagagccccatggaggcagctaaggtagcgaccagacgtgataagttgtgatagatagacacgtttacaaactttatgtctagcccttgccttcctttgcaacaaagattgtgccttggcttttaacttgttctttaaattattgtgttacatggtgcactatgatgtcattaattagagtactatatagcttgacctattaattccactctctctccatggcaacataaatatatagaggttgcaccaaaggatcgaatgtttgctccacaagtaggatatacatacaaatgatgaggacttgctgtatatatatagtttaacaagaagcagaaaaattatatggctatgtgcatctcattaagtatgcttaggcccttgtagtttatatgcttgtggattttaagcctgcaattttaagggtggcgccgcgcgtataattctaatagacaaaagccaaaagaaataaaaaaaatcaaatctagcttttggcttattactacaagagtaccatccatattgccttcggaaggctagtagggtttttagcttatgcgctagtagctaattaatatgcccaaatagacataataaactgctgtaaataaaagtgctagaagaaattctttttgttgaaaataactgaaagaagctagctagaaaataaaaaacaaataaagaaacacaacaattttattattttatatatgatgaccactaaagtgtaatcctcactaaatgtcgtcgctagctatgcgtatctgccagcaagtaataactctgagcttatatgtacaaactcaatggtttctaataaaaagaagtaaaatgttggcaatgaagggaatgtcttagttgtggtaggtgatgatgatataccaaggaggccgaaggcaaaagcccagggatgctgcagggacaggccagccatttttgtgtgctaaaaggggggtaattgaagggaagagatgtagtgtaatatggaagcaaacaagcaaggaattgagcttgttgttgctagcttggaacttgtcacagacacacacactctaaccctagaccccctttgtggagggaagggagagctctgaagaagagttcaatgtgttggctgaaaactcttggagaggaatgaagggagttgtggtgctttatataggagcaaagctagctaggtgggaatcacttggttgcctcctacccatggccattcacgtacgcatcaaagtaatcatagaataattatgcaaagattttttttctttatttgcttttgaggaaagtcttttggacacgcacaataattaggcttttacaaaaatgagctactgttggagataatcctggctaattttcaaaaaaagttgcattggctttgtgcgcagcgcacctctcactagccatagccaatttagtgagtaattgctttgtgcattgtcagtagagatcgatctctccaacgtctgcagcttcctgctgggaacggtaaaagatagccgccgagtgcaacagcaaatcacatgagatctctcccagtgaaggattattcctgaatcctgatacggcttttgacttaaattttactactcgaaaaatattaatcgcggagaaaaagataattgtacttagacaaaagaaaggtagaattctctgccttgtttctatatattaattagaaccgttttgtaacatgatcttgcaattattgggtgatagatacatgtaggtatactatagtttctctgttctttgtttgcacgggtagattaattctcaatgtcgccgacagtgttctgaaaaaaaaataatgattgtaattgaatatgcaattctcccatgcgcgtgatatagctgcttattatttaactgtctttaccaaaagtaacttattttttgtcgaaggattgttttcacctgcagtagacatccctgtcgactaagctttcatacacagtttgttgggaagagaggtcgatttctgcttctgcgaagcgcgttgatcttgttctactcccacgtatatgaagctaagctagtggatctgctttttttttctctctacttttttctgtgcgcgcggctgcttgcctttccaatcaacctataagcatagcacaatatatatacgcaatcaatctgcatatatataagcatacttaatttcgaaatatatatgatacatacatatatttaaatcctaaatttgatacaggtactcgtatttaattgttcttttaatgataggcacaacatactcgtgtgtagttgtaaacagcgagacgtccgtggtaatttcgtcaatctcaaaatatgtcggctagagtagtgtatgcgtttgtaggggtgggtgtgagcacgctttcatgctgtgttatattttattggcatgcatgatgcatataggttggttagtttggaattaccggtgtctaagtagtggcactgctggaaggaatgacatgcatatgtactgtctgaaataaagtacatctctctgacataaatgattgcgtgatagctagcctctgatcatcatcgtttggagagaccgtgtttgactcctaaacatgattggaggaaaactaaagtgattttgttaaaaataggaagcaaagaacggctagaacgcctatcttttggaaaggttggctcaaccaggtctgaacttggctacctgaacctctgccatacgtttactccctgataatgcatgtctcttgtgcttcattcagctagctagtgtgtttcatatgcgacataaattgggggaataatgggcttgatcgatcggacacaagtgaaaactctctcaatagctttaactatatttagtcgtctcattttctacgaaaagtcataaaattaacttcagaattttttttttgcaaccaatattataacataaaaataatctccagacatagtattgggacagcttattatgttgtcaaaaggattgttttttctacattgtcaaacaatttcagtatttttagagaaaaatatatttcctctacactacataaaaaaaaaatttgtgacgtcacccttttatttttactggcggattaacaaaacaaacgcttctaaaaatgtattggagggttcttggccatgagccactagcgaaaaccgatttttattggcggactaacaaaacaaacgcttctcggctcctcctatctctcctctactttacaactccatctacctccactcccttcagcttctccacctccatcacaccacacgacggagacgatgaccgcggtggcaacggcgacggtgatggcaggctgtgacgatggtgccagcgacaggaggggacaagggcggtgacgatggcaaaccgcggatccaacagcgatggtgcctagatgccatggat

SEQ ID NO: 83139 - DNA, 854 bp, Oryza sativa
actcgagcggcacttgtcggtctcgcttaacatgcacctgttatacgaggccagccccagcaaccagtgctgctttcacaggagggcaggatctcacagccccagttgtctgtctactatggaccaagagattagtcaagtcgtgctgaggtcagatcctgctctcacaacggcgttacggacgggcagcagaaggctcgacttgaaccaatcatgacaggcgcgagttgggaactaggccgcatctatacggctcaactgagccgtctagctgctccaagaactactggctggcggtagcctgatgatcatcttcagcaactatgcgggattgttcatatagagccagggtgcgtacgggtgtacgcatgtcgccatggggaatcggtgcttaatgctcgcgtcaaggacaggccggcgttttcgcaatcgatcatatttaaactctcgcttgtacccgctaacagcgggcttgctacacgacacggatgatgacagtgcgcttggttcgactaacggagagcacggtctcacttttaaatgactggatcgaggctgccatgcgtactacagtcccaaacgaccacccggctctggtagttccagtggcgtcgattttgaggcgtcgcaccgatccaccgttggacaattacagagccgtagtccacagactacactagcattccttgcatactccctgaccatcggacgggtagtccttctgttactaaccttgtgcggatgtcactgttccacccccatactgccttgatctgcgcccggctgaccgcccgctcgtacctggggttcatgcacgggtccctaagccataaggttccctttgctcacgggct

SEQ ID NO: 83140 - DNA, 2448 bp, Oryza sativa
aatgggttaggttgactggtggaggcgtaatgattgatgacagtgggatgacaacggttgaccttaacaaggttggatactcggacgaaccttttgtccttgccaatgatgtaacgcaagtctttttcgtgaaggacatgtctagcaaaggaaagaagggcagatggcctaacgagcctaagtgtcatgtggttctcccaagcaaaagaaaaatcgtcggagttgaggacaagactgacgaggattacgatcagttggatgggcaaccccctttcacggtgacgattgaccctagcatcctcctatcaaatgaagacaccccttactcacgtagcgatcacaagaagggaacaatagtgaggagaaagtacgtgcggtcaaccgtcaccgccgatgtattgccgtaattattgtgtacacgatgtaaactattttggatgtattgattatccatataaatcaattgatgtatggcatatgttaattacgcacgattattagaggttttaacaagtttaaatcatgtatatgctagttatatgcgatacttacaatttttaaaagttttaaatcacgcaggtggcaatttcatatgttaattagagtttttaacatttaatttactatcattcatatgcatgtggcatttacatatgctaattataattgactagagaatttttaaaagtttcaaatcatgcatgtggcatttacatatgttaattagagtttttcacaatttaatttactatcattcatatgctaattatatatgactattcgaatttttaaaatttttaaatcatgcatgtggtatttacatatgttaattagagtttttaacaattaatttaatataattcctatgctaagtatatatgatgattacaatttttattaattttaaatcatgccgtatgtatatacatatgttaattagagtttttacgaatttaataatatcattcatatgctaagtatatatgattattagaatttttattaattttaaatcatatatttgcttattacgatttatccacttaatttattacagacaacagtaatttttcgaagtaattgtcattaatctttgtactttaaataattgtaatgcattatcttctattttagaaacacatatgtaatggaaaataatattcagtgcgcttatcagtagtcccggttcttaaccctaaccgggtttaaaaagaatttgaaaatagcgggaaaagatctttagtctcggttgatgagaacaaccgggactaaacaaccgggactaaatctttagtcccggttgttctcatcaaccgggactaaagatctaggggtatatatattcccgatgcgcgccctcgtcttctccactaacacttagaagtttttgcccgatcaatctctctcggcttctccttcgccgccactgcctagggcatccccgcgccgacgccgccgccgtatctcgccgtcgtctcgcgctcgtcgtcgtcgccgccgcctccgcctcctccgccgccgccgcatctttggggtgagagccgccgccgtgcagcgcccgttccgtcatggcgcctagcgggaaaactatctcttaaaaaccctaattgcgaaatctggatctttgcttgttgtctaacgtctgggccatctcagatctcgaatccccgatctatcgtcaagttcaatcccgaatccaaatccttcccaaatcaattccctctgcaaaagtctattttgcctccctcgggttcgatgggccgaatttctctcggaccatctgtgcctacctccccatgtgtatctccctctctctctctctctccccgctctgcccgtgagccgcgccgagccctccctctccactctcgctgccgttcccgccgacgccgccaaatcgtcgccgcgcgccgttgcttcccgcgcgcacgcgccatggtggccgaccggccagtcgccgccgccgtcagatacaacattaagcaacacttgacagatgatgggatcagccaggcctgggtggccgtttgaaagctgttggccggatgtcaaccttgatcaattcaaaagactgataccttgcacatactccgaccggacgagacgcactgtctcatccgtgtcgtttgagaagcactcacttagttgtttcagaaaagagtttaaataaaatcaattgcaaaaacaacagcctttccgttgaagcctgcattaaacacttatttcccacggcttgctgagtactcctgtactcacccttgctctatataaataatcccccccagttgctgaagaagatgaagcggatcccgctgacgaggagttcttccaggagcaagtcggctacgatgagttttcgggtttcggcctagttcccaagtcgcgcctgtgatgtttggtccaagtcttggcttccgcttcccttttgtaatgccagtgggagctcgg

SEQ ID NO: 83141 - DNA, 5145 bp, Oryza sativa
ggggggggctcatccatgacagcgacagacggagtggcggcagcgaccactcctccctctcggcggcggtggaggaaggagaggggggctcggctcagcttgttcgacactgttccggatcttgcggagttaagtcctccctttctcactctacctataacaaatcagcacaacaaccaccgacggcgctactaagatgacaaccagcatgatcacagtcgacacgatgctatttcattttcatatgttgttgttggcatattggaaatggagtgaaaaatcaatgtagtgctatctggatgtggatctgaatatggatttggtttgatttgaatttggatctcaagatgtggtgggtttgaaaatgcagcagcttttgtggatattgattaattttttttgctaaaaagttgttttgctagtggtactcttaccagtatcgcctgcaaaaatcgattttcacagctggtcctcttaagggtctacttgcgaaaattgattttcgcaagcagaccacaacagctaccaaaaaaatcagtcatttttactaaccttttgtcgctggcggttgtgtcagccgctagcgaaaacatattttggccgcctgcaaaaattattatttttaagtagggctagtttatattctcatttatatttgacgatgagagagatatatagttctcaagaacgtcaaatatatatttgaccacatgtagtagcatatataattcggagtaataaatgcattcttgtatactccgtaattggcatggtcctgactcaaaattttttatttgtaacagccataacttcaggaataagttcatttctcagtaatttttcaaggcttagatatacatatgtgcgcccttaatatcaaacggttgtgtggtgtttttttaagtactttggctcatagctagtactggcaaactgatcgtggccaaacacttgcctcgtggagagtaccacatcaactaaaacaaaaaggcgatgtaagaaatttattttgacgagtttctacggtatattccaattgttgatctttggttgatatctatatttgagaaaaaagttgacaatagtaaatttaatagaaatacaagttctgccactgatgagtagtgttaaatatgttatcctaatttcagtatgcaatatggtcgaattagtttcctaatagaatttgactattatgatcagtttcctaatatgaacctatgttttttttcccacgaggattcctagatttctcctttatatattccatgtgagctgcgtaggaaaggcgcgatagcccaatgtatcccctacgtttgtactcaactcctcaatatcattgcctgtcagggtccatggtttttcctgtaagagtttttcacataaaaatttgtatctttgttatgcatctattttttctaacaattagtgagttgcacgaaatattatcatacaaatgatttaggagtttttataggatatttaccggacttttagtatataaagattcatactattacagcacgttttactgcaaatatttttgtcccatggtacattatctgtctttgtggtaccaggatgtacagcaaataaacaaccaaaaagtgcacaacattctagcgtaaccatctatgtactgtaaaccaagacaaaataggtcgtgtatatatctttgaatggtggccaatatttccaggggaaaaaaattgccatccgcaggcaataacagaatcatcgttctgaacatgcaagtggtcaaaagagcatgtatatagaccaattaaaatgcaagaaaactctgtacacgaatggttgagagatcgtcctgcttaatgataaaaaggtcatacataccagtaccaccatcactgagattcactagctagcccggccggcccgttgattataggtgtaatgatgaccaaaaagaattgatctttagaagcaaaagaaatatcgccatttgcctagcagattccaattcgatcaagaggacgtaagctaatttaatttaattatatgttgcttcctgagaagattcttgtggtagtaatgacatgcagctgtgtgcgaatattccagtcacacaagactgaagagtagttgcaaatagttaagggtggtagttcatgcaaaagatctcatctctttatttccagagttcctcaccgttctttcctggtttgcatgcagctgatcaaccgcagaattggtcttcaagtgatcatcaccacccaagcctgcttccatgcccatcgtccatttgataaattatttctttaatgacagaggtaattttcggtgtctatactgaaatttggagtgagtcaataatgaaatgggaagaactttgttgaaaggcatgtaatagtatagatcgtgggacccagattatagtgttagggacggtgtggaaatgaacactaccactactaacattaacattaagtagtacagaaattgtctgaaaaaaacacgtacatattacagtaaggtgtgctaaagcatcatgcgtgcaaacagttcagctaaaatatttcgatcttccatccccagacgcagataattacatttgatgagatgttggattaaatcaagattacatcgttcgagacgcagtcgatttctgctccaccctctcccctccacttccacttcctccaccgagcgggctggtgccgaccctaaccctacccctccatttcctccagcatgcatggtgtgagctactgtaatagatggcctaagcggaacgctagtggtgtataaggggatggtattcatgactaggcacactactaccaaaacaattttctgtacaagtatccctgtaggttccagacggactggtcacgcctacaaaaatcgacctccatccctatcccgcaggagcgagtggcaggcggcgccaccagcactgacgatggcgaggaagcagccgggaatggctgcatccctatcctcgcccgtcaccgccgcctccaacaacgacgagaaggtggctggcctggagtagcgccgacgatgatggtgatgaggtggcagggagtggctccatccctgtctcaccggggtcgccgccaacaaccaggtgacccaatccgccggcggtggctccgtgaccgctggatctacgcctccgtcaccatcggggagctagggtgcggacaacataagcacctgcatgcgaaaatcgaatttgaaaacattcaggtcaaatttaaaaacttttaactcatatttgaaaattttcaagtcaatatttggaaacttccaactcagatttaaagttttaaaattttgagttaaaagttttcaaattaagtttcgaaattgaggtgaaaagtttcaaattttaacttgaaagttttcaaaatccgagttaaaacatttcaaaacttgaaaagaaagtttcaaaatttgagatgaaaattttaaactttgacctaaaagttttcaagatttgagtttaaatgttttaaattttgacttaaggttttatctttcaattgcaggttttaaatgttaaaattcaaaaccgtcaaaaaaaacacaatatgataatcatacaaattcagtgttaataaaaaatcagttataattatatttttgttgtagcaaaatcccgcgtacagatgtgtcagctttgattccggcgcgtatgcgcggattagttttctcaacatcaacaagtgcagaggcagcagccggatctcgcgatggcatccacgaagcgaggcagcagtaagcagattcaagacagagtcctctacaaggtatcgacgtgcagattccagtgatggtgtccgcaaataagcatgcatattgcaatatatataaactgaattgtcactactacagaccctatttttccgtatgcttgaatcgattatcccgtgcggtggctcggcccacctacagcgtctcgtctgggaaaatcagtattttcgcgtgtggtgcagtaaggaggaccgcacgggataatcccgtgtggtgcagtaaggaggactgcacgggataatagattataccccacggctaggatgtgctagggcgaccgcacgggataattcgtgccatcgccctagcacatgctagctgtccgggacaacctattatcccgtgcggtaggtataatttgaccgcacgggataatagatgcaaaattagacgaaattagtcgagctcaattataaacatcaaattacatagaatgtatagcatttgtaatattacaagtttcccccgcgacagatccttttagtccatagcatgtttcctctcccactcccttaggttcttgaatttggggtccgtaacaagttcgctatgaggatcgtggaactctcctagatggttatagatgtcgcaatgaatgaataggcacaagtctgagcatgcaagagtatgaactggttcaccacatctcctagaagttcaatcccctctggtgttgggatgtcaagcaccaatgacatctgattgccattaacccttgccacctggacccttgcgtagtccgccagaactgggctatcatagaactgtctccctcttatgaaatgccgaaattcatggcaacggtcgggctggcggcttatatagcccccgaccaacgcaagcggtcggcttacgtgggccgcacgggataatgcattatcctgtgcagcccatagcccggcgccggtcttcgccttgttccaggcggagccacttacggcccgcctagaagctaccggggctggtgtccaggaaaatctcgcgtgtagtagtgtgtctaccactttcttttatattcggttaaactggttgatacatacaactcaatatagtattagagtgagtggcctcgattttgaatcttcgctagcaccaattaaatgaaagtttccaatccacttctattgcacaattgaggtcagggagactcgcgtgaggagtaagactaacggggtatttggcagagatggttgctgttgtacagccatagcagctgcagcatgtgcaacaaaatttgtgctgcttgcaccgaagctatagctaggcacagccggctataacttcggtaaagagctaaccctaaaagagtgagttcttcatctttactgatcaatttaagcttaagcttatatgttaaactaa

SEQ ID NO: 83142 - DNA, 837 bp, Oryza sativa
  unsure (1)..(837): unsure at all n locations
tgcagccctgattgggaacgagcgtgtgtggcgaaagtagggcgtagcagagaaagagttagagctcaggcggcgaaggcaagaggaacaatggcgaaaggaagggagcaaatccttttctcgatgcttttatacccttgcaatcgctgggcctggctcctcgtttctcgcgcccanctacttcgcttccctcgtatactcgactatcatcgctccactcgtcttccgcgtgcccccacgctatccacttttaatcccaattcgcaccgcattaccggtcgcccatgaagntaggatatgcgnangttgtggacaaatcagcaaatggatctgtatacgtgccgcgccgtataattaccgcttctgccgtcccgannagcggcgttacccgtatacatccaggcgaagacaanantgctgctcaaacccagaanttcgcgcgcctgtctcnnaagtggtggttggcanngtctctgnnaatagaaccgcnctcattgatggaccaaaccnaaagttatcaaatnaaccaatnngtgcatggcattggagacccgnnttgggcatnntttgcccaaactacccggagaaaccggtcaccacncnntgtcaccnnaggcttgtagnngggtggctngtcacaacatttgacacgcttccactttgggaacagggaaattgcnntctggcataacgccgggggctaactgtcggtgatatgggaccgggagtatcatgaccagaggcttgaggcagacgcaatcgcccacgtggcctggcaccttcggtgacgtcgggcccgagggtgaggtgtccgccctcctcgtgaattcccctgag

SEQ ID NO: 83143 - DNA, 2068 bp, Oryza sativa
aaaattaattttcataggtgggtctcttaacatacccgcatgaaaaaatgagcctatttttacaaacggcgtacctaccaccagctcaccaccaccctaaaatatcaaatttcctctctccactcctcactctctccccactcctcccttatcctctcctctcttctcatctcctctcctctcttcctacgacgtatggctccgacagtccacggcgggagcgacagcggactaggcgggaggagctcgaagggggaggtgcatgtcgacggcgacaacggtgggccctcctccactctcctctgatagcggttgccctccctcgtgcgaatctgcaggttgcagaggggcagtggaggcgtagggaggggcgacggcgatgagctgcggggactcagcgacgacgatgtcgacaattggtggcggattttggcaaccacgttgccggcaaaaaacccatgcacattcttcgctggcgtatgagctagggtttcgagttttgatttttttgggggcatttttatttttttttcagatttttatttttatagatagacggcataagcacccgcatgcgtatgcgagtgcgcctacatggaaaaatagcaattttcgcagatactttcgaacatcggacggttcaaccgcaaacaaaaataggttttgaccgtataaaaattgattttcgtagtagtgtactgtgccaaaggagggtgagcctgcagtggcagtggcggtgactgagggggaacagggtactatgggtgagaggagtggggaaattaagcccttaatgagttgacggttcaaccggtcaaccaatttaatatggtccttgatgtatcttttgctggttcagaataaaaactagcagtaatgtgtatctcgctgccgacctttattgatcgagaactagcagcaattaacatcggtttaattagacggtgcagtgatgatgcttctacaggaaccacaagtgatttgatttggcggtatacatcttttattcattttgtatatatactagctagtgatatgagactattaaatgtatacaactgtcagcaagcactggggaattaaaaggaaacaaactgttcctggctaactcgatcaagcgtgtcactcgtttcaacaagcttcaaaatttcctattcccgttcgattatatttgttcccttccttcgatccggtgacgacgacgacgacgacgacggacaacgacacccccagatgagacggtcaaaacggggcaacccaaccccaggccgtgccatgccggccgggggccggagacagcttcgctttcgttgaatttttcagcccccggtcgccgccccaaaacaaatcacacacacacaaaaataactctatctaaggcatctagctctagtagctagctacccctatcatcatcatcttcttcttcctctcgatcgccatcacctcccggttgcgtacgcgaccggcgacccgtctcccggccggtgtcgtgagctgaccctctaagcaaccaagctaccgacgacatcgtacaaacgaacgaaagaacgagcgagcgaacgaacaatcttctttcccatcatcggccggccggccaatcagccagccacatgtctggcccgactggccggccgaccgacctgccacggttttattattattcagctcgatcacgacggcgatttgctcgtcgccgcctcgatcgagctcgctataactgctccaacatcgcaagcaactgacgccgatcgatcgatcgacctggtcggctacggctagctgcagcggcggcgtccttccatcgttttcgatctcttagctcgatcttaattttgatgttaatttaatttaatatgcatatgcatgtgtcattaagtgatgtgggtacatgttgggggatgtggatgaataattaaggagtatgtgaagtgtgtgtgtgtgcgtgtatgtatggacagaatcacttgccatttgctgcaagtaacctagctcgatgattttggttggttggttcatgtgctgttttgctgcgtcgtcggccgtgggccatgcacacatgtacact

SEQ ID NO: 83144 - DNA, 687 bp, Oryza sativa
tcctgcagccctacactgtaccagtctgtccgcgatagctgactgccctgtatacactgcttcttcttctccttcctgctcatctacatctttaaaaccagcgatgtgtgctgtggaaccatcaactggctctccttgaaatatctctatcagaaaatctaagtactcaggggtgccatggcgaaatctcttggcgtcccccttctcctgggttgacactaaatgaatatcacggatgactctaaaatcatgtaaactagctatattattgacaactgcataccttaagtttttatgccaccaagcatatgatgcaattatttctccactagcacttctaccagttgcagtttgatgcttcatgccacacccaagcactgaaataattctttagatgggagaatctatgctttatgtgcttgacagaacgccttacgatagcccttaggacatatctggcgctaagattctggtaccctctatgtgcccatgctccattaggacaatgcccatgcattatttcctcacatgctatttcacacaatgagtaagttttttcttctgaccaatttgtcttgtgatacgtatcctaggaccgacaggcatgacttaactctacttgaacagtgaacaacatatgctgtcatacatatgcttagatcacggcattgatagcactatcaatat

SEQ ID NO: 83145 - DNA, 4746 bp, Oryza sativa
caaagagtagtacacaaatatgttgtgtttagttgacttgctttgaacattgacttggaaactgaaatactacgtacgtacttcaggaatcagaattcgtctgcaaaatttagttcttctatttcatgatggttttaggataacatcatatccttgtccttataagaaaaaaataaaattgatagaaaatatctccattccacagataagcagaggaagttcttgtaagtcaacattttttttctcattcttttgtaatgttagttggttttattagtgcttgcttagataaacttggacccaaatgtcacctccccattagtttttcattaaatcgccagatgaagccaaagcaaggccgatgatatatatatccaatgaaacattgtctgttgcataatatttatgacctactcctagatggagttgggaatcaaacaacaattagtgaaagctacatgatatcttccacacaaccatactaatttgagttaagaagtaaactaatatgtccaattcttagtttaggacatcaccgttttgcacaccttaattaattaatgataagcccctggccaattattggccaatgcctagctaaagcctaacactaaagggcagttgcttcacggataaacagtgatgaatgctagtggtgactaaggttattgttgctctgtcaggaccacttatgaaccttgaaaatgaatttaaaatgttatgctttcagtaatatattctagcatgttctcagcatgcaaatcatgcttgtaacaagaatatcttccttcccttgttattaaacaaaacctaaaagttgtcatccatggataagagagaccaagtggtcttgattcttgaaccaatacaagggtaaccccaaccacctaccaatcttcaattctgcccctgaactttctgcacccaaacaggggagctactgggagaaaaggggacaagaggcaaaatgccatgcaactactcaaccaaagctggtcctgatgatgattaccattggtaatgatgtgtttacactgaaagcatatgtgttcaagagagcaaacacatctttttagtaaaaggtaaagcccattggcactcactgagtgggattcctgcaacctttgcttccttaagccaaacacttgggcttgcttttctaccataaacaatgtgaaatcagaggtgaaaagttgtaggcgttggaaggaaggccatcctggaatctattccttccgagaggtagaaagcaagaaaagttaaacagtagtcattggtttcacgcgtcatgtgaccaaccaaattacatatcgtctgaaaagataaaccggcaaatcatattggctatcattttcatttatagtttcattttatcgatgcttgttatttgttcaaggtctaatacgtacttgacccgtgtaagtagtattaattctctctggtgcagagaagcatatatgttgacttcagttgagtgtcctgctggttagaaatgaccaactaggcaactattagcttttttaggctttagcaataattcctgaagtattatgacccatttcagttaaaatagttttttttattcagtgtggtatatattagctttaaaacttttgtcatctcattgaccactttagtcatgtagcactgtgcagacatcacatatgacagcagtggtgactggtgaggaaaaactgagatgctagctaacagtatatgcacaggtcctacatgataacaaccaatagccttcagttataagatggcatatgtcgttgcgtgttgcaagctacaccccttggtgttggataaaaagcaccaagggtgttgcaagaaagtgactagcacaattcacgaaccgctctaacacatgtcaagatggagataatcacaagaagaaccatcaaatggcattcagaaaccacctgcagatgtccaacatctcatccatctacatgatggataattggatatcatccgtgcttgcataattggatccacttgatgtatatattattaaacaaaaacaattcatgtcaaaaagatcttaacaaggcagaatcggcatagtttggctaatctgggacgcttttgggcacccttgaagtgcagttttttttgttgggatggctattcttttctttatgtgtgcttcgcagacgaagaatagggccgggggctccaggttgtggatctcgttcttgattggcctggcccaggatcgctggcaactgtagcgatccaatgtcttgacaggctgcgcaaagcattccggcccatgtgatcgagttggaggatcagtttacatatggaataagtccacattgactcccttaactagtgaccgaatctgattcgtatcattgaaccgtaataccggatatctcgacccccaactattaaaaccggtacaatttaacttccttgacggttttgaagggtggtttcactgatgtggcatctacgtggtagtgttaacctggtctgtggtattggcaggacgcttaggtggcattagaattaagaacatatatgtgagccccatttgtcattcacacaacaaaaaaaaaattgtgaagctcattgacatgcgaggcccacaacgtcatcccctctgtatctttcttcctcctttctctctctctgtttcttttactctccacttcggtagtctccataagcggcgggatctggagcgatggcggtggtggtggatcagttaattaattaataacttattataatcgtgatttcatatcaactaattatttgataatccggggctattaattatggcataaatcatatgggggtgatcgagttggaagatcagtttacatctctctgggcgggtagctatttaagaagttgaggacgggggcgtggtgtactggtgtgcaggcaaggcaggctgcatctcatgggtgatctggcaggtcctgagttcttagaggcccagtgcaaaactaaacacatgggcccttaatatacaacgtaaataatagtcaataaatattaccccttaaattgcataacaacaatatttacataaaaacatcatacatattaccttaaaactttcttcaggcatttctatgtgaaatcattgatgatggtgccaatatcaatttcatccaataatttttttaatgcacaaaattgccaaaccatttagtctttctgttaacaactaaatttggtaattcaagtatcggagatggagatagaaccgaagcggaatccaagatagagatcgttccggaaacagagcgagaatcggctaaagtccaaatcggctgcgatcaggatcggcagagttcgagtcggactaggtagccgattgagccgattccgataatgtgactcggtattcgttatcgggttgagttaatgtgcttcatatggattgccacgcacggattgagtcctgagaaggcaattgtatctattaattaggatattttatgtaatttttttagagataagtttgggcaaaagtctgccacaaagacttatggtattttagaatttgttagaggtaagagtcgtgtccgacaaggacatgttttgtatctcgggtataaatatgacccgaacccatgtaatcaaataacacacgttcaatacaatctcggcgcatcgccaccctttttactttcgtttactttcgacgagttcttgctttcggattgagctgcattggtttcgatcttcaactagaggtaaaacttgttatggcggcttgcgttctcaggattaatgcttccatctttatgatactctaatcttgtttatgtaattcgtcaagttatcatatatcttatataatcttagataatattgttatttaaccttcattcggctaatatctatcgttggaaggcagccgatcaggttaaatatcaatgttgacttagattatataggatatctaccaccctatgaaacatccaatgacttgattgtctagatattgtccttcttttcatacttatagctgcatcaattgagtttgaccttataagtcgtgattagaatctcaatccctagcctgtttttggttgccgattagggtaatatcggggtttcagccgatcttacctgatttaactactttatattttatatgcttgattgacatgttaaatccgccatttctgttaagatcttgttgcatttaggtatattaagctttctgtttgatatattttgtttactttaatatcttaatatagagtggtatcggagtattagccgatatgtgctagatctatctgatcggctatgctatgaatgcttataatctccttgttaatatatatttcgatctaagtgatttatactgtctcggcacggcgaccgatctaccccaatcacttgatttaagtatatatcgacataaggattatataccattaatacctacagccgatcgaatagatttagttctttcttacttattcatgactgtcgatcgacttaaatatgacatcagctcaaaaataaatgacacgtcatcggcgactggccgatcggctatcgtttatagatttaaccgctatttttctgtctttatttcttgttgattgcaggatcaaatcaactggcatgctcacgaacctaaaggcaagatttttttggacctgcaccaaagcgaagcagatcttccaggcctcgtgtttttcgcatcaaacactttcttcgacattttagatctcaatagtttctttaataatttcgacttca

SEQ ID NO: 83146 - DNA, 621 bp, Oryza sativa
  unsure (1)..(621): unsure at all n locations
ggtccccccnattganatcgataccgcatnnnnnnnnnnnnnnnnnnnnnnnnnnnnnnnnnnnnnnatgcaacatccctaaccacgcacgcatatatatatgaaaattttaatcgtgtgctgcattgatnnnnnnnnnnnnnnnnnnnnnnnnnnnnnnnnnnnnnnnnnnnnnnnnnnnnnnnnnnctgatgaatcccctaatgattttggtaaaaatcattaagttaaggtggatacacatcttgtcatatgatcaaatggtttcgcgaaaaatcaataatcagacaacaaaatgtgcgaactcgatattttacacgactctctttaccaattctgccccgaattacacttaaaacgactcaacagcttaacgttggcttgccacgcattacttgactgtaaaactctcactcttaccgaacttggccgtaacctgtcaaccaaagcgagaacaaaacataacatcaaacgaatcgaccgattgttaggtaatcgtcaccttcacaaagagcgactcgctgtataccgttggcatgctagctttatctgttcgggcaatacgatgcccattgtactttgtgactggtctgatattcgcgagcaaaaacgatttatggg

SEQ ID NO: 83147 - DNA, 3585 bp, Oryza sativa
caacacggcggcatcttccccctcgtcttcttctacctctccacccaacccaatcccatcccatccattggggccaccaccacctcgcacacgttccgtgcaacatgtgattgctttgcttccctgattgatcgacctccctcctctcctcgcggtcaacacaaaatccgtgcaaaatattcccgaccgggacgagctcctcgatcaggggccctccctcccatcacacgcttgaccaccatccctcacacgattgatgtttgtttctaataaaattaaacataaagttaaatcacgtaaaacaaaatcaaaatgttttagcgcaacgcttgaaaaataaatttatttgatatttttagattaacttatgtatagcaagttttcgtatgaaacatattgttttaaaacggaccgaaatttgtgttaacagaaatcaacattttaaaatgtgtatcttaattagaaatgcgcactactcactccttttacatagtaaaatacatgctaacgaaaatcaatctatatcttattagaaatggacgcttcttactcgtcagagtctcctagtcctccaagctaagctgacccatactctaccaccaagttgccctagctactagtagctagtagttagttctcgtttcatttccatttcatttcaccaccaacaattctgctgcatatgcaccatcaacttcaaagtaaattaagctgatcgtttgatctccgtacggctgaaaagcactggaaaaatagattaaataatcggaaataatttattgagagcaaaacttttataaccgtatctagaaaatgctggaaaataaatcacgatgaaaaaatacccctcaaaatcaattttaaaatttaaacttttgtttacggaaaatcaattttaaaatttaaattttttgttatggctgatagggtaacaagtaggcgatgggaggatgttgcctcctgctttccttcatttgtttctccatctccatccatcgtcttcaattcttcggttcttccttgcccaacattccaaccttttttacctttttgttttgtgtgagatggaagtggacccaccagttaattaattgatttattattaatctccattgtcataagtggtggcattgtgaattaatcatgcatgctgatgcccctattgcatccggtttggtggcatatccctagtgattaatctagtcagacgaccgtgttggatgggagattgagagagaaagggagaagactgacccaattggttgtaatcaatccaaagcaattgagaaaaatgggagaagatcagaagattccctttagcttcccatcgcaaatttgccattttcggccggctctcgcaacatgttcaatgatcttatagaaatttatatgaaatcaagatagttatcttttaaaaaattcgaacaaagaatacgagattatcaactcttttgataatgcgcggggtttatgaatatgataaaaatttaggacatgtgaaattgattcttagaattaaaaaacctaggacgtgtcaaactgaatctcccacaaatcacaatttacacatttgcttgggaccaacttaagtcaaactgaattttgtaaaaaaaaaatctaatccaatttaatgcgaatttgcgattgagctcaccgaatttgggacgagcaccgcgggtgcgtgtggcactgtgaaataaaacacaaaacaaaaaacagcagattaaaaatcagatacattagttttaacagatcttgagctacactgaacactcttgagctactctctgtcttgtcctcctgcattttttttttgggggcgatttcgttaagcaaacttacaaacaaagcttaaccctgcctctttcttgctacaatcttgcaaggcttgccttgcctagcttagtcggaggcgtcgccggcggcggcgccgccgttccggctcgtcgtctcctgctccctgcaatgctccgccgacgcatccgtcacgcagctcgacgacaccggcgacgccgcgcggcgccgccgcgcgtcggcgcgggcgaagaagtcgatgaaccggacgcccgccgcggcgtcgtcggcgcgctccgtggtggcgtcgtcgtcgtcggcgtcggcggtggggctggctgtcgacgcggccgcggagcctttcttccggaacacgcggcagagcacccagccctcggcggggcgcgccgggtggtcggcggtggcggcgcggcggcacggggcgaggccggcgccggcgaggcggtactcgtgcatgacccagtccgtcttcttgccggtcggcggcttcccgcggtagaacacgagggagcgcttcatgccgacgacgacggcggcggcctggctcctcggcgccgccgccacggacaccgccaccggcttctccttccccgtcgccttccagtacccggcgcccgtggcgcggttggcgcggcgccccttgacatacttggcctccttgcacgtgaagaagtacctctcctgctcactccaccctgcacgcacgggacctcgtcagcgccggccggccacactccgacgacgccgcgcgacggcggcgagctggctcatgactcacctggaggaagcaggtcggaggggtcatgcgcgaggaggcggacatcggggatgtcgacggcgggcgggagaggggagccgagcgcgcggcggcggaggtagtgcaccacaagctcctcgtcggtgggcctgaacctgaaccccggcggcagcttcttcgccgccgtcgtctccatcgatacacctcggcaaaatcaagaactcaacccaagcagagcaccagatcgccgccgctcgccaccgtcttggcctagccgagctgagcttgtcgcgggtgtgcggggagtaaaggcggggggagaggtggaggagggagacgagagggatttatagcgggaggaggaaggtgttcgacgcggggcggggaggggggagcagtggcgtgaggaagactcaagctcgggagccgagctgagctgagacgacgctgtgtcactgtcacttgcgctgtcgcgttgctctgcggcgcaaggcagcgaccaccacggcaccatggatggttggatggttttaattgtggcgctgccttctacggcgatttggagtgatttttttcatctttggcacggtgaggaagaaacgaaaaagaaaaggaaagaaagaaaaacaaaaagggtgggttgaacttgggggagtgtgtacaagcaagttgttgtgtatctctttggcataagttaagtataagagcaaggctaatagtatagcccgctactggctaatagcccataactaaagccaactactagtacaatagattgtccattagctagctgtatctcataatcaaataattaattataatatacacatatctatgtatgtgatcagtagtaaattgtatccttgtagctatttgtgttgttagatgaactttgttcaccaaacaccaacatcatttcacagatcataccaatcaagttatctgttgtataaaaattactacatacaaagcactagtgtttcgtgggcaagaagagctcacgaggaaggagt

SEQ ID NO: 83148 - DNA, 602 bp, Oryza sativa
  unsure (1)..(602): unsure at all n locations
atttgannnnnnnnnnnnnnnnnnnnnnnnnnnnnnnnnnnnnnnnnnnnnnnnnnntaaatattgggcataattaagcagaaagtcgtgacacttaattagcgactttatagcaaagttgtcacatggtaaatttcgaacttcagttcctgtttgttctttctcaccgaaagagatcaagttgttccctctataaagaaagggccagtaggcgccactcgtgcagaacgtgttgatttgtttttgcatatttgcatatactatattgtttgaaaggcatgtttatatatattttgtctagtttcgtgcatattggcgaccttcagtcccactatctggtcaccccaaccaaatctggccccacttacataatcagtatggttgagctggctgtttccggttgggtcaattaagatgggacagcatctatatataggatgattggatttgtagtttaattaaatctccaaatagcaaaagtggatgctccacaattattggggaagatataatggtcaaataattgtgataaaatattatatcaataaaataaattgaaaaccctgtataatgtgtcacaggaaattaattagctttggtta

SEQ ID NO: 83149 - DNA, 904 bp, Oryza sativa
  unsure (1)..(904): unsure at all n locations
agagagagagagaggaaaatgagagagagggaaagtgagaaattagggggagagagagagaanagaagggggcgggggaagagagaanaaaagtccaaattttttttaatagaatgcgaggaaagtgctattttcctgcgcttttagattagaaggctcgcacgtgaaaatagagttatttttgcgtgcgggcctgttaagtgacccgcacacgaaaattgatttttgtgtgcgggtgatgacccggcttcgctccccctatttttccgtgcagtccaacttacggaccacatggaaataaaatggggtgacgtccaggaaaatcaatcatgtagtagtgaatgattttagttcttcatgtgaaagctgacatgaagcatttctgtcttgagttggagtcaccggtttagttcagttgggtgatgaaatttgctgatggagatggtgaaacaaattaaaacattcggtgttccatgttggaattgatacagccagttagttaattcattgattgaagaatgcgtttgctgtttctcctgattggattaaactggtgacattagtaccttgtcattgttatgggtttcctgtcctatgtttatacattttttttcagcttcttgatgtaatggaggtggccactactttatattagtcttttcatttcctttgtgtgattgctggggccatattagcattcttttctaaagcaaatgcgcatttccacttcgtgcatgttagtgctgatggcctacatcctacctccagtctgcccaatttttgttcttgacaggttgaaaaaggtggcactgttttatgcaaccagtgacaatgcaataggggatagtaggacttcagccttatctgtatgatgaagttttgttttagacaaagcctgtatgat

SEQ ID NO: 83150 - DNA, 650 bp, Oryza sativa
atcgattttgtgcaagttgagtttagaaaaaagttagtattttgagtttagtcgagatttgtgagaggagtgttgttgttgcactttgtaaacatgagtagaagtaagttcaatctacttttgaaatatcttcaatttgtatatgcttgggttcggcggtcacaccgacagcatatgtaatgctgttgtgaactaatgttaagtcaagttggagaggacttgtgctcagatattgtatcttgtttgattcatatgtaggtgtctcttaatgcctggggagagtgttactagtgattgatcgggagtcaacttggaagaagatgatgtccagacgatcaggatatcatggttggtgaagattccatatggtataccatgaagatattgtgtgcgtatggatgcggagtccaaatttggtatgattgtagtttataaagtttgtttattgtatgggaaggtttcctaggagattaggacttcttgtacaagttgggtttgtggttttagactgcttacttcgagtataaatagagagggggttgagacttcccggcatcgattttgtgcaagttgagtttagaaaaaagttagtattttgagtttagtcgagatttgtgagaggagtgttgttgttgcacttttgtaacaat

SEQ ID NO: 83151 - DNA, 41694 bp, Oryza sativa
gtaattcttccttacactaaaccctttttctttggcatacctgttatagaagaggaaaccttgtttctctgtcttaaatctcatggcagtcattgttctgtactcctcttgttcttctaagcttataaaattgtctcccatttcatcacccatacaagttctgtaaaaagaaaacacataatactcagaaatcatctaaaatcaacaaacaaactgctacctatctcttggttccaaccaaaaaaaaattataccacaagaaaatcacatacctgagaggaaaccctaaaccggtagggggcatatgctgcttgagctgtccagggggataggggcaaaaaatacccacggcaccgtcgctccttgcgcagatggatgggcactggatgagataagaaatcggcagcggtgggggcgtgaatgaagccgctggtgaaggagcgctggttcccccgccgcgggcggcaaatgcggggcgagcaagcgagcgcacaggcgggggcgtggatgcggggcgggcagatttggggcgagcctgcgcgcggctcaagcgggcttcgcacgggcggggctgcgctcgccgaggggaggaaagaaaagagattaggtgagaaagcggcgccgcacggagggaggaaacgagaaagagcgaagaggagaagagggggcgcgactactttctctgttttccaatcgtacccttctaacatggacggatggatttatctctgtacctcccagtaccagtacctaccggtacaagttgctggatgggagcaacgctcaagcagtcgaatacatgaatcatccaacttggaccagctcccaaaaatgtattgcacaaagactgaaatccaaaagatttttactcgtcttggatgatatttggaaatgcacagtgaagatgagtggaaatgcctactatcaccattcacaaagggggaggccagaggcagcgtggttcttgtcacaacccggtttccatatatagcacaaatggtgaagacaactaatctgatagaactgcaaggtctagaacacaatgagttcttcgcattctttgaagcatgtatatttgctgattgcaaacctgagatttatgttgacgacttaattgatattgcaaaagaaatttctatgaaattgaagggtttcccactagcagcgaaaacagttggccggctattgaaaaagaacctttcccaggaatgttggatagaagttcttgaaaggaatgagtagaaaaatatgcaaaatggcgatgggatgatgcctgcactaaaaattagctatgattaccttcctttctatctaaaaaagtgtttttcatactgttccctttaccctgagaactaccagtttaataatttagaaattacttttttctgggaagcaataggcatcataaattctagtgatcataataaagctgaggatataggattaagttatctggacgaactagtaggtaatggctttttagtgaaggttagtgatgataagaggcaatattatatcatgcacgatttattacatgagttagcacaaaatgtttcctcacatgagtgtgtcagtatacggtcatatagctttaggtcaaataatgtcccacaatctgttcgccatatatccatcaccttacaagataaatatgacaatgattttgagggtgaaatggaaaaattcaagagaaaaatagatataggaaatatacggactttgatgtattttggagaatacaataaagatatgactatatttttcaaaaatatattcaaagaaacaaagtgcattcgtgttctatatatgtttgcaaactcccttgaatcattcccatacaacttctcaaaattactccaccttcgctacttaaaacttgaattaccatatgactcggaattttctttaccaagtgcaatgtgcagattttatcacttaaaattcttggacctagggtatagtaagtgtattttgccacaagacatttcttgcctagtcaatttgcgccatttaatttctaaaatggagctatgttccaatattcctgggattggaaagatgaagtatttacagtggctggaagagtaccatgttaagaaagaggacattggatttgaactgagtgagttggggaatttgacagagcttggaggagagctaaagatatttaaccttgaaaatgtggcaacaagagaagaagcaaatgatgctaaattgatatcgaaaaggaatctgaaagcattgacactagtttggagtgcaaagcaactctccataggatctggcgttcttgatggtctgcaaccacatcctaatcttagagcacttgacatacgaaaccatggtggttccactggacctacttggttgtgtggtgatgtttgtgtcaaaggcttgaaatctctccatctagaaggcttatcttggggaactttcccacctttcgggcaactaatgcatctggaggaacttactttgatcaatattgctggcatacgtaagtttggacctgattttggtggtgttacccaaaagagttttttacacttgaagaaaattaaatttgttggcatgccagaacttgtggagtgggttgggggagctcattggcatttgttttcaaagcttgcaagcatcagatgtgaagattgtcccaatttctcggtgctactgttgccattctctaagtgctctgtcatttgcacacaagacataaacacagtatggttcccaaacctgtgttctcttgagattcgaaattgctccaagttgtcattgccacccatgcctcacaataccatgctaacacgtgttactgtgaaagaagataatcaagcaaagctgcattttgaagaagagacactgagaatagatggttatgggggtgctttggctttccataacctggacaaagtaaaagatatgacaattgaaaacatgttccacatttcattgactgatctccaaaagctgaattcattaacaagccttgatgtcacaggatgcaaaagcatgttatccagtgaagtagacaatggttttatcttttgttcagttcagcaactcaatctcagagattgtcatcttaccgaaaaatcattgggtaagttattaaattgtttcccagctcttacccatttcttcttgagcatgtttcctgaatctgaagaggaagaggaagtagtactgcgattcctatcgcccagctcattgcacgttgcctcaatctcaaatcacaggaatctggttcttccagtggaggatgtggatggaggctgtctccaacatctctcctcactcgaaacactcgagatcgatggatgtggcaacatgttttctcagtggtccatggtagaggcaggagctcagaccaggaagcccttccctacttccctcaaggaactcagtattgtgggagagtcaagcatgcaatcgatggctccactctcaaacctcacatccctcaccagtttaacactaaagcactgtgttaacttaaccgtggatgggttcaatcctttcatcacatacagccaatactcttataaatagagaatttttacggcaataataatcatcgctgctccatagcaacggatatgttctcagaggtggcaaggaccaaagttatgcctgcaggtggctccttccaacagctggtacgacttgatgtggacagtatctcagcagtgtttgttgaaaccatttgtagcctcctcgctgcgaccctcatcgagttgagattcacgtctgacttgattacagaaagcttcacagaaaagcaggagcaggtacttcagctccttgcctccctccaatacctagaattctatgggtgttctcgcctaaagtccctccctaaagggttgcatcgcttttcttctctctatggactagacatctctcgatgtcctcaaaaagaatgttgccaaaggagggcttccccgcttcactgcaagatctaagtatggaggcatgcagcatcaatctaatggatcaagtcaaaaaattagaagcatcaaacccacatttaaaagtacatgatacatcagtgacttatatcgtgaggttagttcatcgaaaaccaacttattaccctcaatttttgtgattttttctgcactaggcagtaggtactagctagcaaccactgtggctttcagcccctatagtccatagagttcctttatctgttatctaaccaatgttacattagttgtacaattatggtagtttactacttcctctgctattacacttttttttcttgaaacagaaaggtgagagcaagatgtctcaggggcagaggcacattgacccagtatggtccactgggcacaatgtaaatttgcttctcccctgttgtcagagccatgtggatacatgatttgcattaccagtgggatctcaactcctaagccgaactgtcagcaagcccaagataaactctttatcttgatcagatcctttaaaccgaaggtactttcaatttcttccaagtatttcactttatcttcggtgtaatcacaattttctgtcctgaggacttgattgattgccccccccccccctcccaactgcccaagtggcaccgcacacccacccaaagtatataatagtgtcaatatagttggtatatgtcagggaatacaaggcagcgaattgaaagattaaatgtactccctcattttcatattataagtcgttttgactttttcttagtcaaacttcttttagtttgatcaaatttatagaaaaacatagtatcattttcaacacaaaacaaacatatcatcaacatatattcaaagtaagatttagcgaccccgcaaaaaaaagtaagatttagcgaaaccgatttgatgttttagacattgcttttttttaataagttttatcaaatttaaaaagtttaactatgaaaaaagtcaaaataatttatcatataaaagggatgtctactttttcttagatggttaatgaaataaccctcgtggttagatattgtgttttgatgctgatggtgctcattttatatgtgttttatttttcgggaatacatttttatgtgtgtttcgtactcctactttcaataatgcacttgcgatagcgatacaattatcttgttttgttgagcattaatgtaacatttacaaatgaatggttccttttgtactagattcaccctggcgagcctttttcagccatgtagtacggcaaatgtctgacgacataatataactcctcaaaataacgttaaattaatttgggacttgcttttgcatttgcttcctcaaatcaaattgtttccgtgagttcaacctggagattctgcagaacagttattacagtccaatgcattgttttttccaggtggtttccaagacaaattggtgttccatcggacgagtaatgcagccgccatctgtcgttatatcttgacagagccgagaaggaaaatcctccagagattaggcaccatttgcatggtcagttgattctccattagtccattaccctacccttgctgctcctatagaagctcagaagcgcttgttttgcgatgaaccacttacactgtatctgttcatcattgcaggcttgcagcaaccggatggcgagcaaggttacagagacggcgccgggggccctctccaatgggctgtggcttgcctgggccgaatgcgctcaaacaaatcagcccatgtgtgtgtttggggtggcccaggggccagccagactcttgggcttctcctctctctactccaccacgcattgcaagcagagaggcgcgaggtctcttcttcctccacgcatgacgcctccggatgagtagcgaactaacgatcgcatcctgcacgcatctcacaagggacgccgcgtcgacgccgatgccatccgccgtcacgatccgcagaagcatgcatctgctcaggcgcctcgcgctccctctggcgcgggatgatacgcttttagatcattggatggcagcgggtttgttcgatcgagggataggtttttgcttctctcgaggctcgagctatctccctctgcaacccttctcgctttgttcgacggataagttttagctgtgattggtggtgttggcgtgggtcgttcagtggtgggttcatgtctaggcttagcgctctctgatcttgcttagcggtggttggtgcagcgttaattttcttttattgttatatctatctatctatctatctatctatctatctatctattatatactaaaagtctattaaatttcctataaacgctcctaaaacgccacatagcacccctaaaaacactcctaagtcgccacgtggcgctctaataaattttagaatccgatggacccgttagttctaaccattaaatctattataaaaatacaattaaatttatctaaaaactcttattgtacgtgcacatataggtattccaaaaaaaacaaaaagtacgtccatattttgatacgtacgtacgacgttgggcccacatcattcttttttttctatctcacttattatggaaaaccaaactgtctatatttactatgcaaaatatatgttatttagagtttctaattaggcgcatttcatggaaacatccatgaaaaatataaataaaataaaaaatagattatatgatagctaaattaggctttcatttctaaaataaaaacaactctaattgtgactaacaattctaaaaaattttccactccctaggtaaaatataataatatgtcaaaatgatattactaaattatcatgaacgtattttcaggtattatatgttttctctattctataatatttgaaaaattaaagatcttatatattcttttgacaccatgtcgatgtcttctatctccaacttaattagactttgatctagctcaatagctgagcttatcttggacacacgaaacgacacatgtcattagtgcaagattaattaaatattaaatattatgaagccaaaaatagatttagcttttatatagaatatatttctaataatacacacgtttcacttaaatatatacaatgtagtccatgattatcaatttatttataaggaatataatggtttagatggacttagatattgttatcaaaaggtattaatttcttttataaaaattcctagaacaatcgaggaaacgtgctcataataaataagagagtagccaatccgataagtactttacaacttattgcatacatattaaaacccttaatatgtagtatataatatactttataaatacaaaatagtctaatacaatcgtatattcccactaatcataagtatataagttctgtattagtgggaatattgcttacgaggcattcgtgcacagtgcacctaataattagctgatatccaataagcacatgtgtcatcaagcactgaagataggactatactaagtgggcaacttcaacaaatgataggtaagaagagtatgccactaaaccacaacaaacaatagttgacagtgagtaggttgccagtgtgagtaataacatttctacactcctacaagcactcttaagatgccacgtgacaactctaataaattagaaaaaaaataagaaaaattataagaaaacaaaatatttggccattgatatacacgtagctccattattttcaaccattacattagatctattccaactaaaaaccatttaatcccttcgtatgtacgtatgtacacaagatatgtaaaaaagaataaaaaagaagagttcatatacgatctgctctatctgatagtttttttttctttaatttgaggcactaaagtttttttctcaaattgtgcatatatgatatatgtaatgacactcatggcaatcttctcgaagaagtcgtgtcgctgtggcaccgcttcatgccatcccaccaaactttttgaaagtattttttttactaaccatgtaaaaggcaatcgtaagcgctcatataaatgtgtgcacaccatcctatgaatacacatactactattcacaaaaagaaaatatacatacttagaataaaaaaatgtcacatggaaacatattatatccttatgtaattatgccattctcatataaaaagtgttaacaaaattagcacaaataattttgacaatggattattccttcgtatattacccatgaacatgcgcaggtgacttagatgtatagtaaaagaaaaaaacaaaactcatattaactcgtatgtttgtgaaagatggtgatagacgagtttacgtataaccaggataaagtgaatttgtttgaatataatagacattgtcatttagtatataaaattttatggtttatttcatggtgtaagtatttctttcttttatgattataatgtaatttatagttattacagttgaatatggtgagatacgattttttatattcttttttataaacaacaaataaattacccatgcatcggcacgggtttccttgctagttatatactaaaagtccattaaacttcctacaaacgctctcaatccgccacgtgtcactcctacaaacactcctagaccgccacatggcactatataatctcaccgtcgattttcacttaaattggtggatccgatattttagaccattggattagatctattattatttaagaaagtaatcccttcctctactgtgggccagaaaaagaaaaaaaaattatgaaaaaaaacgtccgtacttacgtgtggcttcgtataaccgtgggccggaaaaagaaaaaaacataagaaagtagtacgctcttcctgtctcttcctcttcctattcttttatatctccatctctttcttatcctaattattttatattatcaaattaaaaacaagttaagttgaccataatttaaatgtacatagctaatttatattctattaaaacattgctctatttataactaaattgacaattttacatccaatgttttgctatatataagcaatatgttattgtggtatagactgtgcattttgcaagtttgcatgccatctaaataaattaaatacttattaacaacatataatatatctatatatctatctatctattattatatactaaaagtcgattaaacttcctataaacactcttaagttgccacatgagactcttataaacactcctaagccaccacgtggcactccaataaattagaaaaaatatataacttgaactggtgggccaattggatttatctcataaaaaaatcattcctcaactactaccgtacgttctcatctccttcccctcaatcctttctcctcatccctttcttttttttctctatggtagttaagatttttgttttattacttaataattaatttcttcacttctatctcacgagaatggccgtggattcttgattgcatgtcccatgcctaaatatataaatgattaatgatctgatgcatgcttttataaataataaatctatttttaaccaacaatttagaaaaaagataatagttacatagcaaaataatcataattttaaaaagttactccctctatttcatattataagccattttaacttttttcttaattaaatttctttagatttgaccaaatatataaaaatatttaacaacatctatcacacaaaattgttttgttagatataacgttccatatatatccataatatatttttttttgaaaattttactatattttctataaacttggtcaaacttaaaaattcactgaaaaaagtcaaaatgacttataatatgaaacggaggttagtttgtttgaacggttgtttcataattagacagctaaataatttaaaatcaatattaccaatatttcactataaaaaataaaatatgttatttgaatttccacctattctttacctgacaacccaaataacatcctatttttaatttatttgaattgttgatttatgttactcatattttactatgaaaaatttaaaatacgtaatttgaacatagaccaacaagcaaacaacactgaaacattaaaaaattgacaatatatattatgtcatcttaatcattctacataataaaaattagaaaaatacaaagtcaccatgtatgaccttttagagacatgttaaattaccaagtgtcacatttaaaaaattagtaaaatcttatatattaaaagaaaaaaataaaacatctagctaacggttttcacctagatcgataacctattaacattattttcaactatataatctacttttagaaaaatatatcttaataagtggcatgtcacatcttttaaaaaaaaaacttgcaaatcttaggaaaattacatctaataattggctttcacttaatcacttagaaaaattacaaaaaaaatcccctccacacgcgcccatcactacacacccgctccttcccctctctggctcaagctctacacttttcattcctcttacgttcctatttaactaaaatataaataatctataattataagtttcacgtctaatttctaatctaactattgctctgtttataatcaaaccaatgatataagattcatatgcctatagtttactatataacaaatacgacattttaacacaatcggcctattacttacgagtatctcaaatgcaacctacgatatatgccggcgcgaatgcgcgggctaccttcctagttatatactaaaagtccattaaactttctacaaacgctctaaagccgccacgtggcactcctacaaacactcctaagtcgccacatggcactatctaatcttaccgttgattttcacttaaattggtggacccgttattttacaccattagattagatctattattaaaaaaataataacttccacatgtttataacatacaaacgctactgatgttctttccgtaacatacaaacgtacatgattgaaaataaaatgatcaagctttcttaaccttcgctggaagaaaaaaaaccatacacttggacataaaaaagacagaaacaacatacatccataaaaatcaaccgtttttaaaatatgattttctacaatataaagataaaatatattacttcacatgtataaatatatttagttaaattaagatctataataaatatccaatcaatgttctttaaaccatcttctaaatctatctattatatactaaaattacattaaactttgtacaaactcttttactctgctacgtggctctcaaataaattagagaaatcctagaaatctattatatacttaaaagtctattaaacgtactgcaaatgcttccacattgtcacgtggcgctttaataaaattacagaaatcctagaaattcagaataaaaaaagaaaagcatccaaccttcagttttcacttaaattagtggacccattattttaaacaatggattagagctcttaaaaatacgatgatgctaatctctatcccggaaaaaacataatgcgcttacgtcatacgatcatctccctcccggaaaaaaaacaaaacttaaatacctacatcatatactataagaaaaataaagccaaaacagaacaagaaaacatgcataggtacatagtaaaatcggaaatatatactaatcaggaaaaatcatcagtgtcggcactgatttgttgtcaacagcctttaatctacgattttattaaaaataatactacacatatatgcacaattaaacttaatataaacttattatagtgataaatatatcatgacaaatgacggtaacatgtaatagttaatgcgataataatgtttcaaataatttcacatcatattttacagtgtcaaatatcacttgacaaaaatatacaacatcaattttaatctacatgtgtaaaaattaaaaaaacaaaacctatcattgttttttaagtacatctgtttaggtttatttaattttaggagagattgagattctcaaagtatttcgaagttttcaaaaattttcttatttgaggtgtgagaagcacaaataatagatagatgagaaaaattaaattaaattttagccagtgataataaaaatatataatttagctttggtttttaagtagacctttttaggtttattttgggtgagattgagattctaaaagtatctgaaagtttttcaaaccttttttattgctatttgaggagtgagaagcatacaagatggatagatgtgaaaaaataaataaataagattttagacagttattttactacaatacaacccgtaattcatcacgagaattatgtatgttctttgccaaatagtattggaaaaaatgaataatccaataaaatatgcataaaactacttatgttatatttttttaattgatagaaattctaatatagcgggtataattgatggacgaatgacatataccactgaaactcagcagtaagtgcactctagtgaattagatagtgtaaataagtttgtgaaaataagtacattattacaattagtaaatgagtctcatttagttataaacaatatatggttaaaaaaaatctagcgctaaagtatgaatctttatcaaaatataaataatgatatggtgttttgtagattttcatggtggtacatctctttagctatagctctttttttctaagtagtgccgaatgattaaccccactcatttgaaaaacataatactgtttgtattgcattaaaatttgagaagcacttattactaacttcatatacacattgtctattctctaccaaaaatcgactcgaaactttaaaaaaaattgtttcaatcacctctctttctgtccctctttgtcctttaatgcaaggtgcagtacttgctatgctatcgtaaatattgcatgggcatgcacattgttgagttaaggtactgtccatgaaaggtcaccatagacaatgtaactaaagtgatagacttatcaatataatcatttgtgagtgtaacaatagtaaactaagtgttaaaatagtactctacgatggttttttaggggcatggctacatcgacgtggaacctatatgtttcaaggcattacatatgaaagccttggttggcagatacatttgacttcatccgttagagaggtattcatgtttatttttaaagatgttatcgtattattctgtagatatgttatatttatactatttatacatagatgtgaaaataagtgatgaatttttataatgtaacaataatgtatcatttattttagtggtactaatatagtttcatttattaaaggtgcacctaactcttaaaacaatgatagtaagtaatgatgataaacaaccagtttatatatgactaggacaaaggaatttttatttaaattcgagggacattcttatcacattagtagtatattaaaatctatcgtctattttatggtaaatatatttatttttttattgtaggataatctaaattcccttacactatatatagtgatataatccattttagcatttttttaataaaaaataagatgcccatgcatctgtgcgaaattccttaccgatttatattctggaaatgttctccaatttatattacgtcgttatagtgtttgaacacaacctatgatacatgcccgcgcgaatgcgcaggttaccttcctagttaatatgaaacatcgtactaactttgtagttttgtttattttaaaagatgtccaaacatgagtagggatggaggcatggagctactattgagagggggtgtctgattaagaaattttttaagctatattagttaatctattttgactatatatgtatctttctcaatgtaaatttaagaacctgtatcaatttaaatttggataaaaaaagagtaagggaagcatgtgacacccccttttcattttgctataactctgccctgaacatgaaagaaacggtgcggaaagagagataatttgcgtcctagagtatccgaaagctttagacactagattagtatgcatgcataggttcgtacctacagttcctaatctcttatcaatgttgacaacctttattggtgatcgctatgtaattcatatcatcatatgtggtggactacttcctcagtcccattttaagtgtagccaactcacatgccattaaggacccttgatgctgtactcttaatgtaacaatgattatcatgctaggctagtgtaccaataattgcagagcaatgcaaatcatttacacttaccacttgtgcaattgccatcgtatgagcaggattgcaagagacgactgacttgcagcctttcttgactactttactttgtttgcattttattagtttatttaaaaggcctgatcacggattagtggttagtatgtgaaaactcatctgtatcgagcgagcagccatcaccgatggggtcatctttgttggacctaaataaaaacttgttactgataaggttttacctagtgcgcgaggcatcctataatccatcacgatgactcattcgtgacgggctccaactcttactcataaaaggtgactttgtcatccgactgagtcttgctctccattcttggtccaacatgtgttgttgtccttcatgaatcctcgacatattagatgagggtgtatatctactcttccgacaaacatcttctcatttttttcaatctacacatgaacaagtcatagatcgtattatgtacacgtcaaaaatatcaatgacatagatggccccgttgactgttacaatggtactgacaaaccatgccttactagtctagactctagagcccacatgttgttatagatctaatttccgaccaaagatgataccaaaatatgaagcaactaaaccctacaatgacatagatggcccgttgagaatttgcttttcaatggagtagccatgtcattgtccagcaaaatcaagacaattatagagaaggtagtaggtgcgcgtgttgtctctgtctccaactttgccccaaatagacattggcaatagtattagtagtaagctttacttgactccaaatgacatgacttattttgttcttcccatagttggatgatatacggaaattcaatagcgacagtggctcgaagtagatcagcttcattcatacaaaggggtaaacgatgggcaactcaatctcccatctatatcacgtactagtacacatcctggcagaataactgctaggtttttcgatcataattttgatcatcgtggtttaatggtttaaatcttttttctgttcttttattaatgtgagaatttctagtcttcatagtataaatatggtggcttctttttaagatattttaataatataatgatccctataataaatagatagattggtagaaccaccgatttttttacatctaaacacatgcagtccaataattacatatgtgagcacgcattgtttggaatctatctattatatactaaaagtccatgaaactttctaaaaacactctcaaatcgccatgtggcttccttaaaacgctcctaaatcgccacgtgacattataataaatagagaaaattcgaaccattgattttcacttaaaataggtggacccattattttgagccattagatttaagctaatccgtatcctctcatctccgaacgccgcgtacctcctccccgcacgcaagacgtagatagctaggtacgcatctactcctctccatctccccttttttctccaaggttgttaagctacaaagcataatttgttacaataagttaagaattttggggggggagaaaaaaaggggcccccccctctcttgggggggcccccaaaagggggaagccttcgctgtgcaccatgcatgctacctaaattataggagtgatcacagtgatacacttgaactacacattcagtttattatacacttgaactactgttttttaatcaaatcaacggtttaagactcatattagttagctatattttggtggtaaagaattattacatgttggtctttttcaatttatcacatgcacgtatcattttcatgagtcctccccaaaattgaaggaaaccctaagaatttccttcaatatcaagtctaattttttattcaaatcggtggatcaattatgatacaataaggcaatagtaactaattaactacatacgtactctctcctcctcctctcctttctcattcaattcttcattcttctaatttttaactaattagcaacttaatataaaaacaaaaaataattagaaagctaaatgattataattcttaagttatatatggtttttatgttcaacaatataaaagtaaaatatattacttcacaaatataaatatatttagtaaaattaagatctatatatgataaatatccaatcaatgttctttaaaacatcttctaaataattcaagatctatattacccaatttcactgtaaataatacgtcatttgtagacacctatgcgtgtcaaccaaataaaaaaaatcaaacaaactatatcaccttaaatcatcgtacattctcaatagagcacttacatgtcacgtgttatgtcttaaattaaaaacaaaatcttagaaattatagaaaaacacatttgaccaccggttatgaattaaatatgtatatccattattttaaaccattagatctattttttttaaaaaaatcttaagccgctaggtgttacattttaataattaaaaaatattattcgaaattttaggaacaaaacaataaatcatcggtttttatttaaatcatttataaaaactaggaaataaaccccgcccccaccccccaaactttaccccctcctcacatatgcacaaacacaacactacccgtcccctcatcccccggctcgcactttcccctataccctccttgatatttttataaccaataaaaagagaaataatcaataatattaaagcatacatatcttttgagccacacatctgattctaatataaattgctctatttataattaaaccaacaatttaaagatccataacgcctatattttaaacttaatttttcactaaaattagaacaattatacatgttcctattttttaagtgcttagatattattgactttcatgacattatgagttcctctgcacattattgtatatatataagccacacaatgtttgcggtttatagttggttgagaagttacatttgtaattactaaaatgttcagactcatattgactaggtattttcttttttttaaaaaaagaaagatactatagatcacacatatattagggaagggagatctacgatatatctttagaaatttatatataaatatataacaaattgcgtcaataaaatatattcattaaaaaataaaatatattcattttcaataatagttatttaggatttgctaaaaaaaagaaagaccctaaacattttattaaacaagacaaaacatcacatgtttccaaacaaattaaatctaactcctttctagataacgaagagatcatagataattgtttatatgaatgtattaaatattatgtattttaaaagctaacaaatagattggaaaaattatctaagcaacactgatgagataagttatggataaacagtacttatgaaatgacaagtgtcatctggctgatattctgccatcttatatatttttttcaaacataatttatagtgcatgcccgcgcgatgcgcgggctaccttcctagttctaattctaacaaaccttcgcacaagtacttgaccactgtcaatatcgggtcgaccaagaggacctaacgaagtagtatatgggggttttgcggtcttgtttctagcactaacatgcgagcagcccaatagtattaatcctcttctttttcttcaactaatagcaatagttttggtctcatagctcacattgtattgtagagcatatgtaaataatgtaagaaatacatatgctacaatgagttgtgaaatgaaaacaacacaattaaaccatgcatgctcccgtaatgatgcatttaaccaattggtgatgtgggttattgcgctaacgttcttaattcagcggcccattagtctgttggtcaagtggttcaatggaagcaccgtgcttcatgtgagcatcttgcctatgcatctaaatgtggttgttgcgtgcttatttttgtaattactggattgcatgtgcttacatctaaaaaattcgggtgataccaccacttaactatactaatgctccaagtggatacttctatttttcgagtagttgtgtcaatcaacaaattccttttattttacgctgacgaactaatatcattagaccacattcacaaatcaaggggctcctcatcttcgtcaccaccaggctcagggctatttaaaacaaatcgatgcatcttcttccatataaactaaataatccttttaaaagagaaaaaaacagaacaatccatgtccttatcaaacacaaaaattggtggtggcaatggacagtattgaacaacaagattttggacagaatcaacacatagccatgtgacgaatgccatattgatgcttgggacgtcatgaggcagacatcaaacatgagtagtttgtttcatcaagcaatcaagcctggtacaaatagaatcatcagggactcagagccaatctgaagtctgaaacttatacgtccagcaccaaacactcaataaacaagggttgtttatttgcatgcgtcccagatcccgcatcaagcaataaaggtgtatgatctgacaattctctattcagagctctgaccgttgctaacaggaatttcacttcccaatccatgctcataagcaccctatccaacttctcaaaagtttgattttgtagagcattcgcccacgtaaatttacgtccagtgagctccagctctctcaagtctaagctatctatgacagcgttaaacaagaaaggccacttatcactatacttgtcattgtttttctcgctagggtttcgaattatattgaaatcccctccaattagaatcggcaaagactcttttctacaagatctgacgagttcagtaaggaaagcctccttatactcctcttgcgcagccctgtaaactgctacaaggatccattggaaggcattttccttattccgcacatgaaactttacatagaagtctccttcatcaatactagaaacgtcaaaaaattccaaatttactcccaaaagaatacccccagatctcccttttggtctagtccaatgccacaaaaagtctttacctccacaaatgttcttaaggcatgcatttaaaaaatcacttttgcatgtctccaagagagcaataaagtctagcttttgctccttggttatgtccgaaagaaatctgaatttagccaagtcactaagacctccaaaagatccctaattttgatcgtcgcggtttaatagtttaaatcttttcttttccttgattaatgtgagaatttctagtctctgtagcaaatatggtggcttctttttaagatattttaataatataataatccctataataaatagatagattgataccaccacttaactatactaatgctccacgtggatacttctatttttgagtagttgtgtcaatcaacaaatcccttttattttacgctgacgaactaatatcattagaccacattcacaaatcaaggggctcctcatcttcgtcgctaccagactcaggactatttaaaacaaatcgatgcatcttcttccatataaactaaataatctttttaaaagaaataaaaaactgaacaatccatgtccttaccaaccacaaaagattggtggtggcaatggacagtattgaacaagaagattttggacagaatcaacatatagccatgtgacgaatgccatgacgtcatgaggcagacatcaaacatgagtagtttgtttcatcaagcaatcaagcctggttactggtacaaatagaatcatcagggactcagagccaatctgaagtctgaaacttatacgtccagcaccaaacactcaaacccaattaaccccagctgcagctggcaccatctttctcgatctgcaggcggaggagatccatccatggatgtggccgtcggtgcggcgagctggctcctcggaaaggtggtgacacagctgtccgatggcatggtggcggcgtacgtgtccagtacagagcttggcctcaacatggagcaaatcaagaccgatcttgcatacactcaaggactgcttgacgcggccgaagagagagatgtcagaaacaaccatggcctacgggtgctcctagaaatcctgaccaagcaggctgacgaggctgaggatgttttggacgagctccagtacttcatcatccaggaccagatcgacggcacccatgaggccactcccatggtagacgatggccttcgtggtcaagtgctcatccatggccgccatgctcttcatcataccaccggtaactggctttcatgtttttgttgttcctctgcacgagatgacgccgatgatccacatgatatacccaagtcccatagtgatgttcctgaccatgttagcaagttgacattcaatcgagtagacatgtccaataaaatcaagttggttatagagggcatacatgcctcatgtacacctgtatccaatttgctcaaaattatccatcctgcagtaggaagggcattaccaccgaagcgacctcctaccagctcaacaattacacaggataaattgtatgggcgggaaaacatctttaatcagactcttgatgccatgactaactttactattcatagtagaacactatcagttattcctatagttggtcctggtggaattgggaagacaactttcgcccaatacctatacaatgacaaaacaatagaggcacatttctctataaaggtctgggtttgcgtgtctactcattttgatgtggttaaactcactcaggagatcttgaagtgcatatatcatgctgaaaatgagggaagccgcagagtggatgaattatccaacttggatcagctccaaataaccattgcacaaagactgaaatccaaaagatttttacttgtcttggatgatatgtggaaatgcggtagtgaagctgagtggggaagcctattagctccattcagcaaaggggatgccaaaggtagcatggttcttgtcacaactcgatttccatccatagcacagatggtaaaaacaactaagccaatagaactgcaaggtcttggggatagtgaattcttcacattttttgaagaatgtatatttggtcatgataagcccgagtattatgaagacaacataattgatattgcaagaaaaatttctaagaaattgaagggtttcccgctagcagccaaaagtgttggtcgattattgaagtatcgcatttcacaggaacgttggatagaaattcttgaaagaaatgagtggcaacatcagacaaataatgatgacataatgccagcactacaaattagctatgactaccttcccttttatctaaaaaggtgtttttcttattgtgccctttaccctgaggactaccattttaataatatagagattagtcatttttgggaagcattaggcatcatagattctggaagtcataaaaatagagctgaggatattggattaaagtatttggacgaactagaaggtaatggttttcttgtgaagaaagttgatgataggaccgggaggcaatattatgtaatgcacgacttattacatgagctagcacaaaatatttcatcacaagagtgcatcaatataagttcatacagtttcaggtctgataacattccatggtccattcgtcatgtatccatcaccttacaagataactatgaggatagttttgagagagaaatggaaaatttgaagagaaaaatagacataggaaatttacggacattgatgctttttggagaaggcaatgcaagcatgcttatccttttcaaagatttattaaaagaaacaaaacgtctccgtgttctattcatgcatgcaaactcgctccaatctttcccgcacaacttttccaaactgatccaccttcggtatctaaagttggaaataccttatgacgtagaactgtctctaccaaatgcagtaagtagattttatcacttgaaatttttggacctagggtacagtaaatgtattttgccaaaagacatcaatcatctagtcaatttatgcctcttaaatgctagaaaagaactctgttccaatattcctgggattggcaagatgaagtatttacaaaggttggaagagtaccatgttaaaaaacgggacattgggtttgaactaagtgagctaggggatttgacagatcttgaaggtgaactgaaaatatttaatcttgagaaagtggcaacaagggaagaagctaataaagcaaaattgatgtccaaacggaatatgaaaaagttggagctagcttggggtatggtgcaacggaccacaagatctgatgttcttgaaggtcttcaaccaccttctaatcttaaagcacttgtcataaagaacccaggtggttccattggtcctagttggttgtgtggtaatatttgtgtaaactacttgaaatctctgcatatagaaggtgtatcttggggcattctcgcaccttttggtcaactgatgcagctagaggaactaactttgaacaatattccaagcacgcgtcggtttgaacctaattttggtggtgttacacaacaaagtttctcacacttgaagaaagttgaatttgttgatatgccagaacttgtggagtgggttgggggagctcattgccatttgttttcaaagattacaagcatcaggtgtgaaaattgtcccaatctctctatgctgcttgtgccatcctctaggttctctgtctcctatgcacaagacataaacaccagatggttccccaacctgtgttctcttgagattgaaaattgccccaagttgtcactgccccctatacctcacacttccatgttgacatgtgttattgtctcagagcgtaagacagatttgttgcgtcttcaagaaaacaagctgatctcacatggatacagaggtgctttggtctttgataacctggacaaagtagaagatatgagtatcgaagaaatgccacacgtttcattgactgatctccaaaagctcagctccctaacaagacttgccgtcaaaggatgtgaaagcatgttatttagtgaagttgaagagggtgttatcttcccttcagttcagcagctcgaaatcagtgattgtcgtcttaccagaaattcattgacaaagctactaaaccgtttcccagctcttactgagttccacttgatcttctcttcatttgaggttggagaggaagcagtattgcaactcccatcctccaacttattgagctatgtcagaatctggtgctgcaagaacctggttcttcctgtggcggatggagggggtctccatgatctatcctcactccaagaagtcgaaattaggggatgtggcaagatgttcgatcggtgttccatggtagaggccggagctcggagcaacaagttcttccctgcttccctcagggaactcaatatcagcgacgagttgagcattcagtccatggctctgctcacaaatctcacgtccctcactcatctaacactgataaactgtgataacctgacagtgcatggtttcgatcctctcatcacgtgcagcctcaaggaattggtggtctacaagaaagccgatgacgagattcatctctactctttagcagatgatttgttcttagaggtggcaacaaggatgacgaaagtaatacctgcgggaggttcctacttccaacagctggaaaaacttgaggtggacagcatctcggcagtgcttgttagccccatttgcagtctcctcgctgccaacctccgcgagttgcgattcaggtatgatttgtggatggaaagcttcacagaagaacaggaagaggcacttcagctcctcacctccctccaatgcctgaaattccggaagtgccttcgtctgcagtccctccccgaagggttgcattgcctttattctctctataaactaaatatcgctggatgtccggaaatcatgtcgctgcccaaggacggcttcccggtctcattggaacgtctaagaatacgagactgcagcatcgatttaatggttcaagtcaaggaattagaagcatcaaacccagatttacatatacggctccactagcaaacttaccacccaaggtaaaacaaggtgctctcccaactcctacatcttttttccccatttcgtctctaacctttcgaactaactaaaactcgttttttattgtttgttgttaatgatgtagctatccagcaccattgcctcatctggaacctttcagagttcttccatcatcgtatagctgacaatgtaaatgcgaattacacgacaacacatgaagataaagagctctggatggcagagcagccactttggctttcagacataatggatgtcctttgtctattatccaatcaatgttatattgatcattacaattttggtaacttacgttctctgtcattacacttctttccatctcaaactgcatggtgaattttggcaggttgcagctgcgtgatatcgaaatccacctgcacttgtatgatctgtacagatccaatagcgacattttgccaatcagccgtgctggttttttttagaaaatagattaaaccggcctctacatccaaaatagatacacagccaggccgtgctggttagtaaatatgcttatgtcgttttgctatttttttctttttggactgaaactagtatagtattgtagaatgtcccgctcttggtcttactttctgcttattactagtagagtgctcgtgcgttgctacgggaattttgttgatcacgggaaaacaaaatctggcaatccaaaagaaactacaagtcatagttgttctaagattaatttaaaagcaagatatatgttataattacagaagcgtagtataacctttttggcgcataaaacaatctcatggcgtttattaaattataaaaagcaacataaatagaagacagctaatctccaggtacgctttcttgatgaccctcgcacggacaatccaccattttcagtgtatgtgatccatttgtacctcgtggaaccgaacaattctgatgtgaccatggctaccacggatgcaaccattgctcacatcatggatgaacaagaagatatcgagatcaagtactccaagtgctggaatccgattcggccacctactacactgctgatttcaaccggccaccgaatctgcatacgacctccgttttcggcccgggagtacttgatggaaagctctcggagccctctttctaacggatccagcctcttctctgaattctatctcgtgtggccagaatcacaggaacaaggtgttgcatcacctataatgggcctatgggcttgtaacttcatttgggaccccggcccaggtggggcccatgtggggtgcgccccaagctggtggagcacgaccctaggcacccctaggtcgtcctcccacccctatatatagctagttaccccttcagggtttctcgggttttgttagattaaagtttagccattgctacttgcttgcagcgcgcgtgtcggctagaccgtccgtctgcttgttcttcggaaccccaacttatcatttgtattaaattcctatttgcaatatcagattgcttttatcttgttcttgcttgtttcttcgatttgcttgcaggaatagggttgatctgcaccggcaagatcagcaacccacggagaggtgtatcgatcgctaaggcgcaacacaacgtctcgtacggttgtagtcggatcgtcaacgtttctcccaaatcgtagttatcacaactcaccgaaagatcgggccaacaacagccttgagtgtcgagaggaactcagggttcatcaggtggtatcagagctttcgttgctcggtgagtttttatcttcctataaccagaaaatagccatacaaaaaaattcgtatcatttacctagccatattgtgccattgcattgttcttttcagtttttgctttgttgaattttgtgttgcatcgtcacgtcgtgttgctggtcttagcgtctagttcgtttagagtttcgagttctggtcacgttttgtaccacagtcgtcgctgccaccatgtctctgttgttgtcaggacctacgaaaacggaatcggctcgctgccacggttctatttttgtagttttcagaagtttctgtcggttagttttggagttcttgagttgcatctagagtttgccgatccttgtgtgtgtttgttttggccgtgcctgtgtcgtgcacgagaggaggaaggtgaattaccatatctgattttggaagtagtcaagtttgttttggaaagatatagtagattggattggttaaaaatcagtttcctttttatcccatacaccaaattcggctgccatccactccacctccttgccgagtcccactcgcccctttggccgagtccgaccccctccctcaattccacggttccgagttgtgtcaaacaccttggcgaatttttgtttggtgtcggtttcgagatctgtttggaaaaacggaaccggcataaattcagcattccattttttgtataattttaattttgggtttagacttttatatttgagtccctgtaaattttatatttatgtttgagtccctgtaatcttacattaaggtccttgagtcagtttttgttaaaaaaaatcaagaaaaaagtgaaaaaaaaggcagaaaggtgcaaaaaaaaagagaaaaaaaaagccgcaccaaaaaaaaacagaaaagaaaaggaaaaaaaaagaaagaagaaagaagaaagaaagaaaagagaaaatactattatgtttgagctaaacttcatatatcagagttgtgcatgagttgttcctagtgctatcttgtggtattgtttgtgtctaggctcgcgtctctagtacgttctagcctaggaccagcacggtacttgactttgaacaattattcaactttgcattatctgatttgagcatttgctattcctttgctacatatttaagcctacccagagctccacatatttgattacagccgtaccgcaagtgtttgccaaggcatcgatacatccaaccttcattggggtgcttggttgagtcggtgtatgtcaccattccacttgcattggtaagatcttgtaagagcttggttaaaagcttgagtgtgtgcgatttttgagctgccactacctagtagttaataggaacgcgcatatttttgtgtatgtttcttgttttctactaacaatggcagggatatgcaagataattggggatagctgtgctcaacatcgacatcttcgtcgagacacgaggagggatcaacatgaccattataaggtaagtgatgatgttctaggtaagatcaaatctgcactgccttatttcgagggaaactatgatcctcgtgcttacattaattgggagctagcggttgatagtgaatttcaaaagcatgtcttgtcggagaaacaaaaggttatgtgtgcctctagtgttttaattaaacatgcttctaatgattggaaacatctttgtaggcataacaaaataccacaatcttggaaagacctgaaacgatatttcagagatatttatgttcccatgtattatgctgacattttgttcaacaaactgcaatgtttaaaacaagataccagagctgttacttcatactatcatgatatgcaagcttgtttattacgttgtggtttagatgaatgcgaagaagctaaagaattgaggtttttatgtgggcttaacaaagaaattcaggacatgcttgattgtcaaagatatacatctctttctcatttgttacaacttgcttgcaatgctgaaagtaaaatagaggaggacatgaagaagcaacatgctatgtttttgtcttctattactaaccatttgcaggaagtgcataatcatgaaaaggaggagagagacatgaaagagccgccagtcccattgatcacactcaaagtcgaggcacctccattatctgaagagggcatcaaaggtaaacttaatggtgctgaaattaataaaggtgagtgtgttgttaatgaattgaatttgtccacttttcatgctatagcagagcaaccattagtggaaccaactgctgagattcctttgtcacaaattgatttgtttgctgttccttgtgataaagaagagttatgcgataatgcttcacttatatccatgccacaacttgtgaatgaacatgctattcctactgttaattcatactgcactgattttaagcatgttgttcacattgctaataaaatagaggagcgtgaattgagatcttctttaaatactttgggttatgttcagtttgatgatttttgtgagctcgataatttcaaggagaaattatttgctaagtctgatttgccatatccaaccaatgttatatttcacatctttggtgaatataatgatcttggaatatattttgtgcatagagtttacatctgctcggatttagaacctcctgtacatgtggataaaatatgcaagctagagaaaaatgttattgctaaccaaattgtctcgagtttgcctagttttgattggaagaaacaggttgttgtaaatggactacgcaaagagcaccatatggaaaaaccgaggacggttttccgtgaagaaggggaggatgatgtgaccatggctaccacggatgcaaccattgctcacatcatggatgaacaagaagatatcgagatcaagtactccaagtgctggaatccgattcggccacctactacactgctgatttcaaacggccaccgaatctgcatacgacctccgttttcggcccgggagtacttgatggaaagctctcggagccctctttctaacggatccagcctcttctctgaattctatctcgtgtggccagaatcacaggaacaaggtgttgcatcacctataatgggcctatgggcttgtaacttcatttgggaacccggcccaggtggggcccatgtggggtgcgccccaagctggtggagcacgaccctaggcacccctaggtcgtcctcccacccctatatatagctagttaccccttcagggtttctcgggttttgttagattaaagtttagccattgctacttgcttgcagcgcgcgtgtcggctagaccgtccgtctgcttgttcttcggaaccccaacttatcatttgtattaaattcctatttgcaatatcagattgcttttatcttgttcttgcttgtttcttcgatttgcttgcaggaatatggttgatctgcaccggcaagatcagcaacccacggagaggtgtatcgatcgctaaggcgcaacacaacgtctcgtacggttgtagtcggatcgtcaacgtttctcccaaatcgtagttatcacaactcaccgaaagatcgggccaacaacagccttgagtgtcgagaggaactcagggttcatcaaattctgcatggggaagacaatatacacaacatgatagctttacacaatccatcaatacaagaaacaatagaatgaaggaagagtgacctccatggttgcacggctacgcattctccatattgtgtgctaatcagccgttcggaagagacgtccgtaagaacgggtggatagttcggaaagaacgtggaaatggtggcaaagaatgtggaaatggtggctagggctggcaacaagagcttcggttgctgctggcgcaacttatatgatgattgtaactaatcacgattagcgtgatcttgccatgccgtcaaaagcgaaaaaagaacaaaaaattcgttgcctggttgtttctggcgttggaccgtaacagtcagatgttatgtttctggcattggaccgtaacagtcagatgttatatgggccgattaggcccatagcttgtttccttggctatttctggcgttggaccgtaacagtcagatattatatttctggggaataagttcatctgaggtcccttgactttacaccaaatccgattttcgtccctcgatcggaaaaccagacacaacgggtccctcaactatcacaaccgatgcagatcaggtccctcggcggttttaagggcggttttggctaatgtggcgcatacgtggctaatttgactcagtcttcgttcgacatggcattgacgcggcgcttacgtggcaattcgaccctgaaaaataataaaacccgtgggacccacatgtcagtctcacatagaaaataataaaaaaatcgtgggccccacatgtcagtcaaactcacccttcctcttcttcctcctctctccccatctccctctcttcatctctctcccctctctgctcctcttccggcgagagcggcgagctggagggggcagcgagaccggcgcccaccggcgagagcagcgagctggaggaggaagccggggcgataaaaggggatcaacgacggcggtgggcggaacagatcgacccggggcagcggcagctccccccggagcagcgccggcaatcgagatccggcagtggcggccgggagaagggcggtggccgatggggagaaggggcgacgtgcagcgatggccgccggaggaggaggagatgcagacatgcggggaggcatggcggtggcagccagaggaggaggacgtccgccgtgcgctgctcccctcggtagcggcggcggcacgggggtcctgggagtcgccgaggtcgacgtcgacgtcgtccgcggccacggccatggcgttcctgtccgcatccggcgtgcaccacagaagcggcggcatggggagtggcgcctcagctgctgcaacggtggcgtcaatggggggaagggaagcgaaagctcctcgctccggtgggctgccgctgacgagctcggtggtggtgaaacgcgacggatcgagcgccatcttggcggctgggggccctcctctgacctctgctctagaccgctgccttcgtcctcttcacccgtcgccggctgtcgtcctcctcgctccggtgggcggtcgctgacgagctcggtggtggaggcgggttgcggcggagggcggtcgccgctccctctcccgctggccaccgccggctgcgcacctctccctccgtccgtcgccatcaagcccccgcccacggcgctcggccatcgccggcctccctgcgtcctccctccctgcccgcctcgccggtctttgcgcgttgctccctcctctcctgctgccggccgcctgccgccgcgcgccgttgtcttccgtggcggctggagagagcagagatagggagatgaagagagggagatggggagagaggaggaagaagaggggtgagttggattgacatgtgggacccacgtgggtcccatgatttttttattattttctatgtgagactgacatgtgggtcccacaggttgaattgccacgtaagcgtcacgtcaatgccacgtcggacgaagaccgagtcaaattagccacgtaggcgccacgtcagccaaaaccgctctcaaaaccgccgagggacctaatctgcactggttttaatagttaagggatccgttgtgtctggttttccgatcgagggacgaaaatcggattcggtgtaaagttaagggacctcagatgaacttattcctatttctggcgttggaccgtaatagtcagatgttatatgggccgattaggcccatagcttgtttcctttatcaattaattccaagagtgcaaataagcaagcaaaatattccatcaaaatattccttggcgggtgttgcagatctgctgcttggagttaacctttctagtttctaatcaagctagatgtgccacatctgatacagagagagcttcttggcagtgtgaagctctggaggtgctttaaaaattcttttttgaaattcatcagggacaatcacgtttcttgcacaatatcaattattcttagactaatagctcttgaaactctactgtttctgttgcatcagttatctggtagcattttctaccagctgaacacacgattctacgtacattttaattccaattttcatgacaagagaataattccttttgatgtaacctacccgatctcctctctgaaagcatattatctgtttaaattgtaatcccgaacgatcacaattaacaaatcacatctcatttttttcaaccggcaaacattgcccctatcaataaattgcatgatccacactttttatcagtaaaatcaagtacagaaatcacaaatgccagcaacacttctacaggaagacaagagcatgttcaaccagtgccattggcaatgaaaaggaagcttcttgcattgctccttccagtttacattcacatcaaggaaccaaatagctggtagatcagagtagtaaaacaccagtactggctcatgggttatctgcatgatggagtataaagtaagtatagtgcactactagtatacaatagcaattaatatttagcagaaaaagagtgtgcatataggtaaagaaggtatttttattgaattgtttaacaaattggtcaggaagacgtgtgaagaacagatcaaaagcattgtttcttccagggaattgattaagtcagatatgctgtagtaggagactttccctgctcgtgcttgtggacaaccatttgtaatgttcctaaggtaatcaaatcagctatacaaaatataattttcaactccaactaattatgaaactttgccatttaaatttgcagacaaacaaaaacaagttacatgttacgtatactgtatacagctatggccaacttatatgtttagattaattatttttttggcaaattttgctacaagatatcacgactttgtggttttagctgtagggcaccgcacgaagtcacttttggggaaagacactctcaaaatgtggttatttgctaggggacacttcattcattaaattaatatttttgtgctgactaagcgagaaggggcctacttttttacatggcatgaccaaattgccctcatctctttctcttcctctctcttcctcctttaacagcgaggccgctactgaggcattgcaacggtgtgtggggacgggcgtgggcggcggtgcatgggcgatgggcgcggcgttgcagcggcgcgtggggatgggcgtgggcggcggcgcgtgggcgatgggcggcagcgtgcgggtacacgcggaagacatcggcgcgtggggatgggcgtgggcggcggcgcgcggggacaggcggcgccgacgagggagtcgcgtgatgcggcggcggcgggcggcgctgaggagggcgttggacagtgccgggggcggacgcagcttggggggcaggatggcgacgggcgtgggcggcggcgcgcggggacgggcggcgccgacgagggcgccacgtgatgcgccggcggcggacggcgccgaggagggcgttggacagcaccaggggcggacgcaacttggggcagcgggatggcgacgggagatggcagaggctgctcggggtcgtgggttagcgccgtccggcggtgatgacggcgagcaggatggggaagacgctccggtcgaaggcggcggaggtgtcaccgccgcgcctcttccgcttcttcatcacaaccctgcaagtttgattcgtggcggagctccggcgaggccgccgccgtgggcgctgttggtgcgtgccgcctccccctgcgccaagttggccgcccatcccagcgccgagctcgttgctcgtggccgtgggtggggtgaggacgtcatcgccggtggaggtagaggaggcaaggagggaggtttggggtgggggaagaatatgacaagtgggcccgagggcatttttgaccttttacactgtttatctctcctattgaaccagaaattaatattttattggctgcggtgtcccctggcaaataaccacattttgagagtgtctttccccaaaagtgactttgtgcagtgtcctacagctaaaaccacgaagtcgcgatgtcctgtagcaaaatttgcctatttttttttgtccatgtgaatctaatagtggcctggtatagatggatggtcgacagcaggggagagcagcaaagctgctacacttggccactgcaccctcttttgctcttccttgctgaccaccctaggagatggattacaggcgaggcaagggctccagatcaatatcatccagaaaaaaagtagtatcacaatacccgtaatggtgcatatagtccgtgccaaaatcccaccgaaagtaatgtttactgctgtccaagaaaaaaacacacgaaatgttagacttggaatataaaaattacagaaagaatggaatttaagcaagcatattatggatggttaatagtcacataatataccttttctaatctgtgaggacctctctatacacaatattttttgtgtatgctgctgtctgtttagacaatttctttcctttcttctcattgtccttcacgccagtacgcttagactttttcttttgtttcttgtcttctaccggcatcgatagtatttttatgtttgttctagaggttgctctagacaacgtgacgtatagttgaccatgagagaagacagactctggtaaatagacgcctgcatttggaattgtttgtccctgcgccttattgatggtcaatgcaaagctcaatctaaccagaaattgcttcctcttgaagcgaaaggggaacatctcatcatccgaaggacattgaggtatccgaggaaggaaaactctcttaccagcatgctgccctaccacaatctctacgtcaatagcatttcttccgaactcacgaaccaccagccttgtcccattgcaaagtccgttggctgggtcaatgttcctcaatagcatgatggggcagttaatcttcagcttaagcacatgcggaggtagcccatttagagttagagagttcaagaattcaggcgggtaatagttataagggtcatcctctggtcgatcaaagctatgatatgtcaccacctctcctctaaaccgcccaatcattttcatgttaattcgatccacgaactcattccgggtggacattatggtcctacatgtgatgtagtttgggttcgtaagattatcgtttaggttggggaacacagtatcgatgagcctttcgaggtccgtttcattctctttgcacgacatgcaaatatccgtttcacctcctcggtgccattcccaactcgaaggaggtagtccgcaaaccacacgtcgctctgcaccctcatattgcgaacaagcttcaattgaaccatacaatcccaaagataggacctgcgcagagtggcatctgttatctgagacctagcgcccttcctaatgaccgggagcacctgcctgaagtcccctccaaacacaatcgtcttccctccaaacggagaacacggacaacccattatatctctcatgctcatatcgagggcctcaaccgcttgcctctttgacatggaggcttcatcccatattataagcgacgccatctagaatttggagctcactgcaacacggcgcagttggtgctccaacattccttcggatggccctctccagtcattcgaagtccaaagtccaacacggcccagtccgccacctcccctttctcacccctcgccgccgtccccggctcatgcctcgccgccgcctcatcacctgctgccctctgctcaagcctcgccaccgcccccggctgctcaccacctgccgccgccgccgccgtcccgttactcgccgcattctccacctcctccggtgcacaagtatccatcgccaccgcctcacggcaaagctgccgcacccccaccgcatggccacaggaagttcccaccgccgtctcctcattcagtgaatttggcaatggcgcccttgccatcttatttcagtgccgatccgccatataactaagcagagctgatcatcagcagctctgattgatcggcgacgcacggaatggagcatcgccacattgctatcttttggtatctttgatatgcaaggccatgataaacaccttagctaattaagtaaactcgaggtgaaactgttaggcaaataatcaaaagcccaggagcaactctctgagtgcgttcgtgctttttgtaacattttatctcttccaaaatttaacgagaaagttactgagtaaagtatgtggttgctttgaaatcatggagttgatgtaatgttgttgcttcgttgttttgttgcatgcatgttgccatgttctgtgctggtggatgtgaattgtgacacatgaatcacgctttatttatgctcataagtcatcactattacttgtatgtcatttactgtgtattttcactggtgtatgttgtaatatacttgtatgcaacagtttattggaaaaaacagcggcaggcaaacattgagataagttcaaacatcttaaaatgggtatgcatctgatgacagtaaatttctatatctacaagtaaattaattaggtcataattacatccttagaaatcttcatatatatgaagggctacagaaccatattggaccaaattgtgtagaataccttgctattaacagactcaccagtttaggtttgttaagtggcaaagaaaacatggtaaaacaaagttatcatcttgcaatactgcaacttggaaatagccaggaaaaggaatagcagatacaactcacctagtgtcagattgcagcaacactgcaacagaaaactgcataaggttcaccaggccaaatctgcaacagaaatttgctcggctcattaatctgaacagatatacaattcaagaaaattactttttagcaagattaaccctgctattgtgcatcacagccaggggcaagactggcacctaaatacatctgttcacaactgagcatgcaagctccaacctgtttggttctataatgactataagtggtactttcagattcagcatatgcagagacttttaacagtaggctagtatcggtctgaaatccatttcctattgatccccaacgagcagaaaagagcaggctggtactttcagattcagcatatgcagagacttaaaacagtaggctagtatcggtctgaaattcatttcctattgatccccagtgagcagaaaagagcaggcaagtataggtcataaaaaataaagtgcatcggtgttctcccgaccattttagttttgcagcaaaagaaccagcgaccgcggctggggagatctgttcgggggagttgacaatgagatggtggccagcggccctgagtcccggcggcagaggtggagtacagacggacggcgaggcggcactgaaggaatagtgatcgctggtgacgacgacgcacgctacgacggcggctgctcggcggcagaggtgtagtatggacggacggcgaggcgacacagagggaatggtgatcgctggtgtctggtgacgacgacgcacgctacgacggcggctgcgagcggagaagggtagtcggcgatgaggggctcgaccccgccgcaactcctcccgagcggcacgaagggcggcggcgtgagaggggcggcggagcagcggcagcaggcgtgagaggggcggcggagcggcagcggcaggcatgataggggcggcggtgtgggcgtggcggcaggggcgggccgtttttagggcacgggtgcgggcgtgagaggaggcgctggtggggtcgtgagagggggaggcgcggggtgcggtgtcagtacgtctagattggttcaccatccctcctgcgtattttttaagtagtataaatattcgtagaaatatccataatttcttgaagtgtcacatggcggcttaagaatgctccacggatatgaaatcatgtgactaaaaaaccatgtaattttttttacaaggttattaatgtttatgcggtggcttagtctactaattttaaattatgtagcaaattcttacagtataataatatcaattttaacttcgcccggccctccggcgttagcactagccgttggatgctgctggccaacggccaccgctgttgacgatcgttatcgaccagtttcgaccgtcaatattacccaatgtatgaagactagctatgcttgcaatgcataaattccaaataaaatatctacttccactatatactatgctagtaacatgtatgcaggagaagcacatataaatggaggagaatcgacagaaaatagatgaacgatcaatcagacgttgtcgagaagtagacttgtggatagataggctgataatacagaattaatatgagtaaacaagcccataattcacaccattgggctaaggaataaacgaggagtacacctgccaagttctgggccaaatggaccagaccagggttcggccgaaccaaaagcagcccagatggcccagaaattccacaggccagtagttatcgacatccaatggcggttatgaccgtttctacctgaagcaaccgtcatggacacttgtcacaaggagggagaaagatgctctttggatgcttcatcatgccacatgtcaagaggagagcaaagatgctcctaggatgcttggagcatctccacactcccaaggcacctctccacctataaatacccctcctctcattcattccctcacacactcaagcaaggatcaaagctctctacaaagtagtattagtgctagtggagtagtgttagaatagtttccaagtccgcggaggcttcggggagtttggtaaaggttctatagcttttcctttcttctctgtaagacttccatttatcaatattatattcttctttatacaagttcagtactttattccaatcatagagtatgagtaccagtcttagtttatcaataagtagtataatatgtgtagttaaaccttctgggatttgcattgattctggtatagtgtctgattaccgggtcataagtctgctctggctaggccgagagctatggtccggggactcaggtgctctacaccgattgcaaggctatagagtaataagtagtaatttaagcatggagcttaggttaccgcttatcattatttgggggtatattctctgggtgatttgtaggccgctgatggtgacagctcagtatgggcgtctcccccgcagtttatattcctacatacaatttcctggggttggatacacctccgtatcctacttcggttggagggttatgacaggttatcgtaagaaactcggcaacccggggtaactttgcgatgcatcgggagggcatagctatgcttaggcttagctatgctgcattgttaaaggggttatactacatagtgtatactagttataatatactaagatgttgtatactagaagtacaggaatggaacatatctaaactactgccacttagctataattaggagatgtaggagttagataaatccttagttgtgtgtcactctacccttaagcttaacttacccctgcatagaccttgatgtatataagtaatatataactattagcatagtactctcttatcatatcttcccttgggattaaacaaatacagtaccttagaatactcccgagtgaaatgctacaatggtatatccgtgcgcttgaggatcacatctgtaaccataggaaggcgaagaccgagtggaggtcggcgcggacgctggcggtgcgccaggagctctgccgggacgctatgtggaggcggtcgacttcgaccctgatgacgacgacctcatggacgaggacgtcgccgaaaacatgccggcgcccgcccctcgcctctgctacaccatcgcgggtggcggcgacgacgggggtgtagaggtcggccttcatcgagtcgacgacgttctcgcggagcttcatcaggcagagggcctcgtcgatgatcgatcccgttcccggcaccggcggcggcggcggcgttggtgcccctcatcatctcctcgtcggtcacccgctccgccgccgggcagagcatgcaaaggccgccgcggcggacgcacacgatgttgccgcgcatgatgcggagaggcggcgccggccggcagcagcggcgtcggcgccccttctctgtctcctctctcaccgtgttctctgagttgataaggggaaattttgtctcaacacctagtagaggagagaaaatcttttcgaaaatgaataaaatagcgaaaatggcaaagtggcggtagacgcacgcttcatattggcagtttatcgaatcacgtcttcgggatggcattctagcgaaaccgcgttttgaacatggcgaaatgtccattttctcgtggggaactgagaaagtgggaatacggtcgggacgccactctcgtcggcgcggggagacgaaagcgagaaagacgttggtgccgggtcaatatcccatcggcgagacgggagaggacgacggcgttgattggcggaggcgggaggcctaccgcgtacgggagggtggaggatcgatcgcctgcgagaggggatgaggcggggattccgggcgtggaggaagctaggatgtctcgcctagaaattcatgaaccagaatttctaagctgaatgtgcattaaacccctgtccaggaccagacagggtacacaatcgacaattgttgacatacagatccacgtcttacaaaaatataaaagattacaaatgcagcggaaaaaataaaacgagctagacttggaagcttgacttcagcagcggggcgactccactccacaggcaatccttgacggcagcgacgaaaccaacctcaacaagacagctccaactaggaagatcttcagctctggtgtgggggaaaagagagcaagactgagtactacccactgtactcagcaagtcataccggaagaggagtatgatgcaggatataaccaaaggaagctaggggttcatttgcaataaagcaggcatttaaaagcagtagttgaaaacagtaaagacaattgtagtaattaatcaatattaaccaatcagtgttcaacgctacaccacgttgcaacaggcccaaccagccacctgaactacactagttcattaagctaacctaggggtgagactaatcacggtgaatctggttgatcgcccataaccgcgggcttttcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctaacgggcagtgggcagtcccctcgtgcgccgcggtgaatccggcagctggacaaccggacaccccggccgacccaactccatcacgcccacccacgccaccggtgcctaggaaagggtcgagctatacttcagatcaagcagttacccactcccgcttgtggtaagcacggtaagtctcccagggttt

SEQ ID NO: 83152 - DNA, 536 bp, Oryza sativa
  unsure (1)..(536): unsure at all n locations
taagggagtctaagtggactttttcccgtgaagaagtacatccccgtacgtatagatgggccgggcccggccggcccatctaaagaagcggcttcgagagagagcaccctccgtacaaggagaggtcgcgagcccccaagagaagagaaaccccacgagcccccctccacctccacgccgcagccaacccaaagcgccatggcggacgaccacgccgccgccgccgacctcgtcgacggcggacgccccgaggtgatcccctctgctccctcctcccttgtctgtctgtcctgtgagggggagttcccatctaggtgccgagccttggggggccgtgaagccctccgatggctctcgatcgatctgtgcgtagctagggctgtcgctcgtgaaggcccctagggcgtggcttctcctagggcttactagtgttctccgagggggttgttccgctggcgtggggctttaggggtggggttcgctcgatgcagattcggcggactgaatcngggggggggggggggggggaggggggg

SEQ ID NO: 83153 - DNA, 4708 bp, Oryza sativa
aatgggtcccagcaaaattttttaattctaatgccacgtagacgccacggtggaatgaataccatgtcaacaccgccacatcagtgccatgtcagcaaaaccacacttgaaaaccactgaggaagtcaaattacacggttttaatagttcagggagtcgttctgtccggttttgcggttgagggtcacggattagattcacgtcacttttaagggagtcaatgtggacttattccttttcagtatatgaaggcatgagactattaatttgaatgcggcccatctggcacattcccttgcatggcccagcaactgatctgcataccggcccaacagttcattcggcccaactatctgatgcattatatatttattcaggaagacaacgcgcatttaatttgcacatctacattccttttagaaaatcctgcacatctgaagaggaaatttattctcatatttgaataggtgtatatccaaaataaaatggcatacaataaattgtaggaaaaaaaaaggcatttaatgctggagatataaaatggaattaataaaccttacacatggaaaagcaataaattatacaaagatttgtgaaggcataaatgcaaggacacatcatcgtaagatttggttgtgcccctatataaacatgagcaaaggggcacaacaatgagcacagtgaaactgaagagggcagatacatacaaacaagagctcagagcttgtttcttcagtgatctctcctaatggcagctaccaagaggatggcttactccatctcggtggttttcatgcttcttttgatcatctcttccaccttctcatcctgctacgcaggcaagcatcgatcccaattcctcacccagaaatttactgtcattcagactaattgctatgtgtgctgtttgatttgagtggttcatgatgatctttcttttcttgaaaaaagaaaacagaattgcgcgaatggtggcttatgatgcttcaattgtgttgcatttgcagctaaagatatgaaggaccgagaagcaataatacagcgccatcgcgaagagtgtaagaaaacatgcagagaacgtcatacttactgcccgcctgagatgccatgctgctgcatgaagaacgccccggcatcatctcccagtagtgtcaagaatgaaagcggcgatgggcttgtaattaattaattaaattgattgatcatctcccatccaaatttgtaacggatcgatttgttagtttgatgctatctcaatgaataaacattcatgattttgttatattatgaaaacgtggttattactccatggttgcaaacaattaaggggcagcagagaagagcatgaaagtctgaataactgtgtgtaccgtactgtacctgacgaaacaagcaacgttttattgccttgttgcatatgcaggaaatcacgtttgtgacatgtcttgtgtctggtgtagtggtgtgctgaatctccagcaattcagcatcggaataaccactcgttctccattaacgtagaaacgaagaaagcaggcgaagacatcaggcagaatgcttgtgtttttgacatagtgtgaatcgaggacacactgaaagtctgaaactctcaataatgtagatgaatttgacaacaaatagacgctatatatacggcagcaattggaatcggaccagattaacgacttgattgatttatttagccaacaggcccaacacacatgatggactagaacatggcggaatggttcccatagcgatggctgatcgacaacttggagtggttttgtaggtttttgtgaaaaccagtgtagtggggctcaaaaagatgcgaatattagagaatgacctagaatgacctaatatcaaataattagaaggggtcaggtttcgaacctaggtcgtctagcccaccaccttgtagagctagccagaatacccctaggcgtttctccagtgttgtggggctcagccgccaccttccctctatatagagatgttttatggtgtttgtaaggtacatagaggtattgagaggtggagcaatatgggccgttgatcaacatacgggtaggtagggaacaaaattattataactgatggcatgggagtaattaactagtaaattagtggtatttttgattttgtgtgaatacctttgtttgattgaatgggtacttttgcatctatttggtgatctggtcatcgcaaggggaaaaatcaagatcgttttttttctcctcgttcaatatttctttacggtttgaaccggagatcgatcgagggagaagatatcggatgccgcggccgcctcagcctcgctaacgatgttgctgtagtgtgctctctgatcggccgcctccggcaacgatcatgacaacgacggcgtattctggcccgccgccgttgcctttacctctttagttctccatgtcactgatgctgcgcctagtctcaaggtagcatatctgctagagctagagatgaagcttttcgatcgtaacttgatctcttgcagaattaactgatattcagataagagggttctatctagttctgctatatgcatttggttcagtcagaaaagatggatcgaaccagatgtcagcacgtgaaaagatatcgaattcaagcgataaattgataaccagtttcatgcgaagatttacatagtataggctcatctacattttcattattttgtcgctactaagaaaaaaaattaaaactggtagagacagccacgggaaaagggcacgacaatatgcaaatataaaaaaatacaatgcaaataatataatggaaaattagaggcgatggagatgacttaccgcatatttggtgatgaactactgatgcggtacctatgtacctacaactaatactatagacaattctaccatttttcatcttctagcaaattatcattttaccctttctacctaagtacctatattaatacttaaatactttttgtatgataccttttattatggagcgttggatttttactatttctggaatgcaaataccgtaaaacttctcctctatacaggagcaacgctctctttacactagcagtctttgtttttttcaattctcttgtttccttgccctcgggctggccgcctgggcggttgcattgcgttgtgtaacaaaaacattgtttttcttcaaatatattgacgtgcaattcttttacatgttcgcgaaaaaagtgaaaaccagagttatagatttttttttaaaaaaagtggaatctagtttgatttaatttttttcaatttggctgtttattgagcggtttgtcaacccaagtaggctcgaaatctcaaaaatttgtgaaaaccaagcggtttgttactcaagctggtttgaaacctcaatatttcgtgaaaaccgaatggtttttgtcagttttatggaaccttgagggcaacaagcatgtatttgtacatatacaaatgttttgcagatttagcacatccaccaaaaatattattgtcgtatacaaatatatgtatagaacgatatgacagcaataaattatacaagatataaagtcatttaatgtttcttaaggaagttatgtcatttaatgttggaacatatatctaaaactacaacaataatatgtaaatggaaaaaacaataaaatgtgtaaagatttgggatgtttaatctatctaaaactacaacaataatatgtaaatggaacaaaaacaataaattgtgcaggagatggcataaatgcaagaaaccatcagtacatctccaagattaagttggttgtgcatatatataaacatgagcagagggccatggcaacgagcacagtgaacttgaagagtggaaaatcataaatacatataggaggagaacttaattatcttcttaataatggcagttgcaaggaggatggtgtcctccatctctgtggttttcttcatgcttcttctgatcgtggcagattccaccttctcatcctgctatgcattaacacgtatgcagcaaagctattaattttactctgcattttttaaaaaatatccaaactacactgaatatgttttctctgtataatttgaggggttcatgatatgcctttttcccccctcttttaatttagtttgcaattagtggctcatgaatcatggatggttgaactgaattgcgtttttgcagctagacaaacgtgcaatgacctaggagatttagcgtgcactgacgagacgtgcaagaagatatacggagacagattagaatactactgcaagccaggcgtcacccctacggtatgctgctgtatgaacgtcacagcatcagttcccagtggtgtcaagaatcaaaacggcgatacgcttcttaattagttataattgatcatgttccatgtaaagttcgtcgatatgtttggagtttggtgccaactcaataaataaacatgcatacataatttgggtttgttaataaacgcggttactgaattggctttgtgctagtattgttgcacaaagtgttcccctccagttaactactccatgattgcgtactagaggcagcagagaagagctttccaatgcaatctgaaacgtacgtgttcttttgccttgttgcttccgacgtacgttacgtgacatgttcaatgtctgaatctccagcaattcagcatgaaacacagcccgttctcgttcatgtagcaacgaag

SEQ ID NO: 83154 - DNA, 1077 bp, Oryza sativa
gcatccatcaggcaacacttataaccttgtagctgttgccgtttattaacatctcgtggtaaacgggccgaaaaggagacttggtcgtcggaaaacccttcaccaccatgaatttctcatttttatctcgccaatccccagagggaggccgatcgcatatttttcggccgcaaacctgccaacaaggcataatggaacagtgcaaaaggagaaataccagcaaaatcaatcccacattccagtgaaaacatacgattggcgaaatactaacttttgattaataaaattaaggtcataatggccacaatacggcaacggctcccagccgaacatgtaaggcacctatatacatgagcaaactaccaaaaagcctaaaaaggcgaaggaggaaaaaaaacactagggtgaagggcctcacacctcagggtggtctcggtcttcatcgcttggctccgacggcctagggtccaccctggggttggtggcagcggcttccttatccttcgtcaatttttcaagttgttcgcgaagccgggtcttcgtgcaatccttgccgccatcctcccagaagtccttttggaaggccctcaaggccgccccggagcactgggaattctcgagccaagcccccttcaatagctcaggaaaatctttaatatggtcgcagccatgctcctgaagcaggctaagcacaaagcccgctgaaacgcgtgcgctgtagtctccgtaggcgccagccacttcaacaaccgagtcggtgttgacggtcgttatcgatcagtttcgaccgtcaatactaccaaaataggagagagctagtgatgcttacaatgcataaatgtgttagagtaataatattccactagtattaggtatactaacctttttgtagagaatgaaaataaagtggaggagaatcgacatcaacgcaaatgataaatcaatcggacgatgtcaggaaccagacttatgaataaatgggtcaagaactcagaactgacatgacaaactgggccaaaattcacaagtctacggagaagaacaacggaggaggccgccagctgaaattgggctaga

SEQ ID NO: 83155 - DNA, 2605 bp, Oryza sativa
atacgatccaacaactccaaggcttgtactgcttcatctccgattggaagagagttccaagtatcttggtacactggaggaagacaagagtacccgggaagagcaggctcgggattctgaacgtagaaccagtttgcatgccatcctttgttcgaagtcttgaagggcatcgagaaatatttttggctcagagttccccttagttggaatcctgcccccccgactacacacggtttgttcttgtttggttggggcttgaggaagaagatccggcggaatagggcaaagtgaggtttgatccccaaaaaggcttcacaagcatggacgaaattggcgatatgcactatggaattcgggtttaggtgatgcaagctgattccatagaaattcaagatcccgcggaaaaattttgaggtcggaagagcaaagccgccgtagaagaaatgcgagaagaccacaatctcatgagtatccggagacgggaaagtctcaccgtgcgctggtcgccacccgatgatctccttggcagggagaacgccgtgcgccaccatctccttaagattctcctccgttacgtcggatgacgcccattggccttcgaagctttctctctcttccgccatcggtttcattcaaatgtgctgatttgattcgagggatggcttgggagaggtgagggattgaggcggtggatcacgggaaggattttgatgcacttttcggaggtggatttggtcggagttgtgaaccctagttcgccggcgcagctttgcactgtagcagggagtggggaaaatggcgagagttccggcggggaagacgaagcgtcgcttggatatcggatttttcagttaagggtatcggaggtgctaatgggcctaggcctgaacagtacttcagcccaatacttttaacagcgtggcccattgtgttccttagggacttaggcatattttgctttggcaatattatgcgcacaacagtgttgcccaatgctgatgaaatcctttttatgcggtcatataattctttggaattattgcaatgcaaattaaaaaggtgcccgacagaaaggcgttatgctgtttttgcaagcttttttaggctacaaaagctgtttgggttaactagggatgacttgtttttattatagtcatttccttggcgtgttatatgcctgttttcatggtaaatagtcatggcctaggctattcgacttatttattaccataatctttataatacttgatgggtaatctttagagtttttatattcggatgcctgtcgagtgtgttcattcgtgaaccttttagagtgtaaaccactcggatttcttttattgtggctaaaaagcagtcggctagcatgcctatttaggcgccgcgtatgcttttgtcatataatgcacaattgtgttattattttgtctttcaactatatgtttagtttgttaactaatcacatagttggaggctacacctaattaggtgcatctattcgatgcaccatattctttatcttttcgccctttacagtcttcgtcttcgctactcagcaggccttggcatgaaaagcttgaagcactcggattactatctttgagaaggctatgatggtcgactgcaaaggactcgggggctactgtggagattatgggtatcccatatctacacggcgacggtatttggattgggtaccggatacttaatgtagatagaatatcttatctgtatctcgggtttgtttcttaacttgtgtatcaaggaaacaccctgagatttagtcggttacgactgtattttacctgtatcttcatattccgttaggaatatagattatcttttgtaatccggactccttcccatatataaggggggtccgggcgcctctaggggcatatgctgattttttcccgaatcacacaatcaataatacactcggcggattcatccccggacaggagtagggtattacttcttttataagaaggcctgaacctgtataaatcttttgtctccaaacccatacacttttccagcttgatagccacccccttttattattgccgaaatctagtttcgacacagctaaagaacacctaaaaaacaaaaaaaaatagtaatttggtttaggacactttcagctaaattgaaagaaaaacttcttaataaaacgagaatgcccctaaagcttctaacgtgccgttggagtgaaaatttagaaagtaagtaactctcaatctcccatcaacctagtcccttgtattttatcttcactctagcatcaggtttgtggcttgtggctctataattcatgttttttttctcaacagtggctgtgatactttttacgaagtccactaacaaattacacaaaatttggtgctccctataggaaaatttgcaatgatgttaactgttgatttctatgttataccacgagtagaaaaagttatagctattacccgtaagtggtggtattaaatagttactcctccgtctcattttaagtgcaaccatgagttttctagtctaattctaatcgtccgtcttatttgaaatattttttatttgtatttttattgttattagagggctgcaggaa

SEQ ID NO: 83156 - DNA, 3615 bp, Oryza sativa
aaaaaccctaagttgatcttcatgaaaagttagggtgacttgagtcaagactattccatttctcaattgcacgggatcgcatggtagacactataaagacccacaagtacaagtatggctttgaataatttgtttgtatgattattagtaaggaagtcataatcctattgtatagtccatagccttcactcgggacgagcaaaggttaagtgtgggggtgttgttgacggtccttaaatcataatatttgatggtcaatactttcatataataaaataaaatatggtattgttgatgcaaaaacacacactggcctgagagatctgcttaactctagtgcaggtcctaaatcttgcttttgggttcaaggtgtgccagttggtttgatcctgcaccccccaaaaatcaaagaaagaaacagagttaaatccataaacgatagccgattggccacatgccgatgacgtgtcgtttgtaacctagccgatgtaacgtgaattagatcagcaatgaaatataaagcaaaaagaatgttagatatagtcaatcggctgtagatatcaacagtatataatctatgtatcaaaatatgtttaaactaagtgattgggatagatcggatagattgccgagacagtataaatcacttaggtctaagagtactttaatataaagattatatatgttgatagcatagccgatgttgcagatctaacatgtatcggctaatactccgataccactaagatatcaaaatagacaaaatacattaaacatggattaatcaagtgttaaagtagattaacagattaataacaagcttaatatatttaattacagtgagatcttgatataaatggcaaatttagcatattaagtaaacctaaagtaaacaaaataaccaaatcaggtaagatcggctgaaaccccgatgaaacccaaatcggcaaccaataaactggctagagattgatattctaattacgacttataagatcaaacttaactgatgtagcaataactatgaaaagaagaacaatatctagaaaatcaagtcattggatgaatcatagagtggtagatatgctatattgtaggatcgaacaaggccagacaaacctaccagaggggggtgaatggtagggaaaaccaaaaacccaaaatcttttgcggaataaaagattacctcgaacgaagttgagcatcgccagtcgaaccgctcaatcaccgccgggcagaccgccgtattcttgccggtcagaccatgtgcacacctacgatcagattgctgcactcccaccggtcaggctgccgccctgcctgcggttagaccgtcgggacccagaaacactggtagatgacaaactcgaaatgtagattagaacttttcgactttattgcatcaactagtgtttacgaagtgcaactatagcactcctcaccaagatctcgaattaaacttaaaaccctaactttctctcaacttgtatctcactaaaactgatactgggagaccacaacctccctttctatttatacatgaggtaggctgtgcaaagcccacgaatctaacacaacttaggactcctatccacgtaggaaatcctctcttgcaagtatccaactcatccatttccttatctctttcaatcttcccgaattcggactctcctccaaattcgactcctctttccatatgtacacaatccacttgtataccctatgaaatcttcatcaccacgtgcattatcctctagcctttagtatcccgcgtgatctcttgatccctcgacgtctacttctcccaggtcgactccgatctatcaccggcaacactctcctgaggccttaagcaacacctgcacatgcaacaacaaagaaaccatattccgagtacaagttcatcccaacttgactcacattagtataacaacagtatccatacgcatagaaaccatctagaagtcaaatccccgaaggaaatattcaaatccgacaaaacaactcgaaaccaaaacaaactggaacctgcctgtaataccctgaaaagaaacattttagtgtcggcttcgggatggtttataatatcatggtagcatttagttaaataaataatgtcttaggagtgggccaagccaacctgggccaaagcccatgaacccaatcactcctctcccatctaaaaccctagaggaggaggggccggatttcccctcttccccctcgcggcgcctcttccccctccactcctttcctgtgcgtactttcttctccctctcctctccatcaaaccttgctgtccgtagatctgcaccttcatagcttggatcaagaagcgaagtggaaaaacggaacgaggaggaggagaagagaagaatgatgggttagatcggagtttccccgccgtttcccacgggatatgaaaggaaaaccctatgtgaggtttaccccccctgttgtatcagttgttctagggtgattttagtggtttaattcgtggtaaacaaaggttagagaagggtttttgtttgttgtggctcggtttggtagttctcctccgttggcagatttgcattgtttcggtttttttgttgtttcgggggtctaaatgatgttttctacgaaagtgtataactaggaagttgtagaaaattcatagacctatcttctgaccagagggcgcaattttatctttagttgtttaggatatatgaatttttgagtatgactgttgtttttatgtcataatctggacattagtagattgaactgcaattgggggatccaaaaaattttcaaaaagcaatacaattgttcttttcttccaaccactgtcgagagaatcacgcctttcggcgtgacatagttgtccattcgacaacagctggagccatccgtggggacctccgaccgaaacactgagagtgagtgaaaccactgatgccaccgaagaagatcgtcagtgtcacgtcccaaaacgatcctaaaatatatcctttaaattatgcctagaataattaaatttctagtgaaagcctccaaaattaaaatgtgcaaagttaaaagtcaaacaaggcttagaggatttttgtatatttcctaaaagcctaaaatgtgtaatcaaattttagtggaattttcagagcacaaataataattattaagaaataaacaaagttaaaatgattttataaaaagaaaaaccctaaaatcccttcccctctcttgggtcaaatccggcccaactccctcccccatcttttctctccccggggcccactcggcctcccccttccttcccgcgcgagcgccgctgatgtgtgggcccgtccgccaccctcgctgacgggcgggacccacccatgaacccccttcttccgccgttcccttcgcccctgcccgcgcctagcgccgccgccgccgccaaatccgcagtgcctagccgcccccgtgtgaaattgaatgggggaaatattccccccgattccctctcctttccccccattttcccctccccctcccacattcaaacagtcggatttgctccagcaaatctcggcagcgccattgatgccgaccgggactctcggctgttttcctttccctcccggcccc

SEQ ID NO: 83157 - DNA, 3665 bp, Oryza sativa
gggtttagatcaagtgttggaagtgagtaagtttgggttccaccgatttattcctcagccaggtttttcttgctgatatgccccctgcgcagttctgttttggctgcttttccggccaacataatgggttttcctgtgaaaagtctctatacaaaagttgtagataacgtggagatctatcttctgaccagatggcatgattttatatcaagtggtttaggaggtatcaatttctgaagttggctgtctgaatgtcgatgcatttatctgtagtcgaggttcagagggattttaaaggatcttaatgatggaatcagagaatcttgtacttacagaagttgtagaatatgctgtgatctacctcataaaaaaattgttagcttttatcttgtattttgttgtcagtgctcttttgaatgtttgttgcatagttttctgggcagatgcacttatctgttttgtgccatgttttaggccagctaaatggaagaattcaattttgttatctaaatgaaagttgtaactcttgttctgtagatgtcagaaatggtatatttttctatgttatgtgatgtagaattggaggtatcgaatcgttaatctatgctgcttttataggaagattatcggtgatttgctttatgttgtttggggtgggttcccagcatagaaagtgaatgtgtgattcttgaatgattatatgtgtgttgtttgaggctgagtcggtgtttattcaggtgataccacttcggaatgcaactagagttcatctcgtcatcggtaaaggcaagtaaatgtagcggtggtttgctacagctttaacctgttattttcctaccttcactttaaaattatatatcaataaccaataatcaagatagtattacaggtcgtagcaaggttttacctatctgaatcattgcttatcgttattgcactgtttatggttatactttatgctcttggttataataaccttatactggtctccatctaaggaatgtggtttcgatgttatactctggaattcatactgcatttgcatcacacttgcattgcatttgaagttatgctgtgaacctatggttgcgaccgtaccggtacatcatcgtatattgtcgtaatacgatgcagcttcacaccttgttgggtgcgaaggcaggagtacataccattgcattgcatatgcacatattgcaggatgttatgaaaactatcgatcgaagatgtctttgagaagtgttttcttctctcggagttgtgaatatatggatttgattggtgatgtcatgatgttttagtccttggatattgaacttgtctttatgtgaatcataacttggtatttaatcagctatataataaacctgtggtttaaataggttgttaaagccgtttgcttgctgagatttattctcaccccttatagtcttttcaggtacttgttgtgacatgtttgcatgaagggatgggattagctacactgttgcacaatatgatctcacttagtcatgattattgtaatatgttgataagattacttgtgtttagacataatgggttaattaaataatagagttatcgaccattgattaactttttttttcgaggctatccgtataagtcagtcagttgttgtatcatacccttgatctatatattgaggcttccgccatattgtttttaaaagagagatgctgctgaaatttctttgttttggcacttttatagggttctttagtggcatcccagacttgtgcagttttctagggtgttacaggatgtatctaggtacagccagtctctctcttgagcttatgtgtcgcctagggttagctttcatccactcctagtggtgcacagcttttcgctctcgcagcatccacacttatgcaagcaagaggagatgccctcttctttttataggcggcgtttgctccagttcgcagttgcacatttgccaataaaaaagagatgcttcctacatctctacaatattgtgccaacggatcataccttcaaggcaaaaggtcttgcacccgacgtgtgtgcatgactaaaccgctcgcctgagttggcatggtcgaggtgccttcctccgctataatccgcaacgagatggaggagaaatctacaatcaaatgtgaccatgcaactgccccaaagattccaatatatccatcatgttggcggtaagtacactcaggtatgcgaaagataaaacaaggttcaccaagcatttactcaataatatcaccatgtgaatatggcttgatcatacatgattatgtttaccttgtctattttcatatactctggtttgggtatttccatagactttttaaattaagcatggtgcttaggttaaaattgtttgctttaatcaaattagacatggagttgagattgattaatgaaccatcagagttaatatgttcatcgacattggatatatatcttctgtggactaacccctacaggaaagttttcaaactgacaggtgagtcctcaagttcaattctcattggaggtaagtcagggcccgggaaacaaatcagtaaattgctaacatgcaaaggaggagcacaccatcttttgattatgttcatgcaattttacatcagccctgtatgagattttgcttaaacaaaaatttggtgaacaaaaaaaattaaaaaaaaatgttttcaagaacaaaagaagtgtctctcaaaaaaaaataaatggcaaacttttgggctcgacgcttcttaagttttgaatacaatttctctttagcgtggatgtgaacaactaatcttgaggctatgataaaatcttttcaattatttatagtctctcgggtatttactgtccactaaccgtttgtagggaataaaatgacaatcaacagcagtgtacaataagttcaaacacatatatcacgctccttggcctcataggaaagagatgcacatggaaccaacagaacaaatgcaaaacttggtgcattcgattcggttctaagcttggtaagatatatttggtaagaatcccaaacatcttgtgtatcctcgcctcatatatccatcctgctacgatacccaccatatccattgtggccataaaataaaaaaaagataaaaaataaaaataaaataacataaaataaatttggctccttagtcttccaaccaagtgagtcatttttgcttcactcttgtctttgtttttcttttttgtgtccaacaaagagtcccatgtacaaagagaagtgtgggggtgatcttgcacatcaacgccgtaatcaaagcaagatcaccccagaagtgatgagccatgacaaaccacacaaggaaaattgacgcagtcagacccaataaggggtcaaccaaacctccagttcggctgaactacctctaacatgaatcgtcctctgttttttacagagcgcaagtttgcacattattcatttggacatccattctatcttgagtttagtttgattatcaattctaacatatcgaagataattaaactcaagctagggatggtacaattagagtttatggtctctctgaaaatgacatgcaagcctattattcttagctcattacttgttgcttgtggtgatatatccaatagggaccccatgccatctaggtaattgatgaatgagatatagt

SEQ ID NO: 83158 - DNA, 1837 bp, Oryza sativa
ccctttcccctctttctccatggcttgatatctaccattcgtacaaaaggggaagggggaatgggagatcggaggattgtagtggtggtcatcacttgcacaccgttgcaagttcatgtccattgctttgtgcccccctctctctctcttcgccatcacacaggtgcatgcacacatgtggcaccttgcacatcatcatcgttcatcgtcatcagagagatcatgcagtaattgtggccacaaactatttggaaccaaataaatttgtataatacttggtgtaatttctgaaggggatcggaattggtgtgttaaaaggctcaaataaacggcaggcaagagtgaccaagtgtccccctcttgagtgagaattaaaggtggtagcaaatcacctcaagaagaaaatgaaggtacatgcgtatctacatgtggttttccttgccaccaacagagatttggatccgatagagatatgtccaggctatctcttaggataactagatgaaaagaaaggctagctagctagcgggtaaaagaattaccacttcagtccatgaaatattaattgccagtgtgattagttatataagtagtgacccagtcacaaaaaaataataataatagaactaccctagtatatggaatgggaaataacctagtgcaaacgaatctgggcagaagatgagacataatcctagtacaacgaattaggacacatcttctatctaacttcgttgtactagattatatctcattccatactgggttaggttttttttagagacggaggaagtatggattatagatatacagggttgacatcaatcgagatcagtagggtttaggttacacacggtgagaaattgtcggagttcaaacgatagattagtctaactatgatgaggtgatgtgaccctgtaattaatgtaagactgatattagtaatgatcaatctctggtatagtagtatatattgcatcattactaaggattcgattttttcgtgcggtcaaaatacattttcccgtacgaaggtcctgcccgtctgcaaccaggtgcctgcgaaaatcaacatccacacaggataatacattaatgtctagaccaaaccaccactttgtttagtttaggttttgatttattgggcttagacttttaaactgactttttcttttatggtttataaaccggtgacatttaatccttcaagtttacgggtgtggtcccaactaattaactcagttaagtaaaaaaaagctaattaaatctaacattcgacactacagtgcaggaatgacttctggaatttttttaataaaaaacaactggaaaacaatctatttgtttagtccagtagtcctctacttttttgttcataagagcaaaaaaaaaagggccatagtttataaattttggatggagtggatcaaatttgaatggaggggaaatcaaacttggacttatcggtatatatacgtacgtaacaatctatgccaataagtctaggtatatttcttaattttttccatagaggaagtgtaactttcggcttctttaccaactagatgtacacacagctgctacaccactaagcttgaaaaaattattaccttaatatcggcaaaaataaaaataaaataaaattatcacatcactagcaataataaaagggtaaaaacatacaaccccattatatatcgaactaggagttgattgatcatccacacaggcctgaccattactaaaaacaagatatgttaaaatatttatgtttgttgcaacgcccataagaaaatatcaaatccagggttttcatcttagggtctcatgtgttgaa

SEQ ID NO: 83159 - DNA, 4213 bp, Oryza sativa
cggagggccgcccggcgaggcggcggctggcggccgcgcgccggcggggtgcggcaggcagccggccggcgcgtcgcgcggtgagtctgcagcctgcggcggtggccggcgcgagggcggcggggcgcggagggccggccggcgaggcggcggatttttttttttaagaatttgagattgttgtgtgatgtatttgattggatctgattgttgtgtgatgtatttgatttgtgtgtgatgtgaatatttgataattttgtagaagttgtgatgtaattttttttttgagattttgtgatgtatttgagtatttgagatgatcgattgtggatttggaagcaatttgaaaatgattgatttgtgattttggggatgggattgatttgtgattttgattaaaaacaatgaagaaaataaaataataaagagcaaccggatctagtctttttagtaccaaccgggactaaagataaagcatctttagtcccggttgttaacaccaaccgggactaaaaatggatttttactcccggttttttcacccgggactaaagatagcgatctttagtcccggattcatagtcccggttggaaaaccgggactacaggagggttacgatctgggagtaaaaaccctttctccaccagtgagaagagttaccacagctccaagaccacaccatagaacaacctcgtcactggttatgatcatcctgtatccaaccagcaaatgcatgccataccgttaactgttgggatttcactgggatcgaacgactcaatcaacaaacacgactacgagagaactagaacgaagaagcatggaataataggaagcaaaatttctgacaagaggcaaaactttgcttcgttctagttcacgcgtgtattgattgagtcgatatgcctcatctcactgatatgatcgtacttaaaaggaaccttaagcgatagggccaattctataatggaaaaacgaacccggtagtaatttcttcttggcagaatgacttttactctaagaccaagttcccttggggtaagaggagcattcttgaattgaactatcctctactaatattactaacataggatattgggaaaagaacctatttatttagggaagtaaggtaggtagtttgcaacgttatatacaaagccaagggaaatagagtcctgggttctaccattatcgagaaataaaacaatgatttccatatcatttcatgaaaaagattcttttgttgacccgttgtctgaataaagaaattgtatatcatgcggatctaggaagtcaattctttaggagagccaagccaaaaattagaaaataaagggtttaagtcttttgccttcttcttcaaggaccaacgaggatctaatccagccaactccatactaagctcaaaagtctatggagcagataaatgattaaaaatccttcccttcctgacacttgccgcatctgtcccttctcgagaataattattacgtgtagtagcgatcagtggttcacgctagagctatttcttttagaaaagcttgatccgtctttgactcgcttttgctcaagaaggctcttccttctagttccttgccaaactccacttgtaagtaactctcccttgaaccgaacgaactttacgagaattagttgttatctatgatgtctttttacacctatgctgcaacaagacctacattttacttgaagtgtgctcactgattgaagagctttgcttcctaaaatataatgcattcctaattggttgatccggtgaaatcccaacaccaacctggtccagtaaacgactaggaatgcatgcattcatcctcatcctaatctattaatttcatgcaatttaattatgggaagtgtccaaggtctttcaagagtctctcattatggtatctaaaacaagctgggtttctagcccgtcatctgataatcatcactaatcgcgtgccagtaccaacttggtgctctatcatcagctcatcacaacacacataaatatcaacttattacttggtgcttctcctaatcaaagatcaaaggaggcttcatcaagatgtggtgcaatattgtgctgatcactaattaatatgcgccgccggggtgtttccagtgggtgttacttaatcatatcacatttcttttggcttgccatatgctcaagtgcgcattgcaacttgaagtagcttgattgacagtttgtccctcggcatgctttaatttaatttcgcctcctaattctaattaagaccatggatatttagctgcaagagtgatccttccattgttcttccttttctttcactttatgaattaaacttaattccagtggctaaactatctagttagattgagcactagatatccctctactagggttgtgtttgaggagaagagatagagaagattgggaagatacgcaaaacgaggtgagccattagcgtatgattaattgagtattaattattttaaactttaaaaatggattaatatgattttttaaagtaactttcttatagaaattttttacaaaaaatgcaccgtttagtagttcgggaagcgtgcgcgcgaaatatgaaacaaactcactcccgttctccaaacgaacgcagcctagatctctaggtgcatgcctagcttatctcatatgcatggatccttccttttcgtggtcctttggatgtaaataagttcttagatactttcagcgtccatatgaccaaaaaaaaaaaacaaaagataattctgatggtgtgtaatattcatgcaaataaatgcaagtgcccattagtgtacaccatgttagattttgttccagccatttgttaagttagtagaaacttgtgaaagcaaggaaggaattaattagaggggatcgaatctttctcttgctagcttttgctcgagtgacacacgaatattctggaacagaaagagagaataaacttaactgcgactgttgcatctcagcatctgtgtgatcgatgatgcagtaactttctaggaagctaactagaatatatatatatatatgccatggaactgtcagtataaagttttgaattcagaaattctctggtcaattctttatttgtgtaggggtgttagtgctgtacatatagtggctgtgcatgtttgtagcaagtcgtgttcttagcttttgagatcgatcgaatcatgaaactgattaacaattttgatcgagaattagtatcttgattattcctgagtgtcagctgccattcaaacatgtagtatatgttgggttgccttttctttttttttttttccggttgagaaattctcgaccatcaattggtatctaggaagtcccttgaccatccatatgtcagcaggaataaaacttgaagcatctctcactgtttatgaagcttttggcatgcatgaaatactctctgcttttttattattactttgactttttgagactatatgagtggtttatgacagttgccagtctccaatttttttttcattcctaaagaattttatgcatgcatgctatgtttaaactttaaatgtcgtaatttaagaacttaagaaaattatgacagttcatgtgtcaacgtactgaacttgtccgctgtacagctttcaaaatgttattcccggtcaacgtacagttcatgtcaacgtactgatcctctatatatgttctaaaagaaaactaattagattacaaaaatcttcccggcacgaaaattatcgatatatggtacgtagagctgtcctcgaatcctcaataaaagtaccttttcaaattttcgcaaaagaaaatccttttcaaaaacattatacaggtttgtaatatctcccacatgaactgacgcaacataccgatccatgatattttaaaggaataagttcatctgaggcctcttaacttgtcaatgaatccgattttcatcctttaacctgaaaaccagatacaacgggtccctcaactgtcaaaacaggtgcaacatagatcacacggcagttttagcttacgtggctaattaaattgacccggtctttatctgacgtggcattgacatggcaatttggtttggacattaataaaaatagtgaccccacatgtcagttacaccaaaagaattaattaaaaaatggtggggcccacataggcctcacatgtcattctcacccctcctcttcttcctccactctccccat

SEQ ID NO: 83160 - DNA, 2245 bp, Oryza sativa
  unsure (1)..(2245): unsure at all n locations
tgaactgctggtgacagttccagcaaacattattagcgcctgcatttcagacaaactgcagactctgcatttcaaatttcatccttctgttcctcctgaacagtgtgaccagattctctaaggtacaagaaaactctgctgttgcattacattgatttataatgtagatcgatgtttaaccactactacatgtgttttctcatttcttgacatattagtagatctggtactattcatgtgatatatctaaggccccatcgtttggcttattgatggaagaagccaaacgacatatttacaaacgaaaaataatttgtgaataaaccttttatatatgcgctcttagtgatctaaaagcaaaggttgaaaaataaacttcgataaaaaaaactcaaaatcaactccaaatttaaagttgaaaattcaaattttagctaataagcataagcataagtgaaaagacgaggctgtaaaagtgaaccatccctttgtttcatcaaaattaattttgacatgtcctaatcattctgacgtagcaaagtagagagaagcaaaaaaatctctgatcttacatatctggtagactgatactactgatgttcacaacaacatgaagtgaaatagtgactggtgagcatgccctcagctatttcgaataaatataagctaaatttataattgaagtcacatactcacatggctggatttccttttcctagatcaaaaactgaaatttctaatcttcataaaacagaactgaaacttccaacaggggagcagagcaggccgcctgaaatactgaaatagaactttattcagactgcagagcttttcatatttggtatgattgtcattgtacacattaaaaatctcattgaacagcgcatttaataaacattacaagaatataaattaagtctggaaatacaaaagactcgaccaaattatcatctatgtccattaagttggcaactaaagcacacttctgctttcctctgtaatggatatctgttataactgatactcaatgaatctggccaaacgaagaattgttctttccctcttcaattatcaacagcaccctttaaaatacatcaatggtccttccttactgttcatttttccaaagagaaaattgcactgcgatcagcacaaatgctcttctgtatcaatatctcctgttaaattgtcataagttataacagcaccatggaccctaaatatttcactgcttctgtatgcagtagttttttctcaagaaatggcagcactgtctgtctttgcttcatcaatactctcaaaggtcactacatttgctgttgaatatgctctcgccgacatcaaacttgcttgcacagttaggagtgagatagaaaagctgaganactcattgaaggctatntggctgttcttaaagatgctgaaaggaagcaatctacatctagttcacttaaacattggctggaaaacctcaaagacattgtctacgacatagatgatgttctcgatgacgttgggacacgagcattgcagcagaaagttggaaaaggtgaaatccgtacttattttgctcaactattcatttttccttttgaactgggaagaaagataagaagggttcgtgaaaggctaaatgaaatatctgcacttaaaagaaattttgatttgaaagaagaaccaatagacacaccttcagatcgaattgtacagagagaaacatactcaattgtagatgagcgaaagattgttgggagagataaagctaaaaatgatattgtgaaggtgatttcagaagctgctgaatctaattctgatacactgtcagtgcttccactaattggaatgggaggtgtaggcaagactgccctagcaaaactggtatttaatgacaaacgaaccaaagaaaagtttgataagatgctatgggcatgtgtagctaatgtgtctgatcttaaacatatagtagatattatcatacaatcagatagcggtgaaagcaacaagcaattaaccctagaagcactacaaaagaaacttcatgagctttcaggagataagagatacttgctagtgttagacgacatatcacatgataacattaatgattgggaagaattgatgaacctgctaccgagtggtagaagtggaagcatgattttaatcaccacgcgtctctcaaaaattgcatcagtattgaagaccatagagccatatgaagtgccaaaacttccacatgaagaatgca

SEQ ID NO: 83161 - DNA, 6316 bp, Oryza sativa
cgtgcacagggtgctccacgagccgctcttccccatcgagtggacaccaccgccgtccacgacgtcgccatcggcacccgtctctgctacgcccgcctcaccgacgcttccgcctcttcgccatggccgctgtcgtgcgggtcgacctccctttccctatcccctccacctccccgctcgccgatcgctggaccgccatcctcgcacgctgctgcccacctttacctctgctgccggcgccgcctcgcctcctcctccgctctgtgacggccgcttgagcaacctccacctccgccgccttcaaccgtgctggtgagaggagggagaagagagagagatagagagagagagagtgagagagattggggagagagagagatagataggtgtgggaactgacaggtgggccctacttatttttttaaaaaaatattgactggactgccacgtaggacaaaaccaccatggtttgaggccggggcagggagggggttatttgttcggcttgcgtagttgggggtgaagaatgtgtccggttttgttgttcacaggggtaatttggcagaccgcgatagttcggaggggggtaattcgtaccttttcctttattcaatgttaaatatagttttatgtatacatatagttttacatatttcacaaatttttttaataagacgaacggtcaaacatatttaaaaaagtcaacggcgtcaaatatttagggacggagggagtacttatattttacgagttaattactccactaccatcggtttcaataattttattccatacctcgtcctcctataattaaccatttcattgccatcagttacaataattttattccatacctcaccctcttttaatcaacttctgtctctatatatctatctcatgtgttaatggtaaacactgatgatggtgcgcccaggccatgcgcgcgcgtatctgaacggatagaagattactcctgatcttctgctgcttaacgtcgctagtgcgtgttaatttggaactttggatggtcgtcgtacctaggagcaaatgaaaagctctgctggtcaagttcgtgcagagaaataaaccggccagttgaatattatattatacattattggcagtttacgtcaggatatatgtgcgttctagctagttagcacaatgctgctaatctagtatgacgaaatggggtatctcttcaggcacgttctatgttctagttggtgtcaatcagtgaaggaatgcatgcatattcatgaccgatcgccggccaaaaaaaaagtagggcactggccccgatgcaaaataaatagagaacatatatttacaaaaatactgagaacaaaaaaataagttatagtgatggcgttctacctaaatcggataaagatttttttgaagaataaatttcattggtggcatatgaccttgataggtggatgcaatctggtacgcaaatttgcaaaatgcttgtttcaacgcacggacttgtctaatgcttgcgaaagaagagcaaaatgggaggctgtgactaataatgctgacttaagagtccacttagaatgacatgtgcataataaaagggtcatcaggtataccacatgtgtggatagtctgatctagttggtatttattttttattccactgttttcaattcattgtatcattcatctatgctacaaattatttgtttgtataatcaacatcccttactataaatttgattgagtacatgcatatctagatgacatcatcctgatatatgtgcctgcatggcatcctaataaaatattcaattaagtaggattaaccatggtatgcttctttggctgggttcacatgcaccacacaagttcatgcattttgcaagtttgtgtatcaaattacatccacctcagagtaccgtcagtgcaatttactctccttttaaggaaggttggaaaaaaatatatcttgatgtagtgatatgaattttattaagcagaaaatggaacacatgagctatagcctttcgagatggtcatgattatcatcgaacacttattggaacataatgaaactagtttagacagttcaataaaagaataagattgaagatttttaaaattagaatcccgtttggatgcaataatactggttaggtatcggtacatatgaggtatcatgttctaattcctattggtataaggtgatacccatgcataggtatcagtcgataccccataagtacaatatgttgatacccgttgataccatcagaacttatagatatcaatgcaatactgattgataccatatctgagctgacgtcaggggttgtgcgtgacgatggcaagtcgggtccgagtggcccgaggggaagagcaattgggagacaaagagcatattggtgatggtgaggagctcctcgacaccttggaggagcaggaccacctccatccactattagaaaaataatttattgccataaaaaaaatcgtagtatcaatgctaaaattattgcaatagatacatgttgccacaatcttaaaatcgttgctagccatggtaataaatagcatggtaataggttattgcaatgatttttatttagttgtaataaattttgttattgccataaaatgtatgtggcaaaaaatatatattacaacacttcacatcgttgcaataaataactattgccaccactccatgtgtgacattagttctacgtaccaaattaaatgtttcaatattaatttatcatcctaattattttcttttgatatcttgtcatggctaggattcgaacccaagatttctccctcacgcgcgctcttcatgaccaactcacctaagcatcaattttgtttaaaaatgtatataattccatttgagactgcttaactgagatttgaatcatgaatttgagtatttaaaagatttcaaatgaaaaatttaagttgtagatctcatcgagaggtataaatttcatataaaatttgtcctaatccgtatccatacgaaaataataagctaaattatgagatgataaattttttatcgcaacgaatttgttgatatggcaatagaaaatagtgaaagtaccatgtactatgcaaattgccacaaaaattaaatttgtggggatagaacatgttcagttttgaaaataaacagaaataaggtctttaaacatattagaacacacattagtatggaataaaatattaaatgttggacccctaattttgggaagccttgttcggtcgtccattttgcacacccggcccttatcggcggctctgcattcaagctgacaagttaattatgtttagcatcatgcacttgcaacatgggaagtcaagcccgataaaataaattaacacgagaagttatgccaaccatttcaatttgtgcaacatatatatggtggtgtagtcatgccaactatttcagtttcaaaacggttctaatgggaacatgggaagttcaggggaaaaagctggtggcgtacgtatatacagtgtacagtgcatatagcacccgtcaaattttgcaatttctcatatatatgtactttatctgtctagctatggtctatggtgtatatatgtgttttcatttttttgctgaagttgtttaggaatttggatcattgagccagacgagcagcctctgcctaactaatcagggttgtgcatcagctggttggctggttcaataatactctacttcaaagagagaagttacgtggagtctctaacaaaaatctcataggatttctacagcttacgtggaatattatcccagcactacactgtacaaataacaccaaacatgtgacgacccatatgtaccagcgacatttttctcaccgtcgcctattttcatacagggcggaaactaaaagctgacacatataacaccttattagtgttggttcatacaaaaccgatattaatagcagcgataatgtatttctcttttagtggaattacattatttataaatgttttttaaaaaatatttataaatagtatacgtgtaagaaatcttagttgcttttatctattaagatagttgatggttgaaataggtccttaacgaccgtcaacagcataattgagcccgtttgatgctgtttttactgtctcatcaaagtcctgtctatgttggtactacaacctgcacagatacggttatacagtgctgctgaccgggtaatgcacgtacggttggaaatccggtactggtagggccttcagaaccagcactgatttgggtgcctatagtagggctaattgtatttgaacagtattaatatgcggtctttttggatatgcatatatatatatacatatatatatatatatatttgttcgaatactccatctgatcaagaaatcatgtcgatcggttcttaacaagcttaagacacagtttaaaatagattattgtgcggattgttgctacggtctacgaatgatattctacttgattacaaagaaaaaataaatactttgataaataaacttaaaaaataactgaaacaagtgatctaaccaatacaatagaaaatgttttcttaagcgtctagtaaataatctgtttcagtaattcacttcacatctatcaaatttaaaggacaattactcatttgaccctattttccaacttaagtatcaaattgacccttttttttaaagtttgctcatttgaccatgtttttttaattcgaagttaccgcctaacccttctttcactacaccgtgagtatttcacttagaaaaaacaacaaaaaaacatgtatttacaagcccaactaacaaaaatgcccctaatacatcaatctatcctctaccttcattcttatcctctctctctctctcaccagagcgctgcggaggagcggcggctcggcgacgaagcggccctccgctggcggcggctacgggggagcggcggctcaattacgaggagggccgccgctggtggcggcggagcggttgtggcggctgcggaggggtggcgtcgtctcggcgacggtggcgttggctcggcaacaaggaggaccgccggtgggggctcggtgaataggaggatcgcccggtggcggctcggcggtagctgcggaggggtgacgttggctcatcgacgaggagaacggtcggcggcaacggcggcggcagcggtggctcggctacgaggaggactgccagcacccgcacgcggcacgcatctacagctctacgcacgctatgagcttgtcctgtgataaactaattttgggagaataaggtcaaataatcaagggtagaagtggtattttgggattttgttaacaccgtctaatgcccttaactgaagagggttagagtgtagcttcagtttttaaaagtagggtcaaatgagcaaagtgacaaaaacagggtggtagttagacctcaaaatagggtcaaatgtgctattgcccttaaatttaaagccattgtgttaccgttcacaatgcacctacatatatatctcaatgtatatgcaagcatgcacattgatgccaacatgcaacccagcaccttgagatattcatacatctccagtactagctaccagagatatcagataggacctctcctgagtgccaagtgcatgaatgacatggcatggtgcatcatccatatccaggcagagataagtccaagtggcaagagatcgatggcaaagcataataatccaccagcaaaccgtaccctaattggtttacatcatgtgcacaagcaacaggagccacataattgaggctgcctgccatggatgcagtaaagggatcagcagtttggtgacgacacaaacacacaatctaatataaagcccccccattatttgatcatgacataacctctttcctggcgaaaagaaaaaggaaaaaaaatatatctctgccttttggagagagactgatctctacacacctggtgcaatatgatacatcacctgtggactgcccaataattaatgcatggtgtctctcctttgaccaataattataaggatatgacatagagattagcaccagatattcataacaacaaactaaagaaagcttaatgcatgcatgagattaattattttccttctttagttatatatatgacgatggtatgtgattatccttatcaagaacacatatgatatatatcatcataaagctgcatgcagtgcggcgcctaattagggggacaaaagatggccaagatgatttcagcatgggtggtgagctgtcgaccccatggccatcaacacctaaagaggagcctgtgaattcttccaaaa

SEQ ID NO: 83162 - DNA, 3555 bp, Oryza sativa
ataagtgattttacaaaataagtggtcccttttttggatagggctaatgccaagttagtctacgcatgtgaatggaatccacatgccctggaggctcttcaacgtaatgtcatggacaaccatgtggcagatcgatgtattatacttgaaggagataaccgtttgacagcacctaaagtaatattggttccaaagtttacttgttgatctacctgcactaggatggcttctaaccatttacttctttaactgatattaggggattgctgaccgtgtttgtcttgggttgttgccctcgagtgaatgtagctgggacactgctgtgagggctttaaggtaaacctccccagagttctttccagatttaggcaatattatatacatacagagaggcctagctcaggtttgccaagcttgacttgtgcacttgtattggtatattggtttgtttttttttttaagaatgtgtttgattgagctttcacaaggtgaattcaagccatatcatgttaaagttcacgattgttttaaactttgaagaaagggaaataaacgcttggaatagctcaaagattttcgaataaacaaaatccctaagccaacagttccctgcagcctatcatcatccaactggtgacctctaagtctgctcttaagtgcttatctttgtaacccctaaaaacgtgaatataggctgagcagtagctcctaagctatctttgttactaagtgacggttggtagttgcaagctaggcaatctttagttaggttgtttgtcaattggcactctgaaagtgcctgcgtggtggttctttcagggtgcttatcgtcaacatgcagagctagtggttctagtggtatttttgatgggacagtgccacgtttctgaagttctcttaggctttcatgtgcatctcaaaatatccagaagaatgtagtataactttgcaaaagaaaaaatattactagacattatattggaaaacatacagggcactgaaagcaactggatatgctttaaattacatggttacttcaccttgagagttgagagtcggaacacaatttgttagtggcttgttgatgtgctggatgcacgacgaacacacgacgaacatatgaagttctgactctgctgtgttttacttcatatgtagggctgaaggtggcatgctgcacatacatgggaatgtcaacgactcggatgagtcgctctggttggacaatgttgttaagtccatcactaacattgccaaaacacatggtacgatttgcccttttatacacacaagagttgcgaagcattcgacacggttaaaattaccatcttatgctaccgttgcttttcatttttgtctcaggactgtcttggaacgtcacggtggagcatgtcgaacgcgtcaaatggtacggtccgcatatacgacatctcgtggttgatgtcaaatgccgggcaacctaacaaagcgaaagacttgtccaaaatccatgtgctgtaggttgtggtgtatgacaattttgcttactccgtttctggttaatccagagaattaaactatttgtttgttacttcagaaggaagtttgttcagacttttctcaatagcaaagcatctatcaacatttaagtatcatacaaaatatttcctgacatcttattggctgtggctgtgcctgtggtccagttttttatcagatgtctagatgctgtaaatttgcggtattcgctataaaattgtcatttgttgaaaacatgccctgaattcctgaaagcaaaagccacatacatgatgtgttgctccccaggcctgatagagatttgacacctctgatgtcaaatacaactaaaccaataatcctctcggaaatgtgatgatatagaaacgagttttgcagaagaattgaggtgcaaaaatgctcttttattgtgtgtacttgcagaaacaacttacaaaagggaggacattcaaatcactacaccatacacgggcaaggcaagaaaatatacacaatcatctcaacaatgcaaaagctgcgtccagggtaaaccttttatccgtcgactaccatccatggaacaaaaaaaagaaggcgaaaacagtttactaatgtaattgtacatcattttctacaaggaaacagactatttgagcctcataggctgctgcatcccccctcctctcatcatagcgcaaaattcctcgtagttaatcctcccatcctgtaataccccaaaaataagaatcactgtcatggaaggaaattgtaatgtggcatggaaaaaccgattgtttggcaaaggaacttacattatccgtgtcgacttctgatataatatcctttatggtacttgtatcgcccatttcatgctcgattaaagcggattccagttcatctcttgtgatgaagctgcataaaattgaggtaattctctagtcagatcaaccatggggagtttgatgcgcagatggcattgtacaactgcctttttccaatgatggttctagactagtgagcactagatattataaaatgtgaacctgtgaattatgatcataatcatatttggcggactgccattgtgaaaatactgcgacttgtgagtttttttcaatgtgacagttcagaatactcacccactgttgtctttgttttaaaaatttggagacccctttaaaaaaggtttttttttttaaagttggggttaagcctggggcagtgataattccacaaagtggatggatccattgccgtctacatcagcctggaatggatcagagaaggtcagcataaaaggtcaataaaccatggttcagaaaaatactgtaacagtctaggattggtgccatacagcttccatcaactgctttacttcagcttctgaaagctttgatccaagtttggctaatcctgctttgagttcttcatatgtgatggtcccgctgttgtctgtgtccatgtttgtgaacatttgcttcaggcccttgatctcctcctcattaaggtttgaagcaataacctgcatatacaattgcctgtaagcacgagagaagaaaaggcaactaaattatcggcatgacaataataaccttcagagccatctttttcagcttgttcattgctctgaattgcttcatcctagaaagaacagcgctgtcaataggtttgtcagatgcttctccatctctgagccagggatgttctgataacatagaaaccatcatttcttttgcaatttggactaatattaggagtttaatgtatggttaagactcaagaagcttacggagaacttgggccgaagtaattcttttctttggatcttgtgtcaacatctttctaacaaggtctttagcactctcggatattgatggccatggttgactctcaaagtcaatctccccttgaagaatagcatcaaatattcccttttcagtttctggaaagcaaaacagaaaattaataacaatcaaacaatgcaccactgcttaattgtatatatggatttatgaactggaagtaaaaatggatggtataagcaaacgtaccagccca

SEQ ID NO: 83163 - DNA, 3162 bp, Oryza sativa
cttgtgatttccccataactttacaattagtttttcttttaatctacatttaatgctccatgccatgtgtcgaaagatacgatgtgatgtttttgggaaaaagttttttttttgaagggccatagttggtgcttttgctttgcccaggcaggggagatggcttcggcggcgacgttgctcctggttcgtcgaggcatcatggaagcagccccttcacatgagcacgccgcggctcatggcggcggctggagacggctcgaggcggtggctggagattgaagacgcctgacgagtgggtccagcaacgacggaagagatgcgaacagaaaagatgacggagatggcatagttcgaattaaaaaaaaattcagtggcatctaacaaatttcgcaaatagtaatggcatttttctaaaccgtcaaatttttaatggcatgacggagggagtagtatcttgctagggtaataatacgcgacgttaatttgttctcgtaaaaaaatcgttatatgttctacaatagtctacgtacactggtgtggagaaaccatttttggtcggtcgaccaaattccataatagtcccggttccattaaaaaccgggattaaaaacgatttttagtcccggttaaaaaaaattgatccaaccgggactaaagatgatttttaagtcccggttcatcccctatcagaggcatgccagggggccgaggatctttagtcccggttgatactaccaaccgggactatagatcattttagatctttagtcctggttggtaatccctaatccttatcctctcctccacaatcacaaccacttcctcacatatcgatcctcctctcttctccccctcctcccctctcctatcttacacagatcctccccttcctccttccttcccccttcccttcctcctccctcccctggagacggatgaggccgctcctccttccttccccttcccttcctcctccctcccctggagatggatgaggccacgccgcgcggacgaggtggacggacggacgcgcggcgtgcggcgcagacgtgcgttgcagggggagcacatgcgcgcagacgtcctccctcccccaaagttacttgttgtctctttttttttttgatattttgtgattcactgatatgtaattttgtgattcattgtatggatttgagatgtataatctgtgatgtatttgatttgtgtgtaaattttttaggatttgtgatgttttagatttgtgtgtataagtaactttaagatttgtgatatggatttgggatgttactttatttgaggatttggggtttaatttgggatgtgcatgtcaaccgattcgggagaaaataaaaaagtaacaaaaaaagaaaaggggaccatccgggattgtccctatcctctctttagtccgggactaaagatagatctttactcccgggtgaaatttactctcggttatttcatccaggactaaagatagcgatctttagtcccggattcacagtcccggttttctaaccgggattacagagggttacaaaccgggagtaaagacagtttctctaccagtggtatatcgtatattgccatacggcgacgcgtgcatgttgccaattcatcaccgttggatgggcaggtgatagattcggacaccggcgtcaatgttgggcaccaaatcgcggcgcgaaacgcgtgctgatgctcagcacgtcgttgataattaattttgtttccccttccttttgataggtttcggacgacgtcgtagtcatccacatgtacagacgtacacagtcgatcaacacgcctagtgtttaataacacacgtctaaacaagattatttttttcttttttgagaactaagtataagattagttattagagacgtcgacgtacgtatcatcacgtaacgtggccaaatgtttccagcctcaaagctcgaaccacgtacgtttagacgattagttaaaagcaaggctaataatacagccgacctgttggatgtaaggttttttataacgttctctcagtctacccatataatagtgagctctttataattaatacatggtccacttgtctctctcacagagtttattggttcctgtgttcaagccggctgtaagtttatagcccgcttctcctctctttcctctcttctctccttcacctcagcatttagccggtttatagcctactattatacttgctctaagactcgttcatcaattactaagcacgcacgcccagctggcggctggcatgcatggttaattatcgattaattacgtcgttcggcatattgaattagtctgcaatgcctggctatgacgaaccaattaatatactcctctcgacccacagttggtttacagtcttgactgcgcatatatcagtatattttggaaaaagtacgaattaaccctgaactattgcgatcggccgacttaccccctaaactacaaaaccggatattcttcatccccaactatataaatcggatgaattaccctcctcgacccaatccacggtggttttggtctacgtggcgtacgcgtggcagtccagtcagcattctgtttataaaaaaatgtgagacccacatgtcatactcttcctctctctcttctctctcactctttctctctctcaggccgcggggtggaggctgtcagggagtcggtggcggctgtcgtcgacatcaatcgagaacacattcccagcccactggctcccaaagaggttgtgtgcttctcctatttggctattccccctaccaaatgtaactccggcatcagggattttggaggtggacggcaccgcggcggccagggaggaggaggagatcagtttccgaagggaagtggggttgagggttggtgcggcagaggcgcagacctacggccgtcggtggccaaggtagagtgacgaggggccgggatagggttggctggggcgacgggcggcggttgcagccggacatggcgacgggtgctactgtggattccggcggagaaacgtaagtgcggaacgggaatcagacaggggtattgctgagcctatctacgggcggaaggcgggggccatggagcggcggcggcaacgggttacgcggaggcggcggagtgggggaagctgcgccaagcaatgcgtgacag

SEQ ID NO: 83164 - DNA, 2680 bp, Oryza sativa
gggtgagcaccacctgcaccgccgccttcggccatggtttccggtcgccgtggtccatctctctccctctaatccctctcctctccttccttagggcaccccgaagctcgttcgcccgccgacgtcgtccttccgtggcttgccgtcgccgttcgccatcgtcttcctccgcgccggccaccctcggtgagacaccctcccctcttttcctctccctctccctcctagccgccgctttagcgccgccgcccgttcgtcgtcgctttagcatcaccgcccttcggcgccgcctttgcgccgccgtctccgccgtcggttgccgttgtcggcaacgcgcgtgcgtgtgcgcgcgtcgtcgccatgaccggtcggtcggctttgtgccgagccgagccggcggccgcctttatcgccgcccgttccctccccttcctagccgctgctagcgcagccgccttcgcgtcgccttttgcgccgtcgccttcgccgccggttgccgtcgccggcaacccgttcgcgcgcgcgccgttgccgtcgccgcggccggtcggtcggccttgagccaagccgagccgggtgtcgccgccccttttcctcccgagccgctgaccagtgggcccgcgtgccggcgccccttcctccttctcccgagtcgctgaccggtgggccccgcttgtcggcgccgcgcccccctccgtgctgacgtcagccctggaatatattgcgcaataaatgatttagggtttttcttttatagtaataaacacagtgaatcttctaaaattcataactaattcatccgagctccgtttaagcccattcaagtctcagtaaatcaagaaaaatgtgtagaatccattaaaaatggttttgttccctgtttcagtagtcttatagcctgtttgcaatgtttgctttgtatgtcgctagattccgtttcctccgacgctccggtgtactttgagatagtcgccgaggttcctccagcagcagagcaaggcaagtcatgcttgtcacttgaacatgttgatcctatattgcaaatgctctattgttttctttcaaatattgcattgttttataatattactatgggatggttacctattgttacagccatgctttttggatatcatgctcctttgttagcttggggttataacatgattagagtttggactaggaattgcttagctattcttagttcaactagttcacaatggggaaaatcatattaatgtttagactgttggttctaatgataatgttggattagtaccaccgctctggtgttggttaattaaaatgaatcacatggtgggctgtgggtgcatggttttgctggtcgcacccatggcagttaaggaccggttcgcgggatgccctggaagaacttatcgtacttaccacaaaccagcgtgggcaacggctgggcttgtagcgtagctttcctctagccgacgcatccaggcaagggtgggcgtgatggagtttggatgggccctgcaacggcctatgcggcttccggattcacctaggcacgagaggggactgcccgctgccttgcgaggagtgggggtgaaacctgaggtgtggtgtgcttggttagagggggttatgcgagtggtcctgtcacggcctctttccggtatgtcgtggtgacatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatcttttgaatttggatagtttaggtggatggttgggcctgtcgcaacgtgggctagcgttggacagcggatgtttaatattaattaattattacaactgtttaaatctttcaatttctgtttataaatgctcgctgtatgcaaatgaaccactctagctcttctttgttaattccctgcatcatacccctattacggtatgacttgctgagtacagtgggtagtactcagtcttgctctacttttcctaaccccagaggacgggtatgtgtcagatgaaggtttccccgaggagtaggcttcgtccgtgccgtcgaggatgcctgtggagtggtgttcccgctgtagtttagtcaaagtttagtcaaggcttagctcctgttgtctttcttttcttccgctgcatttatgtaagactttatgatgtttgtaagacgtggatctgtatgtcaacattgtcgtttgtgtaccccggctggtcctggacggggatttttatgcacattctgcttggaattatattcgggaatttctgggcgtgacacacgccgccgttcaaccgagccgccgccgcctcttgcgtcgtcgccggccgtcgtcggttgtcgtgagacgttttggtgagtaccatcgggttcgtctcgacgtcctctacgcgtaggtgcccttggatagcccggccgatctctctatcgccggcgaggtcgtcgcccgtgtcatgccggtgatgatgacgtcagcatgacgtcatgattcctcttttccagttttttttctaatagattaaatcttcggaaaatcataactaaataaccgtagatccgtttcaggtggttcaagttgctaaatttttctaaaataaagatctacat

SEQ ID NO: 83165 - DNA, 927 bp, Oryza sativa
taaggttaacacaaacaatcgtgatataggtttatgatttttttttataggatacagcaggagaggctcctactgtggtttaggtttttatccttatgctcatcatactagacatcctgcctgttgttttaggtgttggtgctaggagtggtgaaattttgattaaacctaaaactaaagacactgtttaaatttgctagcatcatgacttctttaaatgcatcatcttctaaatctgatgttgtgattgcaaaactgcctgttgctactcctgttgctaagtcatctgtttctgtttttgcttctaatcaacgtgagaaatacacctgttcgttttgtggtaaagatggacatcttgtcagtttctgttttagacttgctagaaaacagaaaaaggaacgtgaaattgcttttgcgaaaaagaagtggcaaaaatcaggttctatttcgaggcaggcggtcagaccacagtagaactggcggtcagaccgacgctctactaccgatcagaccggcgatagacctatggttagaccgcaggtgtctcagtgatcagaccgacctcgggaaattttttctaacaggaaacgggttgaattttcttctggttatgctcctgttggttctggtcgtgtgtctcagtactggattcctaaatttttattatctaaccccagtactgaggcttcgacttctgcttgtgtgtaggcatttttggtgaggatggagaacgtgtggattgtggactccggttgtatgcagcacatgaccagtgattctccttcctcaagaaggcgtcaaggagggactcgatcatcttcggtgatgcttctactagttcgataacaactactggttctgtcaaggtaagtgacaagtttacattgaatgatgtcactttggttgagaatttgaaatataatttgc

SEQ ID NO: 83166 - DNA, 2011 bp, Oryza sativa
tcacatcgagcgtgttgaatgctacaagtaatgaacctctgatcacgtgctattctctgtaggccatgcaatagcttttacaaaaagcggggaatatagctcatgctttaatttgtaacacttcatctgttacttttgggtgtactctttctttctttctttctttcttttttcttgtcttatttttttttacaaatgaagtataacttacagtctctgcattggatttacacaaccatatttgcaatattagaaccctaactgatagagttatacacttgcaactttacgactacattaaaggtgcattttgtatgtttcataggttattttttttgaaatgtacaacataatttaggtctattttgttcaacaagaacacaacatattttcgatggtgttgctaatttatatgtatttgttttttatatacaagtttccatgttgtgcaagaggatacatacaaattttcatatttttgaaagttctaatgagataaagtaattgttaacattgtatgtctataagggtattttgggttttttttaaaaaaaatccaacctatggaaatatttaagaataattgataaagtcaccggtataatagatatatagacaatatcagtgaaaaattatagaactgtgacaaattcagtggtatggagtagattctctgtaacaccctaggtattctcctacctagtatgctacacactacggaacaaaaaacactaagtcctaaattcattaagaattttgacagtctcccctgtaaatatggacatttaaggctggcagttatatattaaactattaataatattattcccacagtgcgatcgatccatataatccattaaaagaaacttatagttatctaaaagattattataagaccaaactaggatatagttcaagtgttattatggacctaagtaatatagtttgatagtgtgcatatagatctgtatataattaagggtgctacttcccgcccatgcatgccgatatcaatgtgtacctaaaaccaaataaacacaagagtgagtacgaaaatactcagcaaatacaatatggaactagaaaacacatgtacacatcattggcaatagagcataaacataaagctttctttctttgataagaaacacattttcaaacaccaaatcaaagaaaatagtagttcccatgtgggcaaacatgaattgacatagtagtttccatcccagataattgtgaatacattctagcatttgccagcaaagctgagtaagcgtgatcaacgattacccataagaacatgaataaaaccagatagcacatccatggctcgcatggaacatgaacaagaacatgaataaaaccatatttcacatccatggcaagcatggaaattgaattatttaaccaaagctagaattcggaatattgaaacaagaatggcgttaacaatattctgaacataaacagtcacatatcatctagaaatatatcagaaataaataggtagagcaatcaatccatgaatcatacaattagttcgttatgcacttgcctccaatgaagggttggtatcatgcacgatccgaaggaccaccacctaatcacaaacaaaacctcagcaaacacattcaaatatgactataataaattaagtggcacactccttcagctctatcccaacctcaagccaaacagtaaacaccactcccatctataaacaacactgttacttcactattaattaactttaacacaacaaacaaatacattttaggaaactacagaatgagacctacaacttccatgtagaaaccatatttttattttgccatttaaaaggcctaatgtgcacatcaaaacaagcttcagaatctgcccacgaattcagactgtccacactaaaacaaccataactggagttctactcgcccaatcagggtgtactttaccaatatggaaaactaagaaaaaacttctacaactttatctataggcagcctgactgatt

SEQ ID NO: 83167 - DNA, 2373 bp, Oryza sativa
tcctccaattggcgaaatacaaagacacagaaaaactgacagtgccccgaactaacaatccaaaacactgcacctaaacccatcctctaaccctccaaaaatgatgaattaaaacaataaaacaacctacaaccactactataggagaggtaagcctcacctagggtttgcttggagaacttgtgagaatatgatgggaacaccaacccaccactcctcctgctccccacattttcctcgatctgtttttccaatcagattcttgataagggctatggttcttagagatccatggagtagggttaacaggggagaaaagaataggtgagttccatgcatgggtgccaagggaaaggtgtggcggcctccgttggatgcaccagcagcggcggcgcagaagcggagatgcggacgaatatcatctagtatacttatatagttcatccttactaagtagtgtagttaatactatttctctcttctctcatgaagccatatcacccgaattatttctaacctctggatgatagatctatagtacaattatcttttctttcttctcgcataaaaccattcaatctcaattattttgaggcttaaaattcataaataccaattacataatatatattcaccttgcactatatttgcaaccatgtgcaaattatataaaatacatgaggtcattttgttttggttttaaatgatcatattgcaccttaccttatttgtacatattatgcaacataatttcccacagcaacacgacgggtattcatccagtattacaaacgattggtcccatttgatgaaacatcacattttcactacacatgttctttctcccacccacttaaggacttgaatttgtcctctaattctagttgactctcatcatggtaaaaagaccatggtgtattgcaacagttatggcatatgaagtagcataggtcaacacatatgttcataattgttgccttgttgaaccggtttgctacaaaaggggtttgaggaatttgtgaaaaaaattgacaataaatcttaggaaataaattgcagattaaatacgatgtatagagaacaatctccagacttacatattcatggtttgttgtgtacctaccgttgaccgtaagcatcttgtgatgaggacacaactagcttggatatgaccatgactaacttatgtattcatcaactaaaggtgcatatgttctatgttagatttacttattatatatttgaacaaacattacgacaccatgagttttgtattttttcgtttgcagaggtaattgcttgtgtgaaggaaaagaaaccgagcgtaaggaatgcatggatgatcaaataagttgattggggatgaaaacaagaccttctccaagtctacttctacctcaccatgccacttttggataatagaagataagagataaagttctgtacgttttggattcggattcgggcctcccgacagcatgaaatttaaatggacctagccgctgatctagaaggaatttcggggtccataagtacttgttgaaaaaattttgtagtctactttcatatggtttaggtcccacgtcaaaattccctccgagctattgggaatctgcaaaacaagcaacgtacttcacacaatctgatttgggttttgggccttgtaattgtgtcgtaggctaagcccaagggggtgtgcaccctagggcaaccctaggatatcccaaatcatatttattcagtagccgtcatagtttagatttgggttttgcttagattatttgccattgcagtttcactgttagataggtttgtggaaccccaaattcgagtgcttaatcatttatgtgcaattgtgttgtaatctatcttgttcttacttgtgttcttcgattcgcatgcaagcattagtcttatcggcgaggtcaaccggacagtgcacggttgataaccagaggagatgtggtactgcgattgcaggattcgaatctcattgatcggaagctggatcgtgtgtgtcaagtttccaacaaattgagagttatcaatacctatcggaagatcatgacctagtttcctcatcagttggtatcagagcgccaaattgaccgttaggtactttatctatagccataaccagaaaattgccacacaaaaatattgcatccattacctagccaatttgagccgttgcattgttctattagtttttgtgttgttgaattttaaattgcatcgtcgtgtcgagtgccggtttagttttaggtttaatttttagttttgagtattgcatttgttcatcactttgggttagtcacgtctgtcagtttgggtccagtttgtaggatcgaaacataagagggctgcaggaat

SEQ ID NO: 83168 - DNA, 1475 bp, Oryza sativa
taaaaatgataacttttaaatggagattaaatctagtgattaaagggaaattgaaagggaaaatgatggagaatagtttgagggagtagtgcagaattgatttttgtaatcaattggagaagggaacgcatggagagacagatcgacatgctggcgatgctagggtttggcccgacgaccaaaaaaccggctagcaacgaaaataacttatggaaaaaacccggaaaaaagaagacaagaaaaaagtggatgggaaaaaaagggaaaacggagaaaaaagatggacggaaaaaaaagggaaaaacgaaaaaaagacggactaaaaaaggcaacgaataaaaagcgggtgaaaaaaaaggaaaataaggggaaaaaagactgacaaaaaacccgaaagccttacctaaatgccagtgcgtcacactgggtaaaattttccctacatgtgcgggatgtgaatgatgccctttgacatgttgtctggatggttgcaacgttggaagaacgttcggaagaaacaatgcgattgtgtttgcacagaaagcgacggatggaaattttatgtgatgaacggaaatattgatatcttttaagtaggtaagtctaaaaaaaataaatggaattttgtggtaatttatccactttaactatgagaatatagtatgtgttgatacctgaagaaaatacgtggagttaaaccgacgacacacgtcagaattgtgaaaattggtgttattcgtttgcattttatttttcttttttgaaacctttataactttttttgttaaaatttatggtttttttctcattaaatattgaagttaagaattgatggtttttatgttaatattaaaaaagtaaaatagcaaggagatcataccaaattctgttgcacacagggtttcccaaaccgccggggacggggttaccgtgccccgacggtaagcacggttaccgcgcggtaaccgtggcaaaccatacgaaaccatgcaaaatttatcaaaatttcaaattattttttaaatttatttgaatttaaggagattaccgtggtttttctattaccactgtaaccatggtcaccggtggttttgcaaacccttgttgcacactaccagcctgaccaggtgccagctctcattttcttgacagccactctctctttctccatgtcttcctctgtctctctctccctcatctatatctatagagcaaccaaatattcagttagcaatttatgttgagcaaccgaataatcagacattatacccgcaccaatgcaattcccagaagatttagctacacagattatactattcatgaatactataaagtcggtacgcatattctaagattggaataaagcacctgaattatataaagaagattattctattgaaagtagaagttttacaaaagaagaggaaaagatacaagagactttaccgaactccttttgaaggctccgaggacta

SEQ ID NO: 83169 - DNA, 3376 bp, Oryza sativa
aacccggtgaaacacaaatcgaagacaatacgcacacaatacctccatcgtatgccatatggaatcttcaccaaccacatgcatcaactctagccttagtatcccgcatgatatctgatcaccacggacatcgtcttaccaccaagccgactcccggtccatcaccacagatactctcccgagacatcgaatcacctacacatgaaacaaacaaagaaacaatattccgggaccaagctatcccaaacttgactcattagtagcaaataatagtatctcatacgtatagtatccatctagaagccataaccatgaaacaatcatggatatccaaagaaacaacccgaaaccgaaaccgacacagtgtcggccggtcaaaccgcgggcctggccggtctgaccgcacacatagcgccggtctgaccggcaagctccacccggtcggaccgatcacataaaataatagtgaatccgatcatcacctgaaaattgattatttccaaaaccacttcgacgataatctccaaatatcaaaaccaataatcacagatgctaattattcatcacagaataagaatcaaaacacactttgatcttacacagttttgcatctcgtcggttgttgtcgggacctagcatcctcatcatctcatgcacgtaatattcacatagtacaagatgccgagggggttgcttgaaacactgcgaacataataagaacatcggtcgttataaataagtaattattcaaagaatttgtgttcatgtcatatgtcagtaccaaccaaactgtcttggcgtttagcttagtatttgctcctctattgacctttcatatttcaagtaaaacctctgcgcaccggcctgataaaatctttttctcatcctacttaaaaacgtcagaacagccctttggtacggcggggcgggctgggggtggcgctgggggtggtatcttattacttacaaattagtaaggaactctatgtagcttttcttgtgatagtttgtcgggtcaagaggtatggccaagtggtcctttggatatactaaggaataaaatgtagtgtttgctgcaaataagatagatgaattagagacaatatttgctagtaatgatgtattaacgaattgtaactacgtaatcaaatggaagagccactgcttacaaaaagctgtataggagcattaattaagacttttttttgtcatggtgcgagagcattcctcatcccaagtagtataacttgaatgaactggaagtttgtttcatactaggttgtccacggccgagacggcgaatcagatttggtgccaatagacacatctggatctggagcctgcgaggttgtccatgtgtacagtatgcaagctcatccaccagtggcggcgcatccatggcggccttgctcatagcggatgtgagcagatccacttgagctcatccgagacagcggtggcggcagcagatccatggtgaccttgtggggtggttgtggggggtgaggggttgggctcatgtacgatggaagttgttggcggtgagcagagatggagtatgggtgagctagggtttctgggttctagtgttttgtaaaggttctcgagtgaaaatggcaatcgtcttaaggaatcgcatatgaatatgtgatttcccgtaggctgacctccaagagctagcatttgatatataacatctgcacaaccattttgttagaggtggtcagcaccgcgtctctgctaggtcaatttagagttttagacgcatgtaaaattgacaattgtagtagtgtaccgatccagactagccaggatatataaaaagtcaaccatacatacactctaaataacttcgttgctacaaaaggcaacgtccctgatcgaaccaagcttatacacttttattgtgatttggctgaggagaaaaagtcggatttttttcctagcgtgaaaaatggtatttgtaggcccctggagttctatctttttcacaggtagacaaaataatgcctgcaaaaatggctgatgccatctcagggtcacataacacataaaaaatattttcatagatgggtatagcagaaaactgcatgtgagaacaagtatgtttttgttgatggttctcctaaggaattgctcgcaaaaaccatgactttcacctgtggttccttaagaaaactgcccataaaaataggatgattttttgccgatgattgtcgtatgtaagacttaaaaaataatttttctagaggtatctagattcatcatattaggaatattaggatatgtaacattcgatacaaggttggtttacttttaaatgtaggaaagtagtatgtgtttcaaataagttatttagccgtcagcgtggattcgtgcacctctatttccatgcaaccaattaataatgacgctaggcagtccttcctattcgttatagacttaataatgctttcattttttataggttagaatttaccaaaaatgtaaataaaaaccttgactatcttttgttaatctttaccgtaaattatattttgtttattattgttttgaggtatatatatgatatggtgtatcttgctattcgatcaactttgattagaaatacaagacaatattgcagggggcaacttcagggctggtttgcttttttaaaagttttcagtgcgcactctcgatctgtcacactaaactaatctataattaaggtactgaaaggggctgtgattccaagaaaaaagggtggaattcaaaaaggaaaaagaaaaaaggatcgcaaattaagaaagaaaagaatactaagttggcgtcacagatgatagcatgtagcatggatgcctatcctaattgattaacaattgtgcatgatagtgtacaaaggtttacatagcgattaggaacagaaaaccgatgcgacacttcacctagttctttaactgcaaatatctctgcacttcacctttataataggcattcagtttgtgtacacaaaattaagagggcatgcaataggagaaatcgaactatatatatacaaacgaactacagcagaaccacactcactacactggtcaaggtcacctgtgacgggcccaaaccctcacctttgacggttttgggcttggtcagtgatcagtggtcactggtaagtccagtcacctttgacgggtggccggccgtcagtggtgacatccacctctgacgggcaagttaatagaaggccgtcagaggtgttggtctaagctagactagggcttgttaggacccgtcacaggtgtctcatctctgacgagcccctaaataaaggcccgtcagaggtgatgatctccggtatatagtagccgtcacagggtgacccacctgtgacgggccc

SEQ ID NO: 83170 - DNA, 2770 bp, Oryza sativa
ctagcactatactaacactaaacttgtagagaacctttgatctttgctgggaatgaatgagaggaggagctatttataggccatgagttgcatttgggagagtggagatgctccaagcatccaaggagcatattctccttagcttcatctccttgtgacatgtgtccagcgatggtttcttcagtttaactggtcataaccgtcttgggacatggataactaccagctggtgaagaattaggctaattgggctagctactggttcagccgaactaggcccaatcagcccacaactttgcaggtggacttcttgttgattcatcaatccagtgatgtgaattattgggcttgtttactcgtgcgtattttgtgttattggcccatcttttcacaagtttgcttctcgatagctttcgagtgatcgttcgtttgctttctgtcgattctcctctatttatatgtgcttctcctgcgtatatgttagtagcatagtacatagtggaaatagacattttatttggaatttatgcattgcaagcatagctagtcttcagtaattgggaaatattgacggtcgaaattggttgataacgactgtcaacaaaccccccaagcttaaacctttgctcgtcccgagtaaaggacgaaaggaaacaaagacttggttgttgatcaggagttgctactatggtgtatatctagaatgtagaagtgcacagtttgagtactctctctcatgttaagtaaatatgcatagtggcttacccttatgcctaacatttgtggaacacacgcttctcaccaccttaggcaattgagagatagaacagatcatagagcaccattttctttttccttgctcagttttcatcccggatgggtttcaaggatttttgcaaataaaaactatgttcctcaaatgattctcttgatcactcaaagtgtatagatattttattcctcacgaaagataatgccctatttgaatcctactctaaggttgaatatgtggagcttggttgggatcaaatgaggcatacttgtattctcataaattactaagtcaaaaatctagactaaagcagatagcaaatcatacttagatcaagatcatgcaaagtgtgtggaatgtgtggtggaaaataaaatttggataaagaaaatgcttctcctttgtgcttatacttctcctccaaattatcctttgtttttcatggagagggtatggctatatattttcatcacgctccatattttgatagagcaagactttattcatcatttttttatagccacacctttctctccctttttcttttctttttgcaaaagatttttctttggagaagaatgcatgaatggagagctttatttgtcgatgatgacatggatatgagtgagatgaatgctaacttccagtgtagaagcttagcatgtgtgcatatgtgggtgtatgatcttgttcataaagtatgaaagatatctacacaagtcacaaaatttgacaaagttcaatggaactacaagtaaccaaatattatataaggttttcaagtgcaaattatatttggctgtggtaggaataaatatatcaaatgaggaactttgaaatttatcattttgaaaaacaaatcatccaaaatttaaatcaagcttggatcaagatttaagcaactctatttcactatatcatatctcacaacagcttaggcttaaatcacgcagtgtgcaactcacatctctcaggttcccggataatggttggctaatcattatttaaaacttgagagagtacttaactatgtacagatacattagagatataaagcagagcaaatattcatcatttcaatgtggagaactaggttttcttacctagcatggtaaaatctatcctatatttttggtattttatattttgcaaatttttatgtttttgagttataaatgcaaatgcaagaattgaaacatgcaagaaaggaaatatgcaagataaatgcagatacaagtcacctttgcgggggagagacttctccccccaagcttgctccttgctcatggtccagagtaagcattgaatccttgatggcggaagtaggcttgcagatcagcttgttgttgttgcatcatattgttgatatttgagaactgtgcatcaacactttgctgctactcctgcgcctggatcacgtgtccttcgagggactgttgtcccagcgagaggaactcgagcaccaccagctggaggttggaggcacgccacttgagcctgctgagttggtgtgcccccagcgcacctcatgaggcatctgccactaggaactgccggcactcggctaggcagatcctccagtgctatgacgtagggcttgggcccagccggaggcatctctagctgatttccagccactctcataagcatgaccgggtggtgagtacgttgaatcctcctgttcatctgctgccattctgcggttactcctatgtgtcgcacctgcacgggattcctctatcgtctgcaggggaatggttagtgcataacagttatacaaatgataccccgggttaggtaacaggatttcatttctacaaccgggttggaagaatactaaggtcacatctgctccatgtttcaaagtatgaccttgcactagttatgattcatttatataaacacgagagactgagatataagcaatttgatcatttgtaataaccccaagccctcttgctatacaagtgatcaaagaagtgcattttataggagcgg

SEQ ID NO: 83171 - DNA, 4168 bp, Oryza sativa
gtgatcaaagaagtgcattttataggagcggagacctctatgctctctacccactgcctaatcatgggttgcacaggagaaactctaatctaatgaaccatggcatatataataatcatctcattatcatgaacaggtctaggatctcctctaggaaacaaagtcatggcaatccatttatgtataagtctaagagttggattatggatgtcattggttctgggtttcaacccattgttttccagataacaccaaaatccacatccatacctgttttccggagtagctcaggatcgtatgctcgggtgtgagcgaacgatcggttcttcaacatctggtaggtttgcttctctcgtctgtcgacgaggtcgaggtcgtcatctgtcaggagctgtgaagcatcgtccgtgtcctccatcgacatgtcggcggacgaacgatcactcgcattatcggatcgggagccagatcccttaagcaagcgagagagccgtctcctcatgactgcacaaaagcaaggatacaaagcgaactcgagcgggggttagtacaagataaaatacccgccggttagctttgtaccaacagcgacttgcaaatgtagcgaataaaggattttaaatataagacgagcttgcaccagcctggaatgaatttgagagcaaaatagaaatgagaaggagtaaaaattgagttggcatgagatgaactccttctaccggccatcccttttttatagtgcacctccaacggctataattgtgacacggacccactaaccattggtgtgcaaaagaagggaggtgactattgcctgttgacggtcgtcatcgatcagttacatccgtcaatattaccggaataaatgaagaactagttatgcttgcaatgcatttagtgtcataataaaataaaaaccactagcacttggttcactaaccctttgcagagaatgagccataaatggagaagaatcggcatcaaaacaagcgaataatcaatcggacgatgtcgagaaacagaattgtgtgtagatgggccagaaactcagaattgacacgatcaatttgggccaaaattcacaagtctacaaagagcagaagcaaaggagcccgccagccgaaaatgggctggtttggcctagcccagggttcggccgaacctccctcacggccgttcgatccaagtggacggcttggatcactccccaatgacggttagagggcaatcctgacaattccaactgccataaccgtcattggcagcctatttaaggcattcactccctccatttcttcacacactccaagcatcgaagctctcactctctctcaagtttagtttagtgttcttaagctagtggagtaggaatagaatagtagtcggagtctggaagtctttggaagagttcgggtatggcctctagtagctttcctttcttcttttgcaagactagtatttaatttagaatattcctctatatacgactctagtattgtaatattttccgaatatatgaataccagctttacaatatgtccgagatattatgattatactgctagcttttctaggagatgcattggtacgggtataatgtttgcatatgcaattactctatgtcatgacgatgatattagagtagtatctgggtagtttagacgtgggtgtctagattactagggtatcattatttgggggttatatgctgcggatgaaaggtgggccgctgatggtgacagctcgctacgggtattcccccctgcgtgtatataatcctaagttaattccctggggagggtactcctccgtatttagccctggttgtatggtccatgacgggctgtcgtaagggaactcggcggtcaggggtggcttctcgaagtaccaggagggcatcagaaagggggtaatagctagttaatcatatatttaggatgtatgtacactatgtatactagaagtataggaatagattcttttctatattctttccacttagcttagagatttaatataggaatgagtagcttgagcttgtgtgtcattctaccctggaattatctttaccccttcttaggcacgactagtacaagtaacatataaatattagtttagttctctctattataatcttcccacgggataaacaaatacgatacccttggaaaactctcaggtgaaatgctacaatggtatatccgtgcgcttgcggataatctctgtaaccataatataccttgactatttctggcgccactgctgggaattatatttctagtaatgtcgttaggaaataccaacaagcatttctggcgccgttgctggggaagatttataagaagagattcctaaaactaatatcttatatttacctctgtatagtcaatatcctttgcaggttaaccttgttgttttcaccctttgttgtgaaaatagggtagtgtataattgtttttgacctgccggaaaacttccaggaaaatccataagtcttcttctgaagcataaaactgcgggttgttcccccgcagaagactcttccgacaaagaagccaaacgtactagcgccaccaactttcaagaccatggctgacaagactcttcgcgagttcgctgctccctcctctaagaatgtggccactgggccgcagctcaatttgggagacatggactttgatctgaagtccagcctcattacgatggcgcaggctagcccattctgtcgcaagccgaacgaggatgctaatgcacacctgcaacaatttctggagatttgcagcacgtacactgtgaagggcgtcagtcctgatatcgtcaggctgaggctgttcccattttccctcctcgggaaagcgaagaagtgattctatgccaatcgtgctgtgataaactcttgggaaaaatgttcgacagcattcttgtcaaagttcttcccgatgggcaagattaatgcccttcgtgggtgaatttcgggcttctagcagatgcggggatgagtccattccggaagcatgggaacgtttgcaggaatacgtggccgtctgtcctcatcatggaatgtacgactggctgatcctgcaaaagttttacaatggactcactcccacgtcccgcaaccacctggatgcggcagctggaggagctttcttctctaagatggtcagaggagccatcgacctcatagagaagatagtctctaacatgggttggagcgaggaacggctccaatcccgtcagcgaggaatgcacactgccaaggagacggaaatactcgctgcaaaactcgacctcctaatgaaacgacttgacgaacacgacaagaagccccaatgcaccgtcaaggccttggactcgcacatcacgtgctaagtctgtggcaacacgggacattctgggaatgactgcccagagacccatgaagaggcgatgtacatgggtaacaacaacaacaacgggtaccacccgcaaggaggtcaggggtggaaccagccccgtccgtatttccaagaaggcaataaccaagctaactactgacgcacttaataaaaagatggttgctaatgacaagatcttagaaaatataaatgtgaaactagatggctttgcttccgcattccaaaaccagctaagtttcaatgaaatgattgaaacccagttggcacaattagctgctctagttcctacaaatgaatctgggaggattccggggcaacccgaaccctccatagaaaatgttaaggcgatcacgacgaggggaggtaagtccacttgcgatccgccataccctaacaatgcaggtactagcagcaacagcagggaaacaccgtctgacgcagcggctgaagaagaaattcagccagaaaagaccgtgccgcagcattactgcgacacgaggttgctgccattcccccagaggatgaggaagccgtcagtggacgagcagttcgctcgtttcattgaggtgatctagaagattcacatcaacgtccgttgttggacgctatgcaagtgccaacatatgcacgttatctcaaagacatcctcaacaacaagtgaccactaccgacgaccgaggtggtcaagctgacagaggaatgcagcaacgcgatcctccacaaactcccggagaagaagaaaagattcgggggtgtcccacaatcacttg

SEQ ID NO: 83172 - DNA, 5184 bp, Oryza sativa
cgaaagtaaaagcccgtcacaggtgggtcacctgtgacggtccgacgtttgcgagtccgtcacaggtgaggttacctgtgacggatgtttcttccgaaccgtcactgatgagttaattccagaaaaaaaataaatgctaaatattggctagcctcaggaattgctagccatgccctctgaaaaacagaaacatcacaggtgccagtcaccccccctccatatcacatattccccaactgcccaacatcacagatgcatcacatatcacagatccatcacaaagcaacaatttacaacatcacatatgcaacaatttaatttattatagcacacaattcataccccatgaaagtcctcaaatgattaccaaaatttcttgtattctgttcgttgtgaacctccacaacctgtcaataagggaaaaaaaaaggagaaaacagatgaatagtacaacataaatcgtagttgatcaaatgtgatgacaatttagtaaagtaccataaatattgcacatatgaaagtaaattacattgcactctataaaaacataattttttacatcgccagaaattataaaaacatcttttttacatcacaataaattatctagccaagttcatgagtctatttggcatgaaaacgtcctttcttgttcattatttctgcaagaataaaggcgcacaattcgcctctgatagcgggggggttgatgggtgagatcttgaagccagctctacctttctgtttaataaataagaggttaattagcacgttttgaatagcaatgtagatattgaaatgagcttattcgccattagcaacaacctcagggtcgaaatctttcacctctcttagaagtgttgacatgttgtggcacacgtggaaaccacattggtctccgatctgttgtgcgcatgcaaacttggtgtcatgataaagttcattcttgccctccttgtgcctaccacccttttccacatatgggccccaagccatatttaaggccttggtgatttcactgaaatcataatctttggacttattggagttaaggtaggtaaccctactccacttaggtacgatgactaggagaatccaatgtcgcctgcgcagtggttatgtagcgttagtactaagaaccttaacttcaaaaacaatatacacgaagggtattgtcctcttactcttggttgtgtgcgcacatgatgtactccttgtcttgatgggcccataaacaccggttgacatagtcaaccacctcagtgaagctctgtcgtaaattaacctcatttaccatggatggatcaaggaacccaacctgattaccatggcgacgactctcgatccaacacaaccttaaaatatttacgtattagaactaatttaattaggagatatagtccagtcatatcacaagtatagaaggtatgcacttacaaggagtagcattttagaagaccagtgtccaacttccggatcctgaaaaggtcgaagaggtcatcaaagcctatagttatataggcaggcgacgataggaacggctggtggtcgtgatgtccaactatggatgactccctcattttccgcttggcattgcttagctccatgtattgcttatgtagctctcggcaagcaatacccatcacagctaacacattgtcctccaccaatggcatgcctagctcaaattgggctggcgccctcacgaccttccccgatttgctcaccggcatcgacgtcgcagccttgcccctttttggctccggcgccaactccccgaccttccccttgcctcgttcacgcttctggcccttgacaagtggtggggagctatcggcctttcttgtggtctttattggagccaagctttgagctatatctgccaagtccatatcagctccaccgggagaatgaggtactgacaatgccggtccacggggagcctcaattgatagcttagacttgggaggtgtaagctccgtcggtcgacttggacgaggagtcatcttcacaactatgtcttctttaggccattgtatgaacgtcttgcgcgcatcgcccaaagtcatgatttcatcatttgggggcacgggcagcggatagcctgaccaggtgtcctttactgtatcgatggacaccttggcatacccagctagcaggtctgcgccgtggaccttgtctgtaaccgagggcttgaaagccatgccctcagcgacttcaggagcgaaagttgggtggactctcgctagtaggacacactgtgctgcgccctgcataaggtgaaagtttgaatttaatattggaatgtgtaaatgtcttttattagatatggatcggataacaacaattacctcgatgtggtccactgcagctagtggtgcgatcgggagaccaggggccggcacctctgtggatgcacaactactcctatgctgtgacggactcgcgtcgtgttgtacacgaggagttggttgcacagcaggtgttgtgactcggggtatattcatgtcggcgagcaccttgttaaccctttcttccacccttgcattcatgctagcttctagttcttgaatgacctcaaccttaagttcggccttcaaacgagcgtccctctcttccttggagactttccgtttcctgtattgggagctgtactgagggagtccatgcttccagggcacatcgctaccaattccccgagttcggccaggatgttctttggttccgagcgcctttgtgaggatgtcatcttcgcgcctcttcggcgcggactcaacctcgctttgtgaagcttgttcagcaaccaagcccaactagaaaagaagatagtcgtttatacgaacttgtactttatacgaacggaaattagttaggttaagtagtgaactcaccagttcctgatagacgacggcatcacttttgttctcaaatgtgacagagccgtccgggttgaccttaccccttgcccgcgcccagttgcgagctctttgttcagggatgtctgaaaacgggtcagggacattcgctgctgcagcggctgcatcttcttgggcccatattgcctccttgccgatgtaccctgcggtgcccagccgatgcgggtgctcattccgctgttgcagtacgcgatgtgcctcgctggattccctaaactcttgggtggtcttgagagagcagaattcctcccacaccgcttcggttatttgagggtattcatcgaacggcgtatgattgccgggcgggttgacatactcggtgaagagcttcgacttccaattcttccaagctttgcccatcttttggaatgccttccgcttgagcctatcctttgcttcggctggaaatgtgaaccatttctccattgccgtccaagctcgctctttctcggcttctgtgaccttcccgatatctttatggaggatcccgaagttctcacgtgccgctatcccgcagcagttagaccatcttccaatgacagtcctgggcgccgtgggcctaccactagcgtcaacctctcttataacttgcactgtggtcggccatatattttgtgaccgcggatttctactagacctacttgcacttgtctcacccgacatcgacgtatgttgttcctgcggcaattctgcagcacaaacagaaggcaatatttgctaaggggtgctagctaaaatttatgtggtcatgtggtgaaaatttatcctataaattaccatgaatttcgggttgttggaccgccgttgtcgcgggatgaccttcggcaactgcctctgtggttgggtttgcttcttcctggatcctcgcaggtgttggggagggcgggtttgcgccgggcattgacatggtttaactttcgcgaaaaagattataaatttcctaccattagactaaatagcattagatccaatgtagtgacggggtatactatgaaagatatggcctcagttttgctgagaaatatgcatcaattacaatcatttgcatgaagggataaaaagaggaaatcagctactaggagaaaaaagcaacccaaataaaataggacaagtgtagttcatctgttcttatcaataaaatagaacaagtgtagttcatctgttcttatccataaggaaaagagcaagtgcaggaaattagagtagtagcaacagcatggccatataatagcagcaataagagcagtagcagggccatataacagcagtaggggtatatatgccacaggggcagcaacagcaaggggagattcacataaacagcaacagcagggtggaaattcacataaacagcaacagcagggtggaaattcacataaacagcaacagcagagggaaattcacatagacagcaagggtatataaatcaacaagtgtagataatctgttcttatccataaagaaaagaacaggtatagatagaatgttattaagcaattcatccttggccatttaacaagaagtacaggggcaacaacagcagtggtatataaatcatgcatatattattgtagataaaaaaatgaacaagtgcagaaaatctgttcttatgcataaaaaaagagcaagtgcacaaaatctgttcttatgcataaaaaaagaacaagtgtagaggtatataaccactgaatcaatcattcaaatttaaaaaacagcagcagcaagggtacagaatttgcatgattgacataaaacagcagcaggagtataaatgcaagtccacaaaattcaataggtctagcaacatatatagcagtacacactccatgaatggttatatgtccaaatggcacttaaatccacattcaagttgcacttaactaacagttgcaaccataggcagcagcatgggcaaacatagacagcaagggcaaacatagacagcagcagttgcacttaaatccacattcaagattcactgcaccaaaatcatgtaatacggggtatactatgaaagatatggcctcagttttgctcagaaatatgcatcaattatattcatttgcatgaagggataaaaagaggaaatcataacatcaaaagagcaagtgcagaaaatctgttcttatgcataaaaaaagaacaagtgtagatactctgttcttatccataaagaacaagtgtagaggtatataaccactgagtcaatcatgcaaatttaaaaaacagcccacaataagggtacaga

SEQ ID NO: 83173 - DNA, 1984 bp, Oryza sativa
ccccaccttagtagtatgtctacattggtatctatagctctctcatgcattgcctcgtttttctctatagactatctctaagttagtagatagttttgctctctctcttcatttaatacattccaagtaggaaaatatgctgacatggatctcttgtagagagcctatagataaccattgtgggtgccctaagggcagtagcagtgtaagctatggggtctatacccataaggccctagctcaaagtcacagtttaaagacattcaccccacaatacaaacacccatatatatatgtggtttaattggatggagacacaggtggaggaaatcgagcccacagtgcagcgttacccaagcatgtggacacgaggtacgggacgaaatttcttccccacctaccccttccagctagcgactttctcctcctctactccatcgccgtcgcctgcctctcatcccgcgccgcttcgcttatcctcccgcgccgccgctccacttctcccccgcacctccttcccctcccttcggcggccgaggcggatgtggtggctgtagcggcggatgtggtggtcgacgcagacggatgtggtggcagccgcgcctccttctcctctcctcccaagcagcagtcggcggcgcggtcttccatagtgaacgcgaggaggacgaagaggtaggggagtagatccggcaggcggcagcgagttcttggcggcagcgaggaggaggaggaggagatgggggcgtagatccggcgggcggcggtggcgatgaggaggaggaggaggtggggacgtagatccggcgggtttttggcggcgggttctttgtggtggaggcgtccccggcagcgggttcttggcggcggcggtgggttctcatccggccccatggaggacgtcatcaccgacgcaccgccaccgtcccgcttctccccggacgcctcgacaactttgccgcgccgcctcctcatccacctcatctcccctacctacggtgacggtgggcggcgggcgacgggaagccgcggcgaggaggccacgggcgcgcgtcggtgcatcctgcgagcggtgcggttggcggcggctcaccggtgcgcgggattttttttgcggcggaggaatcgttggcggcggatttttttttctttttcatcatgtggtttacatacgtctcgatttgttttgttgaatccatcttctttgagttcttctcttccaatcccgaaaatttttgttttgttgaatccgtcttctttgagttctcttccgatcccgaaaattttcgtgccttttcttgacttggtggccggagaaagagtggctgtggtgggagtggattttttttttggggggagggattctgggttttcaccccgctagggcacgcatgtgcgaggtgacgctgcccacagcacgcgtgcccggggattttggtgtcgcacgctccctcgcttggaccagggtccgcgcggctttgcttggggccaaggggctctgctagggcgcgcgaccatgctccacgcaagcacaaatcctcgctggcgcggtgtagcaccggtccacgtcactgcactgtgagaggcctaagggcactcacggtgcaagcacccactgtgagttaccataagatgacagctaggacaaagagctttgaagaccctctctttacagtgcaagcaccacgtgttggacccacaaatatcttctagtgggacccacaaacccccaactcctcaccggccaaatccccaaatcctccacccccaaatgccactcttccccgctggctctcccttcctgccttcaccggtgccggctcccctcctccctccgccggcgccggctctcctctcctctgggccgagcaacggcatcgtcctccgggccgagcggcggtggcggcatcctccgggccgtgcggcgtcgtccttgaagaagtggcagagctcggcatcgacgggcttgacgcgcgtgccgggg

SEQ ID NO: 83174 - DNA, 4340 bp, Oryza sativa
  unsure (1)..(4340): unsure at all n locations
cccctccctctctgtccgntgcccctcccttctccctcccccactccatcccgccgccgntgcatccatccctccaccgccaccatttttgtttcttgggagctcctcggcgagggcgatctagggttttctctagcggcgtcggcgcgagggcacggggcggcgaaggcacgctgcccacagtgcgcgtgcctcgcgatttcggcgtcgcgcgtggattcgcctcgacaaagtttcgcattgctatgcttggtcacgagtttccgtgtttggtcccgggtgcacgcaccacgtcgacgaaaatcctacatggcgcaacaaggttccgctccacgtaggagcactgtgaaaggcctaaggccttgtttagttcccaaaaactttttctcaaaaacatcaaactgaatctttggacacatgcatgaagtattaaatatagataaattaaaaaactaattgcacagtttgcatagaaatcgtgagacgaattttttgagcctaatcagtccatgattagccataagtgctacagtaacctacatgtactaatgacggattaattaagattaataaattcgtctcgcggtttccatgcgagttataaaattagttttttcattcgtgtccgaaaaccccttccgacatccggtcaaacgtctgatgtgacacccagaaattttcttttcgcaaactaaacaaggccaaaagtgtgtgatttctcactgtggccttttcttcacatgcgcgtgcatcgaaactttaataatactactattaaattttggtattatcaaattttattaaaataagattagaatatataagtgatgtttagtttagttaaggccatactaattttggtacacccttcaacccaatataaatgcatcctagtacggatatcaacatatcctagtaccataaatctggaccgatattctttccagatttgtattattaaaacatatcacatccatattaggttgcacttatattgacagagagagtagagcttttgaggtacgtacaaaggtgatgtttagcttatttggcaatgcagatccaatgcaccggtgatcgggcccgggtgaggaggctgaagctggaaaacaacgtcgagacgatgtagttgaggcggtacggaagatgggtgatcctgggtgtatgtcacgtagagtggatcggatcggcacagtcacatcaggggtgtggggaaggagatcggtaggctagatttgggccggtgccacgactagttggtgtgccttgaggattttgacaggtgtggaagtggcggcagttgggagatgatgcatgggtgctagcgattgaggtaggcatggcagttgtccgagttgacttgtcctatgtagcattcctcttcatctctagggagctcctcctcctcccatgttatggtcgatccctctggtcgtggggagctagattgacgagacgatggcggtagtggtaggggtaagggatgctccggtggcgtggctttgcgggatctggcagaaggcggcaatggtcgcactgcagggcaacaaatcttggtttggtttggccggtggtggggcaacagtacggctaagatgcgtgctagcggagtttgttagggtgatggaacctaggggtggcagtggcaggtgcaagagagggtttggtaggcaaaagcctagctcgtgatttcctgagctggaaacgacaacgtcttcggacatcgtgacccccttggggcgtggttgaggtaccatactctctctagataaaaacccaatctagttggacaagatatggtggcacctaagcatagtcattgagactgaaccagtaattgaaccggtgaggctcttggttcgatggttcactggttctaccggttgaaccattggtctaacccagttcaatagttattaaatatattattcgttcctttaaagcacaagaaggatgatagcctagtggttgatgagcttcctccctcacacgttatactgtgttcgaatccgtcccaagcctattttcccctcattttcccccgactgctcccttgcttgcacatactcccacacatagcatatccagtcttttaaccggaccgacagaggctctggttccggtttttcccggtccaatccggtcttaataattgcgtcatgacctgccaagaggcttaggagatcttcgtctcttgccttgcctggaggctcaagagatagagatcttcgtttcttacctcgccttaggtcggtcctcgctagtttctcggttgtcgtcttgtgtggtttcggtgttcggcaagacgtttgcgaccctccttaaggtctagcagtgattggtcacgcttagtgatgtccggctcagtgctaacgcttttctcctaggttgtgtgaagagctgctagcaggtggtggtggtgtgtttgtttgctttttcctggttatagccttccagggctataattttgtaatattttttctattatatcaatatgaaactacacaatgcctggtgcggttttttttttgtaaaaaatatttggtaggccaatatctttggcaagttttggcactaccaaaattagtagcatagagtttgtagttgtatgagcaaaaattgatagcaaaacaatcatgcataagatactattggagttgctaaaaatttggtagggcaaaagtaggtctcaatccaaacaagctcaaagttctagagattattttggtaggattgtgttgataatgttatgtttagtttgttgtcttgctaaattttgttaataccaaaaatttaaaaaggttaaaaatgtcaacaaagttaacaagccctaaagtattaatagcatgtttttaccaaggggatactaaattactaatggcttggcctagttttttctcttcaactacaaacttcaactttctcgttttctgttagcacttttttcaaagatgatgcgtttttttaaaaaaatttctatatagaagttgtttaaaaattaaaaaaaatccattttttaagtttataattattaatacttaattaattatgtgctaatgagctttctcgtttatgtgcactaaatatgtttcttttggagaaggtcgaatgcataggattatttgttttctcatgttaggacgcacgcacactgcaagcaatgcacatgcaggtgacaaatctctaactttgctaaatttctactggtgatggtgatctatgttacctcgatacggggatacggatacggatacgcaatacggtgatacgaggatacgtcatttttcaaaatattaggatacggggatacgtgtatatatttatatatattaaggaaatagcaataaaataggagtgttcagccaattccgtatcaatcttctccaaattatcttttctagataattcaagttggcgaattcagacaaaaatcaacacatgtaaattgatgcatcgtgcttacaacatcaagtgaagtgccgactaggcaagtaggaggacccaacacctaccgatcgaccaccaccaatatcaagatgttacttgcccttgctttctcttgataaatcagcagctgcatgagcagccgcgctagcactaggattgctagatgcacatgcactagcctgagcttccaaatccaaaatccatgataatgcttgactacttgtagcaagaagataagaaaaaaaattacagatcaagcatgggaatttggaaagccaagccagaagaggagatttggctcacaggggaacgaagagaagtatactcgtgcttccacggagccaccggcggttgcagcggcagcggcgaaggcggcggcggcagcggccaaacggcctccgcctagcgttggcgcgggcaatcttccgctgcacctagctgcgatgctgttccgcgtgtggcgatgacgacagcaccgggaccacgtgtggccacgagcatgaggagcatccggaagaatagcagatggaaccatatcaggaacgttcggaacgtatcggcgaagtatcagtgtttttctatttaattgaaaatcacgaaaatctgggatacgtacgggatacgatacgtatccgtatccgtgcgagtatccgatacggatacgtgacttttgtgccgtatccaggtaacacagatggcgatgataaagcaaagaatgagataggccttagcagatgaaaccaatcggtgcctccaagagggattgggatcaggtgcaatcccaactacaattgcacgtgatggaggctgcagtgttcatgttgttacaatggaatcttagtctgacaatactctgaccttataaatgcgacaccagatattgctgggaactc

SEQ ID NO: 83175 - DNA, 3304 bp, Oryza sativa
gcgatacatacggtctggctggctggcggcgcgcccgtatatagcctcgctaattaagctacagtacatacgatacgatgtgtttgttgactactagtatggcgggaaaggagcggagccacgtgcacttgtgcctcaccgactacagggacggcacctacacctacacggtgcaccacatcgacgtcgcccccttcttcctccgctccgacgaccccgacgtcccggacccgggagccatggaggaggctgtcctgcccccacccgccacgcgcctcgccacgcgcccggagaccaacggcctcgagttccaccacctcctccgcgccgccgacggaggcgacatgatcgtggccaccgacgaccagcgccgcaccctcatctacgacgtcgccgcccgcgccgtcggcccggggcacatgctgctctccgacaagcgcgtcccggtctccgccgccgtcgccgaccgcctctacgtcctcgacacctcgcacgccgcccggcgcgccacctgcttcgaggccctcgtgtacgacggcgtcgaggacccgctgcgcgccgactggtactggcgccgcctcccgggccctccctacgccgacgacggcatcggccgccctctccccggctcccgtgtcaccgccctcgcggtggtcggcgcaggcatctggaccacgacggcgccggcggaggacggcgtcgcctccgtccgcccctgctcccggctcgaccccaggcgcggcgtctggacgacgcccaagggcgccggcgccggccccggcacctactcgttcgacaccgagcggcaagcctggaggagagagggcgactgggagctgccgttcgccggcaaggccgagctcgtcccgggctgcaacctgtggttcggcttctcccgcgccgacgggtcgtcgtcgctctgcgccgccgacctcgccgcggcgccgcacagggcgtgcggtgtgtgggaggacttccgcccgcccaaggagtggttcagctgcggccgccacctcgtcagcctcggctccggcaagctctgcgtcgtcaggttcttcgccaccgaccccctcgacaaatggaggcgtagggaccctgtcgccatcatcaccgccatggaggtgcggactatgcctgcttgcgacggcgacgacgacggcggaagaggaggagaacggcggatcaaggtggtgaagcacatgtctaggtgtatcaagctcccaaattacaataaaggcagaaattgggttctctaatactcgttaaatttcactctaaaatgcacaagtatgatttctttaattaatttatagatctaaaagatgtatgtatctacataaaattcaatgcaactccaacatttccttccaagtaaatggtattaataatctctcaaaagtgaaggataaagatgatgtactcatggcggcttctcaactctaattcccagtggtttgcttcatcctcctctcatccaaacggatagctgctgtttacaattggcttattaatccctgttcagtccccagatagttattcacttgtccaaagcctgtccattgtcttgattcctactactttcctaaccaatttgtgcaggcagaaagaaacttctcctgcaaagcagacaacttacaaattaggttgagttattccacctccaaacaaactacagcttgaagatgcagttgagactgtaaaaccagcccttgaaatttgattcaccgcatcggaaccagatcctctgacgtagcggacgtccgatggctctcgtccgtccatgcggcatcggacggagtcgaggcgagcatagtgaataggctcggcccatatggtataaaaatcgacccacgcgattcacaaccatcgacgccagtcgccacctccgagccacggccgccggcgctgctaggaagcaagtcgtcgccgtcggcgtcaccaccacagcctgcgcggctgcgcctccatgtcctccctcgaacgggagcctccgctgcgtccgccgtggaggtcgcggaccgtccgctttgacgaaaccatgactcttggaggtcaacctgtcatggaagatgcagcaagagggaagcaacttgtccaaagcaacaatgcattgttgtgagatttattgttaagagcatcataagtgttgcaatttcaacacagatttgatccaagtctgtattcatgtcagttccgttctcaaattgcagcactaaattaatgatgtatatgcgaatatacctttgtttttgccattttgcaagcaaacattagggtttcgtcaaatgctcaatgcagcaagaacagcacattgtaatgttcaatgtttactgtcgaagcagcatcaacacaagtgacattcttttgctagactgaagtttcacttcaattcctttaaacgtactgaattgaaaacgaaaaattgatgcaactacaatcttcacattctcaaatagacacaacaatcaatctcaattggcaaaggcattcagtcatcacattcagtgttgagttacaaacttgcaatcccaattcacatcaatttacaatatccattcatatcaattttagatctcgatctaggattttcaagatgctgccattgcaagcccttgtagtaggttctggtgatgatattactttcatcctcaagaaaattgaaactaggaatcagtcggcaacctcgaacaactgctaagtgtatataacctgctgctgctgctactaacgaattaacaggagtccccttgaacttttatgcagggatgatttgaaggagtacactgccggcagcgagccagcaacatgctaagggagagagaacgcaggggcgagagatggggaggagggcagcgacgaggggaggggcttcttccaggatccactccacccgcggatgcgccggaggagacgacgagcggcagtgagcggccggccgaagaccacgggaaatcaggagccatcccgattttgctggccgagaagaggatggtggcaacgaaggggccctcgcgcgggagacgcaggctgtggcggtggcgacgacgccgacggtgcagaggtctcccctcccccatttgcttcctagccggccgcggctgtggcgtcgatggttgaggatcgcgtgggctgatttttctaccatatgggccgagtctatccgctgtgctcactctactccgtccgatgccgaatggacggacgagagccgttggacgtcctagtgctttaggatctggttcccacagcatcagtaccccacccggtcatgaacacttccgtttttttgacaaattgacccttt

SEQ ID NO: 83176 - DNA, 12508 bp, Oryza sativa
tggttgggcacattggtgaaatatggatgcatgaagacatactattcaaaagatgccctttacaagaccatcaccgctcatcctaacaaggatgggcacgggctcgggttttcgggtggaagtcctgtgtctaagcgtgtgatggtaaatgggaaagaatgcttgatgttaatgagagaaggtaaagctccacaagaaagtgaggtgactagtcttgtgagccgccagggacccggaacatccggacaaaccgggcgaaacctccgggtgggagtctctgtctctcagaaattcccaccaggaagttccggccggtttgctaggaagttccgggccaatggccgtgcacaagacatgtccggaagttccgggcataatgccaggaggttccggccagatggtctttactatgattcatatgtaattttcaaaaattcagagggcaaagtggttgcttattttaatgggaattagaatgatgagtaccgcacttgtgtgtgggtgccaaaggctttggtaactaacatcaagggacccaaacttagacaagtttgggttcctaaatcccaagcttgatttcttttgtaggcatactcctccggtggttcaagttgggttgtggacagtggttgcaccaatcatatgactggagagaggagtatgtttacaagtttgatgaggagaacgaaactcgtgagaatattgtgtttggagatgatggtaaaggaaagataattggtctaggtaaaattgccatctccaataatcaatctctctctaatgttcttcttgtcaattcattaagctacaatttattatccgtttctcaattgtgtaagttgagttacaattgcttgtttaccgatgaggatgtgaccgtctttagaagggatgactcctccgttgcattcaaaggcaagttgaagggtgatctctatcttgtcgatttcgatgtggatagagtgaatccggaagcttgtttgattgctaaatcctccatgggttggctatggcatcgtagactagcccatgttggaatgcggaatttggcaactctctaaaggggggacatatcctcgggctcactaatgtcacatttgagaaagatcgtgtgtgtagtgcttgccaagccgggaaacaagttgggaatccacatcctatcaagaacatcatgactacaacacgccctcttgagcttctacatatggatttatttgggcccgttgcttacataagtattggaggtaacaagtatggttttgttattgttaatgatttttcccgcttcacttgggtgtattttctccatgacaagagtgaggctcaagatgtcttcaagcgcttcgccaagcaagcccaaaacctctatgatctcaccatcaagagggtgcgaagtgacaatggaggagaattcaagaacactcaagtggaggaattccttgatgaagagggaatcaagcacgagttctccgcccccttatgatcctcctcaaaatggcattgttgagaggaagaaccgaactcttattgaagccgcaagagtaatgcttgatgagtacaagacttcggatatcttttgggcggaggccgtgagcaccgcataccatgccatcaatcgcctctacctccataagatactaaagaaaacttcatatgagctcttgagtggtaagaaacctaatgtttcgtattttcgtgtctttgggagcaaatactttattttgagtaagaggcctcgctcatctaagttatcacctaaggtggatgagggattcttacttggctatgaatcaaatgcacatgcctaccgtgtcttcaacaaaacctctagtattgttgaagttacaagggatgtgacatttgacgaatctaatggctcccaaggagagcaagttgttgtacatgttgtagatgatgcggatcctagacaagcaattggttgtaaggctattggagacatacgaccagtcgagacgcaggatgaccaagaagatagggatcaaccttcgtcatcgacatccaatagccctacaacaagtcaagagtcagttgacccggaagtttcgggaccagatgatcggaacctctggacctctccaggccaggaagttccgggtccatctgccagaaagttccgggcagaggacagtcaaggcgtgcctacggcacaagtggatgggattgatgccgagggcactgtagagcatcctgatcaggctcaggtcccctcggtgcaccatccaagaatacatcacactgtccaaagagatcatcccgtcgacaacatacttggtgacataagaaagggggtaactactcgttctcgtgtcgctaacttttgtcaacactattcgtttgtctcttctttggaaccaactaggattgaagatgcacttggtgatccggattgggtgatggctatgcaagagaagttgaataacttcactcgcaaccaagtatggacattggtggatgtcacatcctgatttttgtcttaggatttataaattatttaataaattattaatagaatttatattaaatgttctttaatttacaagtgaagttaaatgtgggaaataaaatttcctaaatataaagcatggacggatttaatttttattaaattctccatggttaattatactctctggaattttctcggatttttcggagctcaattattaattttaatcatacaaagaacagttcagtaattatttgatcaataatgatctaattataattgttaagtgcttttcttgtttaaaatccttaaattataaattgttgtttaaaaggaattattagaaatgattttaaaagcttcaaagagaagatctaattttaatttgctaaatctcaatataaaaatgagctagataaaattttattaaatactttgcttgttcctctattttctagaattttctgggaattatttgagcaagggaagtatttttaataattgaaacaacatttcacaaattgttttatttaaaaaagttcaaaaaacccctccctaagccgttgggccgaattcggcccaatactctctctctctcccgcgcggcccaagccggcccagctcagccgccgcccctcctcctccagccgccgacatgtggggcccacatgtcggaggtttcttcaacctccggccggcctcaggccgagcccgagtcggccgaccgagcccctcttcctctccgaatccgcatccaatccggtcctttttcttccgtttgtttgaggggtttttatcctctcatcctcctctatcttttccctcaacaatcggagcaagaggttgagtattttatccgaatcgagttcgtttcgattttatccccaaaaaccgagtttagattttcccgaagcgatttcttgcgggaggagtccgatctcttcaatccaaggctataaataggaccacctcatcgctctctttcgtttgccccctttcccgagctctctagtgcgccgtagagtcgccgccacgccgagttagtcgccgccgccgccggccgatgtccagccgcgccgccgcgccgctcctgccgtcgccgccgcttgccgccgccgccaagaggtgcgccgaggagtgaggaagcccggccgcccgttccccttcgccgtcgcccaccggagctccgtcgccgccgttcaaccgagccgccgccgcctcttgcgtcgtcgccggccgtcgtcggttgtcgtgagacgttttggtgagtaccatcgggttcgtctcgacgtcctctacgcgtaggtgcccttggatagcccggccgatctctctatcgccggcgaggtcgtcgcccgtgtcatgccggtgatgatgacgtcagcatgacgtcatggttcctcttttccagttttttttctaatagattaaatcttcggaaaatcataactaaataaccgtagatccgtttcaggtggttcaagttgctaaatttttctaaaataaagatctacatattaaaattgtccataaattgaattaaatttatttaattctttttaaatgggctttaattagatttaatcttgtaaaattcataataaattcatttgaagtcggaataaggccgttcaagtctcataattcatctaaaatcatgatctacatgtttgtttactttatatgtattgtttatttggtttttattagtctttttcttcgttttgcgtgttagcttgtcgtttccgtcgttgcgaagattcgtgagtgcgtcggaagtgatcaagaagattaattgaagatcggttattgcaaggcaagtcacacagatcctaaacacaatcctttgagcatgttgatcctatatttaaattctctatttatttcaactatgcatttattttcgaatgtcactgggtggtgtgaacctattcctttgttatggccaatttgcattgaatgccctattccttgataccttgggtaataaattgattagcttgaaccttatgtattggtttggttcagctaaatgttatatatataattgcttagcaatgcttagaaacattagctcactaatgggatgaatcatatatactacattattatttatggttatatttaatggtagctcacgatggttaatcgtgttatgataattaattggtaattaaaatatgattaatggtgggttgtgagcacatggttttgaaggtcgtgctcatggcaattaaggaccggttcgcgagctactgttgtgaaacatttaccgtgccaaccacaagccagcgtgggcaacggctttatcttttgtatagcgtgattcattatagtgcgccagactgagaagtggcgagaagtccatgggggtcgctggggagtccatgccttgtttataagggggtgattatgatccaggaaaggtgcgctgtaatggattatgctgtgcaaggggtattgtcacaactcctttccgaggtaccgtggtggtactgagacacatggtgacatgatgtggggttgtgtcttgtgggtacagtggtacacctctggccagagtaaaactattcgaatagccgtgcccgcggttatgggcgggttgagcaatgtttttcgtgattagtctcacacctctcacaataattatggatgtaataactggtaataatttgcttagctcctggtttggagttagatctgttcagccgggtatggttgttcaggatggttgggcctgtacagcatgggtgtgctgttcagtgttgattaaaacttctgattaattaatctactgttttactactcttaactctttgctaaatgctgctttcgcaaatgagcctatattatgccatactttggaatccttgtgcacttgcatatttgctgtgtggcttgttgagtatgtcatatgctcattcttgcaataatcatcaaacctcagttgaagataaaggatccagaaggagaagacgtttggcttataccccagttgagctgcctgtgggagtggagccggagcttcgctagattttattttccgctgcagttttcttcttgatgaggattaagtgcctcataagtaagtatttatcgttttagttaatttgatgaatctgtatattaaattgtcagtttgtgtacctcggctgattcctggacgaggattttatgcacaaataagttcggaaattattagtgaatttctgggcgtgacaagttggtatcagagccatctcaactgttggataagccaaatggtcaaattttaaggacgaatttttccgacaaaaatgatttgtgaaaatttctcctttcttccttatctagaattctttacaaattgtttcattgtctactctcttctctcgttcaacttgagtagttctgaaactaaactagtggttgaaacctgaagacgccaatgaggtctactgatggaggttaagtaaagtggatcgaggaaggaccaaagtgcccagatgtcaagatggaatgaagttggcatcctgccttagaacctatcccgccaaagtgtctttgaagaatagttagtagggtagaacgctgttgtttgctttgtgtgtaggtatggttgcattcccgtcatagatgtagtccagtgatgagcgtgcaactgtactaggttgtttgcttaaccaacttaaacaatataatggtctacacacatcagatcagtgttaacctggttaaggtcttgtctttagtgtaacctctctccttctatcttttctaatctgcaacagatggtgaacactcgcgccagtggaagtggaaacaataacaatgaagagaaccccacccttgctcaagtgctggctcaacagacccaattgattaacatgttagtgcaacaaatgcagaaccagcaagggaacaacaatgtcaatcctccgccgccgcagaacaagttagctgattttcttcgtgtgaggccgcctaccttctctagcactaccaacccagtggaagtaggtgattggttgcacgctgttgagaagaagttggaactgctccagtgtacggatcaggagaaagttgttttcgcttcacatcagttgcaaggatctgcttcagaatggtgggatcatttccggatgaacagagcagaaggacaaccaatcacttgggcggagttcactgaagcattcaagaagacacacatacctgcaggtgttgttgctttgaagaagcgtgagttccgggcacttaagcaaaaggatcgtactgtgacggaatatcttcatgagttcaatcgtctagctcgctatgctccagaagatgtgcgtactgacgaggaaaggcaggagaagttcttggaaggtctgaaggatgaactgtcagttatgttgatctctcatgactatgaggattttcaggagttggttgataaagcaattcgactggaagacaagaagaacaggatggacaatcgtaagagaggaaggattgttttccaggaggcacaggatagtagccagaggcagcgtatcaagccactccaaattggtgaatcttcttccgctggtcaagaacagtcacaacagttgaacatcggtggtgagatcaactcagagactaatgcaagcaatgaagacaatgatgggcaagctactcaatcagtgtcatttcagcaggatcagtctcaagaagataacagtagtggaagggagcagcaggtatgtttcagctgttacaagccaggccactttgcaagagagtgtccgaagtcacagcatcagcagccgcaaggtcagatcaacaacattgtcgtcacaggagccaatgcagtgccagttgcgtcttcaagagttgtgtcttcaagtgttacaactcagccaccagtttcaaagcggcagtagttttctttaaagccttagaataattatcggagttatggaataagatagactgcagtttacctatgcccttttctttctagccgttccgaatctcgggacgagattctttgtaaggggggtagatttgtcacatcctgatttttgtcttaggatttataaattatttaataaattattaatagaatttatattaaatgttctttaatttacaagtgaagttaaatgtgggaaataaaatttcctaaatataaagcatggatggatttaatttttattaaattctccatggttaattatactctctggaattttctcggatttttcggagctcaattattaattttaatcatacaaagaacagttcagtaattatttgatcaataatgatctaattataattgttgtttataatccttaaattataaattgttgtttaaaaggaattattagaaatgattttaaaagcttcaaagagaagatctaattttaatttgctaaatctcaatataaaaatgagctagataaaattttattaaatactttgcttgttcctctattttctagaattttctgggaattatttgagcaagggaagtatttttaataattgaaacaacatttcacaaattgttttatttaaaaaagttcaaaaaacccctccctaagccgttgggccgaattcggcccaatactctctctctctctcccgcgcggcccaagccggcccagctcagccgccgcccctcctcctccagccgccgacatgtggggcccacatgtcggaggtttcttcaacctccggccggcctcaggccgagcccgagtcggccgaccgagcccctcttcctctccgaatccgcatccaatccggtcctttttcttccgtttgtttgaggggtttttatcctctcatcctcctctatcttttccctcaacaatcggagcaagaggttgagtattttatccgaatcgagttcgtttcgattttatccccaaaaaccgagtttagattttcccgaagcgatttcttgcgggaggagtccgatctcttcaatccaaggctataaataggaccacctcgtcgctctctttcgtttgccccctttcccgagctctctagtgcgccgtagagtcgccgccatgccgagttagtcgccgccgccgccggccgatgtccagccgcgccgccgcgccgctcctgccgtcgccgccgcttgccgccgccgccaagaggtgcgccgaggagtgaggaagcccggccgcccgttccccttcgccgtcgcccaccagagctccgtcgccgtgtcacgcccggaatttctatccaaaattccaaacgcttacatgtgtgtgaaccctcgtccaggaatcagccgaggcacacaataacaaattgataatagagtacaattattactctaattaatacgcgaataaaatgtcattacagaggtagatagttcctctcaatcaataaagatctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcatagtagggtttcatttgcaaaagcagcatttagcaaacatttgagaatttgagaaaacagttaagtaattaaacaatattaatccaacgctatacaacataccctgttgtataggcccaaccattctgaacaaccaccccggctgcacagttctatctccaaaccaggaatataccattccaaaccaggagctaaacaaattattaccagtttaagcatcttttacaacgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattaccaggttttagttggcacattaattaattaactaatcacgattgaccatcgtgaactatcattaaaccatcatgaaataatagtgaatcattagttatcccgaatatgtgctaatgtttctaagcagggctaagcaattatatctaatatctagttgaactaatataaataaagctcaactagtcaaattgtaataacccaaggtatcaaggaataaggtaatcaagtacaaaagggccataacaaagaataggtcaattccacccaatgacattcgaaaacagatgcaatagttgaatagaaacaatagctttaaataggatcaacatgctcaaagggttgtttgggatctgtgtgacttgccttgctggccttggaactcttcaaactcttctccggcgaaaacggactctccggaaacgacggaatctaagcggaaaagagcaaaatcaccaaaacagcacataaacaaacatgaacagtacatgtggatatttttaatgtgtagatctcaattttagaaaaatttagagacttgaaccaactaaatcggagctaagatgaattagttatgaatttttaaagattaaatcggattaaaacacttaaatcggttagaattgaattatgacgcaataatgaattatttttaaaaaggaaaagagggtttattgcgtcagcgggctagggtttgggtggaccgggcgcacaggcggcggttcacgcgaacggacggccgagatcgatccatccaaaacggacggccgagatcgaacggtctacgaccggctcacggcggacgaccctgatgacgtcagcaatgacgtcaccgacagcggcggcggctcggcggaggagatggctcgaacggcgcacgctcgccggcgaacggcggcgcgaggatgcaaacggagggcaccaagacgaagaggacaacgcggcgaactcaccggtgacctaaacggcggcggaagaccaacggacggcgacggcgacgaggaggaagcggcgggaaccttcgggtcaacgacggcgatgctgctccggtgatctccggcgacggcgaaggggcggacgaggacggcgacaacttggcgagcacgacggtggtcttcccgagcgacggcgacggctgaaacgacggcggcgcacggctggagcggcggcggcgacggcgaagctagggcacacggcgctagagcgattccgacgacgagaggcgaaggcaagggtggcgacgggtagaggagacaccgggggtccttttaaaggggctaggaggcggcggcaaaggcccacggcggccggcgacgaggaaggaaagatcgggaagaacgaatccgagacaaactcgaatccgacgctttccaaaacgatttagccaaagattccaaaggagaaaaggtagaggagatcccgaggatcatatcccctctatcaattcggccggagaaggaaaggagcggccggattggaaagcggcggcggcggcggtgcgctagggtttcggcccgaggaggacgacgatcccgacaggtgggaccaacctgtcagcgacagcgcgcttgcgcgggcggctgcggctgcggactgggccggctgggccgaggagagagaagagaggttttgggccgactttcggcctaaagccaaaagaagactttttaaaacctttttcaatttaaattatttcttaaatgcaattccatttattaaaaatactttcttagctcaaataaatcccagaaaaaatctaggaattatagaattaagcaaagtatttaatgaaattttatctggccccattttatattggaatttattaattaaaactagatcttctcttcaagacttttaaaattatttctaaaaattccaattaaacaacaatttatatattttgaattttcagggcgtgacacgctgtcacaccccgaagttttcctcccaagccaaaattgtaatttttataaatgaccctaagaaaatgctggtgaaatcaggagaaaaccctatgaaagtaatgcaaataataatcggatttgacatgtggaatttttcttgagttctacatgtcgaaactcattaacaggatttttagtggaattttcagagctctagaaataattttaaccaattaaaattgagcaagcaatattttaattccagggaaaatcctttttcctttttctttttcttttccctccctttttcctcctttttccgaatgggccgccggcccattccctccttcctcccctcctccttgttgggccggccgcaggccgaggcccagccaggccgccccgccgcctcctctctcggggtcgccgacaggtagggcccacctgtcgggtccttcccccacctcccgccgatctcgctcgcaccgccgcgcccgcaaccgccgccgcgccctcgcctccgcctcctccgggccacgtcgaccacgcccgcgcgtgcgccgcgtctcccgcgcccactcccctctctctcccgcccgcgcccgcgcccgagatggccgggattcgattttcgaatcccgcctctctctcctcccctactccccacgtcggccggcgattcccgcctctcccggccacgtccggttccctctccccctatttaagcatcgccgccgtcccctctcactttttccccatttcgccgcaccctctcgagcctccgatcgctcccgcgccgtgcaacgccttgccgccgcttttttccgcaactccggccgccactagccgccgttagggtcgccgccaggccggggctgcaggaat

SEQ ID NO: 83177 - DNA, 20451 bp, Oryza sativa
ttaggccctctttgtttagacttataagccaacttataagtcaaaaagtctaaaccaaaacaaacaagcagcttttttatttggcttttttaagccataagccactctaacactattaaggccttctttgtttaggcttataagccaacttctaagtcgaaaagtctaagcctaaacaaacaagcagcttttccgtttggcttttttgaagccataagccactctaacactattaagccaaaagctaggttgaagaagcttttttggcttatgtgaggtagatgtatgactcaactactaaacttaggacattaaatccaccggcttataaatcatttaagccaataagctgacttaaaagtctagcccaataagcctaagcctaaacaaagagggcctaagccaaaaactaggttggagaagcttttttagcttatatgagatagatgtatgactccaccactaaacttaggacattaaattcactggcttataaatcatataagccaataagctgacttaaaagtctaggccaataagcctaagcctaaacaaagagggccttaagctatcattaagcttattagctagcgctgtttacgagctctagtttattcggtggcagatctagaaatttttacaagcctgggcaaacctaataatagagaactacaattaaatccatacaaccacgtgcatgatttagtatagatcgagttctaatttataaagaagacaaccaatgcacgaaattatattgatgaaataaaactcgttaattgttaatgttgaatactagacattataattaattatatgtatatagctagtcattttgctagtatatgtgctgatccactgatctcatccattagaactagttgattaagcatgtaatttgctactagtagtattttactcaattgtatgtggctgaacacctgaacttgtatctaagcatggtaattaacataaactaataactactcactactataaaatatcaaataggtgtcggtactatagatgccggaagtgctaaaaccggtacctataggtcttttaccacctcagcggtccgaaaacacaaaaaaccggcacttttaagtaattataggtgtcggttctataaagaaaaccaacacctttaattaaagaaccgacacctataataattaaatgtgccggttttttttaaaaaaacgacacctttggaattgagccgagccggaccggatgagatatttcttctcccggcggggctcacacccggtggagataaggtcgatttttctcgacttctcgtctctcgctctcgaggcgccctcccctgcgctagatccgacagggccgggaggggaggcgcggtggcggctgacggcatgaaggggaggcgatggtggcccggcaggggcaggaggggcggagacgccctcccctccgccagatccagcaggggcgggaggggaggcgcagtggcggtggacgacatggaggggtggcggtggcggcccaatggtggaggggaggcggtggtggcccggcgacggtggatcctcggggcaacggcggcggtggcgccctcccctctaccagatctagcgggaggtgaggcagcggcggcgaaggcggtgacgtcgacgtcggggggctttggatccagcggcctcttcggatctgaacacctagtgagctgatgattgtctgaacatttgattcaatgatgtgaaaatttgatgaacatttgatcaacttgttgttcattgtctaatgtgaaaatttgatgaacatttgatcatgagcttattgttgattgtctgattgtggattgttttatcttcttttttatttatttatggtgctttgaagcatcggctcagctcaaattgagccgagccggagttttttttgcaaatcatatacctcaaaggtgccggtttgtctaatcagtgccgccaacgtggtgccggttgggaaaaccggcacctaagggggtttcccaaccagcaccaaaggccctttatgtggtagtgactgcacagtacggctacatccggtggagcttgggcacctgccgaggctagctgggccctggctccgccgctgagattattcatatcacctcaacagttttaacttcaacttattatgtgtaaataaaataataaacactagctagcaaagtactaactaaatacaaatagattggaaatataacaaaacaacaagcataaattgatagtgtggccttatatactaagtatacactaatcaagctcacccacatgttgggtcgagctagctagcgagctaaaattaagctaaacttgaccggatttattatgactatgagcccctttaaatcgtagaaataaaaaaaggggaaaaacacgtgattctgataggaatataagtacataaagcacagaattacaaaacacagaaaaacacatgaataatcatttagttagaccgcaagaaaaataaatacagtaatcggatgagagagttaggtagactcaaaggaatttcttcaagaggttggacctcttgctgaatttcctccaaaacctacatgcaatgacccattccatagaaattttatagaatttggaaaactccaatccttcgaattaaagggccaaatagaaaattttctataggatttcaatcctatgaaattcctgcataatcctttgattcaaaggggtcttgtattttaggctgactttgaaactattgatatatataccacttgtgttatagtgcatagcttggtccacatagtatgtttaagctgatctgtaacatcccggcctagggcttaataggattaatagaatactcatatcaacaagttgcaacttcttttccggaagccaatctccaaagaactccagggttaagcgtgctaggcctggagcaatttgggattcgaattttccgggtgcacacgagtgaggacaaagtgtgcagaaaagacatgtgttggtctgtgagggcagtctatgacctataaaagctatcagatataagtgggcccggcctgggggaaggcgggacgttacatgatctccatacgggcccggcctgggggaaggcgggacgttacatgatctccatactagttgatataccacttgttataagctagttgtaccacctgttataatgtgtagcctggcccatagagtatgtttgagctgacctcgaaacgtaccgtgcttgttatagagtgtaacccgccccactaattatgggccacccaagtgtaaagaccaacttgactcgatttattttgactatgagctcaagtatgtttaagctgatctcgaaattaaacaagttgatataccacttgttatagtgcgccggacccactaaccatggatcacccaagttacattgggtctgttccaccatggattcaatcagagtcataactttagatcgtggacttacacaatccaaaagacagtctcatggataagaactactcatgtttgaagttgtgttttttcatcatcaattatcgatatgagatttaacccaacatctcgacacaaacacgtcaacatatatactccatatatatgtatatgtagagacatatatctataactaatataaatattcgtatttttccggtcatcacatataatttcgtccgatttttcgtccatacacaatccgattaggttagagatagcgatggaaaaaaaattgcaaaaaaaaaaaaatcggcagccgccgacgccaccaccgcctgcctccggctatccgggccgccgccccgccgggccgcagccgcctccatgccgccggatctagagaaggcgaggcccggctcgccgcctcgacgccgtcctggccgcagcaccgccggatctggcggaggcgaggtccggccggccgtctccacgccgtccgaaccgccgcctccatgtcgacgccgccactgccaccggatccgccgcgggaggaaggcgagagggggcggagcgagccgccaccgtcgccacctccggcggatatgccgcgggagggaggctagaggggcgccagatcatttccaccgcggccctcggccgttgccaccgcagccgacgccaccaccgccactgaagggagaagagacgggagggagagagggaggtggaacgtcgccgcctgtgggaggaggggaaggggagcgtcgccgccggtcgggggagggggaaagagagcggcggcgccggtggggagggagagggggagcggcggagggggaaaggcgccgctgcgccgccgatgtagtcgtgagagagagagaagaagggaggggaaagggagcgtcgccgccagtggggggagggggaaggggagcggcggccccggtggggagggagagggggagccacggagggggaaaggcgtcgcgcgcgtcgccgatgcagtcgtgagagagagagagaggggagggaaatgatttagggttagggttgccgtccttttatatatgtacgaatcaatcgtgaccgtcgattagatcggacggctgcgaattctcctgcatcgggctgccgttcccgggccgccacacaattgggccacgtgtacgctccgcacggataagttcagttttggtccctcaagttgtccccgaaacttactaaggccctaatcagtttatttttcaaagcaactgatttaattttttaaaaaattacagaattttgtttggaactattttgagccatttaaaattgctaggaaattatgatcaattatttaatcactcagtagattcagtagattgtttcaggtcaaaataattattatttccttaaatattaaattatttctaaaattcgaacatattccactacagattttatttcgatactacaaggtgtgtgtttcttttccattacagatgacttttacctttttccttttgtagcactaaaaaaatgaaaacatataataatagagtgcaacgaaacgtttaacccctcttactagatctctcgttgcaaagcacgggcatatttgctagtacttcatatatatgcatatgtagagatgtggttggatcggataagctgagtgacgagacggggtagcggaggggctgcgattgggtgggaggctgctcgaggcaagtacagattcgcctgtgccccttgtctgcaggaagcaagcagccacagccagccagcgaaccagcattatattcatccagagcggccggatcgattcacgtccaagatcgatggacgtgaatgatcgatggatgtgatgagaggtcggccatggcgcattggcgctgccgcagcaggtgaagaaagaggcgcgcagatggaccgatcgatgcgacggcccggccgtgtcttcacttgcgcacaacgccacagtcgctcagacctgtactgtgtactgctgtacaatactactggaatactcaagcacaggtcgatatatatttggcacgacatcttggctagctgcgtgtgtgttttttaatttggggggcacaatagttatttggaaaattggttgtttcaatgtcatcgaaagttcgcaagtgttactgttaagttttcactcataacgcctcaatgtcattatgtcatgtgtgcaaagacgagattaatattaattgccctcatctctttcagcgtcttatgcatggtcttgtattctcgttgtttctcttcgcgaacgtacccgcagcagccagcgtcagtgcccaagctcatatcgccccgtgcccaagctctcttgcttcccatggcacaagctcgtgtggatggcaatggagggacaccgatggctgcgaagccggtgctgacaccgaactcatcaccaaagaggacatggaacatagtatgggcatgttggcttcgtttgatttagattattgaacggattgttgccatgaattattcgcttgatggataaattgaatattttgaaaaaaaaacttaccaaatactctctcaatttgaaaaaaaaccaatcccagctatgaatctggacacgcacatgtctaggtttataggaaggattgttcttttcttgggatggagggtgtagtttaaaacaagtgatcttagcaacatatctttttaatttggagcaaacaatatgtttcaataatttggtgaataattaaaaaaaacctaagcagaccaaaaaggtgcatgtccaggttcataggattgatggctaaaataatagttatattttaaatctattattgtacgagtagcctagtaggtaaaatatgaaccaacacatgtatttttatgcattgtcgaagcattagtaggcactcggaagcggaaagggattcacaagaaggggaaacattccttaggccgagtttaattcccaactttttcttcaaaatttcaacttttccatcacatcaaagctttcctacacacataaactttcaacttttccgtcatatcgttccaatttcaatcaaacttctaattttagcgtgaactaaacacaccgttattcaatcaacagttgaatataaaaattagagttgtctattccgtgcccttcctttctacccctaccaacgacttaatttcgtacatgcatttatgtccagcgtgtatccctaccaacgaggagagaagctcgatcataacatactagccagagggaggaggaaagtttgggcatttatggatttaccgaagtaaaatgtgacatataggtgtgaattttaaaattatatgacaaacaaagaaacaaaaataagagtatgtcactcaactttatggtcaattataatttctcgtttcttcaatatgcatgtcttaaggggtggaggaaaaaaaacccgcaagccaatgcaaagaccggaccaaactgaacaatagtttcttgttcgtttttttctcaaattttttaaccttcggtttctgggtttttctattggccttgtttgtttgaacccactagtcgagaaaatcgatacgtccctaatcttagtccaccaaccatctggcccaaggcccactcttcggagcaacaaagtgaaacacagtaacgttgccgcctcaactaatttctttgtgaactagtgtacttctttttgggattcgtttgatgttcttgagagccaaagtgagggaaatacatatggcccttgccttcctttcagaaaaaaaaagacacataatagcacaaactaatatccaattcagagtatgaatgacattaccagctagatgctttgtttgctgcatatcctggttcttgatctcaacaaaggcaaggaaagccaaaggcgtgcaaagaatttttttttttgcgaggaagggtaaatctattactcaaatttagcgtcatcacagattatctgtgatataaagttacaagacccttccaaccagaaatcagagacattctccgaccgtgctttattcgctaacgcatggctaacctggtactgactccgatgaatcttcttgacgacgaaggcgtgcaaagaattggaagctgaatcctagctacaagatcaaagttgtcagcaggtggattgtaatcatacgtgcaatcagagggcagctgcattgtgattctgatctttaacaattggatcaacaaaaccaaggaataacatgcattgtgcctgcatatattggtaaaaaagaaaaagaaaaagaaataagaagagaaacctcgatctttcattcataatcaatgagaaattacagttgacagattgcatgttcttcttctcatgcgaagaaatcatcctatctacgagaatttacaagatcgcattgccttccatgcaaaccgagaacagaggaagacatgttctgattcctacaagcttctgattccacctactgcacctactgaagaacactgatcacgatgccaacaaggcctcggatttggcccgcagctgctccttctccagcacaaacatcttcagccgcggcagattcttgccggccttgttcggccgcggggccgcaatattagccgggatcggggccgggcgcggcgcgggcagcttgacgtccttgacggcgacgcgcacggcacggaaggggtcgtcgcgcgggaagttgccgttgtagatgacctcgaggtgtccgtcgtcggcgtcggagacgacgaccgcgctgagccacatgacgaggcgcagcgccgtggtccctagcctccccaccggcgtgcggacgcgcacctcgtcgcccttcttgaaggacatcttgttgatgggcgatcctgatcctgacggcttcttggagaccactctcccctgcgcctcgacggcgagctcagtgcggcggtggatgatcgggcgcgaggagcggggactcgagcggcggggaagcgccatggacgagcgccgagagctgctgcgatgatgggtggaaggaattgtggtgggggcggcgcgcttggatttatcggcagccgagtccgagttcgaattgaagtctgtgaaggaagcaaagcgtggctgtcagacacaattcttcaatccgagctcgactcggaatcggagacgtccgttacgcctcgccaccatcatgcaatcccgaatggcgccaagcaggcgggaacgcgaagctaggtgtgtgtcgccgccgccgccgccagcggtggacaaggagatgacggcggctcagcttccaccatctccatacgtagaactggtcgcaaaaatttttattatttctaattgtatttctacgtagactcatgtttcaatattctttaatttttaattttgaatttcagttacttctaaattgtattcatatattgattttagactctacttcccatgttgttttattttgaattttagttatttgtaaattgtattttttacatgaactctaaactctaattttaattttattatgtttattctgaattttagttagttttaaatttctatatgaactttatactctatttctaatatcccttatttttaattccgaatttcaattatttcttaattgcatttcgatatagactctatactctacttctaatattccttatttttaattttaaatttcagttatttataaattgtatttctatatggactctactcttctcttccaatatttccttttttaaaattttaattctgaatttcagttatttataaattgtatttctatatagactctaatcacctcttccaatattccttatttttttaattccgaatttcaactatttctaaattgtatttctatatggactctgtttttctttttctccgattaatatgagaatttctagtacgtgagagtgaacgtggagactcctttttctatctatctattatatattatatactaaataaaaggccataaaactttctacaaacgctctcaagccgccacgtgggactcctacaaacgctcctaggctgccacgtggcactatctaatctcaccgttgattttcacttaaattggtggacctgtttatttacaccattagattagatctattattaaaaaggtgatagtttttccccttaaaaaacatatgcaaccggtggctgggaaaaggaaagaaaaaataaatgtccctagggaagtacaattaaaaaacggtattgctaaatttgtgtacagtcgaatgttttaaccgtgagatcgtccagtaatattcgtttcaagcacttgaaggctgcaccccatcttacagcttatgcgaaagaaccaactgcacctaatcaagctctaaactcattagcacttcacctccatcgtaaaactaataattatttatatatttatacgaatttacactgtagttacactccacttatatatataattagtatataaatttaggatttatatatgtaattttgggacttacattataaatacactaaaattgcatatgtaattcagggaattacaatgtaaatacataccgactattttttggtgaaaaatatggcgccataaatatagctactccctttttaaaaaaaacatataaagctacctactgttagctggaagaaaaaaaaatagacatctatgtacgataaaataaagcaaaaaaaaaaagcgtactataaagcaaaaaaaaaacgtacttagtatccgtggaaaaactacggtctaaaaataggattttgtataatataaaaaaataaaatataatactacataatatacggaagtatatgcatgtaatcgagatctataataaaccaatagattagatcttgtaattaaattataagaaaaatcaatttaatttgatttatccattatttttaactattaaatctattttttaagaaaaaatcttgagtcaccgtgtgtcacgtcctataaaaagggaaaaaccttagaaattcttagaaaaaatgaaacacctcatcattggctttcacttaaattatttaaaaaagttagaaaaatataatatccacctcctcaccatcacatgtacacaacactgccatcccctccctattgttttatctattaaataaaagagaaacaataaataatatttgatgtttttttttaaacaaagtacaaacgcgggcgctcgcaacgcacgcacaatcacttctgtgaacgcacacatgcaaatacccctttgagtattttgaagagactaggctgatatattttgagattgacgaaatcaccacgtacgtcttgatatcgacgggtacattgcctactactgaaagaatttgttaagtctgaactcgagcaagttccatcacaagaaacctaaccggttgagctacgttcatttcacaataatattggatattaaaacaaccataatttttaagctacattcttggagtactcctatatctttaaaaccggtagaaccattatttctaaccgttagaactatcttataaaaggaaacacaagcgtgtattcatggtatgtcacatttcaaaaatattattgtacaattatatttcatcgttatcgtatgcacgttagcttgcgtggaacctcttacccactctacatgaaatgttcatagatggaccaactctcaaactacatcaatcatattaggctatataaacccatatatttagtggagcttcatgtctcacccaattcatcatcgaataaaccataataatacatatgcaattgaaaaaaaaagaaaaataccttagtttaccttacacttacatttcgttgacatgttttctaaagaaaataagtctaccttcttttcaaatgatgaagaagattataaataattgcttataaatatcaggtaaatatgatactgctataatataaaactaataggttagaaaattaaaaagcaattaatgtcgacgaaaacaatttacgaagaaatcatggtagatgttctatggttgtagatgttctacggttgatattttgctcttataactgtgtcaaacatagtgtacaaaacgcatgcccacgcattcgcgcgggctacattcctagttcctttaataagttaatagatttcccttatattttgcctaactggaaaaaaatccacaagagattgggtacctgttgcgtccagaactatgcaagaatcaagatacctgcataacatctaatcaatatttacaatgttcttcgatgacaagtatgacggtctatcactttgttttgcagcctgtctaggtgacgtaagcacatattcgttgaacttttttttgttgtcgtgagagcagggtgtcattgctacatttatagtttttatgtgcctaaactattcatcaatgtcctatatttgcctagtggttgcagtgacctgagtagcacccaaggttctaagttcaaatctccataggagcgaattttagattgggttatttgagagctaaaaggttctaagttcaaatcttcataggagcgattttagattgggttatttgagaactaaaatattgcatatgtctagttggatgaagagttcacgtaaaaaatacccttctcaaaaaaaaaaaaactattcatcgaggtcctaggtcctatatttgcagtttttaacataattgttggatgtagagttcgggtaaaaaaatacccttccctagaaaaaaaaacttttcatcgaggtcctttctatatttgcagttttcatttttaacattcttagtatacataattgtgtatttcctatgatgctcttctttgtaaagaactcattgatacaaactaaatgaacaatttggcacttctataatctgtacaaatataagcctgtgaaaaacattatatgttcctgaccttagtgcgctaagtgtagagtaattatacatttaacatggattggtcaatttatgttattgatcaattacttgagttgtgatgttaatataggtaattaatttattgatcaattgcttgtgatgcttgcagagatccaaatcgttaacgcgcctgtcttgtgcagtcgtgctaatggatttcataaagggagaaaacagagtctgaggacgaaaccttcatcatgagtgtcataacacacaacatgatctacgatcacgcgacacgccctgcaaggatgcacaaacgttgctccagcaagcgttgcaagcttgagctaagatgcgagctatattcgaggccactagggatgtaagcagtctaatccacaaatctatttataggcaaaattaatgggtaacccatagattataaatgagtttatggatcgatccacttgcatttctagatgcggcaatctaggttacgatgtggaaatccatgggtaaccacttatttgacacgtaagtaagtttgcaggtcggttcgcttgcatggccactattgtcagtgtccaagtcattgatgggccatggtcagataatgttcgagggcaaatcatctgccatatctcaagcgtcgataaaatggatgttctgctgcttgattcacatgtgagggcatagcatggattggctgccaattagcagttgtgtttcaaagctctttagtattatggccctctttatttaggcttaggtttattggtctagacttttaagtcagcttattggcttatatgatttataagccggtggatttaatgtcctaagtttagtagttgagtcatacatctacctcacacaagccaaaaaagcttctccaacctagcttttggcttaatagtgttagagtggcttatggcttcaaaaaagccaaacggaaaaactgcttgtttgtttaggcttagacttttcgacttataagttggcttataagcctaaacaaagagggtctatatctacgtgtatttaccattacctagcacgtgtttggacagttatccggctcgacaatgtttagatagtttttagcataaatttgttataatagcatcgttataatgttaacacacgcttaaagagataaggtggtaaatcactttttgttgcacattagagatagccttatatgtagtggtgattttgacacctaaagttatctttagagaaacaaacgaatgaggattgtttttctttagcagtagagtaaagcattgtgattgtaaacttaatatttgtctcaaacaataccaacaagagagagaggcaaagatagtattgcattgatcatgagataatagacgaaacagatcgctcgtgtatatataaaaaaatcttgatctttcattcataatcaatgataaatacacttcacagattacacgttctcttgcgaagatttccagtaaaccatcctatcacaaatacgagatcactgtgccttccatgacaccaaataaacagaggaagacatgtctgaatcctacaagcttctgcacctactgaataacactgatcacaatgccaagaacgcctcggagttggcccgcagctgctccttctccagcatctgcatcttcagccgcggcagcgacttgccggccgtggtcggccgcggggccgccatgtttgccggggtcggggccgggcgtggcccctgcagcttgacgtccttgacggcgacgcgcacggcacggaaggggtcgtcgcgcgggaagttgccgttgtagatgacctcgaggtgtccgttgtcgtcggcggcgtcggcgtcggagacgacgaccgcgccgagccacatgacgaggcgcagcgtcgttgtgcctagcctccccaacggcgtgcggacgcgcacctcgtcgcccttcttgaaggacatctcgttgaccggcgatcgtcctgacggcttcttccccttggcgtcgacggcgcggtggatgatcgggcgcgaggagcggggactcgagcggcggggaagcgccatggacgacggctacgagcgctgctagctgcgactgcgactctgcgaggatggggtggaaggaattgtggtggatgcagcgctaggatttatcggcagccgagtccgactccgagtcgaaaccaatgaagctagctacgtagcacgtcggagacggagttggagttgaactcggtgattagcttgctgtgattaatggctaatccttgtgaattctgctctatatatacacgcggcattgttgaaatcgcagatttctcgaagcctaagccgaactggtggaggtgtcgccggaggggcagggagacgacgtacggcggctcagtttgcaccgtctccatatgcaaacatcaatcggagaaaaacggaacgagtgaattatccgcttcattgacaaatcaaatataagtccctgtttctttcagcttgggattattataatatagattattgagttagattactataagttagattgttataatctgtagtagaataagcggttagttgtttcttttctagattattagagtctagattattgggtttgcaagtctaaaaagggagtggggtggcatggtgggtaatttttcacccaataatctagaaaaagctcacctaaatgagcttatcatattataataagctgggctccagattataagaagctactttaataagttgtctgtttctttcagtttattcccaataatctggattataataatctcagactgaaagaaataggggaaacaagcttaacaaataacttaaaacaaatgatattagcaatgcagcagaaaatatattgtttgaagaaaatatatcgtttgaagtgtggaataaatagagagaacctacggcttgggcgcccgatcggctgggagcaaaatccggcgctgatgtcaacatgacgtcagcgtccgatttacgtacaaaactattttaaactgatttttttctcctaaattacttatccaaatcatgatccgattgcaccattaaattcgttgcaattaaatcttcaaaacaagactacacatggatatatttcgacgaaaaaaatagcttattattgaattatttttaaatgttgcacgatgttccaccaagtatatcggaattgtttcactaagttgattgaaaatgtttcactcgtttaaatcaggtgttgtttcaccttatataaaaacaatgtttcagcaaatagcgaaagaatgtttcagttcactgcaacattagatctgtacacaatgaaacattattagtacactaggtgaaacatttttcggtggaacaaaaaataaaccaaattcccttaatagggggtttccaaaatatatgggtttttttgttgcaatgggatgtttcgttcactgcaacattagatctatacatagtgaaatattgtgagtacacgaggtgaaacatttttggtggaacaaaaaataaaccaaattcccttaatagagagtttccaaaatatgtggattttttgttgcaaaagagtatttttattcactgcaacattatatctataaatagtgaaacattgtaattacattaggtgaaacatctttttgtggaaaaaggggagagagaagtgagtgggcccaataagtgtgcacgtggggggaggggcgcacagggggagcgcccgatcgggctccccccgcgccggacgcctggctctaatcattctcggaataaatattctgtttcaataatccataaataattaaaaaataaattgagcaaaacatgactagaaatatagatggtcaactgggccgcccgacacagcacggcccacgcccagccatgcctaggctgaggctagtcgggccagcacggcccgaccgacacggccgtgccgtgccacgggcggcatacacggcccaggcacgacccaataccactcgggccgtgccgggccgtcccgaaggcacgatggcccatcgtgcttcctcatagaaaaagtctattattcgtccctcaactctgtgggttgtgttcaaatggctggaaaataagtctattttgtattcctcttctctttgggccttgccttatacagttatttaagtctattttgcatcccaatatttttttatttgatcgggccgtgccgggccggtccaccgtgccgagggtgcagcccaggcacgacccggctgtcgagccgggccggtacgggcatgaccctagtcaggccgtgccatgcttgggccgggccaaaatagtgtgcttcaggccgggccgtgggcctcgggccatatggccatctataactagaaagttaagaagtcagggatgctagtccaccaatgagtaggaatgcaagtggggtaggcttgtgggctttgaggcccccattgtagttatatttttgcatctgtttctgattattaggtaaaaaataaactaacatgtgtgcttttatatgcattacagtgtcgaagactcaaagtgttagtaggcactccaaaggaaaggggaaaggggacaccacgactcttgttcaatcaacaattctctactattataaaaattgaagatgtttttgccggtactttggtacatcatctatatatgagtaggtttttaagttcgtcctcttttggaaatacatttccgtatttgagtcggtttttaagtccatttgcttttgaaaatacaaaaggagtcgtataagaaatctcttttaaaaaaactcacatgctaacttgagatgaacagactcctatttgcaactcatgattttctaaaaaatattgtcagagggtgaactccgcaaacgggggacagtgaggccccccttgttggttcggccgggggcagcgggtgagattcgggagctcggtgagtagtttgacgtagagggggtcaggcccctcaagaatgatgagacaaaaggggtttatacaggttcgagtcgctgagaagcgtaataccctactcctgtgcttagttgatcgtgtgatgatttacaagatttccttattcgagtagaaggtgttgatgataagggggcaggaaaattcctctagtgaaaagggctcatccactccctaagtaggcttggacctccttttatatctcaaggggttaccacatgggctcaccgagcctatctagggaggataatcacattaaatgcatgtcttgttgcttgccttagaagccactagcacgcctgctgtggcgtggggccagccagatctatccggctgagacagggaacacgcacgtctcattcgtcatttaatgagtgaagacttttgggtccttactcatgccgggaaacggaaaccttgcactgaccgggttagacggaccgcctcccgactcatcatcgcgacatgacaggggatattaggcggcacgccgcctgacatgcaactagtatgcagacacactaccctggttacatcggtcattcgaccggtcgtagactggtcgcaatctagtcaggtgcaccacgcaccgcatttaatgcggcgtggtgcgctcgctcacactgccttaaatgggggcgtccacctaacccagcacacgcggcaccgcatggaaggggttggggtagcccgatcccaggcaaggaggggccgccgccgccctgcctcaggccagacccccccccccctcggggagagggccacgtggctaccgggcacggcctcctccctatggacctgatacctccggacccatatcaccaacaaatatatatatccaagcgaattcccacagaatttcaccttaacttaaaaatataaccatataacaataataagataaaaatagtcgtcatcccttgcaacacatggcattttttctagttaatataaaaatccgagtttactattttgtgtcatttcttcgtcaatgttgtctttgccaaggacttatcgtagctgtatttcttccggcttgcataacatgcatggtagctagagggagtaggggaggttggacatttaccaagtaaaatgcgacatatatgtgtgaattttgaaatcatatgacagacaaagaaacaaaaatgagactatgccactcaactttatggtcaattataatatcatgttttttcaatatgcacgcggtaagccaatgcagagatcgaaccaaacagaaccgtaagattttttttattttggcattaattttggggtgggaggctaaggccgtcaaggtggtcacgatggaggagagggtgaccaggctcgatcggctcctcgtcatggccgtcggaaccgctgcggcgctcgcgggctgctacgcgaagggcagcggtgtcagagacggtggtgcgtgagagccggagcgcgccctcaccaaggtggagcgtctcgtctgattgagaaggggcaaattagtacttttcacgatttttctctatcgatctacatcggatataatcaaataaggttttcagtaactaattaccaggcttttgcggtgttctataaccaatttacatctttacggtttcccatagctaattacatgttttctgggtgttctgttgtaatttttgactttacgatacctcccactactaatgatagtagggtggtagaggtttgatcttaccgttgattatgatgggtgttttagacatttaatccaatatcatattatattcgacttccaatttaatttatttgtgcagaacagaccattctattgacctgcacattaatcggcttctattggctatgatcatcgcctgctagctacccatcgtgtggcatcgtcggcgagctcgccgtttagattgatcctctcgctgccgctagatctcacctaattcctatgcatgcaaactgtgtacgtaaatgcacagaatcacaggagcatgcctattttctctccaagtaactcgcacatataatccaatgattagccaagaaaatcatattcgtattacggatcagtgatcagcggccccaccagctgcataagggtttcacagtgcaagcctcagttgccaactagacccaagtccctctaaagtcacatccttcaaagtgcaagttcgttgtagtgggcctcaccattatcttctttttttcaatctttccttcccctctctctcctcgtagttcttctttctcactttccccgtcggtttagacggcaccggccggagcctcggtcggagcagcggcgggggcgatccaagcggcagcggcgacgacgggcagagaggtagtgtggtgacctaggcggcttggcggcccaagcggtgatggcgtcgggttgagcggccagatctagcttcgggcgacgaggtggggggatgatggtgcggcaagctcactaaatccgacggatgcggcggcttgtcgggcacggcgcgaggtcggccgtggccatggcttcctcgtcggcgtcatagccactggttcctcgccggtgctggtgacgagctctgcagccgccaccctgccctcctcacctgcaccgacaagaacctctcctctccgccaccagcccaccattgtctttcctcctcctgctggttccggccatgcacggaactaacgaggctttcactcacccaattttttctgacaaaactgacgaggctctgggtacccaaattggacatgggaacaccatgaaaacatggtccccactccattctctcctccacgtaagcattttgtctattagttgttggggctgaatgccacagaggcgcactataaacgccctaagaaggccatgcaagaatttatacaaatttacttttctatcatgatgctttttccccaaatttgccacttctactttggatcaaaagatatggatggctcatatatccattggagggtcctcttcaaaaaaaaaaaaaactttttctattggtcttgtttgcttgaacccactagccgagaaaaccgatgtcacataaatcttatccactaggcatgacgcatctggcccaaggcccaccagctcagcagtggacagctcttcggagcaacgaagtgagacaaaataatgttcccgcctcaactaaatttctttgtgaacaagagtcaacagactaccactagttcttttggccttttgggcttcgttgatgttgttgagagccaaacggttcgtctgaacgaaaagtgaaggaaatacatat

SEQ ID NO: 83178 - DNA, 1617 bp, Oryza sativa
aagactaacccgactgctctcttgaccctattctgcccaccgacgattgacgggagttggaaacataacacaaaggggatctggggaggaatatgttgggagttgacctcccagctaaggaaaccgagggtggatcactcaacgcttattcccacctgatcgacgctagttgttttcttaattacaaattacccacattgattggtagagcctaatcttttggatttcttttgatctccctcaatgcaatattaacatgggagtatgctcttgttagaataattgggctaggcccaatttatcctattaaatctcaaaggcccataataagtgttaaggaaaataataccacctcaggatttaagcgaggaatatcttaacctaaatagggggttattggaggcttcctgttgactggttgaggtgggggtcggaaagccacgcgcgcgcgcgccgggcgtgggcgtgggcgtgggctaggcgtggctggcgggcgtcacgtcgttattcttttgcaaccacgaacccacgttcccacgactgccttcgcaacggcgcgtccacgatcccacattgcaaccacgaacccacgttcccacgactgcctccgcaacggcgcgtccacgatcccacgttcccactactacctctctcctgatagataaggaggtcgcgagtccgatcagaacgatttctcgggtgttagttcctccttcgtttctgatcgcttgcacgcacaagagattggaaggagcagggcctctggaatcacaccttcgcctgagatctgcaccggtaggtgggtgatcaggtttttggggagtgcttcccgcacgactgctcgtcctcgtccaccatgtctgcgcctggagctgcagacggagatggcgcgcctggagctggagccggagccgcaattctgcctcacaatccagcggagggccattctcggggtatatccttctcctgttgttagcgttgttaatcctgttagtcgcaatgttaatcctgttagtcgcaacttgctatgttcctgttcctgatgttcatgcctttagcatactggttatgttatatgttcctgctcctgatgttcatgcctttagcatgctactggttatgttacatgttgtcactagatcaccctacactattcatgccatgattattgtcttaatattttggattaaaatatgccgatatatgaccatatttccaacaatccaaaaacctgataggtcattttcagtagttggctttgctgctgcactgaaaccacatgcttttgatggtcctaattataagagatggaaagcacgtgcactattgtggttgacagcgatgcagtgcttctatgtttcacggggcaaacgaagtgaaccacctctttctcctgaggaagaggctaagttcgaggcttcggattgcctgttctgtggagcattgatcaatgtactcgctgacaacatagtggacgtgtacatgcacatgccttccggaaaggacatgtgggatgcacttaaggccaagttcggagtttctgacgccggcagtgagctgtatgtcatggagcagttctatgactacaagatggtcgatgaccgttctgtagtagaa

SEQ ID NO: 83179 - DNA, 1750 bp, Oryza sativa
aaaccatattccgagcacatgttcgtcccaacttgactcacattagtaaggaactatccaaatccgacaaaccaacccgaaaccaaagcaaatctagaacctgccagtcagaccgcggcctggccggtctgaccaccgcatgacctgcggtctaaccggtggcattcagccggtctgaccgccaggggtcaaccgtgccattacttgacaaaatcaaacatctattaatcttcgaaatcgcatcataagaaaccaatatttcacacatgaaatgtcacaaaccaccaatattttcatcacacagaagctaaatcaactccttgattttacatatataatctaagttagcgttgatatctaaccctatcggctgccttctaacaataaacgtttgtcgattgaaggttagatagcaatattgctctagattatatagaatatatggataaatcagcagcttacatagacaatattagaatgtcataaagatggaagcactaatcccgaaaacacaagccgccataacaagttttacctcgttgtcagagatcgaactgatgcagcccaactcgaaagcaaaaacttatcgaaaggaaacgaaaacgaaacaagggcaatgcgcccagaatggtaatgaactgatcggtcattgattacacgggtttgggcttacttttatacccaaagtacatgatatgtccttgtcggacacaactcctaactctattacaacttaggatacgaacaagtcgctaaggcagactcttaatgacttcaaagtataaggaaattacataaaatatcctaattaatagatacaattgccttctcaggactcagtccgtgcgtggcaatccatatgaagcatatcaacccgatccgacaacgtttccaatgccatattgccggaatcggctccatcggttaccttgtctgactcgaactctgccgatttaggtcgcagccgattcagatttcagccgatgcgcactctgtttccgaaaccgctaatcccttttattccacttcggttttatctttatctccgatgtttgatttaccaaatttggttgttaacacatgccccccaagtccgaaatatttccgggtgttaacgtaatgttgcggattttccaaatcttatctctagaaaaatctaggcttgccttttttgaccgttaccacaccactttaaatattaatcgtcacccccgagaaaattcacaccgttacttccgttttctccgctcaagccacatctgtctcttctctctccggcgatcccctcgatgcgcttggcgattccataggcgatctcatcacagcgacaacctccgttccggcgatgtcgacctctgctggtccatcaagcgccccatcggctgagttccctgaggtaagtttcggtcgtctagatccctttcttttgcagtagattggttctttccttgctcaattcgccttccttttcttttcttctgtagcaatcctctcatcaaatcgcaatcccgagtttaacttaccccaatcagtacttcctcggtcccatcggcaatctagatccaacatagttcatcaatgccgaacccaagaaaatcccttttaggctagccagccccaatctaggaatctggaaaaacaccatcaagtcatggccatcaactgtgaaaagttggacggcttggtataagagggtatcggctagcaagcaaggccattgggaagaaattgggatagcacaagctttagc

SEQ ID NO: 83180 - DNA, 1403 bp, Oryza sativa
acaatcaagctattggaagcttcatagagtggtagatatcctatataatctaagccaacgtcgatatgtaacataatcggctgctccctagcgatagatattagccgactagaggttagatagcgatattgtcagagattatataagatatatgataactcgacaacttacatgaacaagattagagtatcataaagatgtaagcactaatcccgagaacgcaagccgccataacaagttttacctcttagttgaagatcgaaaccgatgcagctcaacccgaaagcaagaactcgtcgaaacaaaacgaaagtaaaagagtggcgatgcgccgagattgttgttgaacgtgtgttgttgtattacatggtgtcacaccctaaaaatcctaaatgtataaattgttgtttaattggaattattagaatttattttaaaagcctagaagagaagagctaattttaattaataaattccaatataaaatggggccagataaaattttattaaatactttgcttaattctataattcctagatttttctgggatttatttgagctaaggaagtatttttaataaatggaattgcatttcatgaataatttaaattgaaaaaggtttttaaaagtcttcttttggctttgggccatcggcccaaaaccctctctctctccccccagcccaagtcggcccagcccgcagccgcagccgctcgcgcgcgcgcgtccgcccgctgacaggtggggcccacctgtcggacccgtcatctacctccggccgccgccgcccgaaaccctagcgccgcgccgccgttgtctccttctaaattcggccgcgtctttcccgatccggtgaaattgattgaggggaaacaatcttcgggatctcctctaccttttctcttttggaatcatcggctaaaatcgtttggaaatccgtggattcgaggtcgaatcggatcggtctctttcctccgaaccccgatctttccttcgcgtcgccggtcgccgtgggccttcgccaccgccctccaacccctttaaaaggatccccggtgtctccgctacccgtcgccaccctcgccttcgtctctcgccgtcggaagcgccctagcgccgtgtaacctcgtgccgttgtcgtcgccgccgctccagccgtgcgccgccaccgttccggtcgtcatcgtcgctcggggaggtcgccatcgtggtcgccaagttgccgccgtccttgtccgccccttcgccatcgctgtagaccgccggagcaccgccgtcgtcgtcgactcgaagaccgtcgccgcttcttcctcatcgtcgtcgccgtccgttcatcttccgccgacgttttggtcatcggtgagttcgccgcgtcgcgctctacgtcctggtgccctccgtt

SEQ ID NO: 83181 - DNA, 1512 bp, Oryza sativa
attatgtatcaaccatgttgcctcacaataattgtgtcgataagaacatgctttagcgataagtatttgaattcatgtgaccagtcacaactatcatgcactcttaatagcatcactacacactctagcaaactaaataaaatagagtaagtgaattttaaagaaaatatgattgttcaacaggccacaacaataaataaaccttagtcttgttcatacctgattgcatccttggaacatgtttagtttcttgacaaggggcaagaaaaaaatgtggcgacaaaagacgacacagcagcaaatcctcgtgagcaatgccaaattgatccgatagagaccacttgaaagtaatctcgacgctttactgttactacaaataataaagttctccatttcatttgttctcgaatccttgatattaggccatgatttggcctgagttgtttaagtacgcatgtaattgtagctaggagcttatcttgaaggcccatcagtgccataacagtttctgccagccattgatgcaatggccctatgagcagaacaagcatgatcatttttctactccctccatttcatattataagtagttttgacattgtatcgatctaatcagatttgtttaagtttgaccaagtttatagaaaaaaaaatatagcggcatttccaatacaaaacaaatatattcgatattatatttaatggaactaatttggtgttatagatattgctaatgttttttaataaaattggtcaaacttaaagatatttaactgaaaaaagtcaaagcaacttattataatatgaaacaaaaacagagtactaaaaggaaagtactagttgtcttcctaatgccattgaaccagtggtgacactaggaaagacaattagtgctcataatttgatccagaaattaaaccggtcgcatcggtggacaataatcagcgccagtgttcttcctaatattctctcttatgcacgaaatacacactaatggatcaagcattatcctatctgatttttcggtgaaggggatttcgaatctactttccttgcggtgggtaggtagcgaggaggaaggacgaaggagcgcgccgcgcgcgtacgatagacatggggtggggagagacgggctaacctttgccgccgccggcgatgcgatcgccgctcgaacaccacgcgaaagggagggagagaggcagagaccggacggctccgggcgccgccgccggcgggatccatccatctccggcgggaacaaccgcggatcgaggcgccgagcaggggagcagcgagagagaaggcaggaagaaagggaaggaagacgagcaaactcctcgcgaaccgctacagggagatttctttggtaaaaaaaaaaagtaaatttcattttggccatatatttttacccatgttacagcttgggtcaggttttagctgagtttttcaccttggaccacttcatattaccatttgtttcaacctggaccatagccgctcgtcttctccgag

SEQ ID NO: 83182 - DNA, 739 bp, Oryza sativa
ggaagtttggcgctctcttcgatttctacctcaacgagtgtagctttccatgaggaccggaagctactcactcttatattaaatctctaagctaagtggaaagagtattgaaaagaatctattcctatacttctagtatacatagtgtacatacatcctaagtaatatgattaactagctaataccccctttccgatgccatcctggtagttcaagaagccacccctgactgccgagttcctttggacagcccttcatgaccatacaaccggggctaaatacggaggagtaccctccccagggaatgaacttaggattttatacacgcgcggaggaatacccgcactgagctgtcaccatcagcggcccacattcatccgcagcatataaccccaaataatgatacccagtaatctaagcaccacgcctaaactaccaaatattactctaatatcaccatcgtgacatagagtatttgcatatgcaaacattatacccgtaccaatgcatctcctagataagctagcagtataatcataatatctcggacatagtgtaaagctggtatttatataatcggaaagtattacaattccatagtcgtatacagaagaatattctaaattaaatactagtcttacaaaagaacaaaggaaagtacctagagccataccggaactcttccgaagacttccggactccgcctactattctgttcttactccactagcttgagagc

SEQ ID NO: 83183 - DNA, 2137 bp, Oryza sativa
aattgctaaaaaaccgtcacagcaaaaaactttgaaatttaactataatattgttgtagtgcaactataatataattacactatagttacattataactgcagtgtaactatactgtaactatatggtaatttttatataagttaaatataaaatcgcatatattattttagtacttatatacaagtattttatagttatagtatagctatagtgaaattatattacaattattggaattatattatggagtagttatgtgcagtttttttagatagtcccatgcccgatggatccaaatcgaaaaaaatactaccataattgaaccataaacttattttaacataaaattatatatcggaatttaagtgaattatgtcctaagtgtaaaaaaataaaaataaagtaaattttatgaaaccccacataacatagttacacaaaatcaccgggattttggcacgtggcacgtaaccttatgtattttcacaaaaccacactattgataaattttgctcttatctatcacactttgagttttacaaactcatctcaaaaccacaacgtgttttgtccatcgtataaatattacatccactttttaaaattttaatatatgagtacatcagaatggttaatgttatggttttgtgaaattttagaaccataatacccaatttgtgttgcatgttaaaatctctatggttttacaacttatgtaacctgtaacctgcatcatgataggtggagttttctgaaatttactcgaaaatttatatcgagcggaactttattttcactactacaatacctattttcctatgtgggcattttgattatctcgtgcagtagtccggcccgtctgcagccgggcgtctgggaaaatcggcatattcacgtgcgggcgacccaacttcacgggataatcgattatctcgtgcggtcgtgttataccgtcctcacggaacaaaaaaaaccaaaaataaaaaagggtgaaaatcgccgccgcccgccggatccgggtgggggcccgcccgctcgccgctgcacaggaagggaggcagtggtcgacgtgcacgacgaggacgacctacaggagtaggtccgccaccgcgcccggctcgccacctcgccagcccgacagaggggaaggggaggagggaaagagagagaggggtagttgagggagaataaaagggaaaaagtaagagagaggatgtgaaaaatttgaagtagatgggagggaaaggagggggtatttttctgtgcggtccacttaaaaagcctgcatgggaaaatcgattttttcgtgcgatcggattaggaggcccgcacggaaaaatcgattttcctatgagggcgatagccccgtgccggttcctttattttcccgtgcggttccacttatgaaccgcatggaaacaaaagggggcggcttccaggaaaatctatcgtgaagtagtgtttactatgtgagctcgatgaccattgctacatggtcccatatgtcagtctcctgtttcctttctctctacctcgcggatttgctcctcgtctttctccgctctctcgccggctagccgctacccggtcgccggcggcggccgccggcggagatggatgctgcgggcggcggcggctctagccgtcgttcaccgggagccatccagtccgcttgtcccccttcagccaacggcgagcgacgatggcggcgaaggttagcctgtgactcctcatctccccctctctcaccttccctccagaccaaccgcagaggaagtggattctgaatccaatctgtgcaaatcagataataaaatgctactagattcatttctgtctacgaatttctcgcaaaagagcgagaaaattgatccccaaaatagatactctgtatagtgactcgatccgatttttatttctggatcaaaccatgagcggccgatgtgccatgccatcgctggctcagtggcattaggaagagaattagtggtagaaaatatcatttcttgtgttgtattgatatatgacctcattatcattatcagtattagtatcagatgagcgttttatcggtttaagtgggtacagtactagctcccttggtaggctcattttgtttgttttccccgcccgtg

SEQ ID NO: 83184 - DNA, 1441 bp, Oryza sativa
tttttagaacaagtaataataagcaacagtgcacacggaattgcagagttccatggaatgacggaattccccttgcttagtttgatatttttcgcaagaactgagcttgcgcttttgaagcaacagtgtagcacaacttcaaccaccatggtggttaatttataagcgtatatcatctgcatgcaaacatatgggtgaagtgaacaagtgtgcaaatgttttgaatattatcactaataaaatgtgtagtaaaaaaacaattaaagacaagtaactggattatggattgataatggaagtatggaccactctaaggtagatgtacttacttctatgcccaggttttactggaatattgacgcctttcagggatctcaattttcttcagagaagaaaatctctggatgaaatctggcaacttcttgaattctttgcagtcactaaccttcaggtattcaagagtggaagcagctgatgcaaagctatctggaaaggtctcaaactttggaagccccacaagttcaattgatttgagactcttcattccacccattgcttcctttggttccatcaaatttaactcatcacagttatgaatcaccaatttctgaagggtgactaaccggttcatgctagaggggagagagggcaaatttggacaattgaagacaaatagctctctaagtgcactgaggctgccaaatccttctgtcagtgatgttaacattgggcaggcactaatctgtagaaataccatggaagtccaacccatgagggcatcattaggaagatattgttgcttagatgtgaggattaagtacctcaagctgacaagtcttttaacatctcttggcagctcctccagttctttgcaccaagcaagttgaagtgtttgcaaattcaccagcttacacagagaattgggaaggtatttgatcttcatattccattgcagatctaggtatcttaggtgcttcaaatttccaattgaacttggtaactcctcaaactcaacttcagagaaaaccaagattcgtaggcgtgtaaaggttgccaagagatcttcaagaaaggatttgctcacagtaccatagttgtgcctactcgcaaatgtccttgccttccttgcccttctcagttgttttggaaattttaggtcctttgagaactccttctggtcccacacaagatgcttaactcttttggaggcactaaagttttcacagctaattgttgcatgctcattgggagatacagatattgctaggtcatgaacaaagctatgcattttacaatgtgagatggtgccatcatgactaaaaacatagtcttggaaaagagatctccctgcaagctcactaaaatatctctctcccattcttattgcctccttacttccactagctgtattcaacagacccattgccatccaatacattat

SEQ ID NO: 83185 - DNA, 20417 bp, Oryza sativa
attcctgcacccctgaaagaatgtacaaaataacgcctgcactccatacatcaatctctttaccataattccgccgaaggacttcaggagcaacataataagcacttccaacaatgtctctatacatttttcctgatatttgaaggaagtcaatatacatgaacaacaggatatatggtatgcaacaattatggtttagatagtaataatgatagaaatgttggaaacttgggatattataatattgatcataaaaaatatacatagtttgtcacatcgaattctatttggttaatgaatcagacaaaatacaaattgatgaaggctggtgcttgcattttaaaaagaacatgataaactgtcaagataaaaaatgtgaatgtaaagagagagggaaaatggctcagctcacacacaatcacagcgggccaatatcaattaaataaaccctagatgataactgggaaggattacagagaatggaaggtggttagggcttactacacattccccacacaccaaatatagaagagagtatgccaaaaaatagagattacatgctatctttgacaaaaaaaaaatcatgtaacgcaaagctgtaaaataaatcatggcagtattttgtattcagggtcggacatgcagaccggcagtgatgaaaatgtacaaggaaagaagagaagacaggaagttaggaactatctctgcctccatcacatcctcatcactaccaccataccatgccataccactaccaaaagaacatcattatttggtaactagtcatgtggaaaagtttccatgctttccccacatttgaaaagcaggaagcttaaagcacatttaggtgttatttgcaactacccagcaccagctaccagcatctgcaaccccaccaccaaaatataatactttaaatttgttcaacttagttttcaggtagcataaaagctctaatatatttgtcaatgtgtacaatagttatacacctccccaaaagtaacagccagtgacaactagtttgctatcatttacatcccatttgcatctttccactacttggagtcgataacaatcaatggtcaagcagtcttaacctcagtggctagggaggactttctcatatgagctaatacaacagatggtgcttgctacatcatcctccatgcctttaaagaatgaataccttggaatggcactatggcagtaataataacatggtgctaataatttcattttaccaataaattttgtggaaccatgtcatttatagaaacagatgtctcatatcatacaaagatgcagatattaggttgaaggatacaaggataaatatagatgttgtaacgaccaacccaaaaacagcaactttagctgtctctgtgaatcctaagtaggtttgtgagacaacttagaattacgatatgattcaagtcacaaaacggtggcccataacataccgtgataggcaaattctccataattcagaataaacaaaatgaaaaacttttcaaactagaaatatggccatttatgaaattctagccctagcaatatagcctgtacagcagaaggtgtaattctcaagcatatgcatcttaaattattcaagttaccttcttcaatgaaaactgagagaccaaaatcagtggctttgagcattgcattctcttctttggttgcaagtaagaagttctccggttttaaatcacgatgcatcactcccataaaatggcaaatgttgacaacattcaccactgccctgcagatggtagcagccgcacgctctgagtagtgccccttggcaatgatccgatcaaacagctccccaccagcgcagagctccatgacaacatggacattgctcttgtcctcatatgctccccggaactcgacaatgttttgttgtccagataggtgctgcatgatctgaatctcccggcgaatgtcctccttgtcggccttgctcacaagcttgcgcttagagatggatttgcaagcatactgcttaccactagcgatctccgtgcacaggtatgtcaccccaaactgtccccttccgagttcctttccaagggagtaaaccgagcgcacatcgtcatacggctttccaagaattgtgtctggggtgggcttcggtggggcaaccacaggtgggactaccggagggttcattgctgatggtgtgtacctcacctcagctggcggcggcggctgaggatggttatagctaggagttgtctgagcaggttttgtctggtgagaatagccataaccgtttgctcctcctcgaccagaatctggagacgtagctctgctgcaacacgaccccatttttagtcaaattctccctagcagttgtaggcttgcaaatttgttactccgcaaacgagatcaaccctgcaagcagaacccaagaaggaacactttatgtcagaattaagcgagccaattaacaaagatttgcgctgaatcaaaggactagtgtgaaaactaagcgaatccaaccaacaaaagattcatgcacaaactcatccctccgcagaagcaatgaaagaaaaaaaaaaggaaaaatgatccaaatactggatctaccagcaaaccaaacaataaactcaacacacaacatcagaaggggaaaacaagcaacgaaaaggaaaagaaaagaaatgcctttgacagcatattgacctcaatctactcccagtcacagcccaggaccgcatgaaattcgcatgaactgaggaacaaggtagatggcgagtccccctttggtgacagtggaagcaaccataggagataagggcacaagggtacacgcaaattgggcaaaaggagacaaataaagcagcatctgaaagcaacgggaccagcaaggcacccagcggcaagagagagagagggggagctaaaccactcacgatcgctatcgtaaaaattgatcctttacacgaggaggaagcgataataaacaaggtacagtgaactagagcttcgtcctctcgtaataaagaaagaaagaaaaaactgtaaattcaccgattacttgttcggtaaaaaattactgtctgcatcagaaatctactgaatccaagaacataacccatgaaactgctaaaatcgagcacttgtggacatgtgaggcgctccagtagctttgcaccgctcccagatccaaaagggccaagatttttctcacagttggatcaaatcctcaatcactgaacctccttccaagaagaacagattaactcctaataatctctgcaacgaaaaacaaatccgcgagactacaagcctctcgaaccaaacaaaccaagaaccgaaaaacagagagacgcgtacccaagcgaaaggagggcgcctaacctttcccaaaccaaccaatccaacaatccaaggagcacagccaccgccccggtagtgtcagctggtacaagaatccgcggtggcgcaagaacaagaagaaggaagaatcaaatctcggcgtgggggaggacagctcggcgcggcgaccgcgtggtggtggtggtggtggtggggggggggggggaggtggatttggagctggagagaggtggtgatcctcgatcgtgacagcgactactaatggcgatgcacacggcgcacgaatcgggagaccacgcgaggaaaacaatgaggagaaaaagaagagcgcagctgcctgccagctgcaactgggtttgggtttgttgagaaagaagaaagaagaggaaagcttgcagtttcaagttgcttcctgctctgctcgtgtgtttttttttgcagttttggtcctcttggagatggaaaaggatcaaaggaaaggagtggtagttttccataagagtccctctaattactactccctccgccaaaaaaaacaaattaggattagatgtgatctattctaatacaataaatctagacatatatactccttccgtcccaaaaaaaaaaaagccaatctaagagatgtcacaacaacgaatctagacaaacaacgaatctagacaaagagatgtgtagattcgttgtactaggagaaatcatatcccctcctaggttggtttttttgggacggagggagtatgtccagatttactgtattagaatgtattacatcatcaagtattatgttggttttttatgggacggacgagtagattagttctatagaaattaggactgtggttgagcagattttgagaagcaccagatagaaaatacctaacttctagatatcatcattttctacggggaaaagtccaaatatcccctaaaaaattttgggtggaactgtagaagcccacgcaaactgaactttgaaatcgaacattcaactcagtaaactttacgacaccatttatataactccataagatgtttttgcacagtagtgtttatgttcaattacatgacatacacattaaacatgtatattaaaatctacacttagatctttctttttatcccttgttagctctcacaaatacgaacataataataatattgatatcattgtataagtctaaattatacaacttgtaactgataatatgcaaaatgttatattagatattcaaagttgttcgattaagatttcaatatatgcaaaaccaccttagacggtaatatgaatggtattgtaaattttagggggttggatgtccagtttaaagttcaaggtactagatggactttcatctaaagtttagacggtaatatgaacggtattgcaaattttagggggttggatgtctagtttaaagttcaagaaggtgctagatgaactttcatccaaagtttagaggagtatttagatttttctttttccttttctatattatataactacagtgccttatataatttaagacgagagatagtccctcgtcatttgctcgacggtaaagctctggagaaaataaacgaagaattacaaaaatatgaataaaaattttctagatgttgttagtgatttaaaagctaatataaaaaaataaactatgatgacaagtctgtctttgttttattattgcttacgagacaagtaaaaagttcatataaataatttgtaaatatcaatctttaaaattcgaaattgcttgaataataataataataatataaaagaaacaaatgtggccaaactacaataaatatatattgttgtatccgacaatgaagtataatgaaaaagaaagaaatgcagcccaactacaataaataatacattgatgtatccgacacatactacattaaatatggagtactatacattgtcatatttgttgtgtgtgtgtgtatatatattgttcttttctacagggaggggaactcaacatcacgtatgtcgatgaagagaatacaaattgcaaatgtatatgctcgttggattgggcttgcagttttgagtcactcggcctgatccacgcgagcagctcagcgtatctgctcgtgatggggcgataccaagcacgtgcagggtgcagcgcatcagtggcggcgtgcgtcagcgcatgggaagcaccgcctcggtgtcctataccagcaaagcctatgccatccccaaatagccgcacctccatagctctatccatggctttgtgcttcagcaagaagaagaataagagaggaaggcaaatggtgtgcttgtactcgctgtgagtttaatggcggcaactacacactgatgtgaagacgaagatagagagtttccttgacatcggaacatactggacaagctgctcacgtcgattgggccaaagctaaataggtgactcaaactataaactcagtccaacttgcaatgggtggtaaacataggtcgtccaaagtgaaaatatagggttaccatagtccaatgtgccactttgatcattttaggtggaccaaagtgaatatttactctaatactattaaagttgtaaacatttgggtaatgcaaaaattagattcaattgaagcaagcccttcatttttacgttatccttttttttccctcaattccacgcgcttttggagtttgcagttcacagagccctagctagattaattaatttcccaacaatcagcggtttaagccagaaaatagttaatttgcttcgtggcaagtggcatctttgatggcactgtctgctactgcacttaattaactactagcaccacgttagtagttgactaggcgtctagtgaggatctggtggtttagttgaaggtttaactgtttttcacttaatattctagctgacttgaaagatatgggaatgttttggttagatgaagtagacgtcaaaaaaatatctaaggaattttcctctctttttccttgtgttgaaaggtacttgtaggagaagatttggctcttttttttcttttaaacgtgtgctaaggacgcatcaaggtagttatgcgtgggtataagtttgatgtatcatatatgcgcgtgagtgtatatgtgagtctagctttactctaataaaaatccaaccggaataaatagacattataattttcataatgtgatatcatctttattggtttttctacacaaatttgctataaatatttactcctagctggacattgacaagatcttcaaataaaggctaatgtggtgactattactagtgtaataaattatatataccattatgaaaattattttcaagacaatccacacgagtatcctgtacgcatcctaagaattttaaaatatcaatacttaaagttttaaaaaaattgacgggataaataaatatccaaaacgaactacagttgtacccagacaggatatacaacaacatcaattacttttgtccacaacgttgaaggaaaatgctggacgctgaccctttttttaatacgcatgcatgtgccactacagatgattacgcgcaatcatttccatcaatctacatcaactagcctcgatctatgccgttaaacaaatgtggaacacatgtatataaatgaagcaatccaatgatatactcctatataggttttgccatgaaaaacatatttttattcatgtttgatttatttagataatggaattcatttccgactttgcttcgaaaaagttacagacttcctttttacgcagctacagctaattattacatagagtacgtatcgaataactacgaattataaaatcacaacttgattaaaaacaagaaaactacctatactacgtgcctaaagataaagatggcaaaaatatgaataaccattgtttatcccaataacttgcaagttacatgtagtcttgttttcctcgaatcaggaaatagtatcttcggaaataacaaccgatcattgtaccgatcgaatttcgctggcatcaacgttacaaaaaccagaacaaaagatgatgttggagagtagttgtttttgcagatcttaccaccaccctaaccatcaaattgatccagcaagacatcgccaccgaggacgtcgcactaatagggggatctccaacacgacaccttcaagaaggtcacaacatctagggtgtggttgtctttgtgttttcacctagaaagtccatgccaaagcacgaaggaagggtgtcgcaacattgcctcaaaaaaaagtgtggcgcgcacgggcgtcaccgatgttagtcagatactgccatcacccttagattaggccatcccgattcatgccgtagttgaaggcatgttggtgccgccattgctagagaactgtgcttcaaccacacgacgtcgtctcagccactcacatcgctgccgccaccaccggcaccaacgaagagctcagccactaagttgcgaggtcaacagtaaatgattttgtaatgaggaaggttaaaagtagaacttagtactctgatcgtacgtactatatccattttcagttgatcctacaaaatcttaggcaatatcgcgattctatttattcctacgatcctaaaaatatcatttatgataaagtgcatcgaaagtaatatgaataaatatgctcaaatttacatatataaaaaccatttaaatttatcaaaatcaatattatatgctttaattgatacaacatattatatattttatattaaaatatgcacttccaaaatttgatagtatcccaatactatggtattattccgatcgtatggtactacaaataaaatatgatcatatctagtatctcgatactgattaatttggctgatcacatcatttggttgatcactaaaaattaatccgttcatcccattaagtacaattaaagttattttcctcctctcttattgtgtcgcatcaactcaataaatttcattcattagatctaagtttagcgctattgcccaaaagtatatttgctattaacaattggattcaagcagcttggacaaaattccaatcatatttgcagaatatggccagtactggaattaggttgtagtcattggtagaacagaggaactaattttctacgtgcaccggagttttgaaatgctagcgcgcgctccacctcagctgccgccggcgccccagccagcggcgcccatgctactccgccgcccgcagttcccaacgtccccctcagcggcctcctggccgtcggccgtcgcagccccgaccttcagcgcgccaagatccaacggcggcgcctactgggagatctcgccgccgccaccgcctccacatgtgcccggcccggcgtctgcccagctccggacagtactacccatgtctccgcgaccccagaaccagcaacacgccgcccatgttccttcgctgatgcagtacgcacttctccaggcgccatccttagcccgcctgctccccaaccaccgacgcgcccaacattgaagtccgtctttactgtgccttcgccgcgacacgacgcctaccgccgcgcctacgagctggatccgagagagcggagggacatcctcctccctagatgtacgacgccgagccctgcattcaagccgcgtcctgctttcatgccggccgagcaaggatggacgaaggtaaagcctcggcgctggtggagagagaaggggcattcaagccagagccaacggcccgattcaaggcgacaagacggcgccggacatgcgcctggaagaaggggcgctctctccctggaagaattcagagcaagaaccaggggacgctgcttcgtctgcctggccagcgaccaccgggcatcagcgtgccgcgaccccccgcgttgtttcacctgtaatcgtactggacacagggcgcgccattgcacttcccctcgcctcgcccaccgcccgccgcacccacccaccagatcagctcgcttgccaagggcagcttccccctcgtcgcaccactccaccagagctgctcgtgcctcaccaagaacaagcagatctcgcactccttgcccccaccgccgacatgccttgagtgaccgccacgacaatcctccaccacgcagagagcgccagcaagcgctggcccttcgcgctgccacgccgcgctttccgctgctgcataatcgctgagaagctgctcacctaccaccaccgccacctccctccggtgtgatggcgcaactgggcgacccggagacacgccccctcgaggatgtcgttttcatcccgacatcgcacgccatcgacggggagttgcgcgagtgggagagcacagcggcggtcacctaggcgatgtgtgccccgccatctgtcaccgccaaagacgtcgagcgcaccatcgccgacaagttcggccttcgcacaggggagctcgccgtgttgctccactatccagaggccttcctcctcaagttcaagcaccgccaccattgcgaggaagctgttaagcaggcttcgccaagggtcggggaattgaagtccacttcattcaatggcgcagcttgaagaacgccgccggctccgccctcatgtaccgggtcaagctatgcctcgacggcgtcccgatgcatctttgggcgcctgacatcaccgagcgcatcatcagccggacttgtaccctggagttggtggagattgatctggtccaccccgtcgaagccggcgacatgagagtgaacttgctctgggcatggactccgaatccgagccgcatccacaagcgcgtgtggcgcgccaaacccgcgaccctctcctcgaatcgatcacgattttggagatgccgccggagcactggcaacagggggtcaagcatctagtcctcttccacatcgaggagatccacgattacaccgcggtggccgtcgacctccgcaatcctaagtcctgcaggccggtgacacgcactctgccgtcatggcacttgggcgttctggacggtgagcgccccccgccgcgcctctttgaatatttccctcaccatctgccgccgccgctgacctataccttccgccacggccgcgcggaaggcgtggaggacaatgacgctgctctccaacaggaggctcgcgaccaaggaagcagaacagtccgggacgccattgatcgtgatggtgaacgactccatggcgaggaacaccgcgacaggcgccacgacagccgcgataatcgtggcggccaagacaggcgcagaggccgtaacaggagatacaacaacgatcacccagacgatgatctccaccatggcgggcagcgcgacaacgactacgacgacgatcgcgataacaggggacgtgatgtcacatgcgggcgaggtggcatccgcggcctggacgttaacttccggtgcgaacgcacgcgctcaccgcgcgcccgtgaccgtggcgacacaaggcggcgcgacgggcggcgtcatcaggctggctgcggtgacaaggaagacagggacaatgactgcggaaacggcgactccccccaagcggccctcactccgaccgttgcggcatcgtcctcggcacggaatgctcacctgacatcgcccccgttcgacaaggggcctctgctcccgccgcgtcgtccgcacgatggagcggggtatgaagcccggtccgctgcgtccatcccggcggcgcgggttttcgcccgcatcaacgaggccgttgcggcagcctcggcggaaggggcactgcggcagatgctagttacggccggtgtggcggtggcgcttgacaagctcgccgcgccggtggcgctcgacaaacccgccgcaaatgctgcggtgccatcaccgatggtgacagccatggcgtcgctggcgacgatcagttcgactacaaggaagctattgccgatcgcgtccacagaaaagacgctgctgtccctgaacgctgagtgcgctgcggcgccaactcttcaagacgcgcttgcgacgaatggctcgtccccggccaaggacaccgagacagcaccggcgcctgacatcgccgaattcgactccatttaggtaaccccgccacacgtcctcttcaaagaacttcccccagcaatcctctccacgccgcaggtgctgatcgacatcgccggagacacgcaggtgccgatcccccctgatgatgcactggaggtcgttccaattccagtgactgctgacatgctgggtgaaggacggcagaggagtccaaggctggcccgacagccgatggctggcctaccgatgtcgctgcgggcgcagctcaatctctgccggcgcctgggtacggttccaacggaaggagtcctcaccgacaaggcactcgccgacttcaaagcgatgttcaacaagacgcaatcgacgccctagtgcagctggtcggctttgacaaggaagacgcgaaggcggcggacatggctctggcgaattacctaggcccctctgacattggctgccaggaggagattgctgcggcgtgagcaagctgtgctctgcgcaccggcaaacggagtcctctgtctccatgtatcgatttcctttgcttccttcgtatccgcgtgagactcggacgcgcgctaccgttaagaggggcggcatcgccagacattgctactccgctattcgcagcaacttcgcgaatcagcctctccctactcggtgccgcaactccgcacccaaacaacatcgacaatgttagccaattgtggcgatgacgccagcaaacccccacggccgtcatgcctcgctgacggccagcacaaacgacgcaattctaagggcgccaacgatagcactctctgcgattgtcgacgactgggctgctgtttcgccctcacgtctcctcctaccgccctcgatgctaggtgtggtacaaaaacggcgctgccacgggcacaacgtggggcgacgcacagcgctgcaatacgcgcggctgtcatccccatcagtttcgccctccacctccagcatcaggcatccccggcccaagtcttttcaggccaaggtcttctcaaaccggcccaatttcctgggggccctcaacatgtcttccggcctaggctcatctccccccggctggacttcgtgcaaatggactcggcctcggtccatgagccagatcgaccaactagattgggccgactaccttttagcctgatagcaccgacacggctgtcacccctcggtttcgtgcacaactcccccctgagaaatactggttacacatgacatacccgatcatagacatcctctcctggaacgtccgaggtttgaatagaccggccagaagagcgacaatgagagagactcttcaagaagccaaaccccatatcgcttgccttcaagaaacaaaaatgagtaacattgatgccagactggtacattcccttggcgggggacgcctaaaatcttttcaattcaagccagcgacaggaccgctaggaacaagaggtggcatcctgatcctctggaatgaggattttgctgagctcaaagactttgtgcaaggaacattctcgctttcggccacagtctccttaaaagaatgtcagaccaccttcctacttacggctgtttatgggccaaccagagagagtgccaagcaaacattcctgagagaaccgcggaacaccaagccatctgacaattcaaaatggctggtgctcggagacttcaacataatctacaaggcttccgacaaaaacaatgcaaacctcaatcgcagacaaatgcgaattttcaaagaaaccctcaacgcttgcgagctcaaggaggttgcacttcagaataggcgatacacctggagtaatgaacaagacaacccaaccctcgtcaaactggacccgtttttttgcaacgctagctgggacacaacattcgagagacatctattacatgccctatccaccttactctcagaccactgtccgctaatgctaaccggacaaggggaggccccacgatcgagaacttttcggttcgagaacttttggatccagctcccaggcttccacgaggcggtacaagaagcctggacagccccccaaccccatcatgaacctcaccatagaatctttcacaaattgggatgtacggccaaaagactaagatcgtggagcaaaaaattgatttcgcaggggaagcttcatttacacttggcgctcgagattattcttcaatttgatatataccaagagtcaaggcaactcactcaagccgaactcacgctaagaaggaaccttaaagacagagtgttgggtcttgcagtggtggaaagagcccgtagaacacaagctacacgaatcaccaatctcaaagagggggatgcaaatacgaagttctttcatttgaggatgaatgcaagaaagagaaaaaacttcattcagaggctacgagtgggaaacatgtggaaagtaaaacacgatgaaaaagctgctgttataaaagagcactttcagaccttcatggcacacccagctccacgctcaaaagatcttgactgggacgccctgcagttaccgactttcgacagctccgtaattagtggccccatcacggaagaggaggttcacgtggcacttaaacagtctcccagcgacaaagcgcctggtccggacggcttcacaggtgctttctataaagcctgttgggaaacgataaaagatgacatcatggcggtcattcattccttcgaccggctacgaagtaataacttctcgatcctcaattcagcaaatgtggtgctcatcccgaaaaaggagggagctgaatgcgtaggagactacaggctgatcagtctcatacacggagttgggaagctaatttcaaaggtacttgcactgcgcttgcagcctcacatggggatcttgattagtcatgcccagagtgctttcataaagaaaatatgcacacatgacaactttatgtatgtgaggaatctgacaagaaaattccaccaaacgagaacgccgaatcttctgttgaagctcgacataaccaaagcttttgattcggttagatgggattacttaatcgacctcctccagagaaaaggcttcacatctcggtggactaactgggtctcaaacatcctagcctcatcgacaacaagggtcctcctcaatggatgcccaggatcacctataaagcatggaagaggcctctggcagggtgaccccctctcgccgctgctagttattttagccatcgacccactccaccaccttctagagaaagcaacagaattaggacacatgtcccctcttcgcggaagagctcccagatttcgaaccttcctctatgcagatgatgtggccatattcgtgaacccaagtgtccaagacatgacaaatctcactggcattctaagtgattttgggcaagtgacgggcctccgaacaaacctcaacaaaagccaaattgcgcctatccggtgtgatagcattgatctctccagcatcattgggatcttcccaacaggcctaacaaacttcccaatgaaataccttggcctacccctcgtggttggaaggctcaagaaggtccacattcagcccttaatggacaagtgcaaagcgcgtctcgctccttggcaaggcaaaatgatgtcgaccgccgctagaatctgcctgacgaaatcagtcctcatggagcagcccatataccacctaacatcactaaagctactagacggaaccctagaggagttggacaaataagaaggaaattcctttgggcggggggcgaaaacatgtcggggggaaaatgtaaagtcaactggaaaagggtctgcaggccaaaagatttgggtggcctaggtgttatgaacctacaatacttcgcatcatctctaaggctaagatggctttggaacgaatggatggcgtcggataaaccttgggtgggatctgtgctaccatgcaatcagctagacaaagacctcttcgcggccgcaacaacaataacggtgggagatggcaaaattgcacgcttttggagctcaaaatggctagacaatcaaactccgcaattgattgccccagatattttcgtggcctctagaagaaagaatagaactgtgcatgatgccttagcagaaaacaagtggatacgagacattgatgtctcttgcatctccgaggcgaatcacctccaacagtatgtccgcctctggagaatgatcagggatatgaggcctctaagcgaaaaccacgacagcatccgatggaacctcacagcaaatgggtagtactcggcaaaatcggcctatcgactacaattccttggggctgccaaatctaccttctatcagtcaatctggaaggcatgggcaccgccgaagtgcaagttcttctcttggctggtaacgcaaaatagagtatggacggcagacaggctggaaaaagaggatggcaaaaccaaaagatttgcccactttgctacaatgttgatgaatcggccctgcatctcctggccaaatgcaaactcacaaagaggatatgggcagaaatgcagagatggaccgggactgaccttcagatggacaattgggaaaactatcagtcagtcgagcaatggtggacactcgtaacggaatctccaaacaccccacgcaagcctctcaggaccctggtgattttaatctcgtgggaaatctggtgcaaaagaaacgcaagaatcttccgcaacaatgcatctacgccatcctcagcaaagatcaaggaggaagggagagcatgggtcaaagcaggggcttcaatcctccaggagttcgaaattttgggagatatcacttaatccctgcgttttgcctctctttttgcgggttatttgttttgctttttttcatctaaccctatatatatctcgctataattttctcctgctctattaatatataaagggcaaaacttttgccttccttcaaaaacaattggattcaacttgactggctcatattgtatcattactatacatattatcgcttgcatttattcctctttttagccataattatctctatttaatccagaggtcgattaggcaccaattctgcactaacatataactatacgccgtgttaacattctgttaaaaacaactaataagacttgctaaatggacctataattatcgatgctaccaatatattacgatcattagttcctttatgtcatgtttttttaaatatattttagttcatgctgatttgatttaagatttaagttactatatccaatatcttctaatctcatttcattgatttgcttatgtaaactttatagagattctcacactaatatatcgtctagttcacagtacattatttggtccatttgacctgtatcttgcacatttcattcagctggttgcagcagtagacacaaaatgccctggagaaaaacaaattaagggatggcagctgaggtggaaggggaatagggcggtcgggcgatgatgagaaggccacagaaggccatgatttggacgcttaattggcccggggatagcgcacatgagcacacgttgtttttagagcaaggataataatacagccagctgcttacttatagcctatctattagctaactcatatagtggttaattcttcactataaatatatggtccatatatttatctcacagattttcttggttcctgtgtctaagcctcttttcttggttcttggttctcatctctctcctcttttctctcatccatcccagtattcagccttttaatagcccactattggtggtggcccatgcttactgttagttttgtcgccttggacgccgagccacacatggcatgagatatttttctcaatccaacgaactcgcctttaattaattgggctggttaattagtttattaattgtagcaaaaggtagcacgcacccactactttgtcctctcttgacctttggcgattaattacgccctttgattctgctccctctgattaaaaaaaaacatatgtaacatcttctagtacaataatgaatctagatagagaattatctagattcattatactttagggacttgttcactttgctactttttccgtttcacaatataagtcattctagtattccccacattcatattgatgctagtgaatctagacatatatatctatctagattcattaacatcaatatgaatgtggagaatgctagaatgacttacattataaaacggagggagtactattttcaaccttaccaagttttgtcattgctaaattttggtaaggttgccaaaattttggtaaggttaccaaattttggcaagatttcatacgcacttactaaaatttggcaacaaactaaatgtagccatttttttataactttatcaaaaagaaggtaaggttgaaaatggtagtaaagtgaacaagcccatatttttttaggacggaaagagtaattgacgtggcgaactggcgatgatgcccattgcaaaaaagagtacacgtgccagtactactgggtttaactgtctgtcttatttttgttatttttagtttattcattaaattattattgtgtattgtttgatttcagattttaaaaatatatcttttaaaagctttcttgcactacattactcaaaccactaggtttatatatattacataatatttaattatttctatagtcaagtagatgatccgtgccaataaatttgctgaatttaatttctccctactgaataatctatttcaaatactcataaattataatcaggtacactcacacacatatgacacttatgtttcacgctcataggtgcatcctatcctatgtttaggtaggtgaagatcgtataccacgatgtcactactattatagttattaatatgtaggtctcatcctcctattacctcacgcgttagtgtttataatgctaataccattcttgtgaataatatgaaccctgtttaaaaagggattggaatcacatgaatatgaggtactcatacgtacttagattggcacaatccatcacaagtaccataatctattactccctccattttttaatagatgacgccgttgacttttgaatatatgtttgaccatttgtcttattcaaaaaattttatgtaaatgtatagatacaaatcatgcttaaagtactttgagtgataaaacaactcacaacaaaataaattataattacgtaaattttttgaataagacaaatggtcaaacatgtgataaaaggttaacggcgtcatctattaaaaaacagaggtagtatgtatgctcacacatctttatatttgcataaggagaaagtactgattttcttttcaaattaagaggtggaagttgttctcagcttgagaaatgtttttcccccggaaaactgatgttgtagtaatagtccacgaacacatagtaaggtacacacagttaccgagttacggaatgagacaagccgaataaaactttgacttaattagttgatcagccgctacagataattcttaaaccatgtgtggtataaacgatggatctccgacgactgtttctttctctctagctaccggcccattctgatatattgtcgcaactagacagtactaggttttcaactatctatatgtcagatgtttgaaacgatcatacatgtaagtaagcaaccactctcaacaacagatcaacatgaagttgacgggaaaaacacctgtcgtgggtgtttgaattcactcgttaaggtttaaattttgatgtatgaatatgtaggtagactttcaggagacttttctatatgtaggtgggctttcaacaggattttagtgagatttggaatatgccaataatttccatccctttgagtgtgtgttagagcatgcacaaaaatagagtttgatataatctcttagctaatactacgtatattatacgtatcacttcctacaatagttgagacagaccacctaaccattaatacacaaaaaaaaattatattacatttttcccttttctttatccccatgcaataaaattccctttaataaaaactaagagctgactctgagtggttgtcatgcataacaaccatatttttctttcctccgctctctcttccacgtcaccaactttacttgcatactaatggagagactccgttaataataaatatcgttgtacatgcccttagatgacgtatttccagaaacgtgagtatgatattgcatgtgtagtgtgtacatgtgtacgcatatgcctaccgtgtaataaaaaaatgaaaaacatgaagttaacatattgcaagaagggtaagagggtacataaagtgaaactttgggttaacaatatatggaaaaagtacgaattacccccgccccctggaaaactattgcggtcggccgaattaccccactgaaccataaaaccggatattcttcacccccaactatgcaaaccggatgaatttccctcaacctaatccacggtggttttggtctacatgacatacgcgtggtagtccagtcagcattctatttatttataaaatagtatgggacccacctgtcatactcttccactcttcctatctctcttctctctcactcttcctctctctctcacaggcggctggcgggggacacggagcggcggcggcgggtgatgcgtaggcggcggcggtgggggatgaggaggcggccgcttggcgcggcttcctgaggcggcaaaagggccctgcggcggcggcggcatcgggtgacgcgtaggcaacggcggcgggggatgaggaggcggccgctcggcgtggctttctgaggcagcaaaaggggacctgcggcggcggcggcgcagtgcaaaaggggccctgcgacggcggcgacgcagtgccaaaggggaactgagacagcggctgcgcgaaggggcactgcgggggtggtgtgatggtggttaaggggccctgctgcggcggtccagcgccaaaagggcgttgaggtggcacggccgcgaagggcgccgcaggggaagcaagcagcctgcgcggggctgaagcggcgccgaaagacgggacggcggggcaac

SEQ ID NO: 83186 - DNA, 10379 bp, Oryza sativa
aggattaaggaaaacattcatcatgcatatattggtaaaaaaaataaagaagagaaacctcgatctttcattcataatcaatgacaaattacagttgacagattgcatgttcttcttctcatgcgaatagaccatcctatctacgagaatttaaaagatcacatcgccttccatgcaaaccaagaacagaggaagacatgttctgattccacctactgctactactgaacagcgctgatcacaatgccaagaaggcctcggagttggcacgcagctgctccttctccagcataaacatcttcagccgcggcagcttcttgccggccgtggtcggccgtggggccgccatgtttgccggggtcggggccaggcgcggcgcgggcagcttgacgtccttgacagcgacgcgcacggtccggaaggggtcgtcgcgcgggaagttgccgttgtagatgacctcgaggtggccgtcgtcggcatcggcgtcggagacgacgaccgcgccgagccacatgacgaggcgcagcgccgtggtgcctagcctccccacgggcgtgcggacgcgcacctcgtcgcccttcttgaaggaggacatcttgttgatgggcgatcctgatcctgacggcttcttggagactactctcccctgcgcctcgacggtgagctcactgcggcggtggatgatcgggcgcgaggagcggggactcgagcagcggagaagcgccatggacgacgagtgccgagcgctgctgcgaggatgggtggaaggaatcgtggtgaatgcggagggagggggcgatcggccggggctgcgaggatttatcgccagccgggtccgagtccgaattgaagtcggcgttgtcaggcacgatccatcaatccgaggtcgactcggaatcggagacgtccgttacgcctcgccaccatcacgcaatccattccgaatggcgccaagcaggcgggaacgcgcagcggagataggtgtatcgccggcggcggcggcggaggagaaggagatgacggcggctcagcttctgattggtcttagtacatccgagcaactgattgggcttataaagaatcaacaaatacaagcgacatgattcaaaatttattttgcttcagtttctcatcatgtgatggccaagtcaaacgtgctaacggcattatatttcaagagatcaagacgcgagtgtacgaccggcttatggtgtgacatacccaaatttttattttggaaaattcaactgaactaaaaattcatgaagagttttttctcaaaaacttttgttacaatctcaactctcaagagcttaattagtcactagctagtcactagaccactaattaagcttttcattaggttaacccgataaccaatcatcttggctgagtagtaaaaatacgtatcaccagtgagtcagcaaaggctcgccattgatgagtgatgatggatggcttagaagctcaagtgctgcagaatacttggctcaaggatagcattgaggactggtcatgtactatgagacaacagagacaaaaactcttcctacgcctataaagaaagagaggagaccttttctaccattcataatcaatgatatatataggtcatcgattgcatgtcctgtcacgcaaagaattcaaaacaaattatcctaactaccaacagtgccttccaagaatccagaaacagaggagccgctgcacctcacaaatgaacaatgatttttctctctatccctttttcatttcctcattcaagagagagagagagagaaactatataggctgagcaaacagttgcaatgtacaatcaagcaatgaatcattatccatcaccatcaccacagcaagaagtagccaatttacatgaatgtaagagtgcaagactatccttctctattacaagacccccggtcactgatctagaacctgtctgattgaatgctgttgtcgtcctgatagtgttttaggaaaagagacatcaaatattatcctcaagtttcctttcaatccctcgccgattggccatccttcatcctttattaccagctcataccctgggtacacgacctcatcaactttgatcttcaagtagcgcccatcaagtgtcttaagatttatggtacactttgcaagtgcatccacaagacgaagaacccaatgaactaccaggtcatttccatagaggatgtaggtctcatgaggtgcgatgtcaagggtcaaaattaaatcatggggcggctggccgtaaaaatgggacccttcataaggaagtgttatttttgttcctttccttgatccaggcagcactttaacttgtaaaattatttcttcattctccacaggtctgcataatatgagaagcctaaacttagacatcaattacatccactgtgtttaaaggattcgcagatatatgattccttcagttgcagatttttaaaacataaaaagacggtaacacttaaacaaaagtgcaaacatactcatcagtgtgtcttgtgatcctcctatgaagtgctactgtcaaatcagttccctggtacagctcttcaagggtgcacataagttctccaactgttgcttgtggattatccaattgatcatgataaatcattgcacagctttgttcagcatcttgaatctaataaaataaatcacagttaatcaaaagttcaaattactaataaacaacacataaaactgcaggaaggaaagaatgatagttacatcacttacatttccatagaagaataacgtgtggggttttaggcacctcagctggttgtatctttgcaattcctgttgcaacaacggtaagaatagtggatacttcacaatgaagatcaattcaaactgttcagcggaataaccaccaacttcctctatcatgaagcatctgtctaaccggtggcaatttgaatgtcgatagtatttaaaaaatgtttctgggtcatgagccttttccggattgtcatcaacaccatagtttttgtgcttcagcgaagcttccagtaaataattcccttcggtgatttgaaaccatctgttttggtatggaagcttcttaagtatatcacgataagcagcatcattggtgtaggctaagacaaacctcatatgctcataagctttgaaatagaaaagtatcctgttttcgattggtatcagtggtgcataattgcagataagataaccatgctcatgtggattgtgcagcattagagacattaaagatctccagtcctctggtatttggtccatactgtaattcctgaatacagtttgacggatcacattacgaagatcaagataattttgacaaaccaattaatccgtcctttttgtcctggtgacaagccggaatcttatgtgtccagtaggggcaacccagatattagattcaccaaatcttgacaagcaatacccctcttcatgttgattgaataactccacagccattgatctgacacaacacttaatcctctccttaacaatccaaacattgagtttcttgtattctcccaacaaactacaccgagtgctgtctatatattccatcgctgatgtcgtgaattctctgacagagataaaatacttgtgatctggtaaatcaccataggaagtgcctatgtcatccttcattatgtcgtaaccctgagatagcatgctagtgaatgttaagacattgtataatttattcaaatcctaatttcattgaggaattctcccataacataaagggcattcacattaaaatctgaataaagggcctaagggacatttaatacactgctgtacacctagtttcagaacatgaacatctatctagtagctgtacacctagtttcagaacatatatatctagtatctaaacccacaaggcattttttctagtgaaacaagatgatcctttttacacttttcaaagtcaatattatgttattcggtaccattgcataaaagtatttcaacatatgaacagtatagtacttataccctgtagatcaagtttgaagttggttcttggcggagtattagataccagtataatctacattgtcaatttttaaaattttctccacaagcatttgcattaaattttaagagaaacatgcatacaagaagatatcctctcaagagattagaatccattcccatatcacgaacagaaatcatcattatgcataagatttgagaaacagaattgaccccttgttgaaatcaagagtcttaggatgaactggcacaggcatgcgttctttcttcaagaacatttcatttcttgattgagagagacaaagcgagagagagatggcgattcaaccttaaacgaggcgatgctctcaatcaagaacgtttcttgattgattgagaggagagagatggcgactaaccttgaaacgaggcgcagctcggcgtgagaagcgtccctcctccccctccctggcgcagctcggcgtgagaagcgtcccgttcttccctccctgagcttttgttcgtagacgaaggagaagaagcgacgttccagcaggagaacacgaaggagaaatgctggagaacgcaaagaagaagatgacacgacgttcttctcctcttcctcctcccaggagaggaggcgccccctgctgatcgccggagatgacctctctgctttctgctttcgtggcagaccaaggaggaagaaaggaggtgtcaagccgttgtagaagaagaggtgagtaatttaagtattggaccgccaggcccaccacagtctaaccatccccatgggccgtatagcccacgttcggcccactcctcctctgtcctgccatcgccgccgcatcctctcctctgcgcgtggacggtggccggcggcagcggcggcgcgccggaagtcttcattcagcagccgccacccccgctggttagcagggctcctctcgtgctgcccttcaccatccgtagcggacttgcatagcgccccggcggcccggacctcagcgagtgagtgaaatccctcgggcggcagtgtcgccggagcaacctgccgccaccgccaactccacgatcgccgcacatactggatctcgcactcgatctctctctcttttcctcagtacttcttcgtgggggcggtgaagattggggatcagctcggtgggaggaggcgagcgacggaggagacgaggagtcggatggggcgactgaatcagaggagttgttttttttttttctggttccacgcatagactggagtactggacccaccacctatacaatgacacattttagggttaattagatccatgccactataacttttgccaaatttaaaaaatatcgctactattcatcatatcagctatgtaccactggaaatttttaaaattgaaaccatatcactcccgtcactttttatgtctcatctctcgcgccgtctccgttcccatcctcatcccctctaggacccaagcgttcacgtggcgcgattcgcggcagagtcgttagacgcgcgcgcggaagcgaggggggatggtggcaggcgggacgcctccgcgccggcgacgaggagcagcagtaggaggacaggccggggcggttgcagccgggcctagcggggttcgcggcagagtcgtcaggcgcgcgcggtgtaggcacggacgcctctgtgccgatgacgaggaggatcaggaggaggaggacacgctccgcgtcctggtgtacatctccctgatatgccagaggagcgccgtcagcaaggacctcgttcgctaccgcaacatcctctgcgccatcgccgagatgctcaagagcggtagcccctgactccgcctcaagtccctccaggtcctccgtgtcctcgtcgaggacaacgatgacgacaaggtcgcaaatcccattccccaagtttcaacatcccccaaagcagataaattttgcaagaaaccaagtaatagttgatcgattcttagtttcaattttgcagaagttggggaagggcgacacaatacacaccatcatcaagttcttgtcgaacaagctatcggggcatgagccgacgtgcaagcggatcgtcgcggtcgggacggggagtagcaagtcggagagcgtcgttgccgtcgacaaggtggagagcatgctctgcaacctcgaccgcttcgaggccaacgcccaacatgaagtagggccgacaacgccagactgcaactactcctcaccaggctgcttcaacgccaacgtcaagcaggccgcgatggccacgcgttggcgaactcggtgaactcggctagatcactacctcagcgagctcgcactggcgaacgatgacaaggtgtcatgccccgaactagccccgagtggaactagcccgtgacactccaaattaacctgttaatcgataccagtcccaggaaacagtgatggtatcacaggaagacagaatatcacagcaacagaggtctctttattatagagtaggagtacagtcattatattgcggacagatcccgagctcacaactgcattacaaaagggaaagcggaagccaagacttggaccaaacatcacaggcgcgacttgggaactaggtcgaaaccctaaaactcatcgtagccgacttgctcctggaagaactccttgtcagcgggatccgcttcatcttcttcagcaactgggggggttatttatatagagcaagggtgagtacgggagtactcagcaagccatggggattaagtgtttaaatgcaggcttcaaggaatggctattgttttttcaattgattttatttaaactcttttctgaaacaactaagtgagtgcttctcaaacaacacggatgagacagtgcgtctcgtccggtcggagtatgtgcaaggtatcagtcttttgaattgatcaaggttggcattcggccaacagctttcaaacggccacccgggcctggctgatcccatcagccgcagattttccaaacatcgaacccaaaccacatcagcaaattttacaaagcagtagtcaaacaaaactacgctaggaatcacctcacatccgcccatgaccgtgggcatggctattcgaacagtttaataacctctgcagagggggtacactttacccacacgacattactaacccggatcatccagcccgtgcagaacggccacgactagagaccttaaggctttcatgacaaggcatttcgaaagccgacacaggttcaccatatgccaacgagaggggtcccagaccaacaccagattaggtcccagaccatactgtgccaggaaacccgggggttctccctgacaccaccccgttgaatccacatgtctcttggcatcatggttcccccgattagctagttactcagccaggggtgtcccattccacccatgtggtcgcacttgtcttatgttcggatgaaattccaaggaaacggtccttaagtgcaagagcgggagactgtacacccggtacgttccccggtccgcgattttggaaattcatttagttcgcaagcaccgacccaggtgtcgggttttccaagtcttttgtaaaacccgagttttacccaagatgtttctcagattttaagtttgaaggcaaccgtcgatactcgtgcagagtgcacgaataccgaggcgcaactaggtggttacaagggaacatgatataacaattaacaatggaaggatcagatgcaacaagttaggtaggcccacctgtctgccttgcagacggggcaaacagattaagtgcaatcctatcaatgcataatattttgcaagcaatataattaagttcaaatataggctcaatatgttcaaaggtggcttgccttgctcgagatcttgagcttgatcctcgaaatcctcgcactgcggatcttcgggctccgaaactacacgcgaaacgggacaactcagcaaacggcgaaaataaggccctattattgacctctaagcgtgtcattaggtagatctcaagatttgaggaattttggaagttgaacggagtcaaacggacttacggttaggaagatattgaatttctaagattattggatttttggtctaaaggaaaaaggatttatttaaatcctttttgaaaagaaaagaagagaaaagaaggagggaggggaattagacttccctcgggcggctagggcgcggcccgagagaaagggggcggctcggccgaacttaacgggccggtcggcctgagaaggcggcccaaggcatgcgcgcgggtggggaggagtgaggaagccggtgggccgggtccatcccgcgtggtcccgggtgggacccgcttgtcggcggcttggctcaccgtgagcgaggtgcacgcggggcgtgctagggtttggggaggggaggcgcggtgcatgcgcgcggttcgcggaggacgcggtgcggcgggcccacgcacagcctcacggctcgcggtggaccgcgcgcgcgggcagggccggagggagcggcgtaccggggtcagcttgacccggtcgcggccgaggtggcgccgacgtggcgcctacgtggctgccacgcgggccggcgggaggtagacgacgacgtcggccggaacggacgcggacggcggcggcgaaccacggcgatacaggcgaaagcgagcacaccgggaggttgcacgggacgaggggagacgagccaacggctcggattcgccgggggatgctcgacgacggcggattgcggcggaggcaaccggcggcgagagaaggggaaacggcgatggcgcgacgggagaccgattcgggcgagctaaagcatctacgcgactccgagaatccgttgctagcgtcggattgggcggagctacgccgagcgaggccggcgacgagcgggcgctacggagcacggtcggcgacggcggcgagcacacagcgagcagcggcaacggtcggggcggcgccagctagctacggggaggctactcgtgctactacccgagtctaaggggaggagatggaacgaggagggagaacggagggaggcactaccgtgcggggtgatggggcgtagtgacgaggggccgacggcacgggagtgatctctccggcctcgggcaggggaagaggaagaagacgagcgcccggagtccccttccgcgtcctagcacgcaccggctcctccggcacacacgacagcggcggtcggcgagagggacggcaatggcgcgggcgaaaaacggggaagattgggaggggaaaaaggaagggagggcgcctgggtttatagggcggcaatgtcggtttggaaaccgaccttgggcggtcaaggcgcgagctggcgctcggcgctcgcggccaaaacggcgacagaggcggatgacgccggcggggaagagaaaaggaaaaaggaagggagaaaggggggttgccccttgcgtctttgggaaaagaaggagggagagagggcgatgaggaggagccctgcctcctttccttggaagcacgcgcggggaggggcggggccgagtcgatgacgacggcgatgacggtgggggcggtttgaaacggagcggcgacacggacggcaggcgcggacaggcgcggcataggctgacggcggcggcggccaggcggtcggccatcacggcgtgcgcgcgcgggaagcaacgggcggcgcggcgatttgggcagcgcggctcgggcacgcggcaaggcagcggggccgggcagcgcagacggcgcaggcgcggcacgggcggcgaccacgcgggcgcgtgcgcgaagcaacggcgcgcggagccgatttcgcgggcggggagctcgcggggatggaggcggggagagggagagcgagggggaggcgctcggcgcggctcacgggcagagcgggaagagagggagagagagagggagagagagagagatgggccgagaggaagtcggcccatcgaacctgagggaggcaaaatagacttttgcggagggatttgatttgggaaggataattgagattagggtttggatttggattcgggacttgaacttgacgatagatcggggatttgagatccggaatggcacggagactgactgcaagcgaggaaacaattttcgcaattaaggtttttagaaattaattttcccgctaggcgccacgacggaacgggcgctacacaaggccacggtggccgaagccgtacgtagccatggagaggagggtgatgaggacgtgaacaaagacggagtgagagaggccgataattaggttttggtacgcacgcatgacgagttacaaaccaggaatcctaataggttttggtgtgcaggggagagaagtcgcgcacggtttccgaacatgttgcgacaagctagggttagggttagtattttaagggtggggtgaggggtgg

SEQ ID NO: 83187 - DNA, 646 bp, Oryza sativa
gctgccgccacgacatacccaagcacccccgtgctcccgtacagcgccgccaccatcgccgccgtcctccgctccatcccgagcctcgccacgccgctcgccgaaggcccataccacaacccagccacgccaagagacaccttctcctcctccacgaccctcctcaccgccgccacgtcgtccgctgccgccagctcaagaagcaaggacgccgccatcaccgtcgcctccttctgctgctgcggcagcggcggtgtggacggcttgcgcggcccagagcacatgacacacacaaacaaacacgcacgcagagtgttcgaccgagttcttgttagtcaaaacaaacacctagttcttgatttcttgttaaattcagagaggagaagaagaacaagaagagggagaagaggaattctcgatcgatggatggatttggagagtggtgtggttggagaggggagggtgggaggtgggtggggaagggtatatgtagagagggagagtaatggaggaatgggggttgatagagataagggaagttggagacgaagaagcagctcgtctccttctccttcgcgcgttttttttttcccttctctttacacaaaaataaaataatcgttttattttttgggggctgcaggaa

SEQ ID NO: 83188 - DNA, 824 bp, Oryza sativa
gctgtatatggagtattctttcaaaattcctaattttttatttttcaatttcagttgtttcaaaactatattcttacttgaactctcttagtttttaatttcagatcttattttattttttattttgaattttaattaatattgtattgggttcttatatggactctttatttgataattacatatttttaatttcgaatttcagttatttttaaattttattcctacttaaaatcttctatttttttttatctccaattaatgtgggaatttgtagccccaataactatcgtgatacctacttttataattttcttaatagtatactacatagagataatagtatcaacaagcatgagtgtcgtcatctggagtagtgtttaaggcaaaatatcttttgaacaaacatagtacgggtctagggcaaaatatctaactgaaatcagtattcataataaaactctagtgaaaaccatcgtcgtcctccactcctccccagtccacactatatatagaacagtcatacatatatatatcacaaatttggcttctacctttcgtttggtcgatatgcaggtcatccaagtagatccaagcggtgtttggacagggtctgagctgtttaattgtcatcctaacagatcgatcatcagctgtttaatcaacgcctcagctgctatctgatcgattaatttgtatatttttgtcgtcatacagatcgaccgcttgcatggggtgcagctgttgccgatcgagctagctctgctgcatgcggtccgcccacgcctagaattaatgtgcagcgagaagtagctctactcttc

SEQ ID NO: 83189 - DNA, 3845 bp, Oryza sativa
ggggggagatgaggtttccccggcatggttcggtcccccccatcttgcggagccgcttcttttttcgctccccctcgggctgcgacgtcggcacagcacccttcgggcgcctgctgctggcacgcaccgccccgccccctcggggaggagatggggagggggtatcctcctgtttcctcttcccccgggcgtcggtagggcggctgccccccgggcccccgtcacggggcccagaagcacgaccccctcccggggtagattgttcccccctgcggctcccgcccgcgccatcgtggcctcggggggcccgctcccccgacgccccgacctcctgcatgatggtcaggatgttggcgcgctctggatcgcagcagaggggaaggaccccttgagggatgagggatgcctccacggagctgagattcagcacccgttggaccactatcctgaagtcctcagggtcccagtcccatttgcgcccctggtgggtcctcatgatgtcctcgggcccggtgtactcccaggcgccccgggcgtgccgctggagcggcgcgatccggcgacgaaggtagtcgccgaacaccatggcccccgtgagcccctgggatcgcaaaccagccaggcggtcaagaacggcgtcgtagccgtctcccagatctaccggcgcccgccagctggaggcctgcgctgggggctggctcggaagtcggaggcgcgcttcgtcggcgagaggggtgtagaaccagtcgctcttccagtgatcccacttcttgcgaaggacgcagggaatatagcggttcagcaccggcccccgcggctggaagtagcagccaccgactaccgacggtggcgacaccggctgtacggtgaagaaccaccggaacaaccagagagatgggcgcaccccgatgaacatctcgcacaggtgcgcgaagatggccaacgtcattactgcattgggggtgaggtgcgccatctggagatcataaagctccagaacatccatgaagaaagaagagaatggcgggaccagccctgccattgcgaaggaaaggaagaatacggaccgccccgggtagtgtggcgccgggcgtccctcacccagcgcaaccacctcccggccggtggcagattccggcatgaatcggcgcggcagcccggcctgcctctcgctcacgatgcgagaaggcagcagcacgctaccgtcgagcggtgcggagccccgtgccataacgccggcggaggaggggtttgagagcgagtgagtgcggcgagggtagggcacaggaaacgagaagttagagcgcaagcggcgaaggcaaggggaataatggcgagaggaaggaaacgaatctcttcctcggcgtctttatacccttgccaaacgctatgcccggctcctcgcttcccgcgcccactatctcgccccctcgtttctcgcgccaactcctccactaatcccgctcgcccgtttgcggcgcacgaggcggatgtgcggccgtggcagtcgagatgggacatatcgtgcgcgcgttaactacgctcgccgaccgatgcaccatcatcacatctccaggcgaaacgaaccggctcgtcccaattcgcgcgctactcgagtaatgtagcggtcttgaagaaagccgctcattattgtcggtcggtttttcccttgccgatgcgcgcgatttgcgaccactggattcctgtccgcttttagagaccggccccacctgtcaccaggcctgaggagtggcgtcacgcccgagcgttttcctcgaggagggtgatcgccctggcataaccccgggggctactgtcggtgacatgggaccggggatatcttgactagaggtttggggcagccgcggtcacccacgtggcctgaccccctcgggggggtcgggcccaagggtgatgagaccgcccctccctctatctccccgaggggtcgggccgctcccgttttgtccccgagggctggggcgccccgaccccctgagggtttggcgccacgtgtgtgggttaggtgagcacagcggcgctcacctaaccgcgtttattgcgggttggacgagcgccccacgccgcatttaatgcagcgcagcacactcgttcggtccgtgacagggcacagtgtgtgactggtcacagaccggtcagaccgcgggttatgtggcaacaggcggcctttcgcacgccttgccccgtcctgtcggaatgatgagagcctctaggcactcgtccctagatggaaccggcgtgggaactcctggagttagcacgtcggtcccggctagattcataccaggcttcatcgcaaccattacaaggaagtcattttatgaagaagggctgacgtgtggcatgctaaactgacacgtggtagacaagaatgaccggtttgtgactggtctgatgccggtcacgtcatcagcaaacaaccgtgcttccacgttgcacttgcttccggcggagtggaggttggtatgacccatcccatcggagggtcattcggacagcagccattgcaaatctccgcccattaatgagggaggacagggttatcccggtgtcaggcgaaggtacgagccaagttttggtcaaagtaggatgggtccccacccaaaagaagggtaggtagaaatggtgtatgtggtatccccttgagatataaaaggaggaccatgcctaccaagaggggggactggagaaaagaggagtgagagggtctctagagtttgaactctcttgctctccagctctttgtaactccttcatacacagatccaccagaacacaggagtagggtactacgcttctcagcggcccgaacctgtctacatcgcccgtgtcttgcgcatttgctctctcgcgaaccattccacagatcaagggcttagaacctcacccagcgcccccggccgaaccggcaaaggggggcccgcgcggtctcccggtgaggagccccacgctccgtcaatgtcctatacggaaacaacctacggatataggagggagttccggataaggaaagacacccagagttctacatggaaacgacaaggactactaggattgtatccatattgatttccctagttcaaattggacaaggggacacctatgggtataaatacaagcctccctaggaggacagggggacacacacgcccaccacgagacaatcaactcccaacacaatcaacatagaagcctacatacaccaagacaagccgccggatatcgacatcagagatacgcctggatcgaccctatctggtaccttcagaggccggccgtagggatctagcactgtctctgattccgtcgggtgcgagctcgaggaggaaggctaccctgttgtcgactacgagtcagaccttcagaccgccatgtcgacaacagttagataggctaccctacatattgtactggtgtgattatggtgaataaaaagcaacatcggctccggccaacaagatgtagggctattacctgatagctcaggggcccgaacctgtataaaaatccatgtcttcatctcttttacctcagtctcgcgtatatcctagcaccgatgatccacatactgtccaaataccgtagtcgagacatcaaacgtcgacagtggcgcgacaggtagggggattttggtgcttcaggatttcgacgagatgcgtttaagatatggactctccgacaacaagctactcgatgacttcggctgtgcggagatctaacccaactgaagtacatcttccgaccagatcggaaccatcatcgtcatcgacaacttggtctatcgagatcatccaagcctcaagatacgcggcgggctgcaggaa

SEQ ID NO: 83190 - DNA, 3736 bp, Oryza sativa
acgctcaagaggaagggaacataggggagaggaggggctccagggagtagaggggccatgggaaagcgggagcgagtgcaatgagagggagggaggcaggagagaaggggtgccaaggagaagaggggctgtgggagagggggagcgcgtgcagcgaggaagagatttggggggggggagaaggaagggaggcaagagaggaggggcgccaaggagaacaggagccatgggggagcaggagaatgtgcagcaagggagagatgggaggtgccggtagggggggaggcgaaggcagaagcagaggtgcttgggagggaggggatcggacggacgaaagagaaggcggaagctttacgtacatagattaattagcggaaaaaattcgaattactcccgaactatcacaagcaaccgaattacccctaaactaaataccaaacattttacagtcaactattcgagccagacaaatatttatttgactccatccattcttattttggtcctacgaggcagcaagtagtcaacaacttttttaaaaaagaatcgggggaccaacctatcagattccctcccctctcacctctctctatcttagcttcctcattccccaccttctctctccctcttctcccctagctcaagagtgcggtggtggctggcccgtcaagctcgccggttgtgcctccatctcgttagcacaataagcatactgccattgtgacactctcccacacgagctcgcccgatgcctgacggtggagcttgcgcagaggtggagcccaacctcgcgtgtaggcggcgacaagactggcgatgtctcaagctttcttgctctcaaggaggctggtgagcttggctcctcctcggccttcgatgtgatgaaactcgcagtcaccgcagctcctcctcgatcttcgcgggcacgcggctcctcctcagcctctgttggcgttcacgtgttgaggctctagtaatatagaacatcaccaatgggacaaattataggtgccgaaaattgtaaaatcaacatctatagacattttcccacctccacaggatggaaaaatataaaccaatacctttaaccaactatgtataccagttccagagaaaactggaccaatactttatgtgcttattttgtaaaaataccaacaactttaatatattataggtgtcggttaaaccagaatatataatatattttaggtgccggtctgttaaaaatccagcacccttaaaattcgagtcacgccaatggttgggagcgagctaaaccagctcctttcgcatccttatcctctcacgcccctcgcttccttgtcctctcatgcccgcgcacctcgtctcatcgctctctcaccgctcattctctcgtcgcctcctccccttgccctccccttccccctcttggtatttgttacgcacacagataaattcacaagagtattccaagcgtatcgaacagaaagaacgtgtgtatctcagaaacaggattaaccatcacaacaactaaatgataggcttaggacagagaatattcctatggatttaaccaaggtaaaactctatcgaatgctttgggcaccggcccttccctagtctactgacaggctgagttcggccttgaactctattatgactgtcaccacctgctgcctacctcactttctgtgaagcacacaataaatgaagctaacctctaccctaaacactacgtctaagctaagcaaagaagcaaccttttcgtttggtttttgtttaagtcataagtcactcatacactattaatccaaaggctaggttggagaagtttttttatcttatgtgcggtacatgtataaccacaccattaaacttaatactttatatccattggcttataagttatataaaccaaaaaaactgacttaaaaaccgaagccaataataagtctaagcctaaacaaagagactcttaaaaaaaaccaagttaatatggatttactttttttatttattagtgatttcataatgactttatcacttttttgactaactatacttcaccacccagctgccacattatcaaaacttgactggtgtagtctaaagataaagtacggatcatgttgagagtttgcaaagtattactaaatgatttcacaagtgaatttcaaaccaagatcacgtagtttcattacaacggaacccctcatatatgatgggcggtaacccacatctgtaacgggtatatgtcccatctattctcatttgtcagtgacaaagaaaaccttatctatgatggattccataagtcatctatacgtataagttatgtaccgtcactactagtcatgattttttttaattttaaagacaccaaaaatccctaaaagaattttaaattttactaggtatctagtcgtggtcacgcatcactaaccataaatctacgatctttcccgattgagctttgagcctacttggtgtaattccaaaacttcctcttgtataaaagatatcaatacaaactatcggtagtcaaaactaaattggtgctttttgtcttgaatgaagcaagcagcttctctcatgaattcatgttttaaaacggtgaattaaaaaaagctagctactacatgtctacatctactaggaacagtagtattattactagcagacagataatagctttattgaaaagcattgataaggtcttgagacttgagtaggtcaagcacgatgacaagtatatattgacccataaaaatatctttctacatgcaatgcatcctgtgctaatcaaaccctaccaagctattcgagctcgagctcactaggtttgcgaacctcaacctatgcttaagtttggcttgtctgtagcattcgagtcgtgctcaaattaagctgtaacaaatcaaactcaaacagattgacagccctatctgtagctaccacacttgttagaaatgtcctgtcatctttgatgacgggtcacaactaacacccattatagatggattcacttctaatcttctatgactggtatccacatatgcatatatcaaacgtacgggctacttttagatccgtccgttagatattagccatttgaaatcggtaatattgatccatcacaaatgacctgctgtgcgttcacgaatatgtgagtgtttaggaacaaatatggaatttttgtcccgatatgtacttaatttagtctttcacctttgatacatattgataatcaggggtgctattcccttttatttaggataaacaaattagagcacagttgataattggaaatatgaatgaaacattgatcggtattttctttgtcacaattcagcgacaactttattttattatttataacaattggtagcaatatgtgaactatatttagaaaagagcacctgttgtaataaaaaagctaataagcgcgcttctcggatgaatacttcttcggattttacattaaagagcacatgagctgtggttttcaattctcattggatcatcctatatccaggtttctataggctattgtgtgggtgatgctataacgtgaaaaacaatacgggaattcctgatcatagcgcgcggtttccgattttcaatctgaagtttcaattcctatagcgtacgtttctaattgtcccgtactgtttccactagaaattcatcccaatacactataaaaacgattatttttttacaagaagccctttagattgcaaagagaccg

SEQ ID NO: 83191 - DNA, 96610 bp, Oryza sativa
gttttttccccagccgcccgcctagggttcggtcgccaccgcgttctcctcgcccaatctcccccaaaaacctctctaatcgaaggtgatttgtgcggcattgagtttgggatcggaagagaaggtaaacccctctataaaccctaagttccccaaagttttattggatattttgcattgttttggttgtagacgtggtttgataatagttggctaaggatggattattagatggataatatgggtggggatgaagtgtggaggtggcatatctttatccatttggttgttattgatacatttgacaaaatatatttgggatggatgtttggtgatgcactagggtttgatgggagatggatgtgtggtgatggcctaggatgtgggatggatttgtggtgattgagagggtttgaaaggggttgatgtgtggtgaagggtaggtaatttgtaggagtagagtttttttttatcaataatgtgtagtatttgagtaatgtacttatttattggaaaaattagacatgttgttagcttttgaagtattggtattgcaatggtaattacatattattttcaagtaattaatgtttatgcatgggttaaaaattgtagatggatagattggtccggcttcattatggtggttgtgtggtagatgaaagtacacatggaagccaatttgagggaatgacagttagacaattagtgttttttgcgaagcctacctttgaggagttaatgtctcgcatcaagcatgaattggattggaatgatgagtcggttggtatgcaagggagatacgatgtgggcggcggtgtcatgtcacataagtttatgttagacttgaatggagagatcgaatggcaaacatatatagatatagtattggggtcacatttcaaatctcttgaggtgtttgcatggaagaaagatggtaggatagggaagaaagaacttatagaccttaatgaaagtccactcatagaatcacccattagttgtcatgaactgtcggagaggtgtagtaggaaggaagaattgattgaggaagacgtggaggggggcgagggagtaaatgatatggcggatgtggaggtcagggaagagaatgacccggtaagggaggaagtacatgcagaggagaatgtgccgttaagggaagaagtacatgcagaggacaatgtgccgttaagggaggaagttaatgtggaggagaatgtgccggtaagagaggaaggagatgttgaggatggtcgggaggtaggagatgatgtggagttgcctgaggaagaagcgaatgctaagaatgtaagtatgggccaagggagttggctaggctgaaattctatacccgagaggagtgtgaggaggctatgatacgcactggattgaacccaggctggttggagtatgatacagaggatgaattggatgagtccgcttccgactccgatgatgatcgttcagtgcgtaagatgtcagagcatgaaaggactgtgtttgcgaaactggtgggtagaaacccggaaataacacaattcgaggatcttaccagatctgggctagcaattgctgatggggatccacaatatgacggtgccttcgaaccaatgtgtgatgaaccaaggaaggggttggagtttcgatcgatggatgatctgaaaatatggctacagagttattctatccgtgtccaccggccgtaccatgtgaaggaatctaacgcgtcagtaaagtatactgtggcttgtctcgatcgccattgcaaatggcagattaatgtaaggaagagtggaggagataggtggcgggtgactagggtgggcgaagaccacacatgctgtagtgcggaagtaaccggcaagcatttgcaacttacttcaaggtttattggaaacaggttacaggcatttgtgcgagctgaaccaactttatctccagcagcgattgtcgaggcagttgagcaaatatggcactatcggcctacgtatggcaaagcatggcgtgctaagcaagttgctatgaaggttatttggggagattgggacgaggcgtatgttcgcttgcctacactgatgcgtgccatcaaagcaaagaaccctccatgcatttccgtgttgaggctcatcccgagaagtccaggatggtggatggagtacagaggcgagtatttggacgtgcatattggatatttggccagtccatagaagcattcaagcacttgaggccggtgctagcaattgatggcactttcttaaccggtaaataccaaggtacattgctcacggcaataggggtcgacgccgggttacatcttgttcccttggcgtttgctctggtagagaaggagaatacatccaactgggagtggttcatcaacatgttgagaaacaagttgatcggtcctaatagagaagtgtgtataatttctgatagacaccctggcattttgaactccatcatccacatcatgcctcatcacctaaccattcaccacaggtggtgcatgaggcacttctgtgctaacttctacacagctggagctacgactgatcagatgaaagatcttgagcgcatatgtcaaataaatgagaaagcattgttcctagatgagataaaacgcctcatgggtgtggtcggagagaggccaaagaagtggctagaagaccatatgccacttaaggtcaaatgggcaagagcatttgataccaacgggcgtcgtcatagcatcatgactagtaatatggccgagagtttcaataatgtattgagaggcattcggaaactgccggttacagctattgtggcatacacattttcgaagtgcaatagttggtttgtcgatagacacaaagaggcaactgtagatatcctgtgtggaaagaagtggcccacaaaagttaaggacatgttggaggagcagcaaagacgaaccttggggcaaagagcagcatgttttgatttcccttcgatgaagtatgaggtcagcgagcaaggcggagtcacggcggctggggttcaatggggtggacgtcactacgtcgtggttgcgagagataacacatgtagttgtcagttccctcagctccatcacttgccatgctcccacatgataaccgtttgtatgttgcgaggtttggatgtggaggtggccccccgaatgtgttatgaagcttccaataaggctgtgcaggactcgtactcccctaggtttgaaccttacctagatccatcgcagtggccaagttatgatggagagttcttcgtgcccgacttgtcgttaaagaacaacacacgaggaagaagaaggacaagaaggttcaagaacgatatggacaaagcatataaaggctcagccaaccgacggtcacaaaagccgaacaatacaaattcagagccggtcatgcaaaatagatgctcgctatgccacgaactaggccataagaaaactaggtgcccgaagcgagacaagtctaaggatcgaccgaaaaagcgccgtaggacggggggaggtggtgagggtagcacacaggtgggattggatgacattcatttgctaagttcatattgttgcttcaatgtttactttccgttgtcctcctttccgttctcattgtgatttttccatttaatattttttcaattactaatgattcaattttcatttgcaggatggagcactttccggggttggaggatttctacgaggagaagcaccgggccccacagattgccagcggagaggttagcatcaacaatattccatttttttatgatcgaatttattttttcttctttgattttagttcgtacagatagatcatccatcatagagatatctcaaatcaaaattcatgagcctcaaagcagagcatgtaaacacacagatcttcttttcagttttcttgctcaatcccaaaattaaagttcctagttgcatgaagtattttccacaacccttgtatatgatatattgtcgctaactttatgttattatgtttgtctattgatgcagcgcttgaagacccttcgagtcagaggtcacacggcgcacatactgttcgacgaccggtacgtcccgtacctacggcgggcgaagctcttggcgttcgtgaccatggcgcagcgaccggtgcctctgtacaacgccgctgctctgacggccctagtggaccggtggcgtccagagacacacaccttccacctaccgtgcggggagctgacggtcactctggaggacgtcgccatgatcctgggtcttcctatccggggtcaggcggtcacaggtgacacagcgtcagggaattactaacgagtcttcgtattcatttgttaatttttttgcaattactaatgattccatttaatttccggttacaggtgacacagcgtcggggaactggagggagagggtcgaggagtaccttggtctggagcctccagtggcacctgatggtcagaggcagacgaagacatcaggggttcctttgagttggttgcgagccaacttcggtcagtgtcccgctgaggcagacgaggctacagtacagcgatactgcagggcgtacgtgctgtacatcttcggcagtattctgttccctgactctggtggagacatggcttcttggatgtggctgccgttgctcgcggactgggacgaggcgggtaccttcagctgggggtcggctgccctagcctggttgtaccggcaactctgtgatgcttgccgaaggcaaggcggggacgcgaacctagcaggctgtgtttggttgctacaggtaagttcacgcatgttatgtttcataacatttcaatttcttgctaacatgttggaagctaacgtatgtgacgcaggtttggatgtggatgaggcttccagttggtcggcccatgtggaggacccatcaggcttggccgcaccaggatgcagaccgacgtcccactgtagctcacctgtgggaatcggtcccatctccagtagtaggccgcaggaatttggcgtactaccactacacaaacgagatggactacctacagccagaacatgtaagctattcggggttctatcacacatgaagatggtttcttactatatagtactaaatgtgcttcaatgtgttttatttttgttgctgcaggtggtgtggatgccatatcaggcacaggaagtgctcgagctagaactgaatcccatgtgccatatagaggatgcgttgaagaccctacggtgcccactgatctgcttctatgcagtggagttccagatgtgccaccgcgtgatgcggcaattcgggaggcttcaaacaatcccacaccgtttctccacgagtatcgacctacacaagttagtaatttcacttaacaatttattttgcttgcccaatcagtcacttcaacatttactacatatttgagttggacattttgcatacgtgcagggtggaccgtcggaagaacaagaaggtgactgattgggcttactaccatcaggatcatatcacgcaatgggagaagttcgaggagaatggagtaccagaccagggtcagcacaacgggacggagttcgacttgtacttggcgtggctccacaggacctaccgtcttgtcctacgtccggcttggacactagccgacatagcggatgaccccgaggatgttgaggagcagaacgagtacgatactcgtacccgtctaggtaccacggtcgagacgggacctgttcgcgacagagtggttagtttctagcattaatgttgtatattatttcatttcaatgccatatatgttgtgacttacttcatttcaatcctacaggctcgagagctcttgcggaccgtcaacgacgcgggagtggcgctaggcacggctcctggctccgaaggagagggcggcaccctccgcaacgccctacaggtaatcgttggaaagagatgaaactacggtgttttcttccaaaagcgataacttaacatggattattttttatgcagagactacggcagcgatgtcggaagttggcagcaaggctcggctgcaggtcgactgatgtggtcgaacatgctcatgcccaccaagagggggatgaagaaggggaggtgggtgacgaggagggcgagcaagacaaagaggcggaggaaggagatgaggaggaagaaggggatgaggacagagaagaggaggcggatgagctcggtccctcgcagctagaggacgcaccagagtcgtcacagccggatatcttgcagcccggcccgtctcgaccacgacgccggcgggctccttcgcaggactggaggtacacccccgacgtgcctcgtcctcgcactagaggtaggaggaggtgagtgcatggttcaatggatggatggatagatggatggacttgatgcatggttcgatggatgtatggactggatgtatggactcgactggatgtatagccgaggatcgatgggatgtttttatttcttatatgtatggacttcatatatggatgtattgatggattctatggatgtatggaatgatgttgggattgatggatggatgtatgttttgtatggttctctggatatattactgcctgtaaatttctgtcatttgatgtttgcctgtgttgtgtgcaaagttttgctaaagtttagcagggctgggacgtcagcgccatgcaaaatggcgctgacatgtccaaactcagcgccagtgcacctggctgggccaaggccgaaacggccaagtcccacctcagcgccaggttggctggcgctgagtttcccacagtcagcgccattttggctggcgctgaggtcccagcccgcaagccatccagaaggcttgcttggctgggccaaggccgaaacggccaagtcccacctcagcgccaggttggctggcgctgagtttcccacagtcagcgccattttggctagcgctgaggtcccagcccgcaagccatccagaaggcttgcttcgctgggccaaggccgaaacggccaagtcccacctcagcgccagtcccaagatcagcgccattttggctggcgttgaggtcccagcccgcaagccatccagaaggcttgctggtctgggccttggggttgcggccaagtcccacctcagcgccagtccggttggcgctgagatagctgccacgtcagctggggatcggccccggccgccacggtggcacaatgtcagcgccagtcccgttggcgctaacacggccaacgtcagcgccaatgtgtttggcgctgaggcgacggcctatttttggttgaagtttttggcaggggttagtttcgaaataagtttttgaaaagggtcaatttgtcaaaaaaaacggtgaacacttgccattttggacatcgatgtggtcttcaaaatgcagctatgatcactaatttctatctattgcaaaatattcaaaaggctaattataatactaaaaaatatttttttccttttcaagacaaatctataaacatgatttttataaatttaatccaaatattttataatatatggatgttcaaagtttttaaactttgacttgagatatgtccaaaacgacatgtttttgtaactgaaggagagagtacgtggcatccaattataaaagaaccgaaagaatcacaggtttgtaggaaagcactaacaaaatgaaatgagatggtgccatctgtcaagggttaagggaacttgtcatgtctttagccacagatagttcaaggttccagaattcccggtagctatagtgctataccaacaggtataccatctgaggccattggaagcaaagattgtgtatcgatatgaattagaacttacaagcggaggtcatttttgctacttacttttacacaagtgtatcatcataaagaaattgctcaaggttgctatatctggtgggccttgtaaaactgaacaaatgcatcttaacgaaaaaagtgtcagttaggacaaaaatcgctagttggtgcttgacttaagcagctaatgtccctgctgttgtaaaaatagtacagctatattgcttcacactgagacatggttagaagggtaacactgccctattatgtagtgaaaagatgtcgatagcatagctccatgatgtcaactccctatcaacactaggtaaaagtttgtcactcactcactctcaccaaacacattttatgtggaagctgaagctatgcaacagtaatccaattatctccttgtatatcatcatcatctgaaaaggccaaaaagggcaatctcgcaaactaatgttattaccttctgtgctccaaagtccaaacatccaactctgggctagaccatcatcattgtaatactttcagtgtgataagaaattgccaacaataccatggaaaattttccctacaatcatgccattgaacaaggaatgagccacaattgcagtttgcagacttgtatttcccactcataatcagatgcaagaacttagaagcacacaacaagatgtacattagtacataacatttttcgtacaggctatatatattttttctttagagaatcagaccatattacaaatataagtagtttgacagtacagtatatttatggtatgcaacacaaggaactataaagcatgctaagattcacaagcataattccagaacgtaatgtaagtttgaaagaacggtgtatatacttgtgtacaccataaaaaatggagcatataactaagaggaaaaaaaaagtactagtaggatacaacaaggacatgtataggactcagcagacaaggtattgcaatgttgttgtaatggtggcaaaataacatccaatcataaagattaaacgctcagcagtttagcagaagttcagctaaagaagtccttggttcactgatatgttctgaagtagttgaacttgatagtagaggataggacttgagtacttactccatcacactatcagatatggatcatacaaaaggcactgtagaagtgaacagtattcatttctcatggccttaagtgcttgtaagaatcatcactttatttctttacatgctccacagcaacaggatggtctatctgtcaaaaaatatcacaaatttattgatcacacgtcatgaagaggatgttgagtacgcatatgtcaaggcatgacaatattgaatgatctaactgcatggattaacacaggtaatgattttaaccctatatgtaaatacagatacttgtacagttcccttttttttcctatgcatatatgtgtgaatgtgtgatcgtgtggcttaaccttacttaattataaaattgtgatcttatgtgtgttgtgaccttgaggtcaacatgacatcatcagttcaccaggactctggtgtcagaagagtcctgatttgaccaacagatgtaatacagtggcagatcaactcaagcagcctggagtaatagacctgtagccatgtaggcaaggcacaattacaaaaaatgatatccaactctctacaaggtttacagcattatgcaaaaactgccattcaaacgctggacagctataggaattcctattagtacaatttgaaacataagtacataaaagcactggttctcgaaaacttttccctaaccaatggcgatgtgagttacaaacataagtccacacaggtcaagcagttaactctacgtagctggacagctctaggaattcttattagtacgatttgaaacataagtagtaaataataaaagcactggctctccaaaactttttcctaaccaatggcaatgcgaggtacaaacataagtccacacaggttaacactatgtagtcggtacagatttgacaatgtcatcacctaatgttacttgaaagtttgtggagtgattaatgaaatcattttctatgttaccaattgtttaagaaaattgtaaatttctgaagggtttaaattggttgcaatcaccaaaatttaggtgctcccagagcccagaaatgtcgtcatatagtaactgtacaagaaaacggcaggcaatactcggaaaataaaacaatgaattcaatgtgcattttgtctcttaccttgcaaattgcataataaccatgatgagcaatcccatacgtatctgtaatatccaagaacctcccacatctcttcaaggaatctcatgatcgctgtaaatagaggatattatcatcaatcataagaaaatgcaggaaattgctaaagtgtccatggatgattgatttaagtgattagatgaaatgaatgattacctcaactgttatttcagcatggcaaaaagggcagtgctttgtctgttgtgtgttcttggttcactttacacattgccaatcctgaatagattaggatgatatcatttgccaaagcatgttacttacatatatgctcttctgcaaagtcatcatccgtgtcagctatagatttcacaagagtgacttccaccagttcatcgcaaagtgcaagggttgactccaaattatcttcattaaaactgagatcaatataaaagttgtatacatctggttctgctgtaagacgttccttcctcatcttctcaaataatcttctcgcttcagtaaatttcttttttttattcaacaatcttataagagcattgtatgagcttgcagtaagcctgaatcccttttctatcatttcactatggaaatacagagcctctttcatatttcttgccttacaatgtcccttgatcaaaatattatatgtgttttcatttggtaccacctcctgtgaaagcattcccttgtagatctcggtggttgatttcatgttcttttcaatgcaatactgcttcataagagaattgtatgttgtggtatttgggtggatgttcttctccagcatccattcaagcagcctcttacctccttctaccctacctgacatgcaaaagccattcattagaacattataagtcacaatagtaggcttaattcctttatctaacatctcttgcaaaaggctgtgagccctgtcaagctctttggactggcaaagagcaccaataatagttgtatatgtgtaaacgtctggtttaagacctgcttcatccatgtctatcatggtcctcatagcttgctccaaattgccagccttgcacaagccattgatcagggagttgtatgtgaaaatattcagctctaaccccttgctgcacatctcatgcaatagttcattagcagcacacacatccccctgcttgcagagtccatctgacagagccgtgtatgtcactacatttggtgtcactcgtttctgcaccattttgttatgcaccagaaaggcctccgtcatcttcccaaccttgcagtacccatcaatgagaactgtatatgtgaccgcatcaacatccaatcccttgtcctccatctcctgaagcactctctctgcctctttcaactctccagcccgacaaaggccattgatcagcgcagtatacgtcactccatcagctgccaaccctctcttctgcatctcatcaaaccaattccttgcagctgccaaatcacctttcctacagaacccactcattaccgttgtgaacaccgctgcatccaacaccactccatgcatcaccatatcctctaccaccctcacagcatctgaaacctgcccttcgtcgcacaacaatgcaataacactagtataggctactgggttgagttccaacccccttgctgccatttcacttaacagcttaatcgcagtctccagctcactaagagtacaatacccatgcaccataatgccatatgttacaacatctggcggcgatgccatttcatcaaacagttggtgcgcatccttgatgcggccagcggtgcacagcgccttgagtagtatattgtacgagcaggtgttcttctccgggagttcctgaaacaactgaacggcttcatcaagcgggaggcggcagagcaccgcgttacaggactccggggagggagagatgccgtactggcggaggcggaggaggagaggcgcggaggggaggcacaggaggaggaggtcgaatgagacagggtcggaggagaaggccttgtaggtggagatgaactgctcgacgaaatgccgatgaggggacgggaagcgaagggcgcgaacgaggatggcccgcgcggcgccgggatcgcgaacggcggcgaggtgggcagcgaccgcgaaggactggagcaggtgagggtgcgggcgaggcccggaggggaagaggaggaggagcggcaggaggatggtggggaggtgcgggtgcgaggcgagcagggggagcgcgaggaggaggtgaagtgggcggaggagagggaggaaggggaggggagggagagagcccgggttaggggaggagaggacggcggcggcgaggcggcgcgcgaggtcgtcgtcggccggcgagtccgggcggggcggggagtagtccgggaacgggcgtggcgcggcggtggttgtgagggcgttgctctcagccggcggcgcgcgacggcggccgtgacgatgttgggaggtggtggtggtggtgaggctagagcaggcagagcccgcgcgccggaggaggggtcgcgagtgcgataatcgggaggagcgctccgctacggcggcgacggcgcggcggaggagcatccggcgcgggcggatccggggattgggcctcctgccggaggcggcgacggcggcggcggcggcgggagacgggcagatcggttggcaaagaaaaatgaaaaactttcgggacgcgatagcatattgaatgtcactaaaacaagaataaattcagcccaaaggtgcacgtaaattggtccaaaagtttatttgcaagtcaaataggcccagaatttcatcccaataattgggctattttgtggcccatagaaaaatcagtgatgggccaaaccgttgcctgacgtcagctggttgcagggcagaccgacgcttcgagtcccaaaacggtcaaaccgaaaccgagccacctctcgccgtcgtctccggtcgccaacccgtcccacccgtgacgtcatgccgaccgccaacctcaggtcgcgcgccgccgcggccgcggccgccgccgcatgcctcgcggccctcgcggtggcggctctcctccaccgccggcgcagacggggtcgcgctcgcgcaccagcctcgcccggcctcctcgggggacggcgagggcgccgcccgcgccgagcctgcgaggaggaggagaagccgcaggcccggttcaggcgcgtggtcgcggacaactcctactccgccttcaagcacctgcgccgccagggtgctggaccggttggctccggccaccacggcagcgaggcccagccgacgtctcaaggtgtggtcaccctgctcctgtttcttttgatctcggcattgccttgcccttgtagatgtgtggttgtattgggaattctgcgaacggttggtacgctaaggagactaaggcaggattaggggggacgtaatagcgtgttggttcttcggggaatttcgtcgaacattttgagtgcaaggttgctccgagcttgaggattgactatggagatctggacctgtctctttgcatacgaggaacataaggaaacgattgcttagttgattgcacagcgtgttagtccttacttggcataggaaggggccttcatgatgccagttcccttgttggagcttcgtcaggtagttatcaacgtgcactgaaaacacaacgtggagcttcgtcaggtagtccttacattgcatgctttgtctatttctttatcaatgcattactgtacatcatcacacccttacccataatatttggtacagttagtgcatctcttgtttaggaattaggattcctagttagacaaaaattaaaaaggtggatcgatcaaaattactacttcacgaggacttttattaactttaccaaagattcctacttctcaaatattatgagttagtaagtttactacaaggctgtactgcacagccttgctcacaatatttggtacagttactgcatctcatgtttagggactcctagttaggcaagtaaattgaaaagattgatcgattaaattactacaagtgcataaaccgttattgatagttagtaagaggagatgctgaaagcacaagtgcctgagtttaagtttgattgcatgagttttcaccatagtctctatgcgcatactgcaagcgaattgactgcacattgagtaggtgacacatttccttttcttatcgatacagagtcatcacaaaaggtgcatccatttgaggaggaaatcacttccttgctgaacaacccacctgattttcagaattttatgcctggtgatcgatgcccagaaatgagcacttcatacaattgggtcgaaacagatgctcagttggaggacctggctaggttgttggatgatgaaaaagcttttgctgttgatacagagcaacatagccttcggtcattcttgggatacactgcactaatgcaggtaactggtggtggataccttcttattgctctgttgcttattggcctgttaagattatgacatataaatatcatttttagatctctacccagaaggcagattatttaatagacacaatagcgctgcatgacgtgatgagcattctacgaccagtttttgccaatccttcaatctgtaaggttgtgcatctcttatatctgatatcactggaaaccattagttttcattttcagttctgcttaaagtgattttgccacttaccatttgtatttttgaattgtgatggatttgcatgttgtccaactttggaagctctagaattatggaatgtgcagtacagatgatggtgtgaattgatttacatgttattccaataaagtttaaattacacttgtgattacagagatagggtgtaggagaacatggtgtaaacaagttgtttccaccagcgtcacatttgtgtgcacccttggtactaagattactataaaagatatctagagaagttcagagattgattctttctggttaaagagctgagccatggtccatggtccataaataaaacaatgtaaaaatgccttttaattattatattttcaccataacacatgattcacattgtctgatgtgcaggagggattaagcctagagctttcatagttcatccctcctaaacgtggtttgtttgacagtctaatttcctgtttgtatcaagcttaaacccactaaactctaatttatgatatccataagatggtggattgttctttctcagccatcatgaaagataattatgtgtctctgcattagaggtagtaatatatttttttttccaagaatcatgctgcgttgttgatactgcagggccaggaaccactatacacaaacaaccaaaatatggaagtttgaaggacaataagtcaaaaattttttcagccaatcctaataagacatgtaatttctatagaagctgggccccgaacactctaaatgaacgaatgctgagtttggtatttggcctaacaaatcaatccaacaaacctaaagcccttaaatcttcttgtaaatttgaatttctggaacatggggccctaacagcatggatgatttacatggtacggtgggtgtttggttgatcaagataagattgctgaatgagtccatcagtgttctcatagacattttactattttgcccagaaatggtccgtttacccttggctcttcagaatcaatgctatatgaatcatttggttcttgttttttcctttcctgtctggttattattaacttttttcatgtattattctttgtcagctctctctctctctctcttttgtttactcttctctgtctattactcactatcaaactgatgatcacactttagcaagtgaacatttggacattggtagagttttagttatcgatatgtctgcttgatatttcaccatggagaaaaataaaccacagtgaagcaaacttttacaaagccgtatagacatccttatgtatatgaactgatgctagctctaacccctagactacggttttgagttgtttcattaccatccttgctcccttttctttttctgtcctttgtgcatatggaaccttcagtattgtctctggcacttgatagtctcatgaattccttcagagctcataactattttagcttgtaatctcatttctttgcaatgtagtggcagaggccttttttagacacctacactaatttctaatgagtttttgactattagccaaaatcaattgctgtataatcgtctcagcagaagatctgtgttgctttcttttattaaatgcagtttcatttaccttctccctacttatttgtcagatcttccatggagctgacaatgatgttctttggcttcagagagactttcatatttatgttgtgaatatgtttgatactgccaaggtaagtccccctacagtatgcatgtcttggatgaaacatctaataccattccgcagagatttctccagcatgcgagcgaactgtgcctgttttttgtcgcatataatgtttgcttgccatgtcttttcactgtagcaagttacatgccatactgtacgtagatatggcaataggtcatgaaacatcattttacttggacatctcattagatgtgagcatattttactttctttaatgtaatgaaagaacatcagcagtgccaatcaattgctgacctacatttgtgtgcttcccgttcatttttgcattagtggttatagttttttcatgggacaacataatgagctgctaagcatcatcaccaatattatgatatgtgatagtttaaagttcgtcacgcttgattacaatttcttatgtttcaattttatatatttgattttagcttcaagtttcaaccagaaatgtattcatggtttaagcaggggaaatgatttcataactggtttactgcaatatgaaaagatttatggatttacaatgtgtttacgatgaaaacatctttttttggtaccagttcctataatctagagtagagatcaccttcttatgaatattttggtcattgaacattggttgtttaatggcaactttgcccctaaagttattcacctatgctatcttagatgttcatttttttttcaccggacctcactttattatttatgttatgcatgtatgcccttttctgaattgccttatgaaagtaatttattgcaggcatgtgaggttctatcaaaaccacagaagtcattagcatatttgcttgaattatattgtggagtgaccacagacaagacaatgcaggtaggccatttattaaggttggcttgctaaagccactaaagtgttttcatcagcttatttactggtttgtttactgtttagtagctggttagctttcatctgccgcctcaatttttacatgattacttctttttagcactttagacacaatggtgcacagggtgctacaaaatgtttaaccatgttagttacagagaatctttgccaattcatttagagcatttgtgttgcacttatttatgagcttagcaagatatatgtttagcttttgttgaagctttcatgtcctagaaaacattagttgcataagctcatgttatgcattgttgattgtgatttcagaataataatgtagcagtaggttctttcaaattcatttttgcacctatggaagctcatgttatgcattgttactctgatttcagaatctactggtgtagcagtagattctaagtcatttctgcactatctgttgttacaaatattaagcaccattactgaaataaatgattgttgacctaaatacctaatggtggtcagtggtactaagccctaaattgtggtggttttctgaatttgtgcctttacatcctttaaagcatgtcactaaaatggttgtcacatctttagttatattttgtcactacttgcattactttatgcatgattcccttgcccttttactcaattccatttgatcctcatacaaattcttgatcgaaactctgttccattaatcaatctcagctgatatttagaagcctgtttccttatgcattcaattgttattaaataggtgacatgtaaaagaaaatgataaacaagttccttctgcctacttgtaatcgatgaccttttagttgtgcctgcaaaatttactccttccagtcaagtatatttgacatagggagtactagaactgatactcccaacgtcagatatacttgaccggaaagagcagtttgttttccagcatcacagttgctctcatttttacggttcattctccttgattctgatatttcagcgtgaggattggagattacgcccactaacaccagaaatgattcagtatgcccgttgtgatgcgcattatctgttgtacattgcaaattgtttggcatcagagcttcatgcaaaaacttacggtatgatctatgttcctatgtcgagtttccccttgcttttttggaggggaacttttcccttccaatatgtactatatgctacttttagttgttacaagatagtaatttgttcagcaaactgagtcaacaaggcaattagggtgtgtttggttgggtggatgggactggatgggagatggccgcctgattttttggggtgtttggttggaggacagggtggatatggtgacccagaatagagaatattctctcaatatgctggatgaagggatccggttcttttggccggatgaagccatccaccttctttaggacgctgattagtacatgattagtgagttgattagagtatgattaacggtattagcatgttttgctattaattagtagttagcatggcaagattagtgtcaacaagtgttaattccaaccggtaagtgtataactagtaatattatgccaattaagatattataattagttaattaatctcatccgatgcatcctcatcctatcaaccaaacaaaaagttggctcatcccatccatacaaccaaacacaaaacttgtatatcctcatccttaaaaacatggatgaacatatcccatccaaccttgcccttcaaccaaacatggatggacatatcccatccaaccagacattacagcattaccacagacagctacatttgacatcttagagtcctagacaatagaactcatgactccctgcatctctaaattagtttcacatgagctcacaagcatcagtttatctggattgttctatgttcacccttcagttcagctgagcacattgttttctgcaaatgtaaattactgatgtagctctgttgggctgcgttccaacctagaggttcaaaacgtttcctctctggcacgaaaaacaggtggctcattagcacatgattaaataagtattagcttaaaagacttgaaaatggattaataatttaatatgatttttttaaataaactttccaatataaaatttttgcaaagaacgcaccatttaccaatctgggaagcctgcgcatggtaaacgagggagtagaagtttggaaactggaaaggggagcttagaacacagccttagtctgttatgcttaaactttaaaaagcttccagtccttgagctgtgtctggaggaccatctatgaaaaaattatataaagatatgcactatctattgtactctcttttgaatgcttcctccacccaagaatgtaaggcatattttttggactgcagcccttagagatactaattagagagtaatcaagtaacgtctaatgactctttggtctatgttcaagatgaaatatatcttacattataggacagaggggatcagtaactttcaagctacaagtaaaaacaaaatttcatgtactaataccttaacctgtgcataaactggaaccttctggatcaagtatctaaaacttatttgataataatatcagcaaatatttagctttgtaagaaaatatattggtctattagcctatacaatcctgttatgcagcttaagaaaatgagattccgtgttgaattgatgatattttattgcttcctgaaaccaaattacataattatttccattgttccctgtctcacttttttgataaactgtaatatctaatcagatgcttcagactctcccaatgacaaaatcaattttttcttcgaggccagccatcgctcaaatatggtgtgtatgcaactgtatgcaaaggaaattgaatgtccaccaggagcatcctctgcggcgtctattttgtcaaaaaatttgcaaagccatggacttgactcctataaatcaagtgaagtgaaggtgctcgttttctgtatttgtttgcctgcttgccagtgatttcaataaattctcaattttgttgctcttttgtaggatcttgtttggaaaatttgtgcatggagggatttaatggtcagccaacatattcttattcttttagaacaattgattttcgcattttcgtagggtatattcttagctttttgttaaatctattagctgtatttggtgcttcacacattgtattttcctatttctgcatatattaagttgctgcacccaataatttgacatatctgttttcttgtgattctggtctctggatttccagactcttcaattatcttgattacttcattgcaggctcgcatgcatgatgagagcttacggtatgtcctgtcagaccaagctatagcttcccttgctgttagtgttccaagaggtccaactgaggtgtgttctgccatattagaaactgaaacaagcaattcaactgtgtatccttccttgccgccaccttcacctattgttgttgctcacgctgaagaacttcgctatctgattgaggacatcactgtcagcatggatgccatctttaaaaatttgcttgagaagtacaaagatccaagtagattatgtcgactatcagtttttaattataaccttgtatcacagctgagtttgaagcaaaaaaatatgttctcctttgcatcaagtggggagaagttgttgatggcaccaactaacaaaaaggcttcccgggaattattcattaaaaagttttcatgcaagtccccagtatatcacaattgcaggatctacgccagtgatggaagactgctttgctactgtgaccgtaaaaagttggaatggtttgtcacttagatgcactatttagtgtttataggtatgtaaaatcatggttatcttatcaaactgaccgactcttctttccaggtatattcaacgtaatttagcaaaattaatagaagataatcctccagcaattgtgctcttgtttgaacctaagggtcgcccagaggatgaggataatgacttctatattcagagcaagaaaaatatttgtgtcggatgtggagaaaagagccactatatcagatatagaattataccatcgtgctacaggatgcattttccagagcatctgaagagccatcgttcacatgatattgtacttctttgcgtagactgccatgaaattgctcattcagcagctgagaagtacaagaggcaaatagccaaagaatttggggtgccgctttttgtacagaagatattaaactcaggtgatataagtttaatagctggtgcatcattatctgaagataaatcaaatggaacaggtgtgtctcctttgcagctgaggactgctgcaatggcccttttaagacatggatccaatatgcctttgaagagatatgaagagctaatgcaggtgatgagaatcttcaagtattttgggcttcaccacagtttcaacattgtcttattgaaacttttcatgctagttatcatcaatatttcagtagaccaaatttgttcttataattagccttaaatctgtattgctgacctattcatttctttgcagattgtgaagtcatactatggtggtagggatgtgactcctgaagatcttgagatggcattacttgttggcatgagtcccaatgagcgaaggcgacattcaaagaaaaatggtttttcttaccgatcccaggctcaaaatgttattagaaaaagcaacagcaacggcattgttgagaataatgaacatgatccagaaaatggatatgctgagcaattttctaaaaatggagttgagaataacagtcatccagacattgatgagaataacaatcagctaggtattgatgaacataccagtcagccaggctctgggggtaataagatacatggtccaactctgagcaaagaaagcacaatctatccaccccgtatggctaatcccatttctgactctagcattgaggcagacaccgtgcagcaagcaagcttaggtggtaatcctgcaaacggtgatcttgacagggatccatgcggcagtaacaattctaaccaagccattccccaaaacggtgacaagaagatctccctgttaggtcatgggcatcacggtaaacaggtcgtggagcttttgctttccaacggtggcgaggaggccattaaccagttcagccaacggtggaggcaggtcttcgtagcttctcttcaccctcgttatttgccttcgggctggaatataaagcacaggtgaattcacctgtcgttttgctactcggtttgttctcacacattgataattgcgcatgtttgtggtgcaaaatcaccctggttatctatcaactatgtgtaggtagatttggaagattttttctgttagatgatttttttttcctggacaattatctttgaccctctggacatgcataccttgtgttctttgctgtgtagtggacggcgggattttggcgatttcagtgtctacaagccatcaaagaaacctcctgctgcagatcaatccgagactttagctgctgctgctgttgtaccctgaggttctagtttacattcgaagttacttccatttcattaaacctgaaccttgtacctgtactgtgcccttctatattcatgtactaccttgtttctacatctggaaagaactgggttacatctgtttgttccctctgccatgaagttttgtgctcaccaattctatatatgcagaagaattacagcaaaactggtaaaataaataaaatcatttccttgctaaaattgaaagcaacaagcacaagtactaaggctgtgtttagttccacgctaaaattggaagtttgaataaaaaagttggaagtttacgtgtgtagaaaagttttgatgtgatggaaaagttagaagtttaaagaaaaagttgggaactaaacttggctaacctaaccatcatgtctaaagcttgtgttaatttttatttttttgggtagtatctgatatctactgcaggatgccaggatatcctcagcacgatcctgagtcccagccagtgtgagttactagtatctcttttccttttatttttcatttttccaatatgctagtatttctttcagtttcagatgggccaagccaaaaaatgattcgagtgaaatggaagcagcagaagcagcagcacatccatccacatgatccgaccactgcctcctccaccactcaccccgccttgaaaaccccacctgccctacttccgcctggagagcctcggcccctcgcctcgcctcgcctcacctccacccaaacccaatccgaaatctttccctccactcgccgccgccgccgccgccgctgttgccggtgacccgccagccatgtcgtgctcgcacctctccaccgcctggtcctcctccgccctggccacccgccgccgctccgctcctagctgcggcagcagcggccgcctgcaggtggtgcggtgctcgctgcgtgagctgcggagccgcatcgactcggtgcgcaacacgcagaagatcacggaggcgatgaagctggtggcggcggccaaggtgcggcgggcgcaggaggcggtggtgtcctcccgccccttctcggaggcgctggtggaggtgctctacaacatgaaccaggagatccagacggaggacatcgacctccccctcacccgcatccgccccgtcaagaaggtcgccctcgtcgtcctcaccggcgagcgcggcctctgcggcagcttcaacaacaacgtcctcaagaaggccgagacccgcatcgaggagctcaagcagctcggcctcgagtacaccgtcgtcagcgtcggcaagaagggcaacgcctacttcatccgccgccccttcatccccaccgagcggacgctggaggtgaacggcatccccaccgtgaaggactcccagtccatctgcgacctcgtctactcgctgttcgtgtccgaggcggtggacaaggtggagctcctctactccaagttcgtctccctcgtccgctccgaccccatcatccagacgctgctccccatgtcgcccaagggggagatctgcgacatcaacggcgtgtgcgtggacgccaccgaggacgagctgttccggctcaccaccaaggaagggaagctgaccgtggagcgggagaaggtgaagatcgagacgcagcccttctcacccgtggtgcagttcgagcaggaccccgtccagatcctcgacgcgctcctcccgctctacctcaacagccagatcctccgcgcgctccaggagtcgctcgccagcgagctcgccgccaggatgagcgccatgagcagcgccaccgacaacgccatcgagctccggaagaacctctccatggtctacaaccgccagcgccaggccaagatcaccggcgagatcctcgagatcgtcgccggcgccgacgccctcgcctaaatccaatcaactcatttcttcatcccatccacctcgcttgagctgctgaggttgctgctgttatatatactactctattcttttttacttcctttttctctcttgctattgtgtctgtaatttctgtgatagcacgaaaaaaaaaaggaaaaaagatcgatccgactcgatcgatgtaattgttaatcgcgcgagatacacaagatttcaattcagcgatgccaaatgtacaagcagagtattctactactatcttgcaatctcctctacttgcctttctagattaggagggatatcgccgtatgcagtttcttccttttcttgtgtgattttggtgttgacgacacttcctttttttcctttccttttcttttctgtttgcttcactttcctcgagcaagcaaacctgtgatgctgcttcaccgtgcacaactgaaacagtgtcgtgtcgtctattagctgcaagttagcaactttgacgggcagcagttcacaggatcatcggagaagaacgacgccgccggcgtccagagcttcctcagcgagcttcattcccgactgacgccggacacatatgcccatcgtcgatctctcgttctgcttttctccgattggtctccgtattgcataaggagaaggtgcaaactgagccgccgtaagtcgtcgcccagcccctccggcgacacctccaccagttcggcttaggcttcgcgcgcgaatctgcgatttctaatcgggctcggattcagcaatgccgcgcatatagagaagaattcacgaggattagccattaatcacagcaagctaatcaccgacttcaactccaactccgtctccgacttgctaccatcaccgatttcaactcggactcggactcggactcggctgccgataaatccaagcccgccgccactctccgtctacgcattccccacaattccttccacccatcctcgcagcagcgctcgttcgtccatggcgcttccccaccactcgagtccccgctcctcgcgcccgatcagccaccgccgcagtgagctcgccgtcgaggccaaggggagagtagtctccaataaggcgtcaggagggtcgcccgtcaagaagatgtcatccgcgccgtcgccggcgcccgtgtccttcaagaagggcgacgaggtgcgcatccgcacgccggttgggaggctagggaccacgacgctgcgcctcgtcatgtggctcggcgcggtcgtcgtctccgacgctgatgccgacgacggccacctcgaggtcatctacaacggcaacttcccgcgcgacgaccccttccggaccgtgcgcgtcgccgtcaaggacgtcaagctgcccgcgccgcgcccggccccgaccctgaccccggcaaacatggcggccccgcggccgaccacggccgtcaagtcgctgccgcggctgaagatgtttgtgctggagaaggagcagctgcgggccaaatccgaggccttgttggcaccgtgatcagtgttcttcagtagtagcagtagctgcagaagtttgtaggaatcagaacatgtcttggtttgcatggaaggcaatgtgatcttgtaaattctcatagataggatgatttcttggcatgagaagaagaacatgcaatctgtgtgaactgtaatttctcattgattatgaatggaagatcgaggccaatatatgcatgcatgatgcatgttgatccaagtgttcggatcagaatcacaatccagctgcactctgattacatgtatgattacaatccacctgccgataactttgatcttatagctaggattcagcttccaattctttgcatgcctttggctttccttgcctttgttgatcaagagcctgggtatgcagcaaacaaagcatctagctggtaatgtcattttcaattttcattcagacgaaccgtttggctctcagcaacatcaacgaatcccaaaagaattagtagtagtctgttcacaaagaaatttagttgaggcggcaatgttattttgtttcactttgttgctccgaaaagatgtaaactgccgaactgcggattaagggactgtttggcacagccccagctctagctccacccctcctggagctggagctcagccaaacagtttcagctccaccaaaactgggagtggagttgggtggagctctctcacaaaatatactagagttgtgaagctgggttttggcagctccacaactccactccagactcaattcctggagttatatttaggagttggagctataccaaacagaccctaagtagtgggctttgggccaaatgcgtcagagatatttaactatttgctacttttaggtgtggcaattaacgatttaccactgggcccatatatcatagacccatgtggacccacatgtcattgagataggagtgacaaataattaattgccaaatctaaaaatgacaaatagcgtggtggacaagatttatgtgacatcggttttctcggctagtgggttcaagcaaacaagaccggaggacctacaaatggggctcctgatttttgttgtaaaaatcgggcattgtttcagtttgttaagaagaatgtttctccactggcttaacacatgtttcagactattaaaatgatgaaacacggttgaatcatagattgaaacatgtaacatcaaagttcaattactgaaacatcaacaaatccataaaaatcaaaggacaaaattgaaacaccataagaaatctcgctgtaacaatttgatccaacacaaagaaacatcgagatacatcggctgaaacataaaaaaaaatcgtgaagatatcagtcagagctggcttcctccctcacctccaatggcggcagtgcaggagtagaccgaaaaaatgacacccgtagacatccagcaagcggagacgagagctctggcgacaaccgtgacgaagaagacgaccatgctgctgttcacgaccggacaagaagctgccaggctgctccgtgtgagtcgaccaaccttcgcctctgcctccatgtaaacacccctcaatcacaatcaggcggcatgccttgttccatccttggacggatgagctgacgactgacgtccaacatggcgtcgatggtggtgaaggcggcggctgtggcatcaaacagagaaaacagcatcgaacgtgagagagagaaagggaggtgcgagaaagacagagggagtcacaggtggttgggaaatagcgcacggcattttcttctctccgtcaggcgcacgtacgataaatagcatttttgaaacaagaccaacagaaaaggatttctttttttttttcagaacaactaggaaacaagatatcgtctatacaacgggattagttatgagtgaaccattattttccatgatttagctatgctctgagtgcatgcgaaggtggcttaggcgtaacgtgaggaggtagaccgtggtaagctggttagaggctagaatagcacatcctgtgtactactatatactatactagtagttttttagtactactgtatactatacttttagtatacttttctaagtagtactagcttttctttggtacacctttttatgcagccaaagttcacactagagacctctaagagtaagtacaatagcaggctgtaagctagctataactatatatcgagaagaaaagagaagagagagaagaaagcgggctacagatttgtagccagctgcagcacggactctaagacgttgtgtgtgtatgagaggtaggaccgggtattaatggtgtagtatatttttataggtaactattatatgaatgggttattagattagctatagatgatttggagctaacatttggctatactattaaacttgctctaacacacttctagtatgtctttttatgcactagccactagagttaagagcttggccatatgtatagtactcctcatggctctcgttggcgcaaagacctgatacccacgaatcatacatgatacgcacaaggtatttgatgtctgtgtatcgagtccctaatacctaggtatcaggtaactggtacccagattattcgagttagtaccataggtactagacctgatactataggtatcgaggtacttggtcgctagatcgggatggtatccataagtaacagaccaggtactaggtatcgggtacctaaagtacttagtatctatatcggtcagataccagtaggtaccagacctggtactaggtatcgggtacctaaaatacttagtatctatatcggtcagataccagtaggtaccagacctggtactaggtatcgggtacctaaggtattaggtacttggtccctagatcgggttgatacctgtaggtaccaaacctgatattgggtattggatacctcgtactacattgggtattaggtacctaagtttgcactgatgttagcatcttaacaattgaaaccggtgtgttatgtcttcagcaagaagtcgtgcgctgacatgtggccccttgagagaacacgaagagatgtgggttgacacgtggggatttacgtgaagttgataaaataacacaagtggttggtcggtcaaatagtcatgctcatcaagtttggccgtaatctgaagaggcccaatataacgggaaagtgttttcatccatcgaggggagtttcatgcatgccacctaaatagtcatcaaaaaattttttaaaaaaattggtaacatatattaatatgagatatatcactctacaaacatgcaagtttaaattcaactcctataagttgtaataaaaataacaaatatagctatgaatgtacgataactatttttagtttaattttttacttttgttgtaacttgtagaagtttaatttggtctttatgtttgtggagtgatatatttcatattaatctatattgtctattgttttcaaattttttaatgactatttagatgatatgcaaacaacaaggagatatccactcgagagatgaaaatccacatcccaatataaccacatatgtattgtttcagactatcagtcgatctctcgttccatttttgggattggtattgcttatggcggcggtgcaacctgagccgccgttcccttaccttccggcgacaccttcagattgaacaatgccgcgcagagaatgaatagattgtccaagtagaataccggatcagttaatcacagccaagctaatggctgacttgaactcggacaccgacttcaattccaactcggactcggctggctataaatccatgcgcggccgcctcccttcgcattcaccacaattccttccgccaatcctctgcactcccagcagcgctctcgttcgtccatggcgcttcgccgctcgagtccccgctcgtcgcgcctgatcatccaccgccgcagtgagctcgccgtcaaggcgaaggggagactagtctccaagaagcggtcagtatcaggatcgtccgtcaacaagatgcccttcaagaggggcgacgaggtgcttgtccgcactccgttggggaggctaggcaccacggcgctgcgcctcgtcttgtggctcggcgcggtcgtcgtctccgacgccgatgccgacgacggccacctcaaggtcatctacaacggcaacttcccgcgcgacgaccccttacggaccgtgcgcgtcgccgtcaaggacgtcaagctgcccgcgccgcgcccggccccgaccccgaccccggcaaacatggcggccccgcggccgaacacggccggcaagtcgctgccgcggctgaagatgtttgtgctggagaaggagcagctgcgtgccaactccgaggccttgttggcattgtgatcagtagtagcagtaggtgcagaagcttgtaggaatcagaacatgtcttcctctgttcttggtttgcatggaaggcgatgtgatcttttgaattctcgtagattggatgatttgttcgcatgagaagaagaacatgcaatctgtgtgaacttcaatttgccattgattatgaatgaaagatcgaggtttcgcttctttatatttttttttaccaatatattttatccttgattttgttgatatccaagagttcagatcagaatcataatccagctgccctctgattacatgtatgattacaatccacgtgctcacaactttgatgttgtagctaggattcagctttcaattctttgcacgcctttggctttcctttccttcgttgagatcaagagcctgggtatgcagcaaacaaagcatctagctggtaatgtcatttctactctgacttggatatcagtttgtgccagtctctgtgtcaatttttttctttctgaaaggaaggcaagggccatatgtatttccttcactttccgttcagacgaaccgtttggctctcaacaacatcaacgaatcccaaaagaactagtggtagtctgttcactctgttcacaaagaaatttagttgaagcggcaacattattttgtttcacttcgttgctccgaagagctgtaaactgctgaactagtgggccttgggacagatgcgtcatgcgtggtggataagatttatatgacataacggttttctcggctagtgggttcaagcaaacaagaccaatagaaaaggatttttttttcttttttggaagagtaccctccgatggatatatgagccatccatatattttgatccaaagtagaagttgtggcagatttgggaaaaaaaagcatcatggtagataagtacatttgcatgtatttttgcatggacttcttagggcgttcacagtgcgccttcgtggtattcagccccaaacaactacatagacgaaatgcttacgtgaaggagagaatggagtggggaccatgttttcatggggttcccatgtccaatttgggtacccagagcctcgtcagttttttcagaaaaaattgggtgagtgagagcgtcgttagttccgtgcatggccggaaccagcagcaggaggaaagacaatggcgggctagtggcggagaggggaggttattgttggtgcaggtgaagagggtggggcggcggctgcaaagctcgtcactagcaccggcgaggaaccggtggctacgatgccgacgaggaagccacggtcaacctcgcatcgtgtccgaaaagccgccgcatccgacagttctagtgagcttgccgcgtcgtcatccccccctcccctcccccctgcccacaattcgctgccgtcgcccaaagccagatctgactggatctggccgctcagcccgacgccatcgctgctctgcccgccgccgttgccgccgcttggatcaccccgccgccgctccaaccgaggctccactcggtgccatctaaaccgatggggaaagtgagaaagaagaactgcgaggaaaaaggggaagggaagattgaaaaaagaagataatggtgaggcccactacaacgaacttacacttgagtatgtgaatttagagggctttggatctagttggcaactgaggctcaccaagtgcgatagctgcaccgtgaacacccttatgcagctggtggggccactggtcaccgatccgtaatacgaatatgattttcttggctaatcactggattatgtgtgcgagttagttggagagaaaataggcatgctcctgtggttatgtgcatttacgtacacggtttgcatgcataggaattaggtgagatctagcggcagcgagaggatcaatctaaacggcgagctcgccgacgatgccacacgatgggtagctagcaggcgatgatcatagccaatagaagcctattaatgtgcaggtcaatagaatggtctgttctgcacaaataaattaaattggaagtcgaatataatatggatcagtgatggcgatgtcctccgccgacgagcatgtgcgcggcgatgcctctctcgtctccgcctccatgctaggcgtgctcatgctcctcctctatggcgagcgtgtgcacagatcagccgccgctacgagctcgccgtggaggcggtgagatcgacggcgagctccactacctgccttgatgtgccagagatggagagaagggaaggcgcaaagaggagggggagaagaagaggattgggctgacagtgggccccaccatgtttatttgttgtggctgacagtgggtcccatgtatctttcttttgttttggttgaccagactgccacgtgtgcgtccacgtaggactgaaactacactgggtcgatctaggggggtaattcgtcccttttgtaagttcaaggttaaaaataaccggtattagagttcagggttaaaaatcagacgaccataactattgagggggtaattcgtactttttttcaaaatataactacaatgggggcctcaaagcccacaagccaaccccacttgcattcctatttgttggtggactagcgtcccccacttcttaactttctactcatggtttactcaattcattttttaattatttatggattattgaaacggaatatttcttccacacttcaaacaatatactttctttaaaaaaaacctttttttctactgcattgctaatatcatttgttttaagctatttgttaaccttgtttcttaaaatatttgatttgtcaatgaagcggataattcactcgttccgtttttctccgattgatgtttgcatatggagacggtgcaaactgagccgccgtacgtcgtctccctgcccctccggcgacacctccaccagttcggcttaggcttcgagaaatctgcgatttcaacaatgccgcgtgtatatatagagcagaattcacaaggattagccattaatcacagcaagctaatcaccgagttcaactccaactccgtctccgacgtgctacgtagctagcttcattggtttcgactcggagtcggactcggctgccgataaatcctagcgctgcatccaccacaattccttccaccccatcctcgcagagtcgcagtcgcagctagcagcgctcgtagccgtcgtccatggcgcttccccgccgctcgagtccccgctcctcgcgcccgatcatccaccgcgccgtcgacgccaaggggaagaagccgtcaggacgatcgccggtcaacgagatgtccttcaagaagggcgacgaggtgcgcgtccgcacgccgttggggaggctaggcacaacgacgctgcgcctcgtcatgtggctcggcgcggtcgtcgtctccgacgccgacgccgccgacgacaacggacacctcgaggtcatctacaacggcaacttcccgcgcgacgaccccttccgtgccgtgcgcgtcgccgtcaaggacgtcaagctgcaggggccacgcccggccccgaccccggcaaacatggcggccccgcggccgaccacggccggcaagtcgctgccgcggctgaagatgcagatgctggagaaggagcagctgcgggccaactccgaggcgttcttggcattgtgatcagtgttattcagtaggtgcagaagcttgtaggattcagacatgtcttcctctgtttatttggtgtcatggaaggcacagtgatctcgtatttgtgataggatggtttactggaaatcttcgcaagagaacgtgtaatctgtgaagtgtatttatcattgattatgaatgaaagatcaagatttttttatatatacacgagcgatctgtttcgtctattatctcatgatcaatgcaatactatctttgcctctctctcttgttggtattgtttgagacaaatattaagtttacaatcacaatgctttactctactgctaaagaaaaacaatcctcattcgtttgtttctctaaagataactttaggtgtcaaaatcaccactacatataaggctatctctaatgtgcaacaaaaagtgatttaccaccttatctctttaagcgtgtgttaacattataacgatgctattataacaaatttatgctaaaaactatctaaacattgtcgagccggataactgtccaaacacgtgctaggtaatggtaaatacacgtagatatagaccctctttgtttaggcttataagccaacttataagtcgaaaagtctaagcctaaacaaacaagcagtttttccgtttggcttttttgaagccataagccactctaacactattaagccaaaagctaggttggagaagcttttttggcttgtgtgaggtagatgtatgactcaactactaaacttaggacattaaatccaccggcttataaatcatataagccaataagctgacttaaaagtctagaccaataaacctaagcctaaataaagagggccataatactaaagagctttgaaacacaactgctaattggcagccaatccatgctatgccctcacatgtgaatcaagcagcagaacatccattttatcgacgcttgagatatggcagatgatttgccctcgaacattatctgaccatggcccatcaatgacttggacactgacaatagtggccatgcaagcgaaccgacctgcaaacttacttacgtgtcaaataagtggttacccatggatttccacatcgtaacctagattgccgcatctagaaatgcaagtggatcgatccataaactcatttataatctatgggttacccattaattttgcctataaatagatttgtggattagactgcttacatccctagtggcctcgaatatagctcgcatcttagctcaagcttgcaacgcttgctggagcaacgtttgtgcatccttgcagggcgtgtcgcgtgatcgtagatcatgttgtgtgttatgacactcatgatgaaggtttcgtcctcagactctgttttctccctttatgaaatccattagcacgactgcacaagacaggcgcgttaacgatttggatctctgcaagcatcacaagcaattgatcaataaattaattacctatattaacatcacaactcaagtaattgatcaataacataaattgaccaatccatgttaaatgtataattactctacacttagcgcactaaggtcaggaacatataatgtttttcacaggcttatatttgtacagattatagaagtgccaaattgttcatttagtttgtatcaatgagttctttacaaagaagagcatcataggaaatacacaattatgtatactaagaatgttaaaaatgaaaactgcaaatatagaaaggacctcgatgaaaagtttttttttctagggaagggtatttttttacccgaactctacatccaacaattatgttaaaaactgcaaatataggacctaggacctcgatgaatagtttttttttttttgagaagggtattttttacgtgaactcttcatccaactagacatatgcaatattttagttctcaaataacccaatctaaaatcgctcctatgaagatttgaacttagaaccttttagctctcaaataacccaatctaaaattcgctcctatggagatttgaacttagaaccttgggtgctactcaggtcactgcaaccactaggcaaatataggacattgatgaatagtttaggcacataaaaactataaatgtagcaatgacaccctgctctcacgacaacaaaaaaaagttcaacgaatatgtgcttacgtcacctagacaggctgcaaaacaaagtgatagaccgtcatacttgtcatcgaagaacattgtaaatattgattagatgttatgcaggtatcttgattcttgcatagttctggacgcaacaggtacccaatctcttgtggatttttttccagttaggcaaaatataagggaaatctattaacttattaaaggaactaggaatgtagcccgcgcgaatgcgtgggcatgcgttttgtacactatgtttgacacagttataagagcaaaatatcaaccgtagaacatctacaaccatagaacatctaccatgatttcttcgtaaattgttttcgtcgacattaattgctttttaattttctaacctattagttttatattatagcagtatcatatttacctgatatttataagcaattatttataatcttcttcatcatttgaaaagaaggtagacttattttctttagaaaacatgtcaacgaaatgtaagtgtaaggtaaactaaggtatttttctttttttttcaattgcatatgtattattatggtttattcgatgatgaattgggtgagacatgaagctccactaaatatatgggtttatatagcctaatatgattgatgtagtttgagagttggtccatctatgaacatttcatgtagagtgggtaagaggttccacgcaagctaacgtgcatacgataacgatgaaatataattgtacaataatatttttgaaatgtgacataccatgaatacacgcttgtgtttccttttataagatagttctaacggttagaaataatggttctaccggttttaaagatataggagtactccaagaatgtagcttaaaaattatggttgttttaatatccaatattattgtgaaatgaacgtagctcaaccggttaggtttcttgtgatggaacttgctcgagttcagacttaacaaattctttcagtagtaggcaatgtacccgtcgatatcaagacgtacgtggtgatttcgtcaatctcaaaatatatcagcctagtctcttcaaaatactcaaaggggtatttgcatgtgtgcgttcacagaagtgattgtgcacgcgttgtgagcgcccgcgtttgtactttgtttaaaaaaaacatcaaacattatttattgtttctcttttatttaatagataaaacaatagggaggggatggcagtgttgtgtacatgtgatggtgaggaggtggagattatatttttctaacttttttaaataatttaagtgaaagccaatgatgaggtgtttcattttttctaagaatttctaaggtttttccctttttataggacgtgacacacggtgactcaagattttttcttaaaaaatagatttaatacatcaaattaaattgatttttcttataatttaattacaagatctaatctattggtttattatagatctcgattacatgcatatacttccgtatatgatgtagtattatattttatttttttatattatacaaaatcctatttttagaccgtagtttttccacggatactaagtacgcttttttttctttatagtacgcttttttttttgctttattttatcgtacatagatgtctattttttttcttccagctaacagtaggtagctttatatgttttttttaaaaagggagtagctatatttatggcgccatatttttcaccaaaaaatagtcggtatgtatttacattgtaattccctgaattacatatgcaattttagtgtatttataatataagtcccaaaattacatatgtaaatcctaaatttatatactaattacatatataagtggagtgtaactacagtgtaaattcgtataaatatataaataattattagttttacgatggaggtgaagtgctaatgagtttagagcttgattaggtgcagttggttctttcgcataagctgtaagatggggtgcagccttcaagtgcttgaaacgaatattactggacgatctcacggttaaaacattcgactgtacacaaatttagcaataccgttttttaattgtacttccctagggacatttattttttctttccttttcccagccaccggttgcatatgttttttaaggggaaaaactatcacctttttaataatagatctaatctaatggtgtaaataaacaggtccaccaatttaagtgaaaatcaacggtgagattagacagtgccacgtggcagcctaggagcgtttgtaggagtcccacgtggcggcttgagagcgtttgtaggaagttttatggacttttatttagtatataatagatagatagaaaaaggagtctccacgttcgctctcacatactagaaattctcatattaatcggagaaaaagaaaaacagagtccatatagaaatacaatttagaaatagttgaaattcggaattaaaaaaataaggaatattggaagaggtgattagagtctatatagaaatacaatttataaataactgaaattcagaattaaaattaaaaaaagaattaaaattttaaaaaaggaaatattggaagagaagagtagagtccatatagaaatacaatttataaataactgaaatttaaaattaaaaataaggaatattagaagtagagtatagagtctatatcgaaatgcaattaagaaataattgaaattcggaattaaaaataagggatattagaagtagagtataaagttcatatagaaatttaaaactaactaaaattcagaataaacataataaaattaaaattagagtttagagttcatgtaaaaaatacaatttacaaataactaaaattcaaaataaaacaacatgggaagtagagtctaaaatcaatatatgaatacaatttagaagtaactgaaattcaaaattaaaaattaaagaatattgaaacatgagtctacgtagaaatacaattagaaataataaaaatttttgcgaccagttctacatatggagatggtggaagctgagccgccgtcatctccttgtccaccgctggcggcggcggcggcgacacacacctagcttcgcgttcccgcctgcttggcgccattcgggattgcatgatggtggcgaggcgtaacggacgtctccgattccgagtcgagctcggattgaagaattgtgtctgacagccacgctttgcttccttcacagacttcaattcgaactcggactcggctgccgataaatccaagcgcgccgcccccaccacaattccttccacccatcatcgcagcagctctcggcgctcgtccatggcgcttccccgccgctcgagtccccgctcctcgcgcccgatcatccaccgccgcactgagctcgccgtcgaggcgcaggggagagtagtctccaagaagccgtcaggatcaggatcgcccatcaacaagatgtccttcaagaagggcgacgaggtgcgcgtccgcacgccggtggggaggctagggaccacggcgctgcgcctcgtcatgtggctcggcgcggtcgtcgtctccgacgccgacgacggacacctcgaggtcatctacaacggcaacttcccgcgcgacgaccccttccggaccgtgcgcgtcgccgtcaaggacgtcaagctgccggcgccgcgcccggccccgaccccggcaaacattgcggccccgcggccgaacaaggccggcaagaatctgccgcggctgaagatgtttgtgctggagaaggagcagctgcgtgccaaatccgaggcctttttggcatcgtgatcagtgttcttcagtaggtgcagtagctgcagaagctcgtataaatcagaacatgtcttggttttgcatggaaggcaatgtggtcttgtaaattctcatagataggatgatttcttggcatgagaagaagaacatgcaatctgttggaactgtaatttctcattgattatgaatgaaagatcgaggtttctcttcttgtttcatttttttttaccaatatatgcatgcatgatgcatgttatccttggttttgttgatccaagtgtttggatcagaatcacaatccagctgccctctgattacatgtatgattacaatccacctgctgataactttgatcttatagctaggattcagcttccaattctttgaatgcctttggctttccttgcctttgttgatcaagagagcctggatatgcagcaaacaaagcatctagctggtaatgtcattttcacttttcgttcagacgaaccgtttggctctcaacaacgtcaacgaatcccaaaagaattagtagtagtctgttcacaaagaaatttagttgaggcggcaatgttattttgtttccctttgttgctccgaagagatgtaaactgccgaactgtggattaagtagtgggctttgggccaaatacgtcatgcgtggtggacaggatttatgtgacatcggttttctcggctagtgggttcaagcaaacaaggccggaggacctagaaatggggctccctatttttgttgtaaaaatcgggcattgtttcagttttttaagaagaatgtttcaccactggtttaacacatgtttcagactattaaaatgatgaaacatgattgaatcatggattgaaacatgaaacatcaaagttcaattactaaaacaccaacaaatccataaaaatcaaaagacaaaattgaaacaccataagaaatctcgctgtaacaatttgatccaatcacaaagaaatatcgagatacatcggctaaaacataaaaaaaatcatgaaaatatcaatcagatctggcttcctccctctcctccaatggctgcagtgcaggagtagaccgaaaaaacgacacccgtagacatccagcaagtggagacgagagctctggcgacaaccgcggtgaagaagacgaccattgccgccgttcacggccggacaggaagctgccaggttgctccgtgtgagtcgaccaaccttcgcctctgcctccatgtaaacacccctcaatcacagtcaggcggcatgccttgttccatccttggacggatgagctgatgtccaacatggtgtcgatggtggcggcggcagctgtggcatcaagcagagaaaacatcgtcgaacgtgagagagagaaagggaggtgcgagaaagacagagtcacgggtggttgggaaatagcgcccgatattttcttctctccgtcgggcgcacgataaatagcatttttgaaacaagaccaacagaaaaggttttttttttcttttttgaaaaactaggaaacaagataccgtctatacaatgggataagttatatatgagtgaaccgttattttccatgatttagatatgttctaagtgcatgcgaaggtgggctaggcgtaacgtgaggaggcagaccgtggtaagctggttagaggctagagtagcatatactgtatactattatactagtttgacggagcgtggggctcctcaccgggagaccgcgcaggcccccctttgccggttcggccgggggccctgggtgaggttctaagctccttgtctgtgtgtggaaggttcgcgagaatggaaaaagcacaagacacgggcgatgtatacaggttcgggccgctgagaagcgtaataccctactcctgtgttttggtggatctgtgtatgaagaagctacaaagtgcgagccagcccccgatccttctgggatcgtttttcttctctccctcttttttctaagtgggcaaggtactccttttatatctcaaggggataccacatgccccctctctccctccaacttgacttctcttcattaatggacggagatttgtatggctgctgtccgaatgaccttctgatgggacggcccatacctacctccacttccgccggaagcaggcgcgacgtgggaaaatggctgtctgctgacgacatgaccattgacagaccggtcacaaatcggtcattcttgtccaccacgtgtcagtttaacaatctgcatgttcgcccttcttcatacaacatcttgcctgtaatggttaggatgaagcctggcatatatctgaccggaaccaacgtgccatctccaggagctaacacgccggctccggctagggacgagtgcttggaggctctcgtcctgacgggatggggcgaggcatgcgtcagaccgcctgtcgccacctaacccacgatctgaccggtctgtgactggtcactgaccggataaacgagcgcgctacactgcgttacatgcggcgtgacgcgctcgtccaaaccgcaataaatgtggttaggtgagccccgctatgctcacctaccccatatacgcggcgcaaaacccacaaggggtcggggtgcctcggccctcggggccgagacgggagcggtccgacccctcggggagacaaagagaagggcggccgcatcaccctcgggcccgacccccccccccccccgagggggttaggccacgtgggtgatcgtgtcttcctcaagtctctaagtcatgatactcccagtcccatgtcaccgacagcagcccccggcgttatgccagggcgatcgccctcctcgagggaagcggtcgggcgtgacgccacttcctaaggcctggtgacaggtggggccggtctaaaaatcgggacaagccggttcgtttttcctggagatatgatgatggcgcttcggtcagcgagcgtaattaacgcgcgcatgagatgttccatctcgactgccacagccgcatatccacctcatgcaccgcaaacgggcgaatgggattagtggaagcgtgggtgcgagaaacgagggtgcaagatagtgggcgcgagaaacgaggagccgggcacagcgttggcaagggtataaagtcgccgaggaagagatttgcttccttcctctcgccattattccccttgtcttcgccgcttgcgccctaactccttgtttcctgtgccctaccttcgcctcacgcgctcgctctcaaacatctcttcttccggcgtcatggcacggggctccgctccgcttgacggtagcgtgctgccgccttcccgcatcgtgagcgagagacaggccgggctgccgcgccgcttcatgccggaatctgccaccggccgggagatagtctcgctgggcgagggatgcccggcgccacgctacccggggcggtccgtcttcttcctcccttttgctatggcagggctggttccgccattttcttctttcttcatggatgttctggagttttacgatctccagatggcgcacctcacccccaacgcggtaatgacattggccatcttcgcgcacctgtgcgagatgttcatcggggtgcgcccatcccttcggctgttccggtggttcttcaccgtacagccggtgtcgccgccgtcggtggttggtggttgctacttccagccgcgggggccggtgctgaaccgctacattccctgcgtcctccgcaagaagtgggatgactggaagagcgactggttctacacccccctcgccgacgaagcgcgcctccgacttccgagccagcctccagcgcaggcctccaactggcgggcgccggtagatctgggagatggctacgacgccgtcctcaaccgcttggcgggcctgcgatcccaggggctcacaggggccatggtgttcggcgactatcttcgtcgccggatcgcgccactccagcggcgcgcccggggcgcctgggagtacaccgggtccgaggactgtatgaggacccaccagggggtcagatgggactgggctcctgaggacttcaagatagtggtccaacgggtgctgaatctcagctccgtggaggcatccctcattcctcaaggagtcctccccctctgcagcgatccagaccgcgcctccatcctgaccatcatgcaggcggtcggggcgtcggaggagcaggctcctcgaggccacgatggcgcgggcgggagccgcaggggggaacaatctaccccgggagggggtcgtgcttctgggccccgcgacgggggcccggggagcggccgccctgccaacgcccgggggaagaggaagcaggaagaaacccctcccccatctcctccccgagggggcggggcggcgcgtgccagcagcaggcgcccggagggggccacgccgacgtcgcagcccgagggggagcggaagaagaaacggcttcgcaagatgggggggacagaaccatcccggggaaacctcatttcccctccaaggtggtcgtttaaccgaccccctcgcaggttcgtcccactcccatcgtggccgtattcattctctcaacgcgagttttcactcatccatcttgtttgtcttctggtctttcttctgtttcagcgagatcccgtcgcgtccctcccgccattccaagtctggccagtctgaggccgaggacccggcgaccacagaggctcggaggcgggaatctgaccggcgagaagccgcggatcgcctacgggaagccgaggaggccgcccaggtggccgtccgagctcgccaagctgaagaagccgctcgggaggaggccagacttcgccaggccgaggcggcaatgacttccgaggcagctcgcgacgagtccgcgggcgcatcgcttgggcccactccctcgggcgacgctcaggacaagccaggtccgggggacatccctgagtccggcacgtccatcggcgggccgagccgcgcggcatcctcaccgaggcggctcttccccacgccttccgttgctccactgagcgcagaaccccttctgcaggccttggccgtcgcaaacaccacggtgttggacgggttaagtgcccaggtggaggccctgcaggcagagcgggcggagcttgacgccgcatgggcgcgtgtcgaagaggggcgacactcggtggaggccatggtggaggtgggccgcaaggcacaccgccggcacgtctcagagctcgaagcccgtcggaaggtgctgggggagatcgccaaggaggtggaagaggagcggggggctgccctcatcgccaccaccatgatgaacgaggcgcaggacaccctccgccttcaatacgggagctgggaggcggagctagggaaaaagctcgacgccgcccggggggtccttgacgctgccgctgcccgagaacggcgggcggcggagaccgaggtggcatcccggcggcgcgaagaagcccttgaggcccgtgccatggcgctggaagagcgtgcctgcgccgtggagagggacctggcggatcgcgaggccgccgttgctattcgggaggtcacactggcggtgcacgaagccgcctgtgccgaagaagagtccgcgctccgcctccgcgaggacgcgctcaccgagcgggagtgagctctcgaggaggccgaggccgcggcgcaacggctggcggacagcctgtccctccgcgaggctgcgcaagaggaacaagcgcgtcgcaatctggaaagtgcccgcgccgagagggccgcactgaaccagcgggccgctgagctcgaggcgcgggagaaggagctggacgcgagggcgcgcagcggcggggcggccgcgggcgaaagcgacttaaccgcccgcctcgcagctgccgaacacaccatcgccgatctgcagggcgcgctagactcgtccgccggggaggtcgaagccctccgcttggcaggcgaggtagggcccgacatgcttcgggacgccgtctcccgtctagaccgcgccggccggcaggtgggcctctggggcgggcggactgcgaagtacgccgccaaccagggggcctcgcccagcgcctatcggagatagccgggactctccaacggctccccgaggagctcgagaggacgattaagtcatcctcgagggacctcgcccgaggagcggtggagctcgtactggcgagttaccaagccagggatcccgacttctccccatggacggcgctggacgagttccctcccgggaccgaggacggcgcgcgcgcgcaggtccgggacgtcgccgaccatatcgtccacagcttcgagggttcggcccctcggctcgcgttcgccctcaactccgacgaggaggacgatgacggcggagtgggcgacggtggcgacgaggctggcgacccgggtgcatcggagtgagcccccaggcccccgccaatctttaaatagcttcttcttttcttcttccgaggccttcgggcccccttcttatatagactaatttaatctgcaatcaaataaagaggaaattttttgtgtcaattctatttgttgtgtgtataagacgaggatgtctgtgccgcggtccttttgtgtcttggcttgaacaagggctcgtgcccaggtcctagtcctcaaatggctcgggtcggggctagtgcctggggagatccacatgtcgagactggccaggccgggagcgtggtgaccgagggttatgggtgacccgattgtgggtttttgccgattcccccccggagttcaccacgccccggggcacggctcggttctgggccccgtttggcgattttagccgacccgagcccccgagggcaggattgaacacgagtgacctatttcaagtcaagatccttcaaaaggaaacaacagcacagatacaacctttaggaaattgaaaatgcttttattgaagagagaatccattatatgccactgactttgtcacacatctacgatttaccatcgactttgtcacattctacaatataccatcgacttttgcttaacttctacgatttaccatcgccgtccaattagcctccgttagtactgtacaattttatccaaatgaccgaaatacccctaaaacaaaaacttccaaaatttggataaaaaattcaaaatatcatattataaacataagattgtaaacatccaaaatttggccaacaacttaaaatcttatatttcagaatttttatccaaattttgaatgtttttgtcccaggggttttttggtcattttgacaaatttgtacagtaccaacggagactaaccggacggcgatggtaaattgtagaagttaagcaaaagtcgatggcatattgtagaacgtgataaagtcagtggcaaatcatagacatgtgacaaagtcagtggcatataatggattctctctttattgaaatacagatataagagaaataagaatatgcatatgtggtagcccccggccaaccctgcacgcccgaggggggtgcggggttggcccgaggccgaaacctgacacccgatccccctttaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcaatccagcacgcgtttggacgcggcataggacgaggtcgtcgacgcagagtgatcgggcccggacgtggcgctgatggtagcgccgcaggctctgctggtagcgcgcagctcggagggccgcgcgccgccttcgctcttccaagtagtcgaggtcatctctgcgaagctgatcttgatcagcctcgcagtacatggtggcccgaggggacctcagggtgagctcggatgggagaaccgcttccgcgccgtagacgaggaagaaaggcgtttccccggttgctcggcttggcgtggttcggttcgcccagagcaccgctggcaactcctcgatccacgaatcgccgtgcttcttgaggatgttgaaagtcttggttttaaggcctctgaggatttccgcattggcgcgctccacttggccgttgcttctggggtgggcaggtgaggcgaagcagagcttgatgcccatgtcttcgcagtaatcgccgaaaagttcactagtgaattgggtgccgttatccgtaataatacggttaggcactccaaaccgggctgtgatgcccttaatgaatttaagtgcggagtgcttatcgatcttgacgaccggataagcctcgggccacttagtgaacttgtcaatcgcgacatacagatactcaaacccgcccggggcccgcctaaacggtcccaggatatcgagcccccagacagcaaatggccatgaaagtggtatgatctgcagggcctgggccggctgatggatttgcttggcgtggaattgacacgctctgcatcgccggaccaggtcgaccgcatcattgagagctgttggccaatagaaaccttgacgaaaggctttgccaaccaaggtgcgtgaggcggagtgggctccgcattcgccttcatggatatcggcaagaagctcgacgccttgttcccgaggaatgcacttcaggaggattccgttagccgcgcgccgatagagggtcccttctaccagcacgtagcgtttggagatgcgctggacgcgttcactcccttcgcggtccttgggtagagtcttatctgtgaggtatgcttggatctcagcgatccaagcaatcaatctcagggagctgggagcgctcccctcgggtcccgaggcctggactccgacgggcatcgggggcctgtcaggcgcgtccgtctcccctaaggggtcgggtcgcgccgacggctgggcaagcctttcttcaaaggcgcccagtggggtctgggctcgcgaggaagcgagccgtgagagttcgtcggcaaccgtgttaccccgtctgggcacgtgccgaagctctatcccgtcaaaatggcgctccatacgccgtacttggcgcacgtaagcgtccatctgcgggtcagagcaccggtactccttacagacctggttaacgaccagctgggagtcgcctaacaccaggaggcggcggatccccagtccagctgccaccctgagtcccgcaaggagtccctcgtactctgccatattattggtcgcccgaaagtcaaggcgaaccaaatatctgaggacgtctccgctcggcgaggtcaacgtgacccccgcaccggcgccctgaagagacagggagccgtcgaactgcatcacccagtgggtggtgtgaggcggctgcgaggggcccgagctggcctcggggactgagacgggctcgggagctggggtccactctgccacaaaatcggcgagggcctggctcttgatagcgtggcgtggttcaaagtgcaaatcaaactcagaaagttcgattgcccatttcaccacccgtccagtaccctctcgattatgcaagatttggccgagggggtaagacgtaaccaccgtgacccgatgcgcctggaaataatggcgcaatttcctcgaagccatcagaatagcgtaaagcatcttctgggcctgagggtatcgggtcttggcgtcccggagggcctcactaacaaagtagacgggccgctgcacctttcggtggggccgatcctcttcgctaggggccacatccctggggcgctctttgtccgagcggcctcgcggggtgcactcgtcttctgtgccgacgacctcggggtcggaggatgacaggggcggccttcccacagtggcctcggggccgtcctgggggtcggggcctcctggcgtcgtcggacaagcgggcaaagggccaactccggtcgtcaggggccttaggccaccgttcggctcgggggcctcttctccctgctctctcccgggtcgagtcggcacagggttagcctcggggtcagagggcgataggtgcggccttcccgcagtggccctcgggccttcctgggggtcgggggcacctggcaccgtctgacaagcgggcagaggggcctgctccggtcgtcgggggccttgggccaccgttcggctcgggggcctctcctccctgctctctcccgggccaagccagcacagggtgggggtgcgcggaatgaggattgtcctcatcgcgctccacaaccaacgccgcactaaccacttgcggggtcgccgctaagtagagtagcaagggttcatttggctccggggcgaccagaactgggggagagctgagatatgccttcaactgagtgagggcacgttcagcttcctccgtccaaataaacggcccggagcgtttgaggagcttaaataagggtagcgccttctctcccagcctcgatatgaaccgacttagggcggccatgcaaccggtgacgcattgcacatccctaagcttgctgggggggcgcatccgctctatagctcgtatcttctcggggttggcctcgatgcctcgggcagagaccaaaaacccgagaagcttgcccgcaggtacaccgaacacgcacttatcggggttcagttttatgcgggcggagcggagactctcaaaagtctccgctagatccaagagtaaggtctcttggttgcgcgtctttacaaccaagtcatcgacataagcctcaacattacgtcctatttggctacccaaagaaattcgagtagtacgttgaaaagtaggacctgcattctttaacccgaagggcattgtcgtataacaataagttcctatgggggtaatgaatgcagttttttcctcatcctccctagccatgcggatctgatggtaaccagagtatgcatctaggaaacacaaaaggtcgcaccccgctgtggagtcgacaatctgatctatgcgaggcagggggtaagggtccttaggacatgccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcggatgaaggcttgacgttccggggcctgccgccgtactttctgccgaaccggccttgcgcccgaccttacggcgagacggtgctcaatcacctccctggggaccccgggcatatccgccggtctccatgcgaagacgtcagcgtttgcccgcaggaaggagacgagcgcgtcttcctatttgccatccagaagaccaccgattcgtgtggtcttggatgggccgtcgcccagggcaacctccttgaccgggacctcgtcgcatgtgactatccgctgcctcggggcggcgggggcggaggtgccaagcctctcgtcgcctccctcgggcttggacgcggcggtgaggtggtccgcgcgccgctccatacaagcaagcgcgactttgaggtcgccatggacagagatggggccaccggggcccggcatcttcatctggaggtaggcgtagtggactgccgccatgaacttcaccaacgcgggcctccctaggaccgcgttgtagggcagactgaggtccgccacatcaaagttcacccgctccgtgcggaagttggcggatccacctaaggtgaccgggaggtcgatatgacctagcggccaagtgtgaggcggcgtcacaccgataatcggctgggacggccggagcaccatccccggggccttgatagcgtcaaaggctgcgggggaaaggatgttgagggctgctcccccatcaatgaggacacgccccagcttcacgttgcaaacagtgggggaaaccaccattgcgatctgtcctccctgggcaacgcacggtgggtggtcggtctggtcgaaggtgagggcaacctccgaccaccgcgcccggcgcgtcgcctcatgagtaggggccgcggccagaagctctcgcttcatggccttgaggctccgacgagaaaagtgagcacacgctcccccatcgagagtggcaatggtggccccaggctcttggaaacctaggtcatcatcgccgtcatcgatgtcctcggcgggggccttctgcttggcctcacttcgccgattgccggaaggaaccgccggggacttgccctctcggcgctcctgcctcctctcctcctcccacttcctcgtccgctcagccaaacttttgactgcgcggcagtccgcgaggtcgtgaagggaggtgttgtggacggtgcaccacttgccggttgggcactccctgctgggagcgctggcctccttctttttgtcgctcgcaggcctcccctttcgggtggcccgcggagcgccctcgacggcgaggacatgaccctcgtcgtcggaatgggctgacctcttcttcctcctcctgtcacgccgccctgtccgagcagcggatccgggggcggccgaagctgccacaccggaaccggaggggttccaggtccatgcctcttccttacgagccactcggtccgcgagctgaaaaagctccgcggtagtctggggctctttggaggcgatcttttcgagcatgcggttgtgccgcacaccccccctgaacgcgtagatcacctcgtgtgcagggatgcatggtatggtgttgcggacttgacagaaccgctgaatgtatgagcgaagtgactcatcatcccttcgctgtactgcgtgcaagtccgcttcctcacctgggcgcggatatgtgccttgaaagttcatggtgaactgttggcataaatcctcccaagagtggacggacgcgggtggcaagttcattagccaaccccgtgcctgtcccttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacattccgaaggctcgccacaaaggctctacagccgacaccaccaaccgggggcacggagggctgatccccgtgtccgtgtcgaggtgacactccggacgaggaggcgccctccgttgcgtgggcagcacgtcggccattacgccggtgctcgatactgatgcgggcatctggccccctacgcagatcttcccgggtcggaggcgctgacgaaggagtggcggccgaatggcgagcaaccgccgccgctcgccgcgccctccgccttgacgacacggagccggtggtagcagctccagaggtcttggtggcggtggaccgctcaccagcacctaggcgctgtcgtgccgtcatgaccaagttggccacgtcgtccagccaacgttgggctggagactccaggtcagggacaatgggcgggtgacgtaggagcgcgcccgcagcttggagcgcgccctggggcgtgctgccgtcgccgtagacgaggaggcgacgctccccatctcgctgcccttctccatcacccgtggatgtcgaagtcacggatccttcgaccctctcgagcgcctcctcccggctaggactttggcgtggagggggcggtggagtacgagctcgacggcgtgggttcggctccccgtcgtcaccgctaacactcggagagaggttgtgcgcctttgcttgttcggccattgggctgaacaggaaaagcttggcgcacacgaaagaatgcgagagcttagaaaaacacacgcagaggcccctacctggcgcgccagatgacggagcgtggggctcctcaccgggagaccgcgcaggcccccctttgccggttcggccgggggccctgggtgaggttctaagctccttgtctgtgtgtggaaggttcgcgagaatggaaaaagcacaagacacgggcgatgtatacaggttcgggccgctgagaagcgtaataccctactcctgtgttttggtggatctgtgtatgaagaagctacaaagtgcgagccagcccccgatccttctgggatcgtttttcttctctccctcttttttctaagtgggcaaggtcctccttttatatctcaaggggataccacatgccccctctctccctccaacttgacttctcttcattaatggacggagatttgtatggctgctgtccgaatgaccttctgatgggacggcccatacctacctccacttccgccggaagcaggcgcgacgtgggaaaatggctgtctgctgacgacatgaccattgacagaccggtcacaaatcggtcattcttgtccaccacgtgtcagtttaacaatctgcatgttcgcccttcttcatacaacatcttgcctgtaatggttaggatgaagcctggcatatatctgactggaaccaacgtgccatctccaggagctaacacgccggctccggctagggacgagtgcttggaggctctcgtcctgacgggatggggcgaggcatgcgtcagaccgcctgtcgccacctaacccacgatctgaccggtctgtgactggtcactgaccggataaacgagcgcgctacactgcgttacatgcggcgtgacgcgctcgtccaaaccgcaataaatgtggttaggtgagccccgctatgctcacctaccccatatacgcggcgcaaaacccacaaggggtcggggcgcctcggccctcggggccgagacgggagcggtccgacccctcggggagacaaagagaagggcggccgcatcaccctcgggcccgaccccccccgagggggttaggccacgtgggtgatcgtgtctgcctcaagtctataagtcatgatactcccggtcccatgtcaccgacatagtttttttagtaccgctgtataccacacttttctaagtagtactggcttttcattggtacacctttttatgcatccaaagttcacactagagacctgctctaagagcaagtacaatagcaggctataagccagctataaccacatatcgagaagaaaagagaagagagaaaagaaagcgggttacagatttgtaggcagctgcaacacggaccccaagccgttgtgtgtgtataagaggtaggacagtgtattaatggtgtagtatatttttataggtaactattgcatgaatgagttattagattagctatagatgatttggagctaatatttggctatactattaaacttgctctaacactcttctagtatgtctttttatgcactagagttaagagcttgggcatatgtatagtattcctcatggctctcgttggctcgaagaccttatacccacaaatcatacatgatacgtgcagtgtatttaatgtctatgtatcgagtccttgatacctagatattaggtaactggtacctagattattcgagttagtaccataggtactagacctgatagtataggtatcggggtacttggtccctagatcaggatggtatccataagtaccagacctggtactaggtatcaggtacctaaataccatgtacttagtatctacatcggtcagataccagtaggtaccagacctggtactaggtatcgggtacctaaggtattaggtacttggtccctagatcgggttgatacctataggtacctgatctgatattgggtattgtgtagctcttaccaggtatcaggtacccaaatctattaacttattaaaggaatagaaaaaagagcctccatattcactctcatggcctagaaattcctacattaattggagaaaaagaaaacagaatccatatagaaatacaatttaaaatagttaaaattcagaattaaaaaataaggaatattgggagaggagactagagtccatatagaaatacaattgagaaacaatagaaattcggaattaaaaataaagaataatagtagtagggtatagagtccatatagaaatacaattaagaaataatagaacttcggaactaaaaataaggaatattagaagtagagtagagagtacatataagaatttaaaactaactaaaatttggaataaacataataaatttaaaagtagagtttagagttcgtataaaaatacaatttacaaataactaaaattcgaaataaaaaaaacatgggaagaagagtctaaagtcaatataagaatacaatttagaattaacttaaattcgaaattaaaaattagggaatattgaaaaataagtttagagtccacatagaaatacaattagaaataataaaaatttagaattaaaagtaaatcatattggaagaagagcctagagtccatataggaatataatttacaaataactaaaatttgatattaaaaataattaataaataacttgtatataaaatacaatataaatattatacattactagtttcgtaaaggtagtacaaaatttaaaattatgttgtcattttaatatatttgaataatacattgagaaaacatattgtcatggttatggataccacatacctaatagtaggtgactaaatctcggcaggacccaccacataccatgtcctatacggaaacaactttcggatataggaggagttccgataaggaaagacaaccagagttctacatgaaaacgacaagtactactcggattgtagccatattggtttccctagttctacttggacaagaggacacctatgggtataaatacaagccccctaggaggacagggggacacccaccatgagacaatcaacacccaacacaatcgacatagaagcctacatacgccaagacacaccgccggatatcgacttcagggataaacacggctagtaccctacggtgtctccggatactgtcaggagagacgaaagcgctaaccgggcacgaattcgaggtggaaggctaccctgttgtcgactacgagtcagatcatcagaccgacatgttgacaacagttagataggctaccccaaacattgtactggtgtggttatcataaataagagcaataccagcttcggccaacaagatgtagggttattacctgacaactcatgggcccaaacctgtataaaaatcctcgtctccatctcttttacctcagtctcgcatatatcctagcaccgacgatccccatactgtccaaataccgtagtcgagacatcaaacgtcgacagtggcgcgccaggtagggggattttggtgcttcagggtttcgacgagatgagtttaagagatggattctccgataacatgctactcgacaacttcggttatggggagatctaatccgaccggagtatgtcgtccaataagatcggaaccatcattgtcaaattttcgatccggcgagatcgatcaatcttcatcaagacgtagccaccatggaggacggcaaatcggtattgccgcccgcgcgacttcggcccagatcgaacacggtgccgattcccaccaaccaaaatcgctcaacgcaggctgcacatgattcatccgagaacaagtgccgctgtgtcactgacgtgtcgtgtcatgcctagacacgtgtatgcatgtgacaggttacactgctctacgaccaaaccaacaagatacgtcaaagtctaccgcatgcacatatatatatcttctgtagatagtatatcgggcatgcaaatcaaggtatttagtggattaatttactaagttaatctactaatttcgtagatatattcggcatatatctacaaaggtacgcaatattttatatgcaatttatcgtacctattcagatcatacaacattgtcatatcagtaatttattatgtttacctagagcatattttttatacaatatcaattatgcgagtgtttccgatgttaaatcaactacggtttaacgctggcggctcgctctgttttcttctgtataaatcatgcttgtttacggtttacataatgcctgatacttacatctgctcgttatatcctgataattctagaagatccatgcagcttttcgaatacatactcgatattatctgctatatatcttgccttctagaaaatatttttcaggaacaattgagcactcgggtaggttatggtcgagtacactccattatcgagaacattctcgacaaatgcggagttatcgcacccaacctaccaacgaagaccgatgacctatctcatagcaccggccatcgctggactactcgagaaaaggttgttaacagataattcctggcgaacgccgttggcttgatcacccgacatgattgagaacggacatccggatataccacgagttgggtgtgtgagtcatgctggccacatgagacgcacatgtaataaaccaactcgagcagttccattggtgctcgagagataattctactcgctcgctggttctcgcaccaagacgtagcaatttctcacaccacagcttccattggtgctcgagagataattctactcgctcgctggttctcgcaccaggacgtagcaatctctcacaccacagcttccattggtgctcgagagataattctactcgctcgctggttctcgaaccggtacgtagcaatctctcgtgccttaacttcagatagttgaggtatgactacggcggcgtagcggtcctcgcaccatgacttcagatggtcgaggtatgactatggcggcgcggcggtcctcgcaccataacttcagatgattgaggaacagctacaactggtcttcgaccggcagcgtagcgatcctcgtgccacgactccaaatgattgagagacacctactcaccggttctcaaccagttgatcgtagtgatctctcgtacatttgcttctagtggtcgagttacgactactgcctggtcctcgaccaacgatgtagcgtctctcccactacttccacttcaagtggtcgagttacgactactgtctagtcctcgaccagcgacgtaccgtttctcccaccacttccacttcaagtggtcgagttacgactactgcctggtcctcgaccagcgacatagcgtttctcccaccacttccacttcaagtggtcgagttacgactactgccttgtcctcgaccagcgatgtagcgtctctcccactacttccacttcaagtggtcgagttacgactactgcctggtcctcgaccagcgatgtaccgtttctcccaccacttttcactttaagtagtcgagttacgactactgcctggtcctcgaccagcgacgtagcgtttctcccactactttcactttaagtgctcgagttacgactactgcctggtcctcgactagcgacgtagcgtttctcccactattttccgctttacgtggtcgagttacgactactacctagtcctcaactagcggtgtagtgatttctcctactacctctacttcaacaaagttgatagcaggtatgcaatatcgccaagtgttttacccagagatcccttaccacgacgacacctagagttgaaacctatcctactgtccctttacgccgtcttgacaaggcctccgaggaacctaagggatcttcggctggggacgcctagaaccgataaggccttgtcggatcctgtagagaagaaagaccatgtaagatctggtcgtgtaagagttctcgccgtgcgtattaaccaagccgtgtaatcggaaattaactttccaacttcacggctgggggataggatcagttcttgttcaactaaggcaggtcaagggtccaagagccttatcctccgagaacgattctccgacgataaggctgggggctagggagagtgtatgactctacaaactgactgatcgaagtcggtaagagagaagacgcttatacacaaaacattggtcggtaaaattaattcattttttccatacatattataacatgtcaccctttgagcgttcgctcgggggctatttctatttgatattcttttctgagtattgatttcaggaaaattctattcgacattgacgaagactccatgtctccatggttctacaccaagatcgactgaggcgagtacgacaaatgtcgacaaggctccgtcgcagactctacgccttctcgatcactcgagaatggttgctggatctcgacaaggaatacggaatgaagaaatggtgtacccgccgagataaaatttcttgacttcgatccaaattctcgattacagcaagacgggagacttagtcgtacgctctgtactttttcggtcgacatcagagattgacttagacaaaccctttcggtgcccgcacgaggctgacaaaggaagtctaacgttatctctgaactcaccgaaaatggtcacgtgagctcgataacagttcctccgaagtctgcagttgagaatatgaactcgttcatttgcatcgaagtcgggggttactgtcatagttatggataccacatacttaatagtagttgactaaatctcggcaggacctaccacataccatatcctatacagaaacaactttcggatataggaggagttccgataaggaaagacaaccagagttctacatggaaacgacaagtactactcggattgtaggcatattggtttccctagttctacttggacaaggggacacctatgggtataaatacaagcccccctaggaggacagggggacacccaccatgagacaatcaacacccaacacaatcgacatagaagccacaacatagaagcctacatacgccaagacacgccgccggatatcgactttagggataaacacggctagtatcctacggtgtctccggatactgtcaggaaagacgaaagcgctatctctgatctcgccgggcacggattcgaggtggaaggctaccctgttgtcgactacgagtcagatcgtcagactgacatgtcgacaacagttagataggctaccccaaacattgtactggtgtggttatcataaataagagcaataccgacttcggccaacaggatgtagggttattacctgacaactcaggggcccgaacttgtataaaaatcctcgtctccatctcttttacctcagtctcgcatatatcctagcaccgacgatccccatactgtccaaataccgtagtagagacatcaaacgtcgacacatatatgttattatatgacagaaaatataatgatgctaaccgcgcaatctgcgcgggccaccatgctagtttacactgatgttagcatcttaacaattgaaactggtgtgttgtgtcttcagcaagacgacgtgcgctgacatgtggccccttgagagaacacgaagagatgtggattgacatgtggatcctcacgtggggatttacgtgaagttgataaaataacacaagtgattggttgatcaaatagtcacgctcatcaagtttgaccgtaatctgaagaggcccaatataatgggaaagtgatttcatccatcacggggatattccctcgtttcgtgcatgccacctaaatagtcaccaaaaaatttgaaaaaaaaattggtaacatagaataatatgagatatatcactctacaaatatgcatgtttaaattaacttctataagttataataaaaataaaaaatatagctgcaaatgtatgataactatttttagtttaatttattacttttgttgcaacttgtagaagttgaatttggtcttgtatatttgtggagtaatatatttcatattaatctatgttgtcaattgtttttaaatttttaatgactacttagatgacatgcaaacaaggacatatccctcgagagatcacattccaatataaccacatatgtattgttttagactatcagtcgatctctcgtaccattttcgggattggtattgcttacgacggcggtgcaaactgagccgccgttcccttaccttccggcgacaccttcagattgaacaatgccgcgcagagattgtccaagtagaatactggatcagttaatcacagccaagctaatagccgacttgaactcggacaccgacttcaattccaactcggactcggctggctataaatccatgcgcggccgcctccgcattcaccagcaattccttccgccaatcctcgcactcccagcagcgctctcgtcgtcaatggcgcttccccgccgctcgagtcacatctcctcgcgcccgatcatccactgccgcagtgagctcgccgtcgaggcgaaggggagagtagtctccaagaagccgtccggatcaggatcgcccatcaacaagatgtcctccttcaagaagggcgacgaggtgcgcgtccgcacgtcgttggggaggctagggaccacggcactgcgcctcgtcatgtggctcggcgcggtcgtcgtctccgacgcagacgccgacgacggacacctggaggtcatctacaacggcaacttcccgcgcgacgaccccttccagaccgtgcgcgtcgccgtcaaggacgtcaagctgccggcgcggcgcccggccccgaccccggcaaacatggcggccccgcggccgaacaaggccggcaagtcgctgccgcggctgaagatgtttatgctggagaaggagctgctgcgggccaaccccgaggccttgttggcatcgtgatcagtgttcttcagtagtagcagtaggtgcagaagctcgtatgaatcagaacatttcttcctctgttcttggtttgcatggaaggcaatgtgatcttgtaaaatgtaaattctcgtagataggatgatttcttggcatgagaagaaggacatgcaatctgtcaactgtaatttcacattgattatgaatgaaagatcgaggtttctcttcttgtttcatttttttaccaatatatgcatgcatgatgcgtgttatccttggttttgttgatccaagtgttcagatcagaatcacaatccagctgccctctgattacacgtatgattacaatccacctgctgacaactttgatcttgtagctaggattcagcttccaattctttgcacgcctttggctttcctttcctttgttgagaaccagggtatgcagcaaacaaggcatctagctggtaatgtcatttctattctgaattggatagtggtttgtgctagtctctgtgccatttttcttttctgaaaggaaggcaagggccatatgtatttccctcactttggctctcaagaacatcaacgaatcccaaaagaacctagacatagctaggcttagtcttttttttgacggcaagagtatttggtcctcttgttttttaaaatactagcaaaatatctatgcgttgtaacgggtgaaatcgctcataaatcatgtcttttaccaacttaatcttataaggatagctttaaaagtcatgatgttcgttttggaggactaaatattgtttacattaattaaaaaaatattttgacatgataggttctgattataatgggatagattgatgaataaactcagaggcacataagttattttcacagaaggatcaacatgtaaattcgtatgtgatccaaatatatttgagaatcagtttgatctatgttttgtcccagttgtcttggtagcttcatcccaattaggggtgaaaacggtcacggaaattcccgatcgatcgagcgccgtttccgtatatttaaaatttctaaacatgaaaacaaaacctatatacaagttgtagatatagatgcgatctacacttttcatttgagcttatctatggtattaaatatagattataagtttggatgatagtagtcttaaaagaatagcatttgtttcgaagacaaacagtattcttttcccctctttcccaactcacttctctcattttccacgcgcacacttttcaaactactaagcggtgcattttttgtgaaagttttttatatgaaagttgttttaaaaaaatcatattaatctattttttaagttttttaggctaactagaaaggtagcccgcgcagatgcgcgggcaatttatttattgtttacaaatataattggtaaattttgagataagtctaatggtttagaaaatttgaagattttttttcctaagagagtaggaaaggaaagaggagatgaggagagtacgtccgtaacagggaagggtgtggagaaggtgggtgcatatactttttttattcgatctaatagttaaagtattggacccaccaatttaaaagaaaatcaatggatagattttagagtgtcacttggcttaatccaaacaaattaaaattaaatcaggtctacttgaaaaaacacaactaaattgttttactttttcgcaattacgtagtacatttatgaagtgatatttgacatcctaaaatatgatatgaaattatttaaaattatcataacattaattattatatatttgcccaagatgtggtgatgtatttagaaccgcaatataaattttataagacacaaatattttatttaattaaagaaatacaaagggatcataaattgattatataatttaaaataatttaaaagatgaatgtttagagataattgatttgatattttttatttatattatagatctagtttatatttgcacatatttgtggagtaatatatttttatatggtaaaaagttatattttaaagaccattgattttgttctgacggtaatatgtattatcgattttaatttatttttaatcttaaattgttggtttaattatgtatagagaaacagttagattagatataatatgtatagcttaaaataactaataactgtggttgtttttttttatcataactactaaaaaaatatagatcagtggagggggcagaaagtgttgtgcgtgtctaatggtgggggtgaggtggaggggactttgtttttctattttttttctaaatcatttaggtcaaaaaccaattatcatgtattttgttttttagaaaatcttttttaattttaaagtcatcataatgacttaaaaaggtaatattagatacaccgatttaagctggacgatttaactggagattgcttggttcgaattagctacgtaatatcacggtaaagccatgtaaactgatttaattagctgtatatgttatattaccgttaatttccttccacaaatcatgtataataactaatttaattagctatgtataatcttcgtgttaatctcctagctcccatatatatacacatacatacatacatacatacatacatatacatatatatatatatatatatatatatatatatatatatatatatatatatatatatatatatatatatatatatatatatgccgtgcatataataaatatagctatgattagtagtaatacaatatgacagctaattaatctcaacttctaacaaccatagatactaatcatccttccggcaaaccatacatacgtacgggagaaaggtagatctaattcattggtataaaataatgggtccaccaatttaagtgaaaatcaatgacagataaagatctaatctaacaatgtaaaataatgggtccacaatttaagtgaaaatcgacagtgaaattatattgtgccatatggcggcctaggagcatttgtaggagcgccatgtgacggcttgaaagcgtttgtagaaagtttaatggacttttagtatataatagatagatacttaattaatctcactataatcgcgtgctttgttttctgtgtcgggaggcaaggttggtaaccatgcttccgaaagtgtttgtaggtgagatgtaaggtgactttgtttgaagcaaaaagtcttgagtttgaatttttcttagtacgtgtatatgaatatgggcacatgtatcatgtgatttgtgggaacgagagtatgaattttgcttagcacgtgtatatgaatatgggcacatttatcatctgatttgtgggaaagagtgtgtatatgaatatgggcacatgtatcatctgatttgtggggaagagtataatggtatagatgcctaaaaaatacatcaaatatttttttttgatttttttagcacctgcaaaaataaaaaacgggtgcacccctacacctataatactggttcaagaaccgacggtaattggtgccggaacctatatatgatataaacttttagaaccggcacattagtgcacggaagcaaggaatacatgtccctccgttaatatctcgttccatttatcggattggtatttcttatggaggcggtgtgctggtgcaaaccgagccgccgtcgtctctttgccctccggcgaggcggcgatacctccatcagttcgcgttcccgtagtagcgatctcagatttcgtatcggtctcgattgatcaatgccgcgtagagcagaatcggattcagaaggattaaccgttaatcacagcctctaagcaccgacttcaactcgaactccgtctccgacttgcttccttcaccgatttcaactcggactccgcttcggctgccgataaatcctagcgcgccgcccctcaccgtctccgcattcaccacaattccttccacccatcctcgcagcagcgctagctcgtcgtccatggcgcttccccgtcgctcgagtccccgctcctcgcgcccgatcatccaccgcgccgtcgacgccaaggggagagtagtctccaagaagccatcagcagggtcgcccgtcaagaagatgtcatccgcgccgtcgacggcgacgcccgtgtccttcaagaagggcgacgaggtgcgcgtccgcacgccggtggggaggctaggcaccacggcgctgcgcctcgtcatgtggctcggcgcggtcgtcgtctccgactccgacgccgacgacggacacctcgaggtcatctacaacggcaacttcccgcgcgacgacccattccggaccgtgcgcgtcgccgtaaaggacgtcaagctgcccgcgccgcgcccggccccgaccccggctaacatggcggccccgcggccgaccacggccggcaagaatctgccgcggctgaagatgtttgtgctggagaaggagcagctgcgggccaaatccgaggccctctttgcatcgtgatcagtgttcttcagttgtagcagtagctgcagaagcttgtaggaatcagacatgtatctgttttcctctgtttttttgacagtgattgtcgtaggtaggattattttttcgagttcttcgcatgagaagaagaacatgtaatcatcatcgattatgaataaaatatcaagaattcatttatacgctggctcgttctctctgttatctcaagaacaataaatgcatgctatccttatttgttgacgagccaaatgttcgatcacaatcatcaattcatcataactcataaggtggccaaagtgaaattaactctaatctgaaagaagatataagctgattgcacacttcacaccagtcctatgcactggcctatcctggaacggtggtgatcaaacttatcgacactcgatacagttatcctgcagtcctacgggagtatgtcaagaaaccaagacggtttggtgtttgacacttcaaaacttatctttcaaatctcgttttccatttataccacctttactggataggccagtgcataggactggtgtgaagtgtgcagtgaattagtgaaatcagcttagatcttctttcagaattcagatcatcactgttgactgttttaaacccagaaacattctggtatgggcgtatgacaatcacggtatttgcaaatttgcaggtagcaaccagaagaagaaacagacgacaagcgatatttgttctagctaagcaaagcatgaaaactccagcatatacgagattgtgccccataggcatgatgatctgatctcaaaacacatgagaatacataggagatacggtctctactcaacgcctcagcaatcaacatcacaacaatagtcagctaaacggttgcaactccttgatgtgctccaaggagaggatcagaggactgcctcaatggtaacctagtaacctaccaatatacggccacatcaaacttgctaaatttttcttttcagggaaggatcgaggagttaattctcgataatcacagcaacagtctatgatcacgcttcctgccatgctcaaagaaaaggatctcaggacggagattggcctgactgtaccggtcgattaatcctttccaggattcagcttgctgcaaggagacgaacatttacgaatgatgatgatatcgaataattctgaaaccaaattcgagtgaaaactcaagtgcgaaagctgacaaggaattgcctggactgtcgtgctgtcatgtatgagccaccttgcctcgtcacgaccaaagcagaggtattgccgcccctcatcatcatagcataccttccattaaaaacagtttgaaaattacccagatgctatcgcgcgaataccagaaacagaactccatactagtcaggcaagcattacttacgataatctgacactacaattgcctattgccaagcaactgatccgaccaaagaagataataaaatatactcctacaatgatctaccaacatgatagcaaagcaatatttgaactgatttgacaggtataacataaatgacaaatcatacataaataaaccccagactagtacattagatactattcatatacaaaaacacactgaaactgagaagaaaaggtaaagaacgaatcaacctcaggaacaaatgaattcactttttttttcacagatatgcataaaaaggaaagacttctctcagcacgtactgcagaaaccagagtgtacatgctttctgattgcagaccttcgtagatatgactaatgtccaactccgctgctaggctgatcaatactttatgcatgttaatatggtttcccttgttgtctggccatctcaaaactgtgacaaaacagcaatagaagagaaactaaatcagcttgcgtgcatccccagtcccgaccaaggttcgagtcctctatctcagatctagcgtcttcttctcaatgacaccagatgcctaggtcctcctagatattctcgatttaggctctaagtttaggtcgattgatgaaagatgcagacatctgtccccattactcagcttaaaagtccccttatatttcttttcttcatattaataagaagaatgcttgttgtctcctaggttttccctaattgccagaaatgaataaatgatgtatgtgcacagaaggctggcatcaaattgtcgcaggaaaggtcgtggcgattaattattttatgttgcagccattacaatagcagatatggtgtaatttatattcaacgattgatatggttttcaggataaaattaaagatcagatgatacactgatccaatgatttctttcgcttatctttcctttctcctacatagaagaaacatatgcacacaattacattgaaatgttagtcgagaaggcggtacctatcatgaaaaaatgtggtggataccataggtatcgggtaatcctatgcccacagccaccattcctgaagtcacaaactgactgcttgtctacagctttcaagagttcactgaaagactccaactgaataagtaaaaggatgttagtttgctaattaaagaaaagatggacatataaaaaaggaaatatcaaaaggatacactgtgcagtatgtaccgtagttccttcaacagaacccaaattaatactgtggaagaatgtagacttggttttcatggggacctcattcacacagttgcatttcttctcaataatgtgcaacccaaaaagattgtgtgctaggcatatacaacccagaaggctgggcactattgctgtttgtggcaccaaagattcacccttgaactcaaaatgcaaaggagtttgtgccacgtgcagcctctcaaggattgattcaacaactctatacgcagaaatgtttccagcctaaaaaaaaagaagaaccagtgatcttattggctacgagagcaacatgctcaaactttccttatgttacagtcaatatgtacactcggaagtgcaagtgggacagaacttggtttgcagtcaagactcagacaatataaaggtgactcttgtatcaaattagtaaaataagcatttgcagaattgaacctgcaacattctatcacgacaaacagggttttaatttaatttactttaaagaacggcaaattgttgcacaaaatggccaaaagattagcacagattcatatggatcacagaaatgtttatttctgtaaacatttctgtttcttttaataaattgtattatctctcaaattaaaagcctaaaatactaaacaatcactttgtgtattagagcaatgagccaatgagaatgtaaaacaagcttgggagtagtacgtaccaataagtagtttaagaagaatgccattttgcctatcttttccaatagtgcccaaacagaactatggagtcaaaactcaaaacttgaaagatatcaggcagctatccagttcattttatatgaaatatttataacttatccattataaatatgagtaaactacatggagacggttagcatttgataagaaagttgctctctggtattttccctgaggtcacaggctgcatttagataggtgggaaacagaaagcgaacgcaaaccttttcatcaatcacaaaacttctcaaagaatcaaccatgaatatcgctgaactaggtaggtcacatgttttgcactggtcccaagaacggaagatacgcaacaagatagcgcgatatactctggctttaacatcaggggatatacatggtatctcccagagatcaccgcagaatctccttatgtgccacaaagactgcagttatgcagagagaatcagagataggaaaactaatagctaaatattaaaaactgaaggatccaaacacacgttacccggagaatggcatccaaaggaacctgtggtttatgacaattttgtggatgagcaagtaaagcatcctctaggggatcattaaccaattttgcctgtcaacaatgaatatcatacacaaataaagttacagacatgctttacaagttcagttcgtgctgaaagaaccatactgacccaaaggcaagcctttgcaataggtgaaataaccgcaaggcaatcaacttgacaagttttcagaagactttccttccagtaatccacctcagcatcaattaatagcatctcaactcgtgcagagccaatctgcaaatacagcaactaggatttaagcattgatcaacgagattaaaatgatggtataaaattagagagcaaacataattttttttttaaaaaaaggaaaacatacccaagaatcaaaataagtcttgatgtcaatatctctctcaaaaatggccttaggaaggaaataaacacctccttgtattccttttagctcttcccatgagctgaatttcagcttcgctttacccaatgctcgacttatgttgttaagaatgtcaggtccatcaacaaaacattctctccacatgctgaaacacaattccatgggatcctcaagcaaaggttcagataatagacaggcaaaaagtcgatctgcctggctagaaccatcagtttctcttgatgcaatcttctcacaatcaaaagatagtgtgcctgtctcttgggaccaggtaatcccaacaagcgaatcttgctggctctcttgttcgccattgcgacgcttatgatggttgcagcctctatgggtatgcacaacgagcgaatcttgctggctctcttgttcatcattgtgatgcttctgatgttcccaacctctctgggtctgcacaacgagcttaagcggcttgagcaattcacacagttcctgaaggtgtgtggaactcaactgtccaatcccacaagacccacacatggatactaccaaaggtgctactggcctgacccggttcattatgaacttgtgcatgatgtacagaaggttgagagaaacgacttccaaatcaatgagctcaaagacgatttccttaacctcgcgcaagatctttgtcctccctgccaaatcatctccatcggttggctcccatctccatgatctgagaagctccctctcactgtcagatattctttcgggtactaatgacagaaattctttgcccacaatatgttcctcatcgatgtgactcttgaaagccgcgaattccacgtagatcattccggagcagaaagggcaagaccaacccttcttgacgaacacctcagcatcggaaagcatacttgtcatatccatcaaccctcgtgagcggcagtacgacttcatctctccaaaactcaccttgaggagcgcttgccgctcctcctcgctcatgcggctccagcgatcgccggcgattccgaggtcgacggtttccggcggccactccggcgtggacgcgggctccggtgaagccgcggcttgccccttgcccttctcgatcctcgcacgctgcccgcggatcgtctctcggccgtgggctttcctgtactcgagatcgaaggggttgtcgtgatgatcggcggaggagtagcggttgctcacgaaggtgtagtgcaacgccgggtcggtgggctccgccacgcggagggcgcggtcacgcacctccgctgcctcgtcaaacaaatccatggagatgagcgcgtcgatgagcagcgaggcgatgtgggggcagcgcggggcgagcaccgccgccagctcgagctgaaccctctcctgctgccgactgttgcgctgaaggtagcagcgcgcgaggatggcgcgggcgagtggcgaccacgggtacctgccgacgagcgccgtcgcgagcgagagcccgtgcgcgtgcccttgctcgccctcctccgtcagcgcgacgatcgccctgcccgcctcctcgcggaaggcggcgtcgcagtccgaccagtcccggttgctcttgctccccacgacaacacccgccatgggatgggaggagctgcggcttcggcctcagcctcagacgtgctgctgctgcggcggcgtcgtcctcgtcgtcgtggacgtggtcacggcgcgaggcagaaggcggcggattgggtcccgccgcaccgctccccggtcggccgagggggaggggcgcgaggtgttcgacgaaatgccgaagcggagaacgaaggtggcggcggaggcggaggatgaggaggcgggtggggagcaagtctctctcggcggagcaggagggggaggagacatgtagccggcgacggcgaggcggttgctgaggtttcggccgttggggtggggcccaactgccagagagacggagagagagagaggcccgttgtggtggggcccacgacacccgctagcgaagggatgcggtgtcggcggcggcgcttccattctagaagcttctggagacagccctgacctgcgccgacgagaggaagggagggaagagctatggaatggaagagaaagggaagaaggggaagaaggggaggggggaactttgagattcgtgcgaaagccatcagaatgaatgggtagtttgtgatcggcccaactagtttttgataggaataagttcacttcaggtctttgtccaacaacaatactggatcgattttgctatcgatcactcgcgtgatttttttgctgacatttcatgtttttttttttgcagcctcgtcagccggcgcgtcggacaccagcacatcggccttcgtgtctagctagcccaagcgcacacgataatggatattggagaagcacggtgacacggtggcctctaaccgtcgagccagccgctggtagcacggccaacactgatcggcgagagacaccgtccctctcgtcgttgtcgtgaaatataaaattacagtcctatataactaaacttgtatttgtaaatttagttgatttgacatgtaagtgcactgtaattttaataaaaataatatgtaagtaaatatgtacttattattttctttaaaatataaaattacagtcttatataactaaaattacatatataaatttagttgatatgacatgtaagtgcactgtaattatgataaaattgttgtgtaagtaaatttgtattagttattttattttgtagtccggtggatgcaaatccaagggaagaaaaaatctggttgattttttttaaaaaatcacccgagtgatgcataggcggtccaacatacatagtggaacgacttccaggaaaagcaataatacaaaggatcatgcttacttttcctaagcacttggaggcaactcaaagcttctggccagattattgcaaaacgaaattaaaatcagaacatttttctttgttcagtacggcaaagcatgaaactaaactaaaccagtccacgcactgaatgagaggtgaaagcaagacgatactattatttcttttaagtaagaaaagaactaaacccatcctaattaatttactatcgcctggaagctcttcgacaacactattatatatcgtgaggcgcagttgaatctccagttctccaccctttggattgtccttggcacctttttcatcatcttggtaagactgtatatatacttcaggtgtgccgatattcaggcctggtaagcacacaaaatcatgcaaagacgattaagtgaaactaatcaaagtttttatatcttctgagtaagaaaaggacattatattcttgtcacattaatatcttcttgaactgaatctatgtcttaatacttgcctcagcagtcagcaacattaccatcctcggaacataataccttttcaggtggatcatcgcgcagtttatcctgttaaacatgagtaaaacaaccatgaaaagaatgataattaagcaaatatataggtggtatattctaaacaaattaaataaagtcctatgtataacataaaaactatagtagtagactaacccataggtaatccttcatggctggtaagctgactttacgataatcacaagtacagacttccacgagctttttcttcaaatcatcaacttcggcatccaattgcaagatatcgatatctaatttagcctgcagcacattttacagccaaagcttagaagattggttcagtataatatcaaaggtacaaacactatctgaaaattaacagaaattcagggtacagtaaaatgaacctttttagtaaaataactttcatgcgtattcatctctattaagccacgttttagctcgattttctctaccaatgcagctgcacttgcaatcaacttttcgaggacacgagctccgttatcaagacaggcttgcctcatgttgttccatgaagtaaccgggtcttgtctccgaggtctagatagccagcgaaagagagcatcttgattgctagaagaaccatcgataatgatccttaacgcatcctcttcgacaactatggaaggaacgaaatcctcacgaacgaccgagacataatcaaaatgatcattactatcctgcagcttggcatcatcatcaccagcactcaatccaggcatagtcgatcgttcaaaaaatccaggcacaatcatatccagagtgagtgccaggacgtgaagcgccacaggatgcagcttagcgatgctgcagataggattctggggaggatcagcagaagcagctgctgctgctgtttcttcttcaatcgtccatctgttggtgaattcgaccaggttatccaagagatcgacggacagtgccttgcgatccttgatgcgctggagcgtgctcttgatcttgctcaagaacctctcgctctcatcatcatcatcgtcatcggatggcgctaatttaaccgcgcaagatccgatcagctctgcctcttgttcttcagatattctctccggcacgagcagcggcgatcgttggagatccgggaagaactcgtctgcgacgtgcgactggaagcactccgcggtgaggaaaaccatcatgcattgcggatcggggcacatccagcagatccaatctccggtgtccttggccaagtccaccgcgcaggcgagggcgctcatctgagcgtccgatagtggctctcctgtgtagtgcgctttcagatcctcgacgctcaccgtcaggaagccgcggcggcgctcgtcgtcgtcggcggcggcggcggcggccatggcgacggccttcgacgaggcctggaggaggaggaaccggagccgctccttggcgagcatccgcgcctctttggtcggcggcggctccagctgcaggtgcagaagctcctccgccgccgccgccgccgtgtcgtcggcgagggcgagggcgagcgcgcgctcgcactcccgcgccgcgagatcgaaccgctccatggcggcgtacgccctggcgagcgcgagggcggcgtcgaggtcggccggggcgaggtccctggcgtggaggagagggccgagctgccgccacctggcgtcgtcgtcgcggctgtccatgttactcgtgagaggaggaggacgcggcgtttacgtgaggagaaggcggcggcccgcggctgcgttgttgttatataggagtaataatcgggttgcaatggtgtccctaacaagttctctaattacatgtaaacccttcaaaatttcagttgcaattttatccctaacacaaatattcgtcacgccaaacagctcgctgagtttccctttttttagtttctcgctcagttccacttccacttttttttttgggggggggggggggttggctaagggataaaaatattatccatgtctcactgtctcacgccgcccctatgtgccctcaccttacgggataaataagttatatatatacttcccgtgtatgataaaaatatcaaactgatagatggtatgtttcgtaaaaaaaaattattttgttaaaatattaaataaattatttttgaaatgtatactagttaatagttaatcaatcatgtgctaattgctctttgatttttattgctagaataagcttacctcgtttggctgtgtttgtttattgttaggaactctttttctctgacacgtaaaatatagtggtagattagcatatgattaattatgtattagattaaaaaattaaataaatagattaatacaattgtttaaaaacatctttctttttttaaaagggtgcatttaatggtttagtaagtatgcgtgtgaaaaatgggcgtttgggactgggggaggtgctttatttctttaaacagcgataagcttcttgcagtactccctccatccgacaaaaactccattttcagttttggatacactctcttatttcaaagttttctatgattagtaattttattgttattagatgataaaaaataaataatactttatgtttgactaacttttttaaaaaatatatatatatttttaaaataagacgaacggtcaaatgttggatatataaacctagaaatgaagactttgtgggatgcaggggtagttctgtggtgccttttttttttcacaatttaagacaacgttgatcacgacgatttgtggatgcagtgagcctattgcatcgaattttttttttaaaaggaaatattgcatcgaatttctccggacatatatttgcctgttttctccgagatactatatgaacaatccttttgaaacgagatctttggcaaagggtgccggaacacctctgttttctgtgacagccgccaggtgttcgatgtcatccccggcttcctcggcgagcttctctccacgacagatgcgagaacacgcattccgtcgctagctcgttccatttttgcgactagttctgcaaatggagatggtggaaactgagccgccggtccgccgtcatctccttgcccttcgcgtaaacggagatctccgatttcgagtcgagttcggattgaagctaggaatgtctcgcagagcatagatgcgtataatcggattattcatcagaagtattctgcttggcatccacacgctttgcttccttcaacgatttcaattcgaactcggactcggctgccgataaatccaagcgcgccgcccctcgccgtctccgcattcaccacaattccttccacccatcctcgcagcagagctcgttcgtccatggcgcttccccgccgctcgagtccccgctcctcgcgcccgatcatccaccgcgccgtcgacgccaaggggaagaagccgtcaggaggatcgccgcctgtcaacaagatgtccttcaagaagggcgacgaggtgcgcgtccgcacgtcgttggggaggctagggaccacgacgctgcgcctcgtcatgtggctcggcgcggtcgtcgtctccgacgccgacgacgacggacacctcgaggtcatctacaatggcaacttcccgcgcgacgatcccttccggaccgtgcgcgtcgccgtcaaggacgtcaagcttccggcgccgcgcccggccccgaccccggcaaacatggcggcccagcggccgaccacggccgggaagtcgctgccgcggctgaagatgcagatgctggagaaggagcagctgcgggccaactccgaggcgttcttggcattgtgattagtgttcttcagtaggtgcagaagcttgtaggattcagacattgtcttcctctgttctttgggtgccaatgtcatcgaaggcacagtgatcttgtaatgtcttagataggatggtttattggaattcttcgcaagaagaacgtgtaatctgtgaagtgtatttatcattgattatgaatgaaagatcaagattctttttttatacacgagtgatgtgtttcgtctattatctcatgaccaatgcaatactatccttgtcttttttttgtttgagcaaagtgttaagattaaaatcacaatgatttaccctactgataaagaaaaacaatcattcatttgtttctctaaagataactttaggtgtaaaaatcaccactacatataaggccatctccaatgtgcaacaaaaagtgatttaccatcggtctctatatctctttaagtgcgtgttaacattataacgatgctattataacaaaaaaattagacaaagttaatatagcaaaattatgctagaaactatctaaacatggttgagctggatgactgtccaaacacgtgctagctaatggtaaatacatgtagatactactattcattattcaagagagctttgaaatacaactgccctcaaacatgatctagccatgacccatcaacgacttggacactgacaagagtggatctgcagtggagaccaaaggagacgatggtcaaataagccagatctaggctggtgcattttttttttgttttctgatgttttaatcgatgtatctatcatgtttttggggttggatccaaatgttgcactgcggtagtctgatcttatttcatctgttcttgcatattggttgaatctcaatgttccatttgtgaggatgagttgttcaatcttgatccaactatgtttcagcatttaatagattgaaacattttttatttagtggtgaaacattttttactaggagtgaaacaacgcttgatttttaggaaaagatcgggcgtccgatttgtagtcaccttcatatacttcccaaatcattcttgagataaaacgattatccacatcccaaatccgaaataaagaaaataaaagcaattactcccattgccgaatagtagtaatttagggtgtgattggttgggtggatgtgactggataaggatggtcattcaattttttttgtgtgtttggttcatatacaagatgagtgaccaaatcaggtggatgaaccgatgaaaccatccatgttttagcctggatgatgtggcctatgtcgattggttgtgatgggtttaattttttgttagcaaactataaataatttttcctactaaactatttatttaatttctaattcgattacatcattatattcattataattatatctttaaagcaagattttatatgttatattatgatggaaaatatgtatgacaagtgggcctaactaagttttgacttatcctattcatgttaaatctctctaaccaaataagaaattggatcactatatccatatatactgaacaaaaaacaaaaaattagatcgttatatccgataaaacatactatccacatgttatcttaaaccaaattactcctcatatttttatgacactgttctctcgacatggactctgtaaacaattactcctttcatttttatgacactgttccactactagacaaccgatattttatcgtgatacccaaaacatagatatctcggttagatttagaaccggtactaaagatatttttagtatcggttctaaaattctaattcccaaagactagatggaggatctttagtttcggttggtgttaccaatcggtacttggtaacaccaatccggactaaagatatttttagtaccggttggtgttatctaccaatactaaagatgccaccaaggttagttaaaaagaaagtatctccatccaagtcagatgtgtgtaataggtgggatggtaacatgcgtgaagtccaaggtgagaaatcttgtatttgaatctcacatccaacatattactttttatttagtatgcaagatcgagatctttagtctcattactagtctgggctgttagaaccgagaataaacgggttcggtagtaaagatcatttctctcgagaaaattccctacatacccctgaaaagttttgcaatctcttctatacccctgaattttgcctcatcccctacatgcctttgagttttcattttgatctcctatatccctattccgttagttgaccgtgaattgactgttaaatttttctaaaatgaccatatcgcccatttcccatacttatagtacatgctatttactctacttcataattcacaatgtgaaaaattgtaaactcatgataaaatcaaatgggacataattatttattgaaaagaaaatttaaactgtaaaccaaaatccatataagagttttagctagaaattctaaaccaaaattatttatttgttgggttcaaattttgatgaaaacaatatataaatttcataaaagttaatttaaattttttaatttaattttagaatttgttgtcaaataattatattccctttgtttatttacaaatagatctttttttcatataagaattgtgatttatcattaaactagtacataagtataacagaggggtaatatagtcaatttcaaaaacatttaacggtcaactaatagaatgtacatagaggagatcaaaataaaaactcaggggtatataagggatgaggcaaaattcaaaagtacataagggattggacgaactctaaaggatacgtatgggattttctccttctcttgcagtgttctctcatcatggactccgtaaacaagtgctccgattctaatggtgtcgctaacaagttctctaattacatacaaaccctttaaaattgcaatttaaattgcttattaattattagtccttctagtcactaatatttgtcatatatatagataagattcagtgaaccttctaactttcgaacgtccactttatattaaagtaactttataaaatttaggtgagactgtttgcggtcacggaggcgtgttgtttcgttaaacatagctactgcttcgtacagtagttttgatatgtttttttaaaaaaattataaatcctttattattatgatccaaattgcacaataccataaaaattttgccacgtgacacataaccctagatattatggttttaaaatttcacaaaaccataccataaatcatttttaacactcctatattaaaatttaaaaaaaggttgtcaaatttatatggtagattgtagaacttaaagaaaattcaaagtcaaaataattaacaatgtggtatgtgaaactttaagaacgtaatacgtgaggttatgtgttactctcacagaacttacaaccttaaatttttttaataaccaggtgatttcccgcgctttgctacaggaattactaagcaattctcaatatttttttaacaatctagttagcagtaaaaaggaaaaaataataatgaaacatcagggtttatcagacaaatgataccatgcttcaatgtgaaacatattgataagtatatgttaaatattgtaaaagtgatagatagatttgttaaaatatcgtgcaaatgatatgaggggtgatgattcaaggtttcacctgatgattcaaggtttcaaacatgctgctacccagtcaagtgaaattttgtccatgcatgtttggttttcaccttaatattgctatgttgtaggaagcaaacttatttagcaaaatgtaagtttattatactatgcaacagtaggaaataataagaatacctggtgatcagagatcttgacaggcaccaggaagaagtcattgtccacctccatggctccatagtatcctttcccccagccaccaccacctctttccgcatcttggacaggaggggatcctctttgtccccaatctctgcctgcagcacaccatccttgaacagcttcacacaaagtagcgaaagagaaagataatgccagaatagattgccagtgttgcccagcagaaaaaggaaagtctgtaaattcattctcacctaagatgaacaacagaggtcagtcctcaattctgtgtctgcaaaaatcaaccaagaaacaatgaggataatgagcagcacaacggaattagccaaggaggaagatttcctcttgttggacaaacgaaagaaaaaaagaagggcaccaattaacctgcagtagtagagtgggcgtgctggcaagagagaggaaccgatgatagcagcacgagcagcagaagcaaaggcactgctgccctcgtccgcgtccgccgtcgtcgccgccgccgacgccctcgaccgctgccaccgccctcgtccgtgtccgccgctgcctcgtcctccgagtttcctaatgggtgatcgatcgtcccggacgatcatctcatgtttcctttctgacaccgtattaactttctattttagtaaatttatccacctaaagtttgtatacctcaagtttacacatctaaagtttatacgtctaaagtttagagacccaaagtttataagtcaaaagtttatatatctgattcaaatttaaatttgaattcaaaattttttatatatatagtatttctatgcatctaaagtttatacacctaaaatttatagacccaaagtttataagtcaaaagcttatatatccgatttaaatttgaatttgaatttaaatattttttatatagtatttctacatataaaattttctaactttgtttttttattttttttagaaaattatgatgtagtaggaagagaagaaggggaggaggaaggggtagaggagctgtcataggggaggaacgggtgatcgctcacagcgaccacccgcccattagcacccccctcgtcctcgtccacctccaccctcgaccgctgccgcctccctcttccgcgtccgctaccaccctcgaccaccgctgtcctctcgcgacctccgtcgctgctgccctcgtccgcgtccgccgtcgtcgtcgccgccgctgccaccgccctcgtccgcgtccgccgccgccctcgactaccgccgccctcaatcgcctcttccgcgtccgccgcagccgccgccctcgaccgccgctgtcctcgtccgtaacctccgccgccaccgccctcatccgcaaacgccgctgccgtcgctgtcgccattgacaaagttcgtcgccgccgtgtagcgcccgttccgtcgtggcgcctagcgggaaaattatctcttaaaaaccctaattgcgaaatttgtttccttgcttgttgtctagtgtccgtgccatctcaagatctcaatccccgatctatcgtcgagttcaactccaaatccaattccttccaaatcgaatccctccgcaaaagtctagtttgcctcccccgggttcgatgggccgaattccgctcggcccatctcttccccggccccctctctcccgggcgtctctctctctctctctctctctcgcactctcccatctccccctcccctcccccggcgcgctctccctccgctccgccgcgcccgcgcgccgcgcacgctgcgtgcgcgagcgcgcaagccgcgccgagcgcctccttccccctccgctccgcccgcgcgccccgtgcacgagcgcgagagccgcccgcgccgagtcgagccgcgcctctccatccgccgcgccctcccgttgcaagccgcgcgcgcgtgccgagtggccgaccgtctggttgccgccgccgtcaccctctgccgcgccagcccgcgcctgtcgcctgtgtcgtcgcgccgctccaaaccgccccgccgtcatcgccgtcgtcatcgcctcggccccgccactcccgcgctagcctccaagggacggaggcagagcctccctcctccctcagccgcgcgcccccgctccctgctccttttcccgaagaggcaaggggacaagccccctttctctccctccttttccccttttcctcctcgccggcgtcatccgcctctgtcgccgttttggccgcaagcaccgagcgccagctagcgccttgaccgcccgaagtcggtttccaaaccgacgttgccgcccttaaagccccgggcgccctccctctcttctcctctcgttgcccctctcgccgccgcgccattgccgtcgctcccgtgctctgtctcgcctccgccgtccatcgccgagcaccgggagagccggtgcgttcgtggacgcggaaggggacttcggccgcgccctcttcttcctcttcctcggcccgaggccggagagattactcccgcgccgccggcctctcgtcacagcgcccctcctcttctcggtgatgtctctctccgttcttcctcctcgctccatctcctccccctagctttcggtagtagcttgagtagactccccgtagttagccggcgccgccccgaccgttgccgtcgctcgccgtgtgctcgccgccgtcgccgcccgagctccgtagcacccgctcgtcgccggccttgctcggcgtagttccacccaatccgacgctagcgtcgagttcccgaagccgcgtagatgctctcaccgccgggaatcggtctctcgtgacctcgtcgccgtttccctcttctcccgccaccggttgccgccgccgcaatccgccgccatcgagcaacctccggcgaatccgagccgttggctcgtctccccttgtcacgtgcaaccgcccggtgtgcacgcttttgcccgtatcaccgtggttcgctccgccgctcgccgccgccgcccgccgtccattcgcggccgggtcgtcgtctacctcccgccagcccacgtggccgccacgtaggcgccacgtcggcgccagctcagcctagaccgggtcgggccgaccccggtcggtccctccgcgtgcgcgcgatccaccgcgagccgtgaggctgcgcgtgggcccgccgcacctgcgtccaccgcggaccccgcgcatgcaccgcgtcccgtccccgcccgcgcgcgtgcgtcgcgtgctccctccgcacggtgagccgagccgctgacaagcgggtcccacccgggaccgcgcgtggtgagcccggtccaccggactctctcctccctcccgcgcgcgcgcgcgcttgggccgtcttgggctggccggcccattaagctcggccgagccgccccaaatcccttgggccgcaccctagccgcccgaggaaagtctaaatttcctccctcctttcttttctttttcttttccgaaaaggatttaattccttttcctttaggccaaaaattcaataatcttagaaattcaatatcttcccaaccgtaaatccgtttgactctgttcaacttccaaaatttcccaaatctcgagatctatctagtggcacgcttagaggtctttaatagggctttattttcgccgattgttgagttgtcccgtttcgcgtgtagtttcggagcccgaagacccgcagtgcgaggatttcgaggatcaagctccagatctcgagcaaggcaagccacccttgaacatcttgagcctatatttgaaatttaattatattgcttgcgaaatattatgcattgataggatcacacttaatctgttgtcccgtctgcaaggcagattggcagacctacctaatttgttgcatttgatccttcctttgttaattgttataccatgtccccttgtaaccacccagttgcacctcgatattcgtgcactctatgcgagtatcgacggtcgccttcaaacttaaaatctgagtaacaacttgggtaaaactggagttttacaaaagacttggaaaacccgacacctgggtcggcgcttgcgaactaaatgaatttccaaaaccgcggaccggggaacgtaccgggtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgttgtgtaaaaaggggttcggtgtttgaaaaatctgcagctgatgggatcagctaggcccgggtggccgtttgaaaagttgttggcccgggtggccgtttgaaaagctgttggccgggtgccaaccttgttgcaatcctaaagactgacacattgcacatactccgaccggacgggacgcactgtctcaaccgtgtcgtttgagaagcactcactcagttgtttcagaaaagagttcaaataaaatcaattgcaaaaataccagcctttccttgaggcctgcattaaacacttatttcccctggcttgctgagtattcccgtacttacccttgctctataaaaaaaaatcccccccagttgctgaagaagatgaagtggatcctgctgacgaggagttcttccaggagcatgtcggctacgatgagttttagggtttcggcctagttcccaagtcgcgcctgtgatgattggtccaagtcctggcttccgctttccttttgtaatgcagttgtgagctcgggatctgtccgcagcccaacatgactgtacttctactctataataaagagacctctgttgctgtgatactctgcctccctgtgataccagcactatttcctgggactggtatcgattagcaggttaatttggagcgtcacgggctagttccggtcgggactagttcggggcgtgacacgccgtagtcgttgttgctgtcgggggaggcgaatatgcgatgaggccgggagaggcgaatagtctatgaggccggagggaggcgatgcggtgaggagcgaagggaccgagggcattgctacaaaacggaatgagtaccactgagatgtaatccaacggctgataattaaatgatgatgtggcttcaccaaatctcagctttgggttttaactttatagaaagaagggataccttagattttgtgattataataggtgggattttataaaatttattttaacattattatttttacaatttaagacaacgatgatgacgacgatttgtggatgcagtcaccctattgcatcaaatttctccagacatatatttgccggttttctgcgagatacaatttgaacaatctttttgaaacgaggacttggcaaagggtaccggaacacctccgttttctgtgacagccgccaggtgttcgatgtcatccccggcttcctcggcgagcttccttccacgacagatgcgagaacacgcattccgtcgttacctcgttccatttttatgactagctccgcaaatggagacggtggaagctgagccgctgtcatctccttgtcctccgccgccgccggcggcgacacacctagcttcgctgcgcgttcccgcctgcttggcgccattcggaatggattgcatgatggtggagaggcgtaacggacgtctccgattccgagtcgagctcggattgacgaatcgtgcctgacagcgccgacttcaattcggactcggacccggctggtgataaatcctcgcagccccgatcgccgcctccctccgcattcaccacgattccctccacccatcctcgtcgcagcagcgctagctcgtcgtccatggcgcttccccgccgctcgagtccccgctcctcgcgcccgatcatccaccgcgccgtcgacgccaaggggaagaagccgtcaggaggatcgccgcccgtcaacaagatgtcatccgcgccggccgcgccagcagtgtccttccagaagggcgacgaggtgcgcgtccgcacgccggtggggaggctagggaccacggcgctgcgcctcgtcatgtggctcggcgcggtcgtcgtctccgacgccgtcgatggacacctcgaggtcatctacaacggcaacttcccgcgcgacgatcccttccggaccgtgctcgtcgccgtcaaggacgtcaagctgcccgcgccccgcccggccccgaccccggcaaacatggtggccccgcggccgaccacggccggcaagtcgctgccgcggctgaagatgcagatgctggagaagaagcaactgcgggccaactctgaggctttgttggcactgtgatcagtagtagcagtagcttgtaggattcagatatgtcttcctctgtttttttttggtgtcatggaaggcacagtatctcgtatttgtgataggatggtttactggaaatcttcgcaagagaacgtgtaatctgtgaactgtatttatcgttgattatgaatgaaagatcaagatttttcttctttttttttacacgagctatcgatgtgtttcgtctattatctcatgatcaatgcaatactatgcttgcctttttctttttcttttttttttggtttgagccaagtgttaagattacagtcacaatgatttaccctactgctaaagaaaatcaatccttcatttgtttctctaaagataactttaggtgtacacagtacacgaactttgaaatacaactgacaatgggccaatccatcctatggttagcagttagcacctctgagccagggttgtctcgaacatgatcaggtcatgacccatcaatggcttggacactgacaatagtggcctcgattgttatcaataaggagctcgcatcttagctcaagctctcgcgacgcttgctggagcaacgtttgcaaatccttacggggcgtgtcgtgtgatcgtagatcgatcatgtggtgtgttatgacactcgagatcaaggtttcgtcctcagactctgttactccctttagtttcagatgaatttcgaaatcaacttgatccattagcacgactgcacgagatgggcatgttaacattagatttggatcctgtaagcatcacaagtaattgatcaatccatgttaaatgtataattattctacacttggcacactaattaaggtcaggaacatataatgtttttcacaggcttatgtttgtacagattatagaagtgccacttttgttcatttagtttgtatcaatgagttctttacaaagaagagcactaaggagagcttactaggtcctccatggaatgtttaggctatgccaaaccactacctcctgtaaaatcaaggagttgatttaagaatttgtgtgatgaaaatattggtggtttgtgatattttatttgtgataaattggtttcttgtgacgagagttaggagattgatagatggttggttttgtgaagtggttgtgcggttgacccgagaggtcagaccagccggcctgacggtctgatcgggcaaggttctgtttgatgtcaatttcaggttatcttgtccgttttggatagtttcttcgtggatttaacttctagattgtttctataagtatggatactgttgttatgctaatgtgagttaagttggaatgaacttgtgttcagaatatggtttctttattgttgcatgtgcaggtgttatttagatcgaagtcaacttgagagaagtggatgtccagagatcaagagaccatgcgggatactaaaggctagagaacgatgcaaatagtgataaaattccatatgacatacaagaggaattatgtgcatatatatggaaaatggagtcgaattcggacgtgagtctaaattcggaaagattgataaatataagggcctattcactttgctaccaaaaaaacattaccaaaatttggcattgccaaaattttagcatagttgtcaaaaatttggtaacttgccaaaattttggcatgatttcttatatagttaccaaaatttggtaacaaactaaatgtagccatttttttggcaactttaccaaaatttggtaaggttgaaaatggcatcaaagtgaacaggccctaagagatgagttagatacttgcaagagagggtttcctacgtggatgggaatcctaattaatgttagattcgtgagctttgtacaacattcctcatgtataaatagaaagggagggtgaggcatcccggtatcgatttttgagagagttgaattgagagaaatgttagagttctgagtctagtcgagattttggtgaggagtgttgttggtgcactttgtaaacactagttgatgcaataaagttgagatagttcaatctacatcttctagtttttatctacctgtgttttctaggtcccgacggtcagaccgacagcaaggtgacgttctaaccgacgagagtgcggtggtctaactgcaggtggcgcggtggtctgaccggccagacaatggaagtctgaccggcagcacgagggcggttcgaccgacgccttcaggacttcgtcgcctacttcatttgaggcaaatcttttattccgcaaaatattttgggtttttggttttccctaccattcacccctctctgataggtttgtttagtcttgttcgatcatatacctccatttttatttacatgggcagcgtaaaaaaaagagggagtataaatgtagcaatgaccaccccaaaaaaaaagacattaaccataacaggaaatacacaattatgtatattaagaatgttaaaaatgacaactgcaaataagatctcgatgaatagtttaggcacatgaaaactataaaatgtagcaatggcaccctgccctcacgacaaaaaataattataaattatatacagcattagggtggcctgttgaccaaattatctatgcaatgcttttagtttgatttgatacttatcgcatatgtggttaacctctaatttttcttacttcgtaggtttcaatttgccccacttgtgccggagagggtggagtcatttcagagtatcgcaaagaaatgtgctggagagggcgtgttcatgttggcaaggagatcaaagtaaaagttcctctaggtgttaggattccatcggatggctgattgagccgggagcgtttcagccgaagcccataggatggctgattcgactgagcccattcagcaaaacaaagtgggctcacaatggagggtaactggcgtttggttgatcaaggtggatattttccgtttcagttttactatatatttatggacaagttttctctcaaaaaattatgaaatgtaaataccctattgattataatttaattattatattataacttgtatgtaattttcatattataatatcaaattattaaatttgcttcaaggttcttgcaaacgtaagaggagaaaatcactgtgcgtgcacggggtgaggggattcgatatcacgacctccgctttgcaggaatcagcatgttacgacggaatttacgaaagttatatacaggatatattgaattacatgcatgattacatactacgactgtactatatttctgcccgaaaatttctctacaaaagcataaacagtcccgctgaactactactcctgtaacctgataggcccaattcaggcccacgaacgtgtttgggccgaaatgtgaacttgaacaggcctggattgaggcccaatacaactatgggcctaggtggaggcctcctgaacacaaaagaaagggaaaaaacccaagtgagaaaccctaaccgcgcgaggcgcctctcctcctctgcttgcctgccatggagttcgatcgccggaaggcggcggcgctggccgcgctcgcgtcgccggcgccggacaagtcgccgaagggcggcgtcgacgcgcccatcgcgccgctcctcgacgccctgaactcccacccggacctcttcaccacctcctcctgctccggccgcgtctccgtcctcgcgcagccgccgccgccgcagcaggccgaccccggcggggccaagaccaagaagaaggcgcggggcggcgggtgggtgtacatctcccacgaccccgcggacccggaggccctggtggaggtgctgttcggtgtgaaggaagggggagggggaggcgatgatgagctcgtgttcaggttcgagccgatgattgtggccgtggagtgcagggacgcggctgcggcggcggcgctcgtggctgccgcggttggcgcggggttccgtgagtcaggtgagcgtttgaattcgttcagctataggtagtgagatagatggtgtttggttgagttctgtgtgtagtttgtgtaaaagaattcatttcttctgcagtttacttgggtcatttagttacctgtattgtactacatttccatttggaggtgctgtaatttcttgggttccaattctgtttaaaatgggtaaaattccggatgctctttgaattttttaatgtcgatttgatagagtttgcctaaaatttaccggtgaattaaggcacaggttaaattttcaagagttatgctttgacatatttatgttttagatggagatagtgtcatttatattgtctttccactttgcttgccttggtgtgccttttcaaatattctgatcaagctttttttatggtaccatttttaggcatcacaagcttgcagaaacgtgtaatggtagcattgagatgctcaattcggatggaggtgccactaggtcagaccaaagagctcgttgtctctcctgattatattaggtaccttgttagaattgccaacagtaaaatggaggctaacaagaagcgaatgggtggattcctggatcttttgcaggctaaggtatcatttgactttgcataccggtaggcattacatacctcatatttgcacctttctggcattgctgctcatctctaactgggcaataaccatgtgatatcatgcaaagttgaagcatgtatttcctggatatcgatttgatggataaagagaattataatatcctttttccaggtagtttagctattggtcatcacacttctttgtgaagaaaattaattttgtctgtagtgaaaggctcattgaagattatttagacatggaaagcttttattcctcaatttacttattaattctgctgttccatataccaccttatcaataagtatatggagtatggatttagggaatgctctaggcctctatcactttgctcattgtgttctttataagttttaatgcattggttccattcaaactgccagggtctcctaggttcatccaaaggatgtgcaactgcagataatgaatccttagttgcaaaaaagagtagtgatacctataattgtgatgctgataataattgtgataatggatttgtggagatttcactagaagcatcatatttggagagtcaagaccctgtacttcaaaatggtgccaagcatggttttggtaatgctaaacggcatgttctcatatctctttccttttatcctgcttttatttcccctcatggtgtcatgtaaacctattggcctgttcagtccttccatacatatgttgaggagattttggtttgtctaagagaatattaccatcaatacataagtacatgttagttatgtatgctaggcctattgattcagttctgcacattgatcttgtacaataaagtcaataaatgttatttgaaaatgaaatttggtgatgctggcactgtttcacaggagggcatttagtaagccatatttttttatggcattaaattggaaatattaccgtgccagttggctacatagtcttttcaattctaactcataactcagcagctcttatatatatttatcctagatacagagctctttttatatgactaaaccctattattccgtttattttcttctgtagattaacacaagaggaagcattgccaacattgtcaggaaatacaactcactgcctttctactgctgcattggagattactggtgaacctattgagaagctcttcttatggggacaatctgcttgtgcactcactgttggaagagagcaccatatcctaacttttggtggttttggagggccagggaggcacgcaagaagaaattactctcttctggttaatcctgggtcaggattgctgacagaattaaaggttactgggtcgccttcaccacggatgggccatacaattactgtagtaggcaatgatatttatgttgttggaggcagaagtggtccttcagaaattcttaatgatatctgggttttggaaagatctaacaatagatggtcaaaagtggactgcagtggggattttttccgtccaaggtattgtttagacgaaattctttatatctaattttcttttgtaccaaataaaaaaatgctaaaaatagtgctaactagctatgtccaaaagttatggaattagtttcttgaaaatagcaacccatttgcttcagggaagttatgtgtttttcaatgcaggcaccgacatgctgctgctgcagtagatcgcaaagtatatgtctttggtggactaagtgatgatggcttatgttcttgcatgaacataatggacacagcaagtatccaatggaatgtgatttctcctgatgacaaatggccatgtgctcgccactcgcattctctagtgtcctatggttcaaaattgtttctgtttggaggtcatgatggtcagagggcactgaatgatttctatagttttgatacaacaacacttaagtggaacaaagaaaacactaatgggaaagctccatcccctagattttcacattgcatgttcatctacaaagactatctcggcatacttggaggttgtcctattagagaaagcagtcaagaaattgcattgctaaatttaaagcataaaatctggttttatgtatccattccatcattgagccaatgcctttgtgtccgtagctcatcagtcatcattgatgatgatcttgtcattgttggtggtggtgcgtcttgctatgcatttggaactagattcagtcagccaataaaaattgatctgcatttgctggagtcaatatttaagcttgcatacaacaaggaaaaagaaatgtctgtacaacacggttcagtgtcgaatgtagacttattagaaggacatgaggaaaattgcaatcccagtgataatgtgaaggtggtgattgatactgctactctaggttcatctcctttggtccttcagctagaaaagaagtatgccaaattagcaaaagacattctaaaaaagtttggatggttggatcttactagaaaagttcgagtaagccaggataacatccatgttctctttcctgttagtaaaacttttcatgccctaatcactgataagcatctcaaggtacaacctgatgattcatgtgtttttgaagaactattgccgttttctgaaaataagctttttggggccagcatttctcttcagaaagcactagaaattttgttgttatgccgtggttccattctgaaagatgaagtagcgatcagccgcaaagcttctaaaactcctcaaaccatcatgagagagcttgtgtctgttctactggataaaaaaggattgcctacccggttattggagcaactgccaactaggtttggtctctgatcttaaatggagtatgaaatataaataataaatccataataatctaagaaaa

SEQ ID NO: 83192 - DNA, 1632 bp, Oryza sativa
ttttccgttgggccagcccaccctgcacacgctccttaaattcttggaaaaaagttaatcatattgccaagaggctaatatgacaaatgatgtttttataaagttttgaacttactcagttaatcataggctaatcctgttttttacacctaacatatcttcacagcaatcaagcaaatcgaccagctcggtacgctagaataccatgtaccttgaattgggtttcctgattgaattgtacttgtttaaacgaacatttaggcgcatctctatctcaacattgtaaatctccttttcttcgtatgctgattcagtgaccaatttacatcaattttatgcacatagaaaattttatagtgtgcccactgcaacgcatggggtatgaactggttgatataatgatcttgggtatgattatgcccttgaggggcctcctacctgccttatgtaggtcgggggcaagattatagataaaacctaactaaacctggtatctatttgacaatattccggagtcagagctataggccgtatcccttaatactcagggaaacgtaatactcaaggcttaatcctttacatattctagagatataaactatctcatataatcagtcgataaactaatcgtatgggtatatgatacccgtaatctccacagtagcccatgagcccttcacactcgaaaatacggtcgcatcggctactttgataatactgtcttaaatcaatttgttaaattctatagacagccgattggtcatgtttagggtttattattctttgatatatccagtccataccgatttggtctaactccatcgactgagaccatcaacgatatgctatcggcctatcgatcgatcggctatcgatcgactgattctgcttttgtcctttcttgctgattgcaggatcaaatcagctggtatgccctagacacactcaaggctaaccttgacctgcactggagttaagcagatctcctaggccgccgtgttttcacatcaacaagcttttggcacatctagtgggacaaagttttgttattcaaccatgtcgtcactgtctgacattggtaaagaaaatgttatacctgctaaggttgaagatctgtctgaagagcaaaaggcagagatggagcagaagatgcaagaactgaagaaggcatatattaattctttttctatgactcggcaagggaaagttattcaaaagtacaagtgccaaatgccgaagttagaaggagaaggagcatctggtgccaaaggagagcagaaagaagatgataataataaaaaacagttgatgactttataggatcgtcttgatttagctgtgcaccatgctctcatcaaccaatctggaatcttggtcaccacattgtcaaatttgatcaactcagtggttgatgggtcgattgctgagtagaagacaagaggaccagtatatttaccaagtggtgttttttttcccaaatatagagaaatcaagactagtcttgggaaagccgagtgcttcgatcatcttcaccacattctcccaagtgcttttaccaaatcataagactgtgaaaggctgaaaaaattttatgagataataaagaatatatactcagatacatcgactaga

SEQ ID NO: 83193 - DNA, 700 bp, Oryza sativa
aaaagaaacgctgggtttcaccaatatggggacttcttcaacctccttggctatgtaagtttttttaaaaatttagtataagagactaatatattcattttaaagatacacaataatcgagcacactgctgggaatatgtatgaactacacggtttgtgcatgcatgagtgcaataatagttaaaattttatgatagtcggtcttcattttgaaaaattatagcatatgctttatgaaacccgccttaacttggctcatggctcaaaattctcattcactaaaattgcacacaatagctcatcacatcaaacttgttgcaggcatggcagctatggaaggatggaagttggcatgaacttgtagatccatcattagtaagtgaaggtcaaatgatggaaataaagaaatgtatgaaagttgcacttttatgtgttcaagagaatgcggttgatcgtcccaccatgtccgcagttgttaagatgctttcaagcgagttgaaaattctacctgagcccaaacaaccagcattctttaatgtaagggtgaaacatggagagctgtctaatactgcacctagtagcataaacgatgtaaccataacaattgtgaacggcaggtaatgccaatatatatagggactttaattaaaatggtaaaaacccacaggactatataccttgtacagaatgtaattattaa

SEQ ID NO: 83194 - DNA, 8365 bp, Oryza sativa
aattcctgcagcccatgaacttagtgagaatatagacatctattatatatcaaattccaatatagagtgcataggattacaagcatttgcaccaaattggtatagggatattaagtctaaaaaggatatagaaaaaattgttcaaagattagaggatattcaaattataggagaaattcctatgaaatattgggagaaaaacgctatcgagtgtaaaattaatatattaaacccagaatatattattaagaccagcccaatagaagcaactccgaaagatatagaagaatttaagatgcatatagaagaactgctgaaactaggagcaataagagagagtagaagtccacataggtctgcagcttttatagtaagaaatcatgcggaagaagttagaggtaaatctaggatggtcataaattataaaaggctaaatgataatactatagaagatgcctataatatcccaaataagcaagaatggattaataggatacaaggtagcaaatatttctcgaaatttgacttaaaagctgggttttggcaagtaaaaatggcagaagagtctatagaatggactgcattcacctgtccccagggacactatgaatggctagtgatgccactaggattaaaaaatgcacctgccctatttcaaagaaaaatgcaaaacatttttaacgataatcaagaatttgtgttagtatatatagatgacttgttaatattttcaaaaacttataaggatcatattgctcacctagaattattttttagaaaggttgagcaaaatggtttaatcctatcaaaaaagaagatggaaatatgcaaagaaaaagttaacttccttggacatgaaataggagaaggcaaaattcatttgcaagaacatattgctaagaaaattttacaatttcctgatgctatgaatgacaaaaagaaattacagcaattcctaggacttgtaaattatgctagaaatcacatcaacaatttagcaaagctagcaggacctttatacgctaaattaagaaaaaatggtcagaaatattttaattctgaagacattaaattagtaagattaataaaagaaaaagtgaaagaactaaaacctctagaattaccattagaagaaagttactttatcattgaaaccgatgcatcacaacaaggttggggtgctatattaaagcaaagacctactaaattttccgctaaatcagaagaaaaaatatgtaggtatgcttctggaagttataaattaaaaactgtcaataatacagatagagagatcatggcaattatcaatgcaattaatgcctttaggttatacctagggtttaaagaattcacggttagaaccgattgtgaagccatctgtagatactataaccagcttaatagcaagaaaagctcaactagaagatggattttatttgaagacattattacaggaaatggttatagagttatatttgaacatattaaggggaaagataatagtttacctgacatgctttctcgtttacccatatttcaggtatgaaaagatcaatgaattacgccggagtcgagtgcttcacatttggagatgacaacaaactcagaatattcccaccaaattcatataaatttaagccaaaggaccatataatcctagatgaagttcaagagtgcatcttggacaatttctggtaccaatacaataataaaagggaagaaaaagggtatatgttatcaatattgaatagcctctctgaatattttcacctaataaatgggtcattaatgcctgccaatgaagatcatgaagtaatccaacagaagcctatatatgtagtatttgatggaagctccctggggtctacatttcttttgaagaaattgtggctcaaaaaatagatgctaaattaatgggaggaatatcttggaagaaatataaggatattgatgaagcattaagccaagctagaaaaatattaggaataaattattatctagagcctgctgcaaaagaatatattcaaaaatgcaaaaaagctaaaggaaagaagacttcagaaatacccattaagatgactataaaagaagaagggttttttaaaaaacccacatacaaggaatgcttaacaaaaggagtggatccattagatggggaatatattgattggaagataatagaaaaatttgaagaagcctccccacaattaaagaaggaattgaaggaagaaatacttaaagaattaaaacaagaaatggatcagaaattcgagcaaataaaaaaggcagtagatgagaaattagaagtttctttttctgatttggacacaatggatcttggtggccatgggcaaccagatgaataaattaatataagctaaatatgtttttcaatatatattgataatagaatatcaacaatttgggcgtggaagaagaataaaagaaattcagaagattacccaagaaagaatccagaagaattcagaagattacccaagaaagaatccagaaggacaccctataaagtataaggggacaatatagggtgcggtgaatgacatatccctgtgaagaataaaactttcggtggaaaggcctcgactttagccagctcccgtgaagatatagtagcgaagagataagcaggaggcacaggcgacgccatccctggcctctataaaaggagacgttggcattcactccgaagacacacaaccacgaagacaccattcagagcaaagcttccaagcgcgctctcaccctctattccacctttcttagtagtagttcctctagcctaccttgcataatatatattgaagcagtgagttgtaatataaaggtttgtaaggtgagaaaaacttgtttgtatctaccttcggggttcccgaaagggaaaaccgtatgtaagcctatttgcttaatatgaagtaattttctttaagtttccccgtttgtttgctctagataagcgtttatgctagggaccctataggagaaacctctcggttgttctcgtttttagcctgcatcttgcatatgcgtctggagaaccagtatccgtagagaagtgttcccctcgggtggaactgcctggggagacggtaaacgcttagctagttcaaatatgactagggatacctgaagttggttgcttaaataggcagataagtgaggcatacggctagtaccgagtaggactttaaaatttctaaatcaagcgccggctgtttttggattcgccaccctgcaaagatcctaaaaatttaaagaaaattttcgagtgaacagtaacctgtgaacagtatttctgtactcataatagtgaattcagcactaagaatagtagtgaatagtaatgaattcagcacatatatatttctgaataataaagttaataataatgtgctatatatatatatatgtgtgtgtgtgtatatatatgtatatatatatatgtgtatatatatgtatatatatatatatatgtatatatatatatatagacacacacatgtgcatgcataggcagccaatcggcaaaatggatcgtgggggccgggccgggattagctgatgccggcttctacctgtattaattctgccaggtgaagtgacacactcatacgtgctgtttcttccttgtcgggccccatatgattaatttggatgacttcacatatacgggaatttaactatttgccacaattatccaaatacccttcagctctttttttccctcttagatagtggcttcttaactatttaccacttttacccacgtgacataccaacgtggtaactcaggtgaaaaaacgatgtagggcccacttgtcattttctcctctcactgacctctctcccccccaactgtccagccggcgatgccggcgaagaggactagggcggcgccggagtggaggtcgacaaccgctacggccctctctccaacacgtgcccaatcgaccttcatggcgccgttcaagttctgcagcgatggccgaccgttgatgcgggacaacggatctatcggagtgctcgccgatagtgacccacgtgagcttcggtcagctctccgccgccttctcctctggcctgacgcccccagtcgctccgtctctatatatatatctatccacgtcggcatcgggaccctcggctcccccgcacgcgcgccctttttcctcaccgtcagtggcagatgccgctgtggagaagagcgttgggactcctgctgtgtgacacgagggcaacgagcacgcggtgttccacttcggccgacgaggacccacttcgcgcgccgaggagagtgccgccgcggtcgtcgaactccacttcggccacccccaacgccggcgtctgatagctggaggagagagatgagtgaaggggagagaattacaagtgggaccacaccgttttttcatatgtgttgccacattggcatgccacgtgagcaaaagtgacaaatagttaagaagccaccatctaagaggggcagaaaaataggagcaaatataagaagggtatttggatatgccaaacctaaagtggcaaatagttaaattccccacatatactgcctccatcctaaaataagtgtagccgtgggtattcatgtccaacgtttgaccgtctgtcttatttgaaaaatttatgaattttttttaaaaaaattatcacacataaagtactatttatattttatcatctaataacaatgaaaatactattaataaagaattctgggatgagttgtcacacgtaaagtctttacatctaacaaccaatgtctcatataagggccgacaaatattttccgtccccctcatcactccatccgctgctgagaattataatctggttcactcgataggagacatttggatcttaagcgaatttcgccttgtctggcaaggtttagtgtttggtaccagaatgatccaaacgcaccctatttgcgtgatttctgctttctcacgtactccctccattttttttctttttaaaaaaggagaacttttagaacgtgtttagactcgttttcaaaaattaaaaggtatacttattatacacgtatttcctcgaaacgactgtctgatttaggggtgcaagaaggtttacccgcgaacccatttaatcacaaaaatagtacgtaacccgccggtttgactagcgggttaactatgaatttgacttataaatgggtttatagattgattcacttgtatatttagatgtggcaagacaggccgtgacacgaaaacccataaattattatttatttaaaactcgtggatcggcccgcttgcacctctagtctgattgccctccacaccgttagcccctgtctactgtgccttcaattcacacggcacgacaactaattcgatcgttactctctttcctgtcgctacttttggaagtgagctcactgctcacacctctatagaggtttgtcttcagcacactagaaaaagaaaaaaaaaacaaggtaatgccttggtgagggtggttgctgacttgcctgtcagctgctatgctttagccaaatcgagaaaacggagttaaacacgacaaatgcgtgatcgagaatacgaccatgcgttatacaggggacatacataggcagtgacgcaactgcacggtattaagtcatgttcggcacaactcgtagatgtcagatgcacgttagatttgcagtttatatgttaaaattatgttggtttaaaatttcaaattttatctaatatagaaacaaaataatttatctaaatgttatgaacgtaatagttgtcatccctaccccaatctaacttgtgcattcaagtcctccacgattttaggccagcacggttctcatccaacagctgataaaaccatcaccgcacgaaacatatgggtgcatttgatagggcttcaaattctatgattctgattctaattcaccctaaatcgtataaaaaagagaatcagaatcaattcagttagctgcttggcaacaaatgttagcactatattactcttgtgataacaaggccagagattaacataaatatcatcggatcttcgttccataatataagtgattttgattagatgagaaaatctcttatattttgggacggagaaaaaagttaatgtaatgctaatatttattagaactacttaaaataaaatcttggtaactttggtggagcctatgggtctgtttgggggagcttctagctgttgcagctttttctaaaatcagattttggcttaaattatgagaaaatatagttgtagaatccagaaaatgaaatataagctagaagtggaaaaatccaaacagtccctatgtctttggtttgcgcgattctcatgtggagcgaggtttctgcttgtgccgatccttgaggagctagcgcgttgcgtttttattcgtttggctgggaattccaccgatttttcgataatcatacctcggtagttcggaaaaatttttgggtttgattgtcacatagatatacggacacatatttaaaatattaaacatagtctaataataaaataaatcataaattccatcagaaaactgcgagacgaatttattaaacctaattaatccgtcattagcaaatgtttagtgtagcatcacattgtcaaataatggtgcaattaggcttaaagattcgtctcgcagtttacccgtaatctgtgtaattatttttttacctacatttaatgttttatgcatgtgtcaaatattcgatgtgaaaacgtaatttattttttgttctggtattaaacagggcctcagattctagcagctcgtaaagccagagaggtctccttggccctcccaactcccaagttccccactccgccgcagcttctgtgccggccggacccccgttgtgccccgatttccgcggccgtcccgcccccgagcggcgctgccatctcgcattgccgccgccgccgccggtatggccacgggtgctgaggccgccgcggcgttatctcctccgggcgccgccggtgccgccgtcatgggagtcttcaagtacaacttcggtgcgtgcactctctccctctcccttctccgatccaagtctgaggttgatttcggggggtgggggatctaagtgcggcctcgttgttgcagcggcgcagttcctatccagggtcacccccttcctctacaacagctggttcgtgcgccagctcagcgccgacgactgcgcggtgcgggatcccctcccctcttcttgctcgctcgctcgctcgcttgattttatttctgtgcccagatgaagaactgaattgtgcgtttactcaccgtagtaaagcaaatgtggcgattttgttggaacccaagttgttgatttttgtagcaagctattgcatgattttattgtagggggttttaatagtgtgatttgggtttattttgaagttttacttggttgaactaaaagagaactgctctgggaatctagtccaccagcaaccgactgtgagaatccagtagatatgaacaaatcaacgttttgataatgctgtgtttcttatgtgcttcactttgttcaaatatctaatagaagcttaaactcctttatatgtcatctatctggcaggcatacgcgttacagcttcctctcttcatcaactgcgtcctatttttaagccgggaggggtttcggcgtgcatgcttgcgtaatgattctgacaggtattacaataactttatatggactttctgaagcaatttaggagctataagccatatttataatttctgaagaaataactaagcagtaagtctttttgtttagactagtcatagcatggatttatttattttaagcgagaaaatcaatctttaaaatgaccaacgtgctatagaactatagatactggaaagtgataaaaccccggtcacaatttcttgacctaacgcaccatatactctggctatagcttgttagttttaaaaagaaccatgtgaaaaatttgtgctctagtttcacttgtgcatacagaatagtaaattcaaagagaaatgaaccctttataatttggtagagtaattcaagaaagagaagaaataaagaaaagaaagaaatgtacctttattaggcacagttgatttctcataaagagttaattgtaggaagaaaggtaaaaggaagaacgattgcaattgatgccacaattgccttataaaccaaggtagacaaatttgaatttattagatgaacaactatgtgtttcatggacacacgatccatgatttgataaagcccaacacttatggggaatggtcatatgatttccatactctcataacagcacttctttattgttactgtgtgct

SEQ ID NO: 83195 - DNA, 42901 bp, Oryza sativa
  unsure (1)..(42901): unsure at all n locations
tcccttgctagagcaagagggccagcagttcccaagggctcagtctcttgggaacacgtgattgtgatgccaagcttatcctcaaagtccttcaggaaattgagcattacctaaaagacggatacagaacaaaccaattagaatgcgaagatagttatacttataccatgagacaacagtaaaatattatctcctttttacctccgggcggtagttgatggctaaaacaacttctgttactccaacttctttcaaggcctcaatctgcataaaccagaaaacttttaattcagagctcattactctcctcaatcctcatgctcatgtttgctggagccaacattttggatataaatgaagtactcttgataactgattggaattttcaaggacagaaaatttggtgtgataccaaaagagttctccaaaatcatgtaaccaaattgataaggaaagaaacagttgaatagtaaaaaggtgcattcaatcacatgcaaatgccacctatcatggatgtttagttgttacaccatgtttatgtgggggttataaacaaatcaaatagtattaatgttctttgaccagtttaacaccctctccctcctttcatggagaggccagtgtcagtgttggaatgttggtaaagaatactgtactaattaacttgtgcccaattcatcgattggcattgcaaattaagtgctcttattactccatcagagtactagcgaaaccacatattacctgatgcagaatcatgggcttgttcgcgaaatcaacaagaggctttgggaaactgagcgttaaaggccgaaggcgagtgccgaagcctccaaccagaatgagcgccttcatggtgaatcgcctcctgttcttccctccctaatccctactccggcggagggatcctcaagcaaggcttgggaaggggaacctgccattgcaacagacaaaatcaaatgtgaaactaggttggagcatcaataaaaaagaaagaaagatttcgatttgattgctcgcggtcgtggcaaagctccagtgagctgctttcgtaccaatagaagggatcagcctggaagatctctcttccttctccacgaccagccccattggaggtaggtagcacagctgcggtcgaaggaggagcctttgtgctgtgctagattgggaatcgagaattggatgggactttatagaggcgaagtggagaggcgacgcgaggaggggaagggggcccacagtagagatgcggttgtgtacttgtgtgtgtctcgctctcgcgaaagaaaattcgcgaccacaggtgacacgtgttccatcacaaatctcaaagcaaatcccatcatctccacaatcttgtgtttggtttatgggtaaggtatgatacgttaaactcatcaagttattggatatctatatatctatatagaaacgacggacgaagcggactaatggaagccttacgaatttttttattagatatagatatctatatacctaattaaaaaataagtaaggcttccggttaatcttttcgtccgtcattaagagtgggcccacacgataattcgtcgctaatccatgatccgaaagcgtggccacgatctcttacgcctgcaaataaaggagaaaagaaaaataaaaagagaaaaccttgtttgtggagcagcccatccaaagcagcccggattggattagtgacgaggcagcccacccaaagcagcagcaggccggcccagatagcagccgcagcccaccagcgagcccacagagcggaggagaagcagcccaccagcccagcacagtactgcacaacactgtagcaaccgaacacgaataaagtttggactcacgccaagcaggaatcggataataaaagaagcgattttattacttaaaacatgtagtcaccaatgtagtcaccaataaaatgaattatttaccgacaaaataaattattttttaaaataaaaataatcacatgtgtctttctttttttaaaaaaagaagtaatcaccaacaaaatgaatcgtgtttacatttggatttttttcccctcatcaattgctcattcgccataggacacctaatcacatcacttttttttccattcattatataatttcttctattatttagagtgaaagttattctgcgatataccacatttttttctttccttctaattatttaagtgaaaggttatgcaattggagtgcaatgaggttgatctgatagctagcaaaaaattatttcttgtattatggctactctttacaatatgaaaaaaatgcttatcaatatcgagtaccaaaaaaataacaaagtactgcaattgactcataataatacatgacaaaaaagtaaatattttttgtggtttcaaactttagtatccatgtcagtgcatttagagcagcaaataattatatcatgttagcgtcttatttgcactagaaagattcgattcgactataaagacctcaatttacctggtggttttatgctcccacacactaattactatttctgtcttcacccaatgcaacgcatgggcattttgctagtagatatagatatagatatagattagatatagatagatatctacctacctatattataattaataatataataaaaatataaatctatcatatacctacccctaattaaaaaattcagtccgcttcgtctgtcatctgtatgttttgagtccaagtcggtcttcaaggaaaaaaaaatccccgtgctagatacccaaattaatcaatcaaccaaaaacagcacgaaaataccaaatttaacctagatatcatgaatttgatcccaagaaatctaatcccccaattcgatccatctgagccaagacacaatacataaacgatagaaaatgaatcacgaaatcacaaatccaaaatcatccagggaaaattaactcacaaaaactaaatcagcgacgccactggtcatgggaggcgaggacgccgcttctacgaggagggtgccgccgccgaggctgtcgataccgtccgttgtgttgtggcggagaagagggtgaggacgccgccgaggagccagggggagggcaccgcggctgagacgccggctgccaagggaagggaagggcgccctgggtgagtggtaggggaagcgacgtcgtcggtggggggagagggagggcgcgctggctgaagggtaggggaagcggcgttgccggtgggggaggagggggccggagagagggactgagggagaggaattaacgcgccgcggagagaggagagaaggtggggaaggaaagagataataaggtcgatggggccaagcattgagacgccgctctcttctctagtctagtctcatcccaaacacttgatttcctctaaagcgacacatgtcccccctccttctctcctaccatgtggttcccaattctttatttttttttctcccggtgagatgcagggtttcccaaaccaccagagccggggttaccgtgccccggcggtaagcacggttaccacacggtaaccgtggtaactgtgaaaaaccgtacaaaaccgtgcaaaatttatcaaaaatttaaattattttttaaatttatttaaatttaaggaggttaccgcggtatttatattaccgtatccccgcggtaagcccggttaccggcggtaagggaaaccctggtgagatgttgagcttgggtcggaccatccacgcggtgttgagcgccattgagctcatagtggcagccgggaattggagtcaaggcatcaagctaagccctaccaactttttcttcaaacttccaacttttccatcacatcaaaactttcctacacacataaactttcaacttttttcttcaaactttcaattttaagttaaacttccaattttcgcatggaacacaccgtgctgccgtcctactgaatgaaagataaatcacgtgcatgcgttatctttttttttcgaacagtcagaccgttgccgacgttttatataaagaagaatgtgtctcattttaagaagaaaacgagacaaaaccttacaatgcgcagttaattaggaaaaactggacgaaaaccacaacactctaacataagctaccaacaccgcgaaaaaagaaagaatggcgaagcccaaaacagccatcgataaagagcttgttgaaagcgacacaaaggcttcgacttcgcgtggcaagtgttatcgttgccgagcttgtcacctagcgacacagcagcttcgactccacagctatcacatcatcgttaccaaaggcatcgcagaaaacgagcaagacaccgactgtccactttgaacatcaacccaagccacttgagcactactacttgtacacagctaacaccaacctccctcgaaaacttcaacgtgttatcgttgtcaagcttcatcgcaccccgataaagtagctccgacttcacctagaagaaaacggagaaagttggacacttgccacatccaagagcggcacccaagagacgaaggcctcgccgaatagctaggcttatagagcttcgacgtagggggtccacgaacgaccatccttgcatggaaaaggttcttggtagtgagggagacgccatagcaacgcctccaaggaggggaacgacgcctaatggcgccgccgtcgtcaagccaaccaaaggccagccaaggctttcgccagcgtcatccaaaaccacacaacccacccgcacaacgtatgacgccggaccgccacatcatccctctagccaccaagcctagcccaccacccacaacttaggcaggctcacgagtccaccgtgctgccaacccgctgccatcctctgctgcactgacccgatctggccaaggcggccgtggatccggccgtcaaagcttgacaagccaacgtcaccgcgagcgcctacactccgctgcaccgctgccaccgtcaccaccgcaaccgtcggtgggcgcagccagtggctgccactatctccgcgccgacgagagcctcccgcaaccgccggtggcgcgcccgccccctccgtcgcagcaccaggcccccgcctccgtcacacgcgctcgattccctccgtggccggcctcccgtagccatccccacgccggcgaggccacgccggcccccacctcgccttggcagctcgccgtcatcatccagacggcggatctggccaaggggcgccggaactggccgtccccatcatcgggccgagggtcaccgtcgttgcagccttcccgacacgtcgtcgacctccgcccagcgcgccgccggcctcctccatgcgcacaccgaccacctccgtgtggacaccagctgggacaccggatccgaccatgagaggcccagatctgtccccaccatcgtcgaagctagtcgccgatgaccaccacttggggtcctccctccgtcttggcagcgccccgagccgccgtgcctgcgagaggaggcaaggagtcccgccgccgccgtccatgcgcccgcccgactttgccagtggccgctcgggcggcggcgaggcggaggggaggaggagaagtggtcccgcccgtgccaccccgaggctgagcggcaggagggcttctcccctagggtacttgcctgcgttatcaattccaatctgcttcttgaactgcaatgcaaggagttgcctcatgatgaagttattcaatgattagattttgtatgccattgagtttagtttgtatagtgaatttcactaataatttttgctggtgactgaacttgactgagccttcaaggatttcttcgtgcagttgagccttcagggttataaataacgttgatgtttggacgattcttctcgataaacgtctcatgcgactatgcgagcatggatgctggtaagtttctctgctacattgagctcgactcctccgaggagagctaaagaatgggaaaccggagacgaagagatgagggggtaaacctgccctgagattttttcggatgagggtaggagtaggacttatatatcctacgtaatttccttccccgcatcaacgttcggatgggcgttagcatccataatttattatatataagtcaattctttttcgattttgctatatctcactcaaaagattttttcttatctctcactcgattttctcacttaaatttacagtgcattttcttgtaagttacagtgtaatttatgaaacttacactgtaacttttgtaagttacactataatttttgaatcttcgcatgtaaattttaaattttgtattggatttggtctttttcttgaggatatagtaatttagtgtccattatggtgtttcttaattgctttttactttttattatatctatcggattttaatccaaagattaaaaatctgtgtgatacgatcataaaaatctttcgaaagatgtataagtactcccattcttttttataaaaaccggtatatttgtcagtttttattaagaatcacatatatagagattcatagggatcggttttaacttttatctttcctaagagtaacatggattgaaaaatgttctataaatatcggtttcaaatgaatcggcacatatacgggtgcccttcattggtgtttctgtataatttaacatgtcaatgccattgtatatacatgcaccgcatataataaggatgggaaaatgtcacgcccagaaattcactagtaatttccgaactaatttgtgcataaaatcctcgtccagaaatcagccgagacacacaaactgataatttaatatacagaatcatcataataataacgttacatacttataaaagaaaagagaaaacaacaacggaattacggtctagcgaagctccggctccactccctcttctccttcgcaacttgtcttcaactgagatttgattgattattgcaaggtgagcatatgacatattcagcaagccacacagcaaatatgcaagcgcacaaggataccaaaggatggcataatatagagctcatttgcaaaagcagcatttagcaaacagttaagaattgtaaaacagtagagtaattaatcatcaattgctcaggcccaaccatcctgaacaaccatacccggctgtaccgatctatctccaaaccaggaatgtaccattccaaaccaggagctaatcaaattattaccagttataggatcagttattatggtgagaagtgtgagactaatcacgaaagatattgttagactcgcccatgaccgcgggcacggctattcgaatagttttactctggccagaggtgtaccactgtacccacaaaacacagccccacaacatatcaccatgcgcctcgataccaccacgataccttggaaaggagctgtgacagtatcccttgcacaacacaatccaccacagcgcatcgttcctggatcataatcaccccattataaaacaaggcatggactccccagcgactcccgtgggcttatctccgccacttctcagtctggtgccccgcaatgaaccatgctatacaaaaggtaaagccgttgcccatgctggcttgtggttggcacggttaatgtttcataaccgaaactcgtgaaccggtccttaattgtcatgagcacgaccatcaaaaccatgtgctcacaacccaccattatcaagttttagttggcaagtaattaattaaccactcacgattgaccatcgtgagcttccattaaatatccaaaagtgatagtgaagcatgatttatcccattagtgagctattgtttctaagcatggctaagaatctattataagcatctagctgaaccaaaccaatatataaggttctagctaattaaattataacccatagaaaaataaagtcatcttcggccataattaaataggaaaggctcaccacccggtgacattcgaaaataaatgcacagttgaaataaatagagaatttaaatataggatcaacatgctcaaaggaattgtgtttgggatctatatgacttgctttgcaataatcggtcttcaattaatcttcttgaatactcccggcacacacgcgaaccttcgaaacgacggaaacgacaagctaacacgcaaaacaaggaggaagactaataaaaaccaaataaacaatacataaaagtaaacaaacatgtagatcataattttagataaatttagagacttgaatagcctcattccgacttcatatgaattagttatgaattttacaagatttaactccaattaaatctattaaagaaaagactattccaaattaattaaacaatttacaaatgatttataactgagataaaatattaaaacaacctccggaaaaagattagaatatatttagtggatgacatatattaaaaaggaataatatgttactgaaaagaggaaacggatttatattgattttggacggctgagattaatcttgacctagtcgaccaatatcggaatgcttggattgatctggcaagcgggcctcacgagataccgactcaacgagtcaattctacgtgacacgggatcacccaaatgatcaaccgaaactggcgaacggaaccggcggctctgaacagctctaaactaaaggacgactccacacggatgaacgaacgaaacacggggaacacctcgttcgaatgaacgagcgaacgactcaacaacggctgcgactagaccgatggctagacacgattcacggtaaaagcattggtacggcaaacgataggccgataggaacctagggttacacctacggctagacaactcgattaccaagcaatgggctaaagtggcggctaggtttaagcgacacatagctgcgacatgacacaacaacgacaacacggcatgcacaacagcagcagcatggctgaggcagggagtggcacggcggcggctaggcggctagcggcacagcgatacgacaagcggtgtgcacggcagcggcacaccagcggctaaacagcgacgtggcggcaacaaggcgacggcggcagcggcggtgcatagagcagccggcaagcgacgcgacagtggctgcgctagggttagagcaacaacggcttggacagtggcggcgacacgaccgagggattgaaacctaacccgaggggatacagatagaagtcgcaccgaacccaaacgttcggagagggagagatgacgacggcgacccggcggcaacacacggagacgacgacgctatacagacaatggactaggttagattggattaaggccctagagaaaacctgcaccgatgaacagcatgggagcggcggttggcggcgaaccacgacacaataaagcaaacggagggcaccagaaggtagagaaggcgacggcgattcttacttacacttacacgatgacagacggcgacggaagatggccggcgatgagcttgaaaaggcggcgaggtactgatcaacggtagcggtggctttccggcgatccacggcgaagaagaggtggtggacggtgttctcctcgcagctgcgaatccaatggaggtgacggcgaagcttggcgacgacggaaggagcagcagggcctcgccggagatcaaaacgcgacggcgagcttcgggttgacggcgacgatggagctccggtggattttggcttcggggaagtggaggccggtcttgttcttgccgctgcggtgccgaaggaagtggcggcgctggacgaaggcgaccagggaagacggcaacggcggctgaaacggcggccggcggcggagagagaaggagcgcgcggggagagcgattccggcgactacggagagagggagagatggcggtcgaaagaggggagggagggtgcactatatatagccatgggaacccggaatcgagcccacatcgacgggaaaaactcgggaaagtttaggattctcgccggtaaaaggaaagattgattcgcgaaattggaaaggatttccatagaaacatttggggatttcttggggaaattgaagaggagattgagaggattccattcccgcaactaatttggaaaaaggagcaacggggaggccggattggaggaggagatcggcacggctgcacaggctcggcctctgtccagaggttgaagaaggtactgtatcggagggaggcaaattagacttttgttctgggcttccttttccttggcacgattgaaggagggatgcaaaatggacttcgggaatggataaggccggccgaaaagaagcaagaatgggccgataactgaaggtgaacttttcctgtttcggcccgaaaaggaaaaggggattttaattacttttcccaattaaattaatcagtgaaatgatctttcattgttaaaaatacttccaatgctcaaataattccaagaaaaatcttgaacatacttggacactctaattatttaacaatattaaaaacatatcatttaatgattaattttttaattaaataattgctgaactgttctttgtattattaaaattaggaattgagctctgaaaaatccgagaaaatttcagagagtataattaatcatggagaatttaatacaaattaaatccagccatgctttatgtttaggaaattttatttcccacatttaacttcacttgtaaattaatgaacttttaatataaattctattaataatttattgaataaattataaatcctgaaacgaaaaatcaggctgtgacagtaaattttagattagactcatcaattatccgaattcaacacctcaaccaactattcggtacacgcatcagcgaaacatggatcataagacttgaagcccatcaagtgtacaaagaaattaattgggcaagcgttctgttcatcaaggctattggaaccgacaatccgtggagaattttaaatttttgagtcaatttagtgattattgattccctgtaatctctagaaaaaaaacttaattgttttatttattttctaagtttggtcaatgcgtgtgtaaaaaaatgttggtagtgacttatgctccatcccgcatcgattagtttctgttcttatttcttttatacattcggctatgatacttaaaattttggattcgttttttagtgtcggtgcatattgtatgttgtgagttgtgattcggggatggggattaatttgcatttggggcagcagggagtaactcggaggattttttttttatcgtgtgtgcctcaaaggtgcaccgccgctgtgctaggagatgccgagagggaaagggaggaggaaggcgctgacaacgaggctgaggtggcgcggccgcgtggtggtggctggtggcggtggccggtggcgggaggcggatgcggcatgggtagcggtggtggtgattcccaaccatagtactagaaataggaatcggttgaaaggcttccgtgcgcgtgaggtttctacctgcgacggacgaaaaaattcatctagaagccttgcatattttttaatttttatatttactagaaaaatgtccatgccttgctatggaaaactacactttcatgatccaagcgttttaagagaatattcttcacggtgcacgcgaatacaatcttttgtcaagttctagataagaggtaattttttttcaaaacaaactatttcacattacaccagataaattattctatttgtacaagactgaaacacaaaataattgaaatccgatctcgacacggacttcgtgtcgcacatgaacatgatctaaaaagttacaactttaatgtacaagtctcaacattcgtacctatgagattggccagatcacaactcgcggtgggcttggcgtagaggtaccttgatgagcaccacgcacgctcctgtaactcatccacttcccccaccctatcagctccacgctgaggcagccccaccctcagccgcaggctcacagcagcaccccccgtcacctcccgccccctctcccccacctcctccagccgcggccgcagttgcctctctgccccaccgcgaagctgacaggtgaagaagaggaggaagccctctcggccatcaccggccctggtgccaacagctaggtgaccgcggaggagtggccacggtgggcacctcctcgcctctctcggccacgatggccgccgtcgtccgtgagcttgtcgagaggaggaggtgtgcgcggacggagaggacactactggagaagtgatctttgccaggatgggcaaaaaccacaattgtcccggttcacccaaaaactgggactaaaaattatttttagtcccggtttataagtgcaacaggaagatatgatctttagtctcggttggtaacacaaaccgggactaaatgtcatctttagtcccggttgtaaatgcgtcaggggttgtcaggcgccaggggatcttttgtcccggttggtgttacaaaccaggactaaagatgagagctttagtctcgatttatgttacaaaccgggactaaagatcatggtgatttttagacccggttggtaacaccatccgggactaaagatcccatccatatatagtcttcttcttcctctagctagcccgagaaggctgttggtatttcttaacgatattattagaaatataactccgagcaatggcgcagaaatacttctggtatattatggttacagagttcattcgcaagcgcacggatataccattatagcatttcacccgagagtattccaagggtatctgtcgacgtttgatgtcgcgattccggtatttgcatagtatggggatcataggtactaggatatatgcgagattgaggtaaaagagatggggatgaggatttttatacaggttcgggcctctgaattgtcaggtaataaccctactcctgttggccgatgccggtcattgctcttattcaccataatcacaccagtacaatatttgggggtagcctatctatttgttgtcgacgtgatggcttgaagtatcatcacgtagtcgacaacagggtagtcttcctcctcgaatccgtgcccggcgagatcagagatagtgctagatccctcctgacggtagtcgtaagtaccatacgagggtcctcctagacaaatctctaacatagatatccggcgtcttgtcttggcgtatgttggcttgtatattgatctatcgttcccctctcccctttcctcatagggggccttgtatttatacccataggtgtcccattgtccaaatagaactagggaaaccaatatggatacaatccgagtagtccttgtcgtttctatgtagaactatattcatccttccttatgcggaactcctcctatatccgaagattgtttctgtataagacatggtatgtggtgggtcctgctgagatttagtgaactactattaggtatgtggtatccaaaaccctgacagtattgtatttatttaatcccgtgggaagatcatagtagagagaaccggactaataatttatatgttacttgaaataatcagagtctaagcagaggttaagataatccaagggtagagtgacacacaaggagggagctactcattctcatactaaaatatctaagctaagtggaaagaaaatagaaagagaatctattcctatacttctagtatacatagtatacatacattctagttataagattaactagctaatactctctatccgatgccctcttggtacttcgagaagccacccctgactgccgagttcctcacggcagcccgtcatgaccatacaaccagggctaaatacgaaggagtaccctccccaggaaattaacttaggactatatacacgcgcggaggaatacccgtgctgagctgtcaccatcagcggcccacttctcatccgcagcatataatccaaataatgatatcccgtaatctagacactacgcctaaactaccagatactactctaatatcatcgtcatgacatagagtaattgcataagcaaacgctatacccgtactgatgcatctcccagataagctagcagtataatcagtataacatgaacataatgcaaagttggcattcatatacttggaaagtatttcaataccataaatgtataaagaagagtattctaataaaagcaaaaagcttacaaaagagaagaggagatctactagagccatacctgaactcttccgaaggcttccggactccgatttctactctattcctactccactagcttcagaacactaaactaaacttgagagaatatgagagagctttgcttgagatgtgtgagtgaaatgagaaggtgaagtccttaaataggcaggtatgacggttgtaactgctgtgaaatgtctgaaataccctgcaaccgtcatcaggagaagatctagagcgtccctgccaaaccccacatccaacggtggaggtgggtctggttcggccgaaccaggggccggcccaaccagcccacaatttggctggtggccttctggacttctcttctccgaagacttgtgaattttggcccaattgatcgtgtcatttctgagttcttaagccatttatatataagtctgattttcgacatcgtccgattgattaatcgtcttatttgatgtcgattctcctctactttatagttattcactgcaaaaggttagtgatccaaatactagtggaatattattattctaacagaaatatgcattgcaagcataactagttctcttctattttggtaatattgacggtcgaaactgatcgctaacgaccgtcaacgaaggcttcaaaattttcttgagtttgaggggatgtgctgccaaattttttggtgattttgttttggtgataatatacaacttggaggtgtcaaaaaggttagcaacttcatcctcctctattttgtggttagcatttgcatttagagatatgttttgtacactattttgcctctataaatttggaatgggagatgatgagagagaaagtttgtgtagagatggaataatatagaaatttttttatttagaatttgagaaaaaacttgtgataaaagagatgagaaagaaaaagatagaaaattaatctaaaagaatataaaactaagttaatttaaattaaattaagtacaacacattaaatagtttacaactttattgtggaattgaaacatgaataatttgtggtattattttataattattgtttgaataattatatataactattgtatgattgtttaattggttagaaaactaagttaatttaaaattaaaataattacaacacattaaatatttgtttacaacttcaaatataattaaaacatgaataatatgtggtattattttataatcaaatttgtttatttagaatttgaaaaaaaaaacttgtgataaaagtgatgagaaagaaaaagatagaaaattaatctaaaagaatagaaaactaagttaatttaaattaaattaagtacaacacattaaacatgaataatttgtggtattattttataattattgtttgaataattatatataactattgtatgattgtttaattagtttggctttagtgaattatttttctcgatttttgtgctttttgtgtagatggatcggcaatggatgtgcgcagaccgacggtcgaaagagtttattgatggcgtgcataattttctgagagtggccgaagctaacaagcagaataatggttttatccgttctccatgcactaagtgcaaaaaccagagggagtattttgcagtaagaactactcatattctcttgtttgagatgggcttcatgccaagctataatgtttgggcctcgcatggggagcaaggtgatcaaatggaagaagatgaagtagaagacgagaacattccggactgagctcaatatggtagatttgaaggaaatacaacgggtgaggtggaaagggctgttgaagataatgacgctgcaaatgatcgtggtcagatgttgcaggatgtcaaggaggactgcgaaagtgaaaaggaggctcagaaattagagcgtatgttagcggatcacaagacgtcattgtaaccaggttgcgaacaggggcacaaaaagttgggtacaactctggaatttttgcaatggaaggccgaaaatggtgtctgccacaaggcattcggcaacgtattaaaactagtgaagaacattcttccggaggaaaacaagttgcccgaaacaacatacgaaggtaagaagatagtctgccctctaggactggaggtgcagaagatacacgcatgtccgaatgattgtatcctctatcgtggtgagaagtacgagaacctagaagcatacccggtctgtaatgcactacgatacaagattagaagagacaatccaggtgaagttgacagacagccttcgaagaggagagttgctgctaaggtgatgtggtatttccttataataccatggctcagatgtttgttcaggaacaaagagcatgaaagaatgatgcgatggcacgcagaagaacgtcaacaagacgggatgctgagacaccccgctgatgggtcacagtggcgaaacatcgatagaaagtttaaagactttggaaaggatgcacgaaacgtaagattcggtttaagtacggatgacatgaatccatttggagagatgagcagtggccataccacttggactgttacgatgtgtatctacaacctccccccttggctatgcatgaagaggaaatacatcatgatgccgattatttttcaagtcccaaagcaacccggtaacaatattgatgtgtacctaagaccactggtcaaagatctgaaactgttgtggaaaaaagaaggcgtccctatgtgggatgaggacaaacaggaggaatttaacctacgagcgttgttgttcgtaaccatcaacgattggtttgcccttagcaacctatccgaacagtcaaacaatgggtacaaggcttccattgtttggaagaaactgaaagtacgtatctgaagcattgtaaaaaggttgtgtacatgggccatcgtcgatttcttgttgtgacccaacctgtcctcaagaaaggcaagcatttcgaacagaaggcggactaccgtaagaagcctatatttcgcaacggtaaatacgtgttcgatatggtgaaagatctcaaagtagtgtttggaaagggacctggcagccaacccatagccagcgaagatggtcacgcggcgatgtagaagaagaagtctattttttgggagttaccctcttggacgtccgccatgcaatcgatgtgatgcacctcactaagaacttctgcgtcaacttgctgggcttcctaggtgtatacgggaagtcgaaagatacacttgaagcacacaatgatctctaagatatgagtcaacgcgaggacctctacatggaaccaaaggagaaaggaagccagtacttgagcccaaccagctacactctaagcaaggcagagaaggaaagtatgtttgaatgcttggagagtcgtctgggtactcctctaatataaatagaataataagtatgaaggataagaagtttacaaacctaaagtctcatgactgtcacgtgttgatgacacaactgcttcatgttataattcgaggtattctccctgacaatgcccgggcaacaataacaaagctatgtgtttcatgaacgcaatttcacagaaggtcatcaatccagacaaattagaagcccttcaaaatgatgtggtgcaatgccttgtcagctttgagttgatctttccacctttcttcttcaacataatgacgcatcttccaagtcacattgtgaaagagatcagtattctccggctctcgggcctgtgtacctacccaacatgtttcctttcgagaggtacatgggtattctaaagaagtatgttcgtaaccattcttatccggaaacaagcatagccaaggggtatggaacagaggaggtcattgagtttttcttagaatttattgaagaccttcgtccaatcggggtggcagaaatcacgacatgaagggaggctacggggaaaggggactcttggaaggaaagcaattatgactgtagatgtcacatcctgatttttgtttcaggatttataaattatttaataaattattattagaatttatattaaatgttcattaatttacaagtgaagttaaatgtgggaaataaaatttcctaaatataaagcatggatggatttaattttttattaaattctccatggttaattatactctctggaatattctcggatttttcggagctcaattcctaatttttaatcttacaaagagcatttcggtaattacccacatattaaattaatcattaaatggtctaattataattttgttaagtactttgagtgtccaagtatgttcaagatttttcttggaattatttgagcattggaagtatttttaacaattcaaagatcatttcattgattaatttaattggaaaaagtaataaaaatcctcctcctcagcttgggccgaatccagcccattccctcctttcccctctcccttcctctcagccaggccgaaagtctgttttgcctccctggcgctacagtactccatcttcctcctccagccgactgtctcccgtgccgtgcacagtgccgccgattcccttccaaaatccgacctccccgttgctcctatttccaaattggttgcgggaatggaatcctatcaatctcctcttccttttccctaagaaatcctcaaaattttctatggaaattctttccaatttcgcggatcaaatccttccttttccggcgagaaccctaaactttcccgagtttttcccgtcgatttgggcccggacccgagctcccatggctatataaaggacccccctagtcctcctctttcgtttgccccatctcccgagctttcccgtgcctcgtagctgccgcgccgccgccgtttagctcgccgttgccgccggctgactccatccgcgccgcgccgtcgcctccgtcgtcgccgccggtcgccgccaccactgttaggtgcgcgagagcgaggagaagcctggccgctccctccccgctatcgccggtcaccggagctccgccgccaccgccgaccgagccgccgccgccacccacttcgtcgccggccgtcgtcgttcgtcgtttggttcgagggtgagtaccgttgggttcgtctcgtcgtcctctacgtgtgcatgccttccaaatccgcagccggccgctctagctcccgcaagcttgccatccgagccggccaccattgatgaggtcatcgctgacgtcatcatcgtttttttctttttcctgtttttctaatagattaaatcttcggaaattcataactaaatcatcgtaactcggttttgagtggttcaggttgctaaattcatctaaaatcatgatctacatgttggtttactttttatgtattgtttatttggtttttattagtctttttctttgttttgcgtgttagcttgtcgtttccgtcgttgcgaaggttcgtgagtgcgccggaagtattcaagaagattaattgaagaccgattattgcaaggcaagtcacacagatgctaaacacaatcctttgagcatgttgatcctatatttaaattttctatttatttcaactgtacatttattttcgaatgtcaccgggtggtgtgaacctattcctttgttatggcctgtttgcattgattactctattccttgataccttgggatattataatttgactagttgagctttatatatattggttcaactagatattagatatgattgcttagccatgcttagaaacattagcacactattgggattacttatgactcattattatttaatgatggcttaatgatagttcacgatggtcaatcgtgattggttaattaattacttgccaactaaaacttgataatggtgggttgtgagcacatggttttgagagtcgtgctcatgacaattaaggaccggttcgcgagctactattgtgaaacattaatcatgccaaccacaagccagcgtgggcaacggctttacctttcgtatagcatggttcattgcagagcaccagactgagaagtggcggagataagcccacgggggttgctggggagtccatgcctctggtttttgagggggtgattatgatccaggaaaggtgcactgtggtgggttgtgttatgcgaggggtaatgtcacagctcctttccgaggtaccgtggtggtactgaggcacatggtgacatgttgtggggctgtgtcttgtgggtacagtggtacacctctggccagagtaaaactattcgaatagccgtgcccgcggttatgggcgggttgagcaatgtttttcgtgattagtctcacacctctcacaataattatggatgttatactggtaataatttgtttagctcctggtttggagttaaatctgtacagccgggtatggttgttcaggatggttgggcctgtgcagcatgggtgtgctgttcagtgttgattaaaatttctgattaactactccactgttttatttctcttaaatgttttgctaaatgctgcttttgcaaatgagcctatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttattttccgctgcagttttcttcatggtgaggactaagtgcctcttaagtaagtatatatcggtttagttattatgatggatttgtatattaaattgtcagtttgtgtacctcggttgattcctggacgaggattttatgcacaaataagtttggaaattactagtgaatttccgggcgtgacagtagacaacgatttattctgtaaagcacatttcacggttttgcaacaatcttcgttggtggctccttacatcgaggagcacatggcgattattcggtccaaaaacatcgttaagtccgatgcctggattgcacgacatcacattgatactttcccagcgtggctacgacaacatctcatagctaacgacgattaaccaacagcttgccttcttggagaggggaccatctggctcacgacatggcaaggatatgagatcaatgggtatatattttacataatagcccaagacagcaagagcacgaaccagaacagtgttgttcgtatcgatgccattagacagaatggcccaaccagcacgtattacggtgccatcgacgacatatgggaacttaactattgacctctgaaggtccctctgttccggtgccaatgggttaggctgactggtggaggcataacgatcgatgatagtgggatgacaacggttgaccttactaaggttggatactccgacgaaccattcgtcctagccaatgatgtaacgcaagttttctacattgaaggacatgactagcaaagcaaagaaggggaaagggcccaacgagtctaagcgccacgtggttctccctggcaaaaggaaaatcgtcggagtcgatgataagactgacgaagattacaatcagttcgacgggcaacttccgttcgcggtgacagttgacctgagcatcctcctatcaaatgaagacaccccttactcacgagctgatcataaggaggaaacattagtgaggagaaagtacgtgaggaaaaccgatgtattagcctagactgttgtatggatgatgtaaatttgttttaaaatgtattgaagattcatctctttctattgttgtatggcgatatctgattattagaatttaaaacaattttaaatcgaggatatggtaattatatatgattattagattttaaaccaattttaagttggggatagaataattatatatgatcattagaatttaaatcaatttaaaatcgatgatatgataattaatagagaaaagagagagcaagcgggcgacaaatctgtcgccgactacacgcaggctcctaggcacccaaattaactgcatccctgttgaagcaaaacaaagaacactgagggagagaggaaaggcaccatgcggtaaaaaaatagtaaaatttcttaatcttgtttaacgtgccaatagcctgttactgtattctctagctactaattaatttgctttacatgacgtggcacacttatatcgctagcagctggcttgtacacaaaaccaagaaaatatatgaaagagacaagtcggccatgtattaattataaagagctagctattatatgggtagtctaagagaaagctacaaagaatctttcaaccgacaaacatgctatattattagagtaagtttaatagtatatccaactactaacttcaattcatctataatcaatataatagcttattctacctataagcatatactacaccattaatatatagtcacacctttcatatacacatattgtattggagttcgtgcttcaggtagctacaacgcttttcttctctctcttctttccttctctttcttctcttctcttctctacgtgtgcttacagctgacctgtatcttgctattgtactctcttctagccttgctctcaattgctcgactactgcagggatcttgtacatgctttcctccgttcttttttgggcttgtttagttagggaaatggaaatttgtaggtgtcacatcggatgtttgaccgaatatcggaaggggtttttggatacgaatgaaaaaactaatttcagaactcgtcggaaaaccgcgagacgaatattttgatcctaattaatccgtcattagcacatatgggttactgtagcacttatggctaatcacggactaattaggctcaaaagatacgtctcgcgatttccccctataattgtgcaattagtttttatttttatctatatttaatactccatgcatgtgtctaaagattcgatgtgatgttgttgggaaaagttttggggaactaaggccctgtttaattcgcgaaatgaaaatcttttgatatcacatggacatttgaccggatgttggaagaggttttcggacaagaataaaaaaactaatttcataactcgcctggaaaccgcaagacgaatcttttgagactaattaaaccgtcattagtatatgtaggttactgtagcacttatgacaaattatggactaattaggatcaaaagattcgtctcgcgatttctcccataactgtgcaattagtttttatttttatctatatttaatgttctatgcatgtatcgatgtgatgtttttagaaaaatattttgaaaactaaacaaggcctttagagcagatacaatagcaggctataaaccagctgcaaacatattttaagaagataaataaggagagagaagagcagcgggctacagatttttagccagctgtagcacggactccaagacatactgtgtgtatgataagtaggaccatgtattaatagggtagtatgtaactattgtatgaataagctattaggttggttatagatgaattggagctagtagttggctatactattaaacttgctcttactgaacacctctgctcctcatcaacgatcagccagttgtgcttgtatggtcgttgcgtcaaacagtagttgcgtgaatccgattcgatatcgacaacgctgctgcacatacggcgggaaagcttcgggcttggaactggaaaagtgctcggtcggctcggtacgcttgctcaaggaacagatgatccacaccgtccagtttcaagattagaacggcaaagccagtatcggcggcgaagcccaagctcccgaaacaagtctgcatggggatgaaggtaatgtgctgatgttgagattataggcatataatgatttaatatattccataaataaatcatgacattgcagatgtatactagcattaacgcatcattagatctacacatgtaaactaagcagtaaaacatgaacagattaaatatgcataacacattgaacacgtgccgagattgcggaacaaccggttgctcaacaggaatcactcgcggttgcggacgtcgacgaaggcgcgcagcacgcgtgcgaaaaggaagacgagccgtcgcgaacgaacagagagcagtcgcgcaaagcgcttcccaaaaaccttattaccgccttctcccggtgcaggatgtcgaaggcagaggttccgaagacctgctctcccgatcgccagtgcacgccggcgagcgggatggagtagtctacgagcgatggcgcagcacagagtaggaggcaaaccctagattgatttcgcgtgtgttgcgtgaaggcggcggctcagtttatatagagataggtcgcttgatcagggcgcccacacgatctccactccgcgtaaccgaacaaaactgcaaaaggaggctgcatctgcgcaagagtgaggagccaattttgcggaccattaccttattaccgccttctcccggtgcaggatgtcgaaggcagaggttctgaagacctgctctcccgatcgccggtgcactccggtgagcgggatggagtattctacaagcgatggcgcagcacgcagcacagagtaggaggcaaaccctagattgatttcgcatgtgttgcgtgaaggcggcagctcggtttatatagagataggtcgcttgatcagggcgcccacacgatctccactccccgtaaccgaacaaaactgcaaaaggagcctgcatctgcacaagggtgaggagccaatttcgcgcctgccctgccaggcgaggcgaggcgagcgagagtgcgcgtgtgttccccctcttctctccaccacatgcttcaagtggctaggagggcatcctcccttttaaggaggtccccctctccaagaataaacaaggtggtactaaactccccatgcatgccatcccatgaggtgggcttttgtgattttccaaagaattaatcttcgagtgggccttagcccatccattaattccaataatcccccaccaaatctcaaaatcccactgagatttgccttttccaatgtactgtttatataccagcggttcgatgaagaccgattaaggttgaacatccacctagaactaaagctacacttactcacaacttgaacaatggactacgtcttgaattgcaagtcttgtgcaagcaagtttcacttagagtcttatctggtactagaccgtctgtagactacccctcgggtggagcgtataagacatactcctaggtctttagtaagcttcctagaagattcacccaaaatctccatagactgcgaccaatagtcaagctcacaaaggtgagttctttcaagaatgctctgcaggacaatatcttcgctagttaaagccaacagaactcattaaggtatagccaacctgccttgcagctcacgagagtacacgcatcttcacttagagagggtatagattggtactctcctctagtttactaatgtttgttcttcccaggttttaattcacgggatttccgatcacatagattgggttaccaccataatataactcacatgggtctcaaacccatctcctttgatgcattgtctatcacattttgtgatagtcccttcgtgaagggatttgccaggtttctggctgtttggatgtaatccaacgttataactccggagtttctcaatttccggatagacttcaatcgtcttttcacatgtctagatgatttcatattatcctcagaacaattcactttgacaattatcgtttgattgtcacagttcataaggatagtcggcaccagtttttcaacaataggcagatccattagtagatcacgcagccattctgcctcaacagtagcagtatccagtgccgtcatctctgcttctatggttgacctcgtcaaaatggtctgtttgcaagacctccacgaaacagcaccaccacctagtgtgaagacatatccactagtggctttgatctgatccagttagaatcactatattcctccagtaccgcaggatactcagtatagtgaagctccaatttcatagtacctttcagatagtgcattactcgctcaagcgcacgccagtgatcatttcccggattagaggtaaaccgactcaacttgctcacagcaaaggagatatcaggcctagttgcactagccaggtacataagcgagctaatgatttgggagtattccagttgattcctagcaattctcttgttcttgcgaagcaacaagctaggatcataaggtgttggagaaggcttactatcaatgtagcccaagcgattcaagatcttctccacataatgggactgcaagagtgtaatctcattcttacctctaattagcttaatgtttaggataacatcagctactcccaaatccttcatatcaaaattttgagacaagaatgatttaacctcatttatcacctcaaggtttgtcccaaatatcagtatgtcatcgacatacaagcacagaataactccctcacccccatggcgatagtacacacatttatctgcctcattgactgcgaagccggcagatgtcaatgttctatcaaatttctcatgccattgcttaggagcttgtttcagaccatacaaagacttcaacaatttgcacaccttgccatcttgaccttcaattacaaacccatcaggctgatccatatagatctcctcatctagttctccattaagaaaagttgtcttaacgtccatttgatgaacgagaagaccatgtgaggctgctagggaaagtagcacacgaattgtggtcaatctggcaacgggtgagtaagtgtcaaagaaatcttcgttttctttctgagtatagcccttagcaacaagccgagccttgtacttttcaatggtaccatcaggcctaagcttctttttgaacacccacttgcatccctcaggtttacatccatagagatgctctatcaactcccaagtcccgttagcgataatggaatccattttactaccgacagcgtccttccagtagtctgcatcaggagatgcatatgcttctgaaattaacttaggagtgtcatccacgaggtacacagtgaaatcatcaccaaaagacttagccgtcctttgtctcttactccttcgaggagcttcattgccatcctcctcagtgacatgttcatgtgtatgttcaatttgttctggtggtgtgattaaactgggaattattttagagggttggttagaactactatgtgtattctttattgggaaaaagctctcaaagaaggtaacatcacgagactacatagttataccaacatgcatatcaggtaccacatttttaactattaaaaatctataggcaacgctgtgatgaacatatcccagaaagacacagtccacagtcttaggcccaagtttgcgcttcttcattattagtacattgactttcgccaagcacccccatgtgcgcaagtaagaaagtgatggttttctcccaatccatatctcatatagtgttttgtccttatttctgttaggaactctatttaacacatgattcgaagtcaacaatgcctccccccaccatgccttaggtagtcccgcggtgtccaacatggtattcaccaagtcagtcagtgtacggttcttcctttcggcaatcccattagactcaggagaatagggaggcgtcctctcatgtataatgccatgttcctcacagaataagtcaaactcatttgagaaaaactctccaccacgatcagacctaagtctttttatctttttgttaagttgattttcaacttctaccttataaattttaaaatagtctaaagcctcgtctttcgttttcaacaaatacacatagcaaaatctagtagcatcatcaatcaacgacatgaaatatcgttttccacccttcatcaacaccccattcatttcacagagatctgaatgtaggagttctagaggtgccaagtttctctcctcagcagccttgtgaggcctgcgagattactttgattgcacacaactatggcacttagaacctttgacaatggaaaacttagaaattaaacacatgctataaagccgagacatcaagctaaaattaatatgacataaatgtgaatgccaaacattagcctcatcatccacactgccacaaatatggttcacagacttattgtagaaatcagaaagggaaaagcggaacaggcctccgcactcataacctttaccaataaaatattcatgtttagacacgaccactttattagactcaaaaaccaacttaaatccgtctctagtcagacgggagccactagcaagattcctgtcgatagtagggacatactgcacgttcttcagctgcacaatcttccccgaagtaaactttagatctgccgtgccaacaccatgaacagaagcatgtgacctattccccattaggacggtggaaccccgtgcgacctgataagaagaaaacaatgagatgtcagcacaaacatgtacattggcccttgcatcaacccaccaattagtagactgattaactgaaaaaacagtaggtaaattaccatacccgcttccatctctagtgttgccaatggtcacattagcaggcttggaagtctgccctgcaggtgccttcatccccttgcgttgtggacacttcctagccagatgactaggttggccacacacaaagcaagtcctctcatcctaattaggattgttgttgttgttcttcttcttgaagttggtggtctgctgagctttgtattaacctttgctcttgttccgggccttgtgcacgacattggcgctggactgcccaccatcgcccttagacgcggagtctttttcccgagctttctcctcaacatcaagagacgctatcaacccctcaacgaagtattcctgtctcttgtgtttgagtgcagtactgaaacctctccaagatggaggaagtttcgcaataatgcacccggccaaaaatttgtcgggtaagacaacttaaggagttcgagttccttagccatggtctgtatttcatgagcctgctcaactacaaaacggttgttagccatcttgtagtcatgaaactgctgcatgatgtacagatcattgctagcatcagtagcaccgaatttagtattcagtgcatcccacaactccttagcgtcggtcatatgcatatacaccttgaccagacgatcaccaagcacgctaaaaatgcatcccacaaagagagtagtggcctcatcaaattctttctgctggtcaacattaagaactcccatagccttgccagtactcacccagaagcatttcatagctatcagccacagagtgaccctgatctgccatctcttaaaatgcacaccggtgaatttatccggcctcagtgcattggcaaaaccagccatagtaaaatcacagtgcctataataaggtttttggattgttgagattataggcatataatgatttaatatattccataaataaagcatgacatttcagatgtatactagcattaacccatcattagatctacacatgtaaactaagcagtaaaacatgaacagattaaatatgcgcaacatattgaacacgtaccgaggtttcggaacaaccggttgctcggcaggaatcacttgcggttgcggacgtcgacgaaggcgcgcagcacgcgagcgaagaggaagacgagccgtcgcaaacgaacagagagcagtcgcgcaaagcgcttcccaaaaaccatattatcgccttctcccggtgcaggacgtcgaaggcagaggttccagagacctgctctctcgatcgccggtgcaagccggcgagtgggatggagtagtctacgagcgacagtgcggcacggagtaggaggcaaaccctagattgatttcgcgtgtgttgcgtgaaggcggcggctcagtttatatagagataggtcgcttgatcagggcgcccacacgatctccactccgcgtaaccgaaccggatatgtcgcgcgtaacttatccggactccacgccattttcacgcatcggatttttcggaatgtttccaaaacaaaacaaatccgaatttcccgcggcaaaacaaaactgcaaatggaggctacagctgcacaagggtgaggagctaatcttgcagaccattcgacacgtacgtcatgcacgcccgcccctgccctgccaggccaggcgagcgagcgcgcgtgtgttccccctcttctctccaccacacatgcttcaaatggctaggagggcatcctcccttttaaggaggtccccctctcctagaataagcaaggtggtactaaactccccatgcatgtcatcccatgaggtaggcttttgtgattttccaaagaattaatcttcgagtgggccttagcccatccattaattcaaacagctggtagctccagtaattgaatctgaaactcgcctggttaaattgtatctctcctaattggtttggatccgagtcagagagcaagagcttgtcgaagttgtcggtgacgaagaagtcgaaattcccgaagcgaagacgaagacggtgacttatgaagttgatttcatcgcacttgtcaataggtaactcgatacatccctacctggcgcactaattgtcgaaacaagattttggcaatatgaaaaggggtagcgtacgagacctaaaagtggatagatgcggagataaggaagataggttcagtccctctcaatgagaggtaatacccaactcctgtttggggatagtgtatattgatctgacgttctagttgagaatctctacaccctagagggcctcctacccaccttttattgtatgggagcaggttacaagacagaaacattaaccaatacggcatctgtcggtgatatgagcccgggggtatcatgtttagagggaggaggccgcccccaaacccacatggcgtcccctgaggagggtggcgcatgagtggagtggcggccgccccctcccagcttacggtactgagtttggagggaggaagctgccccagacccacgtggcacttccccgagggggtgacgcccggggtggagtggcggctgccccctcctagagattagatggaggagactgcccctcaatgccacgtggccctcccccgaggggagtcaggcccgaggtagggtggtggctactccgtcccagagattagccggaggaggttgcccctcaatgccacgtggccctcccccgaggggagttaggcccgaagcggggtggcggccacttcgtcccaaagattagccggaggaggctgccccccaacgccacgtggccctccctcctgtgactaggggtcgggctcccccgaccccctctgcgggttgccacgtgcggtgggttaggtggccaccttcgagcgctcacctacccgcattaatggcaacctgagcaggcgcgccacgccacatttaatgtggcgtgcagcgcgcccaaattggtctgtgaccggtcgaatgaccgataggacccggggtgtcaggtgcactaccgcatgggtcagaaggcgtgcaccccgtcctatcccatcagtcatgatggcgaaaggtcttaacctctcatcctggccagggtcggtccatcctccctggtcaattggggtttccatttcccggcgtaagcaggagcccagaagtcttcacccattaatagcagctgacatgggcgccctcccatgtcaggcggcaagatttgacatgcccccaacatcaagatgacgtgcgcccgcttcccaagtcaagaaataagacatgcatttaatgcaaagaatgtaatacttctccaccaaagctaggtttttgggcccatgtggtaaccccttgagatataaaaggaggtcaaacctacttggggaggggggtcgatggatggatccgggatgagccattttagacactagagcagtctcttacccccgatcatcagcaccaccttcttctctaacaaggagatcttgtaatccttcactcagtgagcatagcacaggagtaggttattacacttctcagtgacccgaacctgtataagtcccttgtgtctcttttgcctacgaaagaccttgctaattacccgctgcccccggccgaactctcaaagggggggcctcacggttccctattggaggagttaaccctccgacatctggcgcgccaggtagggggcgcgtttgtgatttttgaggttcttccgaccgccggcgtgattagcatcgcgctgccgatgcgggggaaggtgcagcctcctcaggagtgtcacgccaccctaggcagggggcaaggccccccacatccccaccgggtaaggttggctgccaggtctttgtggcgagtcttcggaatgtctgatggcccccaaagctccagccctgcctcaccgagaagtacgacggcgacgtcgacccctccgagtccctccagatctgcacggcgatcatagaggcggtggggggtggcgaccaggtcatggcgagcgtcttccccatggccctcaggggccaagcggggggttggcccatgaacctgctgtcgcctcggttcactcctgggaggactcttgcagttgagctctgggtgccgtcaaagcccgggaccccttgtgctggctcttccgtagtggctagctttgatcccgccggctggctacggtgcccggcccggctcaactgatcgtcctttcaagttttaagtattttcaattttttcaattcatcaacttgaaatcttatatttaaattccccctattttattctcatggccctgcgacgctcgcgtcttgtgcattatttgtatatttgaatgataatttgtcatgattcattcgaagggtatgctactgagtaattatccgaagaagtttatgaaatagttctgatagtactaagttaatcgtaaagtgtttctcaaatagtacggacagaacataaatgactaaaagtttaatacaaatagataagtcaaggacgatcagtgcccttcgcacgcttgctaggtcctcacttcttcctacgcctaatctgctcagtgggatatgtcaaattatcaggggggtgcctatctctagctgcctgctgtggtgtcacgtctggcccctgaccggcctccgtctcctgcgtcggctgtgtgacctgaggtgctgcgtgccagtaatccatccctacttccccctagggaggatcagtggaaaagaagtcctcaatgaatgctgtgcgaggggagtaagcaggcattccgtgatgcgtcgacgccgaaccgtactcatcgtctgtttgcacaagagggagaaaccaaaaaatatggcgtagttagtaacgatacatataattagaaactaaagcgtgttattgtttaaaatgacttacatgtgtgctgtgtgtggccctgctctggcgcacgcggagtgatatgaagtccccatgctggtgtgttcaacacgttgtcccccgttggcatgtaagcgaagtgtgccgacccagatgctccctgcgaggggtgaacataaggcggagtttggaatacctgcggacgtggtggtgccgtgctcgacgtgggtacccctgatccggctgaccccctggtgtactccggtgctggggtgtgctgaaaggaaggacgaccgtgagatgtgtgggccgcttcgtacccgcgacgtgaagaggatggaccactgcgatccacgctggaacgtcggggtagtgaaggtgatggccgtcggcccgacgtctgcaccacatctgccacgctccgacaggagacacgacgtagtagtgcggcagcacgtgcacggaagttgcgaaggatgctcgccacgtcgtcaggcctgacgactggaggtctcacctctagtctttgcaacagggtgtcagactccacgtgaacgtgctcaacaaattccgcctgttccacaagtaatcaaggcaattaaaattatttaaccagttgcacatttattaagagtatttaacaatatgcacatttgttagaaataatgaaccagttgcacatcatttataaatactgaactagttccacatttatgtaagaaaaggaactagttgaaccaattgcacatttattagacatactgaactacttgctaactttttaaaaatattgaactagttgctcaaattccacaaataaacacgtaccattgagttgtaagctgatctaggctgaggggcaaacgtgtcagtaatcgctgcctggtgggggacggtgctatctccttgtggaggaaaacacctccatcgtgtaacactgcggtaccaacgaaggtaagctccataataactcccatcgtctggaggtgtctgaagtgccaagttatcagctgcgtgctcccactcttgtaccgtcggctgaaccgtggtcataataactagctcgtaggaaagcccgagcccctttctggagtacctgcacaacaacaaattcacacatcagaaaaaatgttgtgcagtgatttattttaaaaaatgtaggattaaacaactgtgatgtgaactaacctatgaagactatcagccaaggacgaccatctctcgaagggaagtcctgatacatgcccaactgtttgagaaccctgtggacattgtgtggctcgacgtgcacgtccaccacgaggtgacaagtcgtcatccagagttgcatatctcgcgtgcaaagatccgcgagaccgtgcggtgcacgatcattgacatcgggctgagtgtagggagtccaccgaacacggtcaggcgtaagctgatcaaagtcagctacaaactgagtgtagacacgacgtgtcgtcccgctaacccactgcggctgtaacaagtagtagttttcattagtcatataaggaaagtttgtgaactagtattcataatgataacataaacgattttaacaaaaaatacctcacggtgtgtccacaaggatcccatagtgggacgatcgtcgatgtcatcaacaccagacctgtacatctctcgcaaaccgtagtttgcgtacgagtcaagctgaggcctcccaatgtcgaagcgctcgtgcgcccacaacataagtagcaacgggcatccagggagtgaactttgcttgctgttcctcacgcaagcatcacacagtccggcatatgtcgccgcaagtaccgtcgacccccaactgtactgtggaatctccgcgataggtaactctgcaatctgctccgcaaagtggatgaagtgcttgtccacggagtcagcgtgagttcccgtgaacatcacccatccaaacaaccacaacaggtaagcgactaagtgccgctgcacgatccactcctcctggtcatcagggaagacatcctgtcgaaactgatttaaccaacttttcgtaggcccgtgcccatctgtgagatcctccagtgcaacaggcagcacaccaccaaaactggccagaaggtcatgcgcccatccagcattcaccattgttgggccaactgcttgcccagctatcggcagccccaacaaataagacacatcctgcagagtgggcaccatctctccaactgtgaggtggaaagtgtgggtctcaggcctccatctatccacaagagcactcagaagcgccgcgtcaatgtggattcgttcggaccttgcacgtgaaggctcgaccaaccgtgcaaacgtcaacaacccagctgctctcagcctacaacatgacagagcgcaagttattaatacatgaaaatataaacaccttgtattagtaaaaacaatatattttcacacaccttgaaacccaacgaggatcaatacgccaatattgatccggtcctcgcatctttagcacattgcagaaagttcctgtactaagacgtcgcgatcgatggttcctatcgatctccttgtctataagctgcccatcatattgatcagcaatacctgcagatcgaaaaccacattagtacaatgcacgtatggtaccagtacagtaaatgtatgcaacataattcaagtaacaaatttgcatgccatttcaatttaaaattacagtaccagcacacatagatacagataagaacagttcagtacatttcaatttaaaattacaagcccacgacacatatattatgatattacaagtgcagtgcagttcgaaatttaaattacaattccaatacaaatacatgacgatattaaaagtgcagtgcagttcaaaataaaaattacaaggccattacaaatagattcgggtaataaaagtgcaagaaagttcaaattaaaattacagacgcactaaacataaattgaacgataacgatcttcaaaatagggagtccaccaaggataatagcgaactaaggattatttttcttcttcgacttcccctttggaacgcgacgaacatcagcgcctgtggcatcttgccttacattgtacatgctgcaatctttacgggaatggttctccccgcaaagaatgcaagctttcttacgacgagaacgatctttcacttcaacttcatccataaggttcttgatcctgcgcgactggcgacgacccttagtatcaagtaataaatttgagtcaggaacccaattggcttgccctggaggaggacgagtgaaatcgcacacggcacgccaaccacgcaattcaccacgccaagttgcctcccacgattcctttctaaagtagggagaaacaaaaatgtttccatcaacacccccttttgcggaagcagcaagaacatgggaacatggccgatgtaacaggtaaggcttgttgcaattgcatttgcaagcgtgatactctggccacaacgtgcattccaatgtgatgtcagtagtcccaatgccgacaccactcttgtcacgaagtcgtatctcatataacaactctctattcccagcaggccacactctgtggattcctcccttcttacttttctcatccatgtactgtgtaatagcggggctatacttaacactgggtttgctgaggttcagactagccatggaataccttttacagagatacttctgtgtacccctcgtgatgccctccaggatagcaacaagtggtagaggtcgtgtattcttcataacccagttatacacttcagcaagatttgttgtcatcacaccatacctcgatccatctgtatcgtacaacaacgaccatttctcccttggctcaaattctacccactccgtgaagcacttcgtggcccttccacgcttcctgcgccgagtaatacttggtgcttcattaggaatgggttcaagtccctccggctcctcctgtctggcaactatagggtttttcctaacctcttccatgtgtgtagtggtcaaacgatccagttgatcccatatggcatcaaactttctttgttgattctgcttgcataacttcttgaacaggtccatcaatctcttactcctgaattgtctataaaaattagccccaaaatgtcgcatgcaccatctgctatgtaaatctggccatggcacggactgtgtgacatcttcttgaagcttctgtatcgctgatagcaaaccggcgtgtcggtcatgcagaacacacacatttggtctgttttcaacaacacacattttaatgtgctgcaaaaaccatagccagcttgatgtgttctcgctttcaacaaatgcaaaagcaacaggaacgacatggctatccgcgtcgactccgatcgcggttagaattgttcctctgtacttgcctgtcatgaaagtgccatcaacacagagcaaaggaatgcaatttctaaaggcctctatcatgcacccaaatgaccagaaagcccgacgaagaacattctccccatattcattcacctcatcgagaatagccatgtgtgtgcccgggtttcttgcctgcatcacctccaatagtgggggaagattgtgataagaatcctcataagttccaaacctcatctccaatgctttctattttgccctccaagccttgtcgtacgatatctcatatccgtactctttctcaacgtcatgcattatggtgaaaggggacaaagatgtttttctaaccacctttgaatataccatttgtgccacaaataccgctgtcaggtttctgtgcaccagacaggtattctccaacaaacacgtatgttgctcaacccttgaagctacccataaagtgtcatgttgtggcttgtaaccatgcactctccaaggacatccaccctgtatgcacttcacgtcatacgtcgtcctatttgaaaccttcaccctgaactcacgcttctggacaaatgcccacctcttcaccgcatcttgtaagtgacctttgtcatgaaacatctgtccaactttcacctgcttactatcataacaccagtgggcatctaaaccatcgtttaccttcatacgactcattgatatggtcgtccaatcatcgggtatgttagtttcgttgtcccacagtgttgtatcttctccttccactacaagcgcaaggtattcctcgttttccacttccatctgatccactaccgcctcattctcctccgctgcatcaacacgcataggcgaatccggttcttcatcgtccgagtcgttggcctcacgattagtaccacgaacaatgacctctccttgtgtattaccctctactacttcttcccctcgaccttgctcagtccgccaaacattttcagcttgtccaccttccaacggagtttcttccaccacggcatgacttgactcccccgatcgatcaacacatgttgtcttctgcaccactattgccaggctatagcctttctcccttactttactaacaaacttcctccaactcccagttgacgcaacctccactactctccactgccatccatgttgacccctcactggccacacggcatttatgacaaatttatcgtgcactggatctaccccaaacatattatacaaccaccctaacacgtcgttcaaacccatatgctctggtgcattcagactagtatcatggaaggcatatacagtcaaatccaccccgctatcacatatttgtataggaacatcgccataatacagacgaatgggcatatcacctgacatcctgataaaacatgacaaatagtctcacgtttaatcatttaatcattcgataattaccctattacaacttatactacattgccgtgtactaatttacaactattagtaacaaagaactagtttaataatccaaataaaatataacacctttgtacctattttaacacacaacatatcaataatatgtactaactaagaactaatttaaccgtacaattacttaaatacctctaccaacatttagcaataacaaatatgtgctaaccatacatactaacatcgaacaatgcgaaacaattaacaactcttaaaccaattttttattaaactttcatatgcattgtacttagggattactaatgtataccttaacttcactgctggagggtgtcgccaaccctttcctcccggccggcgcctcctcggcctcctctccggcctgctatcccctcccctcgctccctccggcgctcacggcgacgatgtggcgactctcggcggcggctggcgatgtggtcctcaaacaaatcgaactcgcggcctgggtggacggggctttaagccggcctgtcgaacgcccattgttcgatagggtcggtggagggccctgtcgaacgcccccggttcgacaggcctcgcggcgccgggtggtgggccctgtcgaactccctccgttcgacaggtgagcgtgtcgaacgccagccgttcgacagggctttgtcgactgcccgtcgttcgataggtgccctatcgaattgcacccgttcgacagggacctactttcacgattttccccggttggccactacttttgcgattttccataaaaataatattaattctcaaaaaaattccccagaaaccgcccaccaactttcgccacccgccggtcgccggggcggcgtctgagaggacgtcgggcagtgcgcgggtcggaggagggcgatcgagatgagggagctgggccggcagcctctagacatggagcggcctctcgctgcgggtggggcacggcctccgcccttggcttcgccgcataccagtgttgtagaagacggaatacggttgtcggacaaaaagggtatcgttcaccgattaatcgaaattatacggaaatttgacgttcgcgaatatatgtacaaattttattatattatatacttatttgaagaattatatttgtttaactatataaatcaaatatcttcatgttgttttttaattaaacagataagtaaaacattaactcttctaacaccggatttatatatcatatggtggtagaattggttgcattaaataagtaaaacataaaaatatatgtaacaaaacaaaaacaattctaaattaagtaaagaaaacaacactaaatgatcatcaaatacaacatacggacgattattcaggtgatttaacggaaaacgaccaactaatcgctaaaaacgagttttaacgttcgtgaacaataaatgtacaccgtatcacattaacgcggtggtggttttaacgttacgaccgattagtcaatcggtatggccattttccacaacactgccgcatacaccgccttcgatctggtgcgtgccgtcccaccccccttctcccctcccttgcccagacgtcatcccatacgagtagtctgtcgctcgattgctacgagtaaccgtcgctgcgtgtgaggcacgcataccctacactatagaaagacatgcatgtacaatctggagatgggttataatcacttgagtggatgttccattgtgactcgccacgtccatgcgttgcatgagcccacatctcttgaagcgtgtgtgttatggatcgagcacgcttgtaatcgatggtgaacatactggtatgtaatggtgttgcatgcgtatccattaagtaaaataattctattttttttagataataatagaaataattctaaatttaactaaaacagattatatatatacatatatatatataaccgatatacaaaccgagagaaattacacacgaattaattaagaaattttggactaaactaaacacgctctctagctataactagctagttgatggtgcactcgacggggaggcccgtgtccttgaaccgtttggtgtcctcgcagtagtcgtagagcaggtgctcctgcctcgccttgctcagcgccgccgcgtccatctcctgctgatcgaaccacggcgactccggcggctcatcgccgcaccacgccacgccgggggacggcgcgcacggcgtcacccggagcccccggtagtaggcgaagaagggtgcctccgaccagtccgtcttcaccctcccgccctgcgtcgcccagtcgtcggcgttccacaggctgccgtgggcccgcatcttctgccacgtcgggaacgccggcccgccgcgcgccgccgtgttccggtagtccctgatcggcacgccgtccaccagaattctgcatcaatggcggcgtgtcaatgcgaagctctctgtctcgatggcaatggcggcggagagggatcaaacgaactactatctacgttttaggttatacgactttctactattgctcacatttatataaatgttaataaatctagacacatatatgtgagcgtgaggaaagctgaaaagtcttataatatgaaacagaggaagtagtacttacatgatgtgcttggggttccagacgatggagtaggtgtggaagtcggcggtggggtcgaaccagaggcggaactgctgctcgcggccgccgacgccattggcgaagatgttggtgtgcagggtgtagggctcgccggtgacgttcccgaggaactccaggtccacctcgtcgtggtactcccacggcacgtcgtccggcatcaactgcacgtacgcacgcacacgacgacatgtcgatcagcatgcatcgtccatggcggcggcggtggccggcggcgaggaggaggaggaggaggaggaggagggggaacgtacgtagagggtggtgacggtgccggcggagttgttggcgacgagcatcatgtcgacgtcgaagcgggcgtagaggtaggcgtccctggagcggaagcccgagccgtgggtctcgtcgaggcagagcgcgagggcgtcgccgtcgccgtccatgaagaagaagctgtggtcngccgcccacaccaccttcacgtngtcgtacatcgacgccgtagccgncgncgncgncgncgncacaaagacgacgaagaagaacgccaccaccgccgccgccgccgaccaccacacgcggcggcaccgctcaccggaacacggcattgccatggaatattaattcttcaattgattcttcctgatcttcttgttcttgttcttgttcttgctgttgctattcgatttcgagcggaattgtatttataataaccaatcgagaacaggttgatcatcgagaagatgatagaatttgcaggaacatgcgaggcatgttcgtggggaatgtttgagataggggacatggcatgttaggattcatggggatgtcaggctggccaaacactgcaataatctgcatgcatgttgcctcgcctggaatgcatttggatgatgaacacagttgaacacacacgctggtggctcgtgcatgcaggagttcgatcaagagcttaaaagaaaaataaaaaagaacttccatggggagcgacgaa

SEQ ID NO: 83196 - DNA, 14160 bp, Oryza sativa
cccaagtaatcaagcactctctttgcaacgtagcccctccgtcagaatagaaattcaaggagtaccatttgtggccaatcttatcctgttagaatccaaagaccttgatgtcatcctagggatggactggttagccagacataaaggtgtgatagactgtgctaacagaaaagtaactctcaccagtgatgatggtcgagttgtaactgttcatgcattgtcttctgagtctttaaggtcaagtctgaaccaaataattttgaaagagattcctatagttcgggggtatcccgatgtgttcccagatgacttacctggtatgccacctaaaagggatatagagttcagaatagatttggtaccaggaacaactccgatccataagagaccttatagaatggcagccaatgagttggcagaagtcaagaggcaagtagacgatttgcttcagaaaggatacatcagaccgagttcatctccatggggagctccagttattttcgtggaaaagaaagatcatacccagaggatgtttgtggactatcgtgcactaaatgatgtgactatcaagaataagtatccgttgcccagaattgatgatttgttcgatcagcttaaaggtgccaccgttttctccaagatagatcttcgatcagggtatcaccaattgaggattaaagaggaagatatacctaagacagcttttaccactaggtatggattgttcgaatgtactgttatgtcttttggacttaccaatgcccccgctttcttcatgaacttgatgaataaggtgtttatggaatacctagacaagttcgtggtggtctttattgatgacattcttatctactctcgaaccaaagaagagcatgaagaacatcttcgccttgcactagagaagctacgagaacatcaactgtatgctaagtttagcaagtgtgagttttggttgtctgaagtgaagttccttggtcacgtcatctcagcaggaggagttgccgtcgatcctagtaatgtggaatccgtaaccaactggaaacaaccgaagacagtttcagagattcgcagtttcctaggcctcgcaggatattatcggaggtttatagagaatttttccaagattgctaagcccatgacacggctgcttcagaaagatgtgaagtacaagtggtcggaagaatgtgagcagagttttcaagaattgaagaatcgcttaatatcagctcctattttgattttgcctgatccaaagaagggtttccaagtgtattgcgatgcatccaaacttgggttaggttgtgttctgatgcaggatgggaaggtggttgcctatgcatctcgtcagttacgtccgcatgagaagaactaccctactcatgatcttgagttagctgcagtggttcatgcgttgaagatttggcgtcattatcttttcggtactcgtacagaggtgtataccgatcacaagagtttaaaatatatctttactcagccggatctgaacatgagataacgaagatggttggaattaattaaggattatgacatgggaattcattatcacccgggaaaggctaatgttgtagcagacgctcttagcaggaaaggctattgcaatgctacggaaggacgacagttgccattggaattatgcaaggaatttgaaagattgaatttgtgaattgtcagtagaggtttcgttgcagccttagaagcgaagcccactctaattgatcaagttagagaagcccaaattaatgatcctgatattcaaaaaatcaagaagaatatgagaagaggaaaagctatcggtttcttggaggatgagcaaggaactgtatggttgggtgagagaatctgcgtccttgacaacaaagatttaaaagatgcaattctgaaagaagctcatgataccttatactccattcaccctggtagtaccaaaatgtaccaggatctcaaggaaagattttggtgggcgagtatgaagcgtgaaatcgcagaatacgtagcagtatgtgatgtttgtcagcgagtcaaggcagaacatcagaaacccgccggtttgctgcagcctttgaagattcctgaatggaaatgggaggaaatcggtatggatttcatcactggtctacccagaacgtcatcaggccatgactctatttgggtgatagttgacagacttaccaaagtggctcatttcatcccagtaaaaacaacatattccggaagtcggttggcggaattgtatatggcaaggattgtgtgtttgcatggagtgcgtaagaaaatagtgtctgatcgaggcagtcagtttacttcaaatttttggaagaagcttcaggaagagatgggttctaagctgaactttagtactgcttatcatccgcagacagacggacaaaccgaaagggtgaatcagattttggaagacatgttgagagcttgtactttagacttcggtggaagttgggataagaatctaccttatgcggaattcttgtacaacaacagttatcaagctagtcttcagatggctccttacgaagcactgtatggtcggaagtgccgcactccgcttttgtgggatcaaacgggagagcgtcaggttttcgggacggatatcctaagggaagcagaagaaaaggtgaaaatcattcaagaaagattgcgtgtggcccagtctcgtcataagagttatgccgacaatcgtcgtagagatctaagttttgaagaaggagattatgtgtatcttcgtgtcacgcctcttcgaggagttcatcgtttccacactaaaggaaaattggcacctcgttttgtgggaccttataagattgtcagtagaagaggagaggttgcttatcagttggagttacctcaatctttggcaggagtccataatgtgttccatgtttcgcaattgaaaaagtgtttaagggtacctaccgaagaagctaatcttgaacagatagaagtccaagaggatctgacctatgttgagaaaccaatccgtatcttggaaacaaatgagagaagaaccagaaatcgagttatccgcttttgcaaagttaattggagtaatcactcggaagaagaatcaacttgggaacgagaagatgagttgaagtcagctcatccgcatctgttcgccagttcttccgaatctcgaggacgagattctgtttaaggggggtaggtttgtcacaccctaaaaatccaaaatatataaattgttgtttaaatagaattattagattttattttaaaagcctagaagagaagatttaattttaattaataaattccaacataaaatggggccagataaaatttcattaaatactttgcttaattctataattcctagatttttctgggatttatttgagctaaggaagtatttttaataaatggaattgcatttaaggaataatttaaattgaaaaaggtttttaaaagtcttctttcggctttgggccgaaagtcagcccaaaaccctctctctctctccccggcccaagtcggcccagtccgccgcagccgcgcgcgcgccctcgctcactgacaggtggggcccgcctgtcggagtcgtcgtctacctccggccgccgccgcccgaaaccctagcgccgcgccgccgccgtttccttccaaatccggccgctcctttccttctccggagaaatcaaaagaggggaaatgtttcccgagatctcctctaccttttcccttttggaaacatcatctatttcggtttggaaatcgatggattcgagatcgaatcggattcctctctctctcccgaacccgaggtttccttcgcgtcgccggtcgccgtgggccttcgccgccgccccctagcccctttaaaaggatccccggtgtctcctctacccgtcgccacccttgctttcgtctctcgccgtcggaagcgtcctagcgctgtgtgacctagcgccgccgtcgtcgccgccgctccagccgtgcgccgccgtcgttccagtcgtcgccgtcgctcgggaaggacgtcatcgtgatcgccatcgcgtcgccgtcctcgtccgccccttcgcagtcgctgttgaccgccggagcaccgtcgccgccgtcgacccgatcttctccgcagcttcaacttcgacgccgtcgccgtccgttgatcttccgccgcttctttggtcaccggtgagttcgccgcgccgtccgctacccgtgggtgttctccgttcgcgccgcagcgccgtcgttcaccagcgagcttgcgcgcccgagccgccgagccgccgccggtgctgacgtcatcaatgacgtcaccgctgacgtcatcgtggctgtttgccgtgagccggtcgtggaccgatcgatctcggccgtccgtttcggatggatcgatctcggccgtccgttctcgtgaaccgccgccgtgcgcccggtccaccgcaaaccctagccgctgacgcaataaatcccttttccttttcaaaaataattcattattgcgtcataattcaattaaaatcaatataagtgttttaatccgattaaatcttcaaaaattcataactaattcatcttagctcggatttagttggttcaagtctctaaatttttctaaaattgagatctacatgttaaaaatatacacatgtactgttcatgcttgtttatgtgctgttttggtgtttttgctcttttctgtttagattccaacgtttccggagagtccgttttcgcaggagaagattttgaagagttccaaggccagcaaggcaagtcacacagatcccaaacaaccctttgagcatgttgatcctatttaaagctattgtttctattcaactattgtatctattttcgaatgtcattgggtggaattaacctattctttgttatggcccttttgtacttgattactttattccttgataccttgggtgattataattggactagttgagctttatatatattggttcaactagatattagatataattgcttagccatgcttagaaacattagcacactattgggataacttatgactcactattatgtaatgatggcttaatggtagttcacgatggtcaatcgtgatttgttaattaattacttgccaactaaaacttgataatggtgggttgtgagcacatggttttgatggtcgtgctcatgacaattaaggaccggttcacgagtttcggttgtgaaacattaaccgtgccaaccacaagccagcgtgggcaacggctttaccttttgtaaagcatggttcattgcggagcaccagactgagaagtggcggagataagcccacgggggtcgctggggagtccatgccttgtttataagggggtgattatgatccaggaaaggtgcgctgtagtggattgtgttgtgcgaggggtattgtcacagctcctttccgaggtaccgtggtggtattgaggcacatggtgacatgatgtggggctgtgtcttgtgggtacagtggtacacctctgatcagagtaaaactattcgaatagccgtgcctgcggttatgggcgggtctaacaatgtctttcgtgattagtttcacacctctcatcataataacagatgctataattggtaataatttgattagctcctggtttggaatggtacattcctggtttggagatagatctgtacagccgggtatggttgttcaggatggttgggcctgtgcagcatggatgtactgttcagtgattgattaatattgatgattaattactctactgttttactactcttaaatgtttgctaaatgctgcttttgcaaatgagccctatattatgccattctttgttatcctgtgcacttgcatatttgctgcgtgacttgctgagtatgtcatatactcaccttgcaatcattcatcagaggaagagttctacagtggtgctgatggtgtggaggattaggtgtagccttggtcaagctgcttgtggagtggagccgtctgcgccgtttatcttttattttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggtgtgacagatcagctcgggctgatctgggccgtcggttcccatggaccggcggtggaccaccccgtggtcccggtccacggtggaccggcgcccttgtgccgctgaccggtggggcccgcttgccggcgccgcccctcccctttgatgacgtcagcaaccgtcttttcctttggaaaaataaataataattgcgtcataattcgttaataattctagaaattcatttaaatggctcaaaacttctaaaattcatatctaattcattcgaactccgaattgagccattcaacttgcaaaattcatctaaaattgagctctacatgtttgtttagtttttatgtactgtttccttggtttttattagagtttttcctcgttttgcgtgccagcgtgtagttcccgtcgttttggaagatcgcgttcgcaaggataagagttcagaagatccaagtgaagaagcaaggcaagtcacacattccccttgagcatgttgatcccaatttacaaatgttttactgtttgcaaataaatatgcatgttttgctaattacatggggtcagggttttacctatctgctcgcttgtgccatgtttacttgatatatgtcctttgtcaacattgggtaataaatcgactagctcatgttacttatgtgacttagctagaactatatgcttggccatgcttaattaccactagctcagttgatggggtaattacagttttagaccttttagtatcagaatgagctgcgtgctcgagacatctggccatgcttcatggtcgtaattatccaactaaaatgcgactgaatggtgggctgtgggtgcatggttttgctagttgcacccatggcaattaaggaccggttcgcgggatgccctggaagaacttatcgtacttaccacaagccagcgtgggcaacggctgggcttgtagtgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggcctctttccgatatgtcgtggtggcatgtcggtgcacggaaacgtgtcgtggggctgtgtcttgtgggtacagttgtacacctctgaacagagtaaaactattcgaatagccgtgcccgcggttatgggcggtcgaccagattcaccgtgattagtcccatcttaatacatgtcgcgaccgggaaaattgccttttcccgaacgctagtgtattaatccccgtcccaggaaaagccggggtacaccatacaaacatgatataaaagacacatctttattatatcgataatatttacattattacaaaggcgcttcaggcctgacaatcaaaaataaacagcagcggactagcgggcctacggctccatcttcacaggcgctcaactggggtataagccaggactccacctaagacatcttctccaaagcttctcttactgaagaggggaaagattgagcaagaatgagtacaaccacagtactcagcaagccacaccggagatgcataattaatgcaagggagtacaaggggataataatataggggttaagttttgcagtaacagcctttaaaagtcacttagttgcccaaagccattttataaagacgatcctagagccacacagtattattaaacaaggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaatttgaaacactgacttgggtacattgctcggcttgcccataaccgagggcgcggctattcgaatagattatactctgatcagaggtgtacatctttacccacaagacacatcttcctcacgtgttaccacgtgccacataccaccacggtatacggacggaagacgtgacatagttcccaacccatcctagccataaacaagagtaccgacccaatccccctacggccgggacacccgggacaggcaggcaggactgagccccctagcagcagggcaccaaccctctgccatatgacatctcgactaccgggccgcagctcgtgtagccttcatttgccctggagaatgtccatcgacccccgacttcatccatctccaatccgtgtactttcgtttatgactagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtatgtccaattccaccatattccaacaattccatagtgtccaaatgatatgagaattcccaaagtctaaagttataaaaccacctaatgttacctaattagatcgcgaagcatctacctaaaattaaactagtggtgtcataagtagagtgtccactagttgaggttttgtttattctagggtgaacaaggtaataataacaataacaataatagtatggtcataacaaaggtaaataggcatggctaaataaaacagtgataacgcgggaatttaaataaagcgataatgcattaatttaaattaaaataattttgtaaactgggattcaatatgctcaaggatgatgtgacttgccttgctcactttcccaaacgccggcttcaacttccacgaagagcggatcttccgaagctgcagcgtctacacgaccaacggaaaagaaaaggcttttactctaataaactccaaacaacaacagaaacaaagcacaaaaatgggttcttgacttcttaaggaaaaattagagacttgaacggtccaattccgagttcaaatggccaagatatggtcatttgaagtttatatgctctttaaatggatatttacgaatttcttcatttaaattttaattaaaaacgcatttattgcgtcagccgggagaggggcgcgcggaccgggtccacgggaagtggggcccacgcgtcagcctctcggtccacggtggaccgggcgcacgcggctggcggcggtcggcgccgtgggtcccgcgcgtcagccgcacccgcgggcgcgggcggctgacggccgggcccacctggcagccgcgagggcgcgcccgaaggcggcctcgccggcacggccgacgggagcggcgcgcccgcgccccgatggtcaccgccggcgaccatcggcgcggcggagcagcgcccgagagagcggagaggagggggaaacggaagggacggtccacggctcaccccgagacacgaggacggcggagacgacgaacggagtggagaaacgcggcggcgcggctcgggatgacgatgacggcggcgctccgacggtcggcgagcgaaacggaggcgcggacgaggtcgacggcgatgcggcgatgccgagggaggtggcgccgagccgggaggaagaccggagcgacgacggcggcgaaccggagcggaggaaggcgacggcgcggttcgggatgccgagggcgacggtgctccggcagccggcggacgaagcggagcggcggacggggtcggcggcaacacggcgaagcggatggaggtgtcgccgagtcgggcggaggaccggagcgacgtcggcggcgaaccgaaggtcggcggcgacggcggagagagaggagcacggcgcgagcacggatccgacggcgagagcgagcggcgagcggtggaaacggaagagcggagctcggggagcaattatatagcaccgagagggggagaacgcggccggagaggaaggaaacgggcgcggggatctcgggctccatagatgtcgccggcgaggattacgggatgaatccggacggatccgagggagagagagaggggaaatcgggggaaacgggggagggaaacgcggggaataatttccccctctttaaggcgcgcgggcaaggcgggatgcggcggaatccgcggcggcggcggcgctagggcacgggcgggcggcggcttcggcgcgaggaggaagacgacgggtgggtcccacccgtcagcgagagtggagggcgggcccgcctgtcaacggcgcgcgcgcgcgggggaggccgatgggccgtgggggaagagagagagagggagggactgggccgagccggcccaagaggggaaggggggggaaaagaacttcttttaagatttttctttttataaacctttttaactttgtttatttcttctcaattattatttgtgctctgaaaattccactaaaatttgagggctcctttttgaccaaggggaatttgacaaaaattctccgggccacatttgaatttttcttgtacgtattttagtgtttgccaatttcttttcgaattttaattaattctattattccttttagagaatgatttttaattcgggatgaatttatcaggacgtgacaatacatcgacccaatgcactgtagtccaggtgggttggttgggcctgttcaacgtggtgtagcgttgatcagtggagatttaatgttactctaattactcaaccgttttactgatttgctcaataaaatgttttacaactgcctttatgcaaatagccacaaacccctccttgtatccccttgcacgtctgcatcgttggtgtggcttgctgagtacggtggttgtactcagtcttgctattattcccccttttcagaagtgtagtgcttctgagctgaagatggagttagaggaccaaggctcagaccccagttgagttttgcctgtggagtggagctgaagccccgctaggatcgcctttttccgctgctgtcgttctgtttcggtgcgaggactaagtgcctcttccgtaagtattttacgctttatttacgtttggaactgtatattacttgtcgttttgtgtaccctggctggtcctggacagggatttaatacgcaaaatagtctggaaatttgggttaaatttctgggcgtgacacgtacccgtgttctacaatccccaagttgagatgttcaagctcctgttgcaattcattacacatgccttcggtgcataaagcattgcagtagcttttcctgctcaaggcatctgccaccacattggctttgcctggatggtagtgaatgcccatgtcataatctttgattaactccaaccatcttcgctgtcggagattcaggtcaggctgggtgaagatatatttcaaactcttgtgatcagtatagacttcacagtggttgccaatcagataatgcctccagattttcaaagcgtgaaccaccgctgccaattctaggtcatgagttggatagtttccttcatttggacgcaactgccacgaggcataagtgaccactctgccctcttgcatcagaacacatccaagcccgtggtgggacgcgtcgcaataaacttgaaaatctttcgtctagtcgggcagaattaagaccggtgctgatactagcttcttcttgagctcctcgaagctgctgtcgcactcagctgaccatttaaatttgtcatctttattcagtaactaagtcattggtttggcaatcttggagaaattttcaatgaaccgacggtaatagcccgcaagtccaagaaaacttcggattctgagatactgtctttggtggggtccacttggtaactgagtccacaagcgaacaaacctaaacatgcaaactaatagacaattactaaacagaacgatatgctaagggaaaacgagcctagtgctcggaacggctcctgcggtcgatggagtcgaaggcgtcctcttgctcatctcctggtccctctgagcggctcctggagtcctgcacgtacgtctcgccactgcccggctctgagctactggaactgctgctgtggtcgcggctgccactgggagtagcaggcaaccaacctccactgccactggctgggcccctgtaggctgaagctggagcatcggtgaagacgaactcaggcgcgggagctgaagatgatgctggtgctgaagctggggctggagtgggagctgcgggcgctataggaggtgctgaaggtggaggaggcgggttcccggatggtgggttcctgggcaccaactggatgcgcacaggtgctgtagtagacttgctcggcatggtgcggatgcgggctcctaccactgctggacgtccctgcagcctagcattctccctcttgaggcgagcgacctcatcctgcaggctggcaatcctgactagcttctgattgttgagggccttggacgccttgtgaagctcagcatagaccctgtcgtagctgcacatcacccctcgcatgtgaccaaaggtggtgtcgacctctcccctgcaagacctgaaggtgctggtgtcatcattggcgccacggcggggatagtagcggtaggcggtgctacgaaggtcgttgtcgtgcaggtctcgcagtcttgccatcatcatgagagtagcttcttcacaggcatgatcaaacgtgcccccactagctgtgaccgtcatgttgggcaggtaggaagggatgccatggacctccaagcgaacctgatgcggaaactcgccactgagggggtgaatcctggtgtactccggctcctgggtaaaaccaatcacgaatgccatgcaggcgagctcggcgacaaaacctcccatgtcctgatcactgtgcgtgttggggcggttggccatctatagaagataaaaggagggggaatcaatgcatgctcaaacccaaatgtaagtaaacgataaaggactcaagcaagataaacaaataagagcagaattttgtgcataggatattttgcatgagcgaataaatacgaccgacatagttaagcaataaggtagtgcataaattagatacataataataatagtagcataagtaaactttgcaacccatattccttagttaggacctaatgcatacctcctattaaatccgaactgactgacctcatttgaacaacgagcgatcaagatttttcccatgaaccaaaggaacaaatccaaattttcccgaaacaaaatgcagcggaaaaataaaagataactggagctaagccttgacttggattgcagcggcaacaccactccacaggcatcctcgacggcacggacgaagcctactcctcggaatagccaccatctgacgcatactcaaactctggggttggggaaaagtagagcaagactgagtacaaccaccatactcagcaagtcataccggaatagggcgtatgatgcaggatataaccaaaggatagctagagcggttcatttgcataaagcgagcatttataaatagtagttgaaagcagtaaaaatagtcgtaataattaatcaatattaaccatccactgtccaacgctacaccacgttgcaacaggcccaaccatccacctgaactaatcaattccattagactaaactaggatgagactaatcacggtgaatctagttgaccacccataaccacgggcacggctattcgaatagttttactctgatcagaggtgtacaactgtacccacaagacacagccccacgacacgttactgtgctctgacatgccaccatgacataccagaaagaggccgtgacaggacctttcgcataaccccctctagccaagcacaccacacctcaggtttcacccccgtccccagcgggcaacgggcagtcccctctcgtgcctaggtgaatcggaagcgacagaggccgtgtagggcccgccccgctccat

SEQ ID NO: 83197 - DNA, 25444 bp, Oryza sativa
cttttatttgagtttatttggattttatttgaattctaactgaattcaaatcatttcttcgcacgtaattttagagcccgagggagttgcggatccgagcaaggatcaagacccgcaggactacgagcaaggcaagtcatcactattctttgaacatgttgatcccaattgcgaaattattttgtttacaaataaaattgcatgcaatgatgaacatcccacttttgattatgccatgccttgattattgtttactcttaaatctttgtaaccatgattatgtatgagtccctagtcaattatgataattgcttagaaatgctattctagaatcatgcatattcatatttatcaaatgctatatgcttgggcaattacctttgggaaggtaattgagatgtggcatgtggagacatgagcgccacattgccatgatattgatgacatgatttgtgaaaggaaaataaagtgaaacaactgttttcgactggccgtggatggaggatttgggtggtgtccggaaaaggctagtgccgtccctggtcagttaaggaccgagccatgaagttaagcatgaaacgacccccgtacgaccgcacttctcgaatgggtatagacctagcggagtagatagctgtgcggaggcagtaaccatgcatagtagtttcttgatgtgtgaggcaggggctctacggtggggcagccattggtaggaccgcgaggcgggtgtctacagtggtgtcgccattggtaggactgccatgtgagaatctaaacataattataccttaatgcatgtgtgagtcttcctttcccgggtgcgccagaactcctctcactgctagaaatcgtattacgcctagagtgcatgaggatgtaaagttcatggagcgggtactgccaatgcgaggttatcgaaaagctttgccatgacgcgtctcatgtgttgggacgaggctcatgtgttgggcagtcgcggagtgcgggtaaagtgtacatccactacagtgtgagtaaaccaaatctattcgaatagctgtgctcgcggttattgagcaccgggacatgtattacacttggctagactctaaattcttaacttgtgtggggtggaatattgcatgatgattttatgctgatggagccacttcctgagaggagggaaggtggtcgtcctcagaaaaccatgacgactcaatggcgggaagctatccttgggatcacaatggatggtggacagaaccgtcgttgtttaatatgaacactggtactaaaatttgatcagtctatgctaggtcttaggcttgtgaaaagaattacaaaacttgctttgcacaaaaaaccatagccatcccttgaataccccctatcatgtgcattgttgttgtagtggcttgctgagtacggttggtactcacccttgcaatatacaaacttaatcagaggtcggaattatagcttagaaggatccatacgcttactccggaaagggtgatgaagacgatggcgctcagtaggtcttagttacggtcgttgcctgtggcaatggcgtgccattgccttaactccgctgcgttatatacttctgcttttggaatgtattccggaccattcggtcctatgttctaagactatgcctgtgggcctatgatgtaataatgcgcactagactctcgtgtatgtgcacttggtatttcagctatgaactcgtgtgtaccagactacttgatccagggaaatggtactatttacacgattgattcttgttataaaaacgggggtccacaggagtggtgtctagactacgggatatcattatttggagttatatgctgcggttgagaggtgggccgctgatggtgacagctcagtacgggtattcctccgcgcgtgtatatagtactaagttaatttcctagggaaggtattcctccatattcagccccggttgtatggtcatgacgggctgtcgtaaggaactcggcagtcaggggtggcttctcgaagtaccaggagggcatcggatagagggtattagctagtatatcagataactaggatgtatgtatactatgtatactagaattataggaatagattctttttctattttcttcccacttagcttagatattttagtatgagaatgagtagcttcctgcttgtgtgtcactctacccttgaattatcttaacccctgcttagagtatgattattacaaataacatataaattattagtctagttctctctaccatgatcttcctacgggattaaataaatacgatacccttggaatactctcgagtgaaatgctacaatggtatatccgtgcgcttgcggatgaactctgtaaccataatataccaagagtatttctgcgccattgctgggaattatatttctagtaatgtcgttaagaaataccaacaacatgctagttctccatgttgaaatgataaataattgatctgctttatatctttaatgtatgtgcacatagttaagtactctctcaagttttaagtgaaattagccaaccattatacgggaacctgagagaactgagttgcacattgcatgatctaagtctaggttgttgtgagatatgagatagtgaaatagagttactatattcttgttccacgtttgactaaaactccggatattttgtttctcagaaagataaactcttgaagttcctcatttgatatgaattcctaccagagccaaaaaaaatgttatacaatgttgaacccatatacattttggttacttgtatgtccattgaacaaattccgtgacttgtgtagatgctcttcatactttatgattaagatcatacacccacatatatgcacatgtgctaagtttctaaactggaagctagcatccatccattccatcatatatcacatgtgtcatccaccaaataaatactccatgatatttatacctctttttcaaaagtaacataaaagaggagagtgactaaaaagaaataaaagagagagagaaaaggaatttatactcatgcaaattatgtggcatgaactctctcaaaaatattcttgaaaaaaaaacgaaaaagagctagccaaaaagactccctctcaaaagctttcaaaaatggaggaagaggtatacaaaaggagtagtcatattcatttcattttcaccgtatattccacacactatgcacgatcttgagtatgatttgttatccgctttagtctagatttttgacttagtgataaatgtgattgcaagtatgccttattcttgatcactaacaaactacacatattcagctttagtgtaggaataaaaaaggtataattttggtgaggaataatatgtatacacattgagtgattgagagaatcatttaaagagcatggttttaatttgcaaaatcatttgaaaacttccagaataagagctaggcaaagaatgagataatggtactctatgatctgttctgtctcccaaccgctcaaggcaaagagaagcatgtgttctgtcacaccccgaagttttcctccctagccaaaatcgtaattttcaaatgaccccaagaaaatgcaggtgaaatcaggagaaaaccctaagaaagtaatgcaaataataatcggacttgacatgtggaatttttcttaagttctacatgtcaaaattcattaacaggatttttagtggaattttcagagctctagaaataattttaaccaattaaaattgggcaagcaatattttaattacagggaaaatcctttttctttttctttttctttttcctctctttttcctcctttttgtcaaatgggccgtcggcccatttccctctttccttccccctcctcctttctgggccggccgcaggccgaggcccagccaggccgcccgccgcctcctctctcggggtcgccgacaggtggggcccacctgtcggtcccgtctccctcctcccgcctctcccgctcgcgccgccgcacccgtaacggccgccgcgcccacgcctccgccttccccgggccacgtcggccacgtccgcgcgtgcgccgcgctctccgcgcccattcccctctctctcccgctcgcgcccgcgcccgagatggccgggattcgaaaaccgaatcccgcctctctctcctccccactcccccgcgtcggccggcgattcccgcctcttccggccacgtccggttccctctccccctatttaagcatcgccggcactccttctcactttttccccattgcgccgacctctcccgagctccccatcgctcccgcgccgtgcaaccacccaccgccgcttcttcccgcactccggccgccgctagccgccgctaggctcgccgccgtcttgcgccgtcgccgccgttagattcgcgcggccgaggtccacctcgtccacccctcctccgttgaggttcgccgccggagacccatccccgccgtgcgccggtgagtgacgccatggccgccgccttcggccggcgcccttgcgctctcgcgcccttccctctctctctaacccctctccttttgttcgttaggaggctccggagctcgttccgccgtcgccatcgtccttcgtcgcccgccgtcgtcgaccgttgtcggtgaggccctcctcctcgttttctctctcccgcaccgtttagccgccgcgtcgccgcctagctgcgtagccgccgctcctcctctagccgccgctctccgccgcccgcgctcgccgtcggccgtcgccttgcgccgctgctgcatgcgcgccgccgccgcgtgagcgctgcgccgccggcgccatggtcgccggttcggcttgcgccgtgcccgcgtgccccggccgcgagctcccaccgccgtccgatctacccttgggtagatcggggccgtcggtccggctgccacgtggcgccgccgcccctttctctctctcccgtgccgctgaccggtgggccccgcatgtcggcgccgcaccccccgtgctgacgtcagccctggaatttattgcgcaataaattgtttaaggtttttcttttatagtaataaacacagtgaatcttctaaaattcataactaattcatccgagctccgtttaatcccattcaagtctcagtaaatcaaggaaaatgtgtagaatccattaaaaatggttttgttctctgtttcagtagtcttatagcctgtttgcaatgtttgctttgtatgtcggtagattccgtttcctccgacgctccggtgtacttcgagatagtcgccgaggttcctccagcagcagagcaaggcaagtcatgcttgtcacttgaacatgttgatcctatattgcaaatgctctattgttttctttcaaacattgcattgttttataatcttactatgggttgtttacctattgttacagccatgctattttgataccatgctcctttgttagcttgggttataacatgattagagttaggactagggattgcttaaccatgcctagttcaactagttcacattggagaaaaccctattaatgtttagactgttggttctaatggtttgttggattagtgacaccgctttggtgttggttaattaaaataaatcatggtgggctgtgggtgcatggttttgctggtcgcacccatggcagttaaggaccggttcgcgggatgccctggaagaatttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgtttggctagagggggttatgcaaagggtcctgtcacggcctctttccgatatgtcgtggtggcatgtcggcgcacggaaacgtgttgtggggctgtgtcttgtgggtacagttgtacacctctgatcagagtaaaactattcgaatagccgtgcccgcggttatgggcggtcaaccagattcaccgtgattagtctcaccctagtgtaatctttgaatttggatagtttaggtggatggttgggcctgtcgcaacgtgggttagcgttggacagtggatagttgttattaattaattattacaactgcttttttttttcaacttctgtttataaatgctcactttatgcaaatgaaccacgctagctcttcattgttaattccctgcatcatacccctattccggtatgacttgctgagtacagggggtagtactcagtcttgctctatttttccccaatcccagaggatgggtttgtgtcagatgaaggtttccccgaggagtaggcttcgttccggccgtcgaggatgcctgtggagtggggttcccgctgcagttctagtcaaggcttagctcctgttgtttttcttttcttccgctgcatttttgtaagacttttatgatgtttgtaagacgtggatctgaatgtcaacattgtcgtttgtgtaccccggctggtcctggacggggattttaatgcacattctgcttggaattctattcgggaatttctgggcgtgacacagttgggccaggctagggttctgacgaacctccctgagcatcgttgatctccctctttggcttggatgtccaggatgcactctcattgacggttggagggtgtttccggcatttacaaccgtcataaccatcattgagaggctatataaaggggtcacctcactctctcccacacacactccaagaagaagatcaagctctctccaaagtttagattactgttctagttctagtggagtagaattagaatagttttcttagtcctcgagtcttcaggagatttcggatatggctctagtagctcttctctcttttgtaagacttatagaattaatgaaatattcttctttatttagcttcggtcttttacttaattcatattatctaagtaccaactttactttatacttgtctcgatgtaattgtgtagctagcttaccagagatatgtgttggcgtgggtttaatgttcacgcagatgattgctcaatgtctttctaggggatatagagcaatatttaataatgtaagcgtgatgcttggattattaagtatcattatttgaggttatatactgcggaacagtaaaggtgggccgctaatggtgacagctcagtatgggtattcctctatgttaggatagagtcctaagacactttcctggtatggacactcctctatatgcatttccggttgcatggctgtgacggattgtcgtaacaaactcgacaaacaggggtggtctcttgaaccaacaagggggcatagttagggggtaattgctacatgattgtatactagtgagtgtaaactaaagataattgtatattggaagtatatgaatgatttcttttcttattctttctctacttagcctagaatttatttagtgagagtaacctgattcttcctcgtgtcacctaccccttttgaattaattaaccccatacatagactttgatatatgcaagtaatatatgaaattattagcatagttctctcttatcatatttttccttgggattaaataaatacgataccttggaatacttctgggtggaaagctacattggaatatccgtgcgcttgcggactatatctgtaaccataatataccaagaatatttctgcaccattgctgggaattatatttctagtaatgtcgttaagaaatatcaagattgtggcgaaggcagagttatggttggcaattgtatattccatctagcacaaccacacgtcagcctctgggtaagtaacttgatcaaatggagcatttcgaagtaatgagttgacgactgtcatgtgctctgcaggtatgcgtacggaatcgatttgcactggagctacatcttgggggttcaacttcgccatcctccaatgatctctgcagtgtacggtcatgtgcacctcagtcttcgatctcctcgtcgattacgttcatgtcatgtggtgtgtttgatcctgttaacaacggaatttcacatccgattcaaagaagaagatacaagatctaagtggatttggtatgaaatcaaattggaattagagtcggactgcgcatcggctgagtatcgtatcggctgaaggcagagcagaggcttgacttagtgataaaccctgagctccactagagacactcaaccctgagtagatcaaccttatttctacaagcaaatcgaagaaacaaacaagaacaagataaaagcaatctgaattgcagaaaggaattgaatacaaatgataagttggggtttcgtaacgagcaaaccggcgatctaaccgatcacaggattatacagcaaagtagtgaggctaaactttaatctaaacaaaacccaagaaaccctaaaggggtacctagctatttaagtatgtgggaggatgacctaggggtccctagggtcatgctccacctggttggagcgcaccccacatgggccctacttgggctggggtcccaaatgaagttacaagcccataggcccattataggagactcaacaccttgtttttgtgatcgcggtcaaactagatcgaattcggagatgaggctggatcacttggaaagataactctgagagctttccatcaagtactcacgggctgaaaacggagctcgtatcttagatttggtggccgtttgaattcagcaatgtcgtaggtggccgaatcagattccatcactcggtgaacttgatcttgatgtgagtgacggttgtataaatagtagtcatagtcacatcatcctccccttcttcatagataaccgtcctcggattttccatgtggtgctcgctgcatagtgcatggtcttgcgcgtagaattgtctacaagaaaacaaaagcaacaatctttcggcatgtaatatcattagctctttagcaaatagtatcaatctccaatgaaacaattgtacctgattatgaggtaacacaacaaaaaatgtaggcactgcatatgtaaggccctttagtagctcatgttgcacccctttctcacatgtcaagtaatcacatggtacatttttaatggagtatggtagcagcattgagggatttggtcgctccccttcttcaaaaccatcctatttctttacatcaaaacaagaaaaacttgagataacatgataagcaataatatgtctctctagcttgcaatttttatccacaacaacatctgtaaactctatgcaccaaatatattcctctatcattatattaaccaaagatatgaaaattagcattagttggatagatatggcaaattagacttagcaaataatttctccttcaaattatcgagctcacaaaatccatgaaacaatacatagcccaaagtttttaaagaagatagcaattcacgttcctcaacttcattagcaatttgaacaacatgctcattcactataaatagcatgttcattcagtagttgtggcattaatataactgaagaattatcacacaactcttttttatcgcaaggaatagcaagtgtgtagctaatggtggacatgtgtagctcggcttgagaatactcaccttcatttatctcagcaccatttaatttaccttgcaaactttcttcaaacatcgcaggtgcttcatactcctccgctttcttctcaagaacattattctcttccttttgttgaatgttttgaactccctgcgaaacgttttgaactcacaggagacacaaaagattgctcctcccatgtttgcacaccatcattgcataaggatataggagattcagaaacaggagataaatcacattgttcatgcttccttgcatttgattatgatccgagtctaaatgctatgagcaagcatgaatatgtgtccaatatgattatgtgtcatattagcaagcataacctgaacttcagaattaataccattgataaacctacgcattgtgttttcattacattcttttaaagcactgtagatgatacaaactttaaattctcagatgtacaccttaacatttctatcatcttgtttcagattttctaatttctcaataatagtacatttgtaataagaacttacaaaactctttcccatcattgttttgcattcatcccaagttttaggtttattactcacataactccaccaaaataatgcagaagaggtcaacttattattagcagccttaatcatttgagcatcagaaaaatcttgtcaaattcattgtctattgctagcttccaatcaatataagcaacaaaatcatacttctcgtcgcataatgataacttagattcaactcatgcaaacttatagtcaggtacctcatatgcacttcatggagaagttgtcatatctcatctaaggtgaagaagtcgatgatctcttattcccttgcgcaatcctgcgatggttagtagcaaacaacaaacatacacaagaatatgcacgctcctatcaactacttggtcgtggtagctcagatatcacacactcaagcttttaaccaagctcttacaaaatcttaccaatgcaagcggaatggtgatgtacactgactcaactaagcaccccaatggaggttggatgtatcgatgcctttacaaacacctgtcgtatagctgcaaacaaatatgtggtctgatgtggagatctgggtaagcttaaatatgtagcaaaggaatagaaaatgctgaaatcagagagtgcaatgttcaataattgtgctggttctaggctagaacgtaatagagacacgatcctagacacaaactagcagtagaaaaaactcaagcacactatgatatatcaaattcagctaaaaaaacaacttattttctctcttctttttttctctctcttttttctttcttctctgtcttttcttttttttctcggtgcgtcttttttttttgttttttaagcacctttctgtcttctctctctttttttgcctttttcttttcaaaaaacgactcaagcacctcaatgcaaaattgcagggactcaaatgtaaatacaaaaatcactaggacttaaatgtaaaagtcccaaccgaaatcaaaattatacaaaaatggaatgctcttgtcccgtaggtttcgtttttgcaaacggatctccaatctgacacttgcaaaattttcaccaaggtgttgagctactcaaagtattggaggaaacaacagtagagggagagaaacggtggggaggtggtactggccacatgttaagtgcagatgtggtgcacaggataagagggaaactaattctagcagattcaatctattatttcttcccaaaacaaacctgactacttccaaaatctgatttggtaattcaccttcctcctctcgtgcacgacacaagcacggcaagaaacacagccaagttggcaaaccctagatgaaactcacactgctggagaaagcgtttttaaccccggttcataaccggactacgaatccggctatctttagtcccgggtgaaacaaccagagttaaagatccatctttagtcccgattggtgttaccaaccgggactaaaaatgaatgcatctttagactcaggactaaagatttgttttctttcttttattattttttgttgtatgcatattgatttcataccaaactcaacaacaaacatccacgttcacaaaaccattagaaaaacttccacaaatttatagatcgaatggacatacccagattaacatcacaaatttaccattcccatcacaaatttatagttctaaacatcacaaatcaataaaaactcacggatctaaacatcacaaatcgacaaaaaatcacaaaaaaaaaattccgagcggccactgccctcccgctccgccacctgcaccagagctggcaccgccgcccccctcgctggcaccggccacagccaccgatacggagcgagccgccactgtagccgccgggctagcgcaggccactggccaccgctgcccccaccttgctatactatgtgttgattgctagtcccgattggtgttaacaaccgggactaaaaatggtaagggggcggacgcttttttaaccgggactaaaaatgatatttattcccggttggtaacaccaatcgggactaaagatcataaaatggtgctggctttttaactggggttaaatatcatttttagtcctggtttttggtcaaaccaggactaatgtggtttttgggcaacccaacaaagatggtttctccagtagtgtcaataactccaaaacagattgacagaaacttctgaaaactagaaaaatggaaccctagcagaaagatgattccgttttcgtaggtctcgacgacaacaaagacacggcgactgcgatgacagtggtacaaaacgtgtacataactcaaaactctaaacgaactaggcgctaagaccatcaactcgatgcgacaatgcaacgcaaaactcaacaaagcaaaaactgaaagaacaatgcaacgggcacaaagaaggctaagtaatggatgcaaacttttattgtatggctattttctgcttatgggtagatcaaaaatcactgagcaacaaaatctcctataccagttgataaaacctgaggtccactcgtgacactcaaggctgttgatgacccaatctttcagtgagttgatgatgactacaatttgggagaaacgttgatgacccgactacaaccgtactagatgttgttgcattgtgccttagcaatcattactcctccccgtgggttgttgattttgccgatgcagatcaacattattcctgcaagcaaatcgaagaaacaagcaagaacaagataaaaacaatctgaattgcagatatgaatagaatacaaatgataagttggggttccgaaacgaggaaaccggcgatctaaccgatcacaggatcacacggcaaagtagcgagtctaaactttaatttaaacaaaatccaagaaaccctgaaggggtacctagctatgtaaggaggtgggaggatgaccaaggggtccctagggtcgtgctctacctagttggggcacaccccatatgggcggggtcccaaatgaagttacaagcccatacgcaacactttgtttttgtgattgcggccaaacaagatgtaatacggagataagactggttcccttggaaacagggcttccgagagctttccattaattacttacgggccaaaaatggagctcgatacagatttggcggccgtttgaattcagcaatgtcacaggtggccaaatcagattccagcacttggtcaacttgatcttgatgtgagcaacggtttgggcttggtttgagcataaattgtgataaacgttattgcaaattagagatagacctcgaataaggcaattgcatgtattaattaggatatttaagttggtttattttagatttgtgttggtatttcttacgaccatagataaatccgcaagcgcacggaataccgctatagcacatcaccttcgggtgacccaaaaaggatatcgaactcagggaatgtgtataatctacctaaggctaagacaatccaaggacaacaactgtaggtaggctaggctagagaggactttctatgttttttaattatctacgctaagcaaaggtaatttcctatctgttgcttcgggaaccgacccctacttgtctgctagcatggttccggctatagctctatgatgtatccgaacgtggaggattactaggacgggatttagagttgtcaccacctgccacctacctctgacaaatccgtgggatacacaacaaacaaatccgagccgtctaggtgaaagtaaatggcgggaagcgctaggattggttcgaccgaaccaaaaaaccgtcctcccggcctctcctttggctggtaggttgcttaatggccccccaacatcttgcacaatgttttggctcaattctaagtggttttggttgacatatggaccctccaatccatgtaaacgtgtcctgaatgagcagaggtccattttgtcgcatggcggatgtgttttctcctcaaaatacctgcatgcacatatttcaccaacactagtagaaatgatttgtaataaaccctatcactaagttggatactatgttttatttcattatatgcaggtattgacggtcaaatgttatgatttaaggaccgtcaacaatttggcaggagaacgccttgaggtcttgtttgtatcttatctttaggaaagtttgagtcgtgtccataacggactaaatttgtattcggggtatatatacagaccctgactattgtaatcagggagacaatccaatacaacttcgatgcatcgccaccctttttgttcttcttgtcggtgagttctctcgacaagaggtaacccgtctcgatggcttgtgctatcagcccatgaccatctgctgtcatatgtcttagttaatctagttttagtatctcaaattagccctattggctagctctcgttttagggttcttgccagtatcgactaaattgccttactagattgtattaactaaggcatctaccatcttaaaaagtgattaattccttgattgtttagaatttaggtttctttacttactttgagatacatcatccctagtcttgtctagaaacctagaaactaatgtggaattaattatagttagagatagtatcggagtttcagccgatcttacctaatatacatgctactttactagttttatgtatatttgtcacttatatagatagatcaccctatataaatatatcaagtctagatcagcattggctatgttatcaaacctggcagtagatcgttatttgatatatttctatagattgatttgtttatataagtttgtactagagtattagctagtacattatctttatctatctatcttgctctaaatactgttccattggctatttctataatatcgtctgacttgtacttgacaaacttattagatgatactacagccgatgaggcatatttagtgtttatacttattttatatatcaattcatagtcgactacatctgctgggatcactaatgatacgtcatcggcctgtcggctaactaactttgtttgttgttttggcaaaccccgagctccactagagacactcacccttgttgttggcacgatcttttggtgagttgatgataactatgatttggaagaacggtgacgatccgactacaactatacaagacgttgttatgttgcgccttagcgatcgattcacctcttcttgtgttgttgatcttgccaatgcaaatcaaccttattcctgcaagcaaatcgaagaaacaagaaaaaacaaaagaaaagccatcaaatccagataggaattaaatacaaatgataatttggggttccgaagacaagcagacggacagtctaaccgacatgcgcactgtaagcaagtagatatggctaaactgtaatctaaacaaaacccaagaaaccttgaaggggtacctagctatttaagaaggtgggaggactacgtaagggtccctagggtcgtgctccacttggttggggtgcaccacacacaagccccacttggctcggggtcccaaacaaagttacaagcccaaaggcccatgacaggtgccacagcacattgtctctccaattctggacagctgaggtggaatttggcgatatggccgaatccatcggaaagaggactccgagacttttcatcaactactcatgtacccaaaacggagctcgtatgcacaattgcacatctaacggcctttagaagtcagcaatgtagcatgtggctgtatcggattccaacacttgaagggacttgatcttggtgtcttcttgtttattcatgatatgagcaatggttgtatccataatagccatggtcacatcatgtttcgttgctggttgcaagatcaaaccagctggcatgcccttagcacactcgaagcaagccttggacctgcactggagttaagcagatctcctaggccaccgtgtttctcgtcaacagatccaaaaaattccaggttatccagaccatgaagaatggatggttcgcgggagtcgaacctgatgtgtatgatagtatgatcttgtcgttctaaagtgttgctgtccatgaatgcgttgcgagtctcatcttgtctggcatggatcgggcgacatgtgactcgcaccgttggttctataagcttcatgaatacttcgcaactggtgagggggtgattctgagttttgtgaatcggacaccacgccctgtaaggagaggcacgctgaatcatgcgttcttcgcaaccgtcgagttcaactttgtcttgaatgatcacccggcacccgatcaatggatagctagttgtcttgtggatacggcaccaggatcaatctttacttgaagacttcctaatcggtgcacatttcttggtggaatcgaggagcaagacggtttaggagtcttgcaatgggtaacgaagttggcgcaccgttgtcaggatgaaatgaagaaggtgttgtctgtgttgatgtatctgcttggtccatcattatagccacatcttcgctaggtaccaaaggggaggagatcgggatgggagcgaaaactgaaaagataatggatctgacttggactaatgtgtaggatggttggattggatctaccaagccaggttggtcatagaaaccctcgtcagagaatccggctcttgagtttatctcgttgaaactcattagcaccaagcccactacctagcgcgccactatcgagggtggacatctcgactacggtatttggatagtatgggcattgttggaaccaaggtgtacttgagactgtatcaagcagacaagagacaaagatttatactggttgaggccctcaagatgagtaatagccctagtctattttatatgaattatggatggaaatatcataaagagtagaatgaggagtaagaagatcggactaacccgccaactagatgatgacaagaacaacccgatgagatatattcggcgagtacggcgctggctccctcctgattgatcctccttatgatgatggccacaccatgtaattcaatgcccctccctgagcacggggggcttgtagatatagcatagatcatcttcttctcgaagtagatctcggagagataaaacaggaaacaggctcaagaatacattatcttccccagtagaactctaacaccttatatctggaaagataatttccttccttatccgtcgtatttccttattcataggatatcttcttgtatgtagtcgagtatatgttattaatgtattccataaatccgtgtataggatgtatgccctatccttacactgacagaaagtatgacaacccaatgtatctcctacatttataatcaactcctctatagtaaccattgccaattgacattcgtgattttttcggtaagagtttttcacgtaaaattcgtgtctccgttgtgcatctaattttataacaaatgggtatcagagtattggagatccgttccgacatccctcgctgcagtgtttatcatatccgtcgagttcatcgttccgctgtatgaccatatcaatctgtcagcaagattgcttccgaagcggagttgtgatatcaattccgagttgtcattgcgtcgagtccatgaggaaataagcacccggcgtcgtccacaccaatctgccaagactcaatggaagtacaacagcctgtgcatgtcacatcgtccaccagggcagcagccaacgtgcacacatccactgaagagcacggttcccaaggcgcacacgcccaggaaatcaagtccttgcattgttttggttttattcggtgaatccatgttcgcgttcaatccatgatgtgtggggcacggttgtcatacccagaaattcacgaacgagaatttcaagcagaatatgtattaaaacccctatacaggaccagccagggtacataaatgacaaagttgatacacaaatccacgtcttacaaaaatataaaaaagtcctacatatgcaacgaaattaaataatcgagctaactagccaatagagctctcggataagcgtagcatctccaaatccacaagcatcctcgatggcagcaacaaccctactcctccgaataatactctgcttctaagggtcgggggaaaaataaagcaagaatgagtactacccactgtacttaacaagtcataccaaaagaagaggcatgatgcatgataatttcaaaggaagctatgcgttatttgcataaagcagcatttacaaatcacaatttgaatatagtaaaatagcagttagaaattaaactatattaaatatcactgcccaacgctaaaccacattgaaataggcccaacaaaaccacctgaactaaaccagttcattaaggcaaactactatggtgagactaatcatggtgaatccagttgatcacccataatcacaggcacaactattcgaatagttttactctgatcagaggtgtacaactgtacccacaagatacaatctcacaacacattaccgagcaccggcataccacctcgacataccggacagagattgtgacaggacccttcacataaccctccctaaccaatcaagccacacctcaggtttcgcccccacccctaaactggcaaagggcagcgacgctagtgggagctagcaacggccggagattgaagtgtggcggcggcggcaagggcaatggcgcggcggcgatgtagggcctgggagtggtggaacaaatagggaaaaggatggaggggggttttgggatgctttttaaggcgaatgtgggctcgaaggtgtccggtggtcggcaaatttggcggcggcacggttgggaagggagagagaggtggcggtggatagggttggatatcccgccgattaggaggggaaaagacgcggcgattgcgggctagttgggaggaggtggacagaggcacaggcgagcgagggcgaaaccgggagcgacacggctcgcggcggaatcggcggcggccggaggttggagacaggtcggacaggtgggccccaactatcggtgtccgaacgacggggctgttgatggtcgttatagaccaatttcgaccgtcaatataactaaaataaaggaggactagcgcttgcaatgaatatttgttttaggataatctatttccacttgtacttggattcttgtcggtgatatgggtccgagggtacccaacctgtgaggaaggccctacccccgatagccacgtggttgttggtaattcttacggtcacagataaaatccgaaagcacacggatatatcgatgtagcacttcccctacggattatttcaaagggtatcgaatccaagggaacgtgtgtggtcagatcttcctccagttcatccaagggtaccaagaaaatgataggctaggatagagaagatttactagtgagaaatagtgtctagggaaagcttaagtttaatcctaacgcaatactttaggcactggcaacccgctgttcccagatgtcactctactacatacccggatagggagggcttaagtgatctcgaaggctgtcaccacctctacacctacctcaaacgtactatgggatacgcagcaattactggataacaattacctaaacaccacgtctaagcaattaatatctactttagtgtttataactcaccaaagcaatcactatattttagttgattatagtgaacaataatcccgtatgctatttaggaactaaccaagagatgattctcacaagataaatctaaattacttaggaagataattctattgaaatcaaagtaataaaccgaataaaagaaatgagagaagattaccgacaactccggaattcttccgacttcttctactctaatctcttcctattctagtatacaatatagtacaataaagcctcttataattcaggtcaagcttggaagtgtgtgtgagggtgaaggagtgaagctccttttatagggcagttatgacaattgtgagaagaggaaatgttcgaactgccctgcaaccgccatcagggagtgatctggagcgtccatgccaaaccccaggatcaacggtgatcaccaggatttggccgaacctgtgctgggccctcctggcctaggcttcggcctgtggactccctctgctttgctttatccatttctgtaaattttgggctgattctttggtattttgatgaagttcacaactcatcctagtatggatacatgtttctccctcactttagtctgattttcctcccaacttctgggtttaacacctgcatcaaataaacaccaacacttgtggaatatgtgagatttaacatctatctctatgttggatgttttattatttggactttatacagaggttagcaatatagaattggcatttaatgaccgccaacagtggcctttcctctagggggttcggcccgaggcagggcggcggccgttccccacgtgccccagggttgggtcaccccgacccccaccacgtggcggcaaatgtgccgcgccagacaggcgctcctagcacccacctaaccgcatttaaggcggtctgagcgagcgctccacacatcaggctggtatgtgaccggtccatgacaggtctgtgaccgatgattgaagtggccgaggtagtgtgcctgcgccctggctgcatgtcaggcggcctgctgcctgacaccccccgtctcatcacaattgtgagaggcagctcagcctatcacgtctgccgaagacggtttgcctaactgtttatggcagggttcccatcttctagtgcaaatgaggaccgaaaagtcctcactctttaaatgtcgaatgacgactacgtctcctgcgtcaggcaggaggatttgaaaatcgccatcattatcgtgcacgtgcaaggcacgttttgacagtatatattaacaaacgaagaagaatctatgtaattgtttttatgcaatgcactccatataaattcttttagtaattaagacaatttcatataaactatactaacctgacaatttggatggttctctataaaaacagaataaaagcaaaaatattttatggatcaagcacaatttatacattgcactcctaaggtcaactcaatcggagtaaaaaattgattatcacaaacaagaaaagtacactaaaaaacaattacaagaaaagcttgcacttctaatgtcagtagcaggacagaggagagggagatcaattatgccatcaactttggtcctacaaaagaaagcaaggacaggagtttaacatatccgtgaggttacacaagaaaacggtagctgaggaggaaaacaatgcattttgtttaccttcaaataactattgatcaactccatctactacaccaaaccaaccgtcacaagctataatatagcattgtctccacctgggagatatattatacagatgagaaatatgtgaggttatcttaatggcatgcaacttgccacatctaataaatcaaatactaatggagggtaactattcagttataaaaccaggttttgaaaatttgcacaaagagatctatgggtaagggcgatccctctgtacttttttttttaaagataatggatagaaatccaacctttatatcaagggagccagaaaaccgatagatcatatagaatgctataaccttagatatgcttcactgataacttaagttcatgtttcaatctttagttctaactttataggtcacatatacactggagaaggagcaagacaagccaaaaagtaagacagcgcagaatgaagtgaactattaccagcatgcatggagtaggcttattcttatcacatagtaattagttatcgagttagtgtagctttattattcctgaagtgtgtttgtcggagatagtaaatatacaacacggacaagggtccgaggaaaactaactataatttacctttgaaggaagatgtggcattgctgcacggctacacctgaagccaatatgttggtatggctactgaagccatcctacaaataaattaatcataaaaatgattaaagtatcttttcaagatctgcaagttcacaagggaaaagatgggaaaaaagagaaaacatgtcatcatcacaagtatgtaccatgcagaaaacagatgcagagcactattttgggctgtgcaatgaaccctttttagaaattactcatcattggatatggtgctaatcctggatcagggaatccactattgtacacagtagatgagaaattagaggggcatgacggctgtttccacattctttcactgcgccctgacatttccatcgttaatcagtcaagcatccataccaaggcatcatcagctcacggactcaccaagtactacctgacaaccaaattatattcagtttagggttcaagtaacacattacattcctttccaatcagaaaggataacaagttagtctatctgtactccaaacatgtaattgtgactaaagaggataacatgaaaaaaaatacctctggcatgtaaggaaaaaaaatgagcagccaaccgaaagggaattgtatttgttggtggataaccaacaaagaagtaatttacaaaagttttctagaaacaccctatcagcacactgcagattttattccaatgaaaaaacagccaacgtttgagaggcaagccacgatttcagatgttgggatcgactactttaattagcatcaagcattggtctttctaaaaaatagaatggatcaatagtacttatatcaattgattaagaaatgtcaaattttgtttccataaagtggtaaaagtgcttgcaatattgacagggattcattttctagtatagatatgtaccttagcataaaaaaagaccaacaattcattgaaagaggcagctgcgtcttcgtccaccggggcaacaatgatttgtgatcctgtaattccaaatagattgcaaaatgaattgattgggcataagaaccaagcttggagacgatggtgagtagagatgtcattgcctcttctgctggtgacgcccgcgatggtggtgggtaaaacgtgggttcgtggttgtagctgcctatgcaatctcgtcgtcggagatcgcgaagcagtgacgctggcagccgtctggcagatacttcggcggcggtgaagacgtacgatcccggtccacatctggccatggcggctggcgacaacgacaccaccagaggtaggctcttctcgggatgcagcgatgggggcagcgacgcgagagtcgaacggtgaaggcggcgtagcagcgaccaggaagcaacagagtggatgacgccatgtgacctcgccttcgagcggctggaagtcggtacggtggaagatcgaaacactttaggaatactgtcaaaaagacaataatttacaaatccgcggcggctggggacgaccactccgtcggcggcggcgacggcggatggggacgacgtcgactccgggcgtggccgatggggaagaccacggcagcggtggagtgcgcggtggcggtggtggtggcggcggaagggaccgaccttggctccggccacggcggatggcgaagaagtaggatccggcggctgttggaaaagaagtcagcgtgggcggcggaaggggacaacctcggctccagcgagagtagcgctggagcaaggctgcggcctgcggcgccagtacacgcggagaggagcgaggaggaggataggattgcgcgtggagaggcgtaatcttcgcacgcggggaggcgttgtcttcgtgtggtaaaatcgtgcgggggagattggtgaaccatacggattatacctgatttgcggatggacggttgggatttaacaggtgatttcaccgggtccaactcctcctttttatattagtatatagatacatgttaggataataatattccactagtacttggttcactaaccttttgcagagaataaccataagtggaggagaattgacatcaaatcaaatgataaatcaatcgaacgatgtcgaggaccagacttatgtatgaataggccaagaactcagaattgacatgataaattgggccaaaattcacaagtatataaagtaaagcaatggaggaggccaccagccgaaacttgggctagttgggccagcccctagttcgaccgaacctcccgcagcgccgatagatgcagggttttgatggaccgctgggattgatccccaatgacggttggatggtattaccgaccattccaaccatcataaccatcattacctacctataaaaggagttcactctcttcagttcaatacacacctcaagcaagagctctctcatattctctcaagtttgtttagtattcttatgctagtggaacaggaatagagtagaaatcggagtccggaagccttcggaagagttcgggtatggctctagtagctcttctcttctcttttgtaagctttgtactttatttagaatattcttctttatacatttatggtattaaaatactttctgagtatatgaatgccaactttacattatgtttatgttatctgggagatgctttggtgcgggtataatgtttgcatatgcaattactctatgtcatgacgatgatattagagtagtatctggtagcttaggcgttgtaacaccctaaaaattcgactgacaaattcgaaaccctaaaaatacggaccttcaaaaactttttaaataaattacatcatgccgattttattcgcctattttatttggatttgatttcggagttcattgatcgtgagtaaagaataatcaattaggaataaaccctaaaaataaattggcaaaataaataattgaaatataatttaaaataaagattaggcgaggatagaaataaatagaatattatcgtgaccatattggtaataattaaatttaagtgcgatggaataagaattagccctaattaaaaattcaaataaattatataaaaataaaatatgggtaatattaatctatggtgaatcattggttagaataacacaaataatgagtaaacttcatttatgcaaaaattaagatttatagaatagaatttagataggaaataggctacaatagggttaattgggatctggcactattcattgcgcgctaggtgttcgtgtaacgaccgagaataccccaacgggcgttcctgacgtgcgtgcattaatccctgtcccaggaggcaaggtacaccaaaagttgagacaattcagagttaacaagcgcgagcgtaaat

SEQ ID NO: 83198 - DNA, 809 bp, Oryza sativa
ttggcatggctggggatgcaggagtgcacgctgggaaaggagatgatggtgaggaactactgccaacatcaaatgccccttgtccttccagggcagtagccaacagatagtcagatacagatcgagtgttggcgatagatggagcaagtctggttggggattacggttggaggagttggtgggctttgaacagaggcggaacggcgtgctccacaccgaggccagcttcgaacgccagcgaccaagggctgcagatcgagctcggcgatggaaggccctggattgacgccgactgcatgcggccatctcggatggggctctggcggaagggggaaccaccacgtcgcctgcaggggcacgatgcggtggcgtgcggcggggagtcgcgaggaggcgcaccagcgaatgaggtggtccggcagtggaccgcggcgggaattcgtacggctgagaggagggaggatgcgcacggagcgaggagggggcggctggtccggcggtggactgcgtcggccgcggggaatcaggcggggcaggtgaggcggcggggattcctcgtgctgctgagagagggaggatgcacacagagcgaggaggagggtggctggtccaacggcggcaacggggaatcgagcggagcgagtgatcgaggcggcggggattcgtgcggctgagatgagaagaggagggaggatgtgaagaggagcgatggggcggggattggagcggcggagtcgcgcgctcgggggcggagtaatcggtgggattagcacaacgatcatgatgacatgagacgacggatcagatta

SEQ ID NO: 83199 - DNA, 6944 bp, Oryza sativa
tccaataacaaatgtatccatagggtgtacatgtctcatcacttcactttccaaaaacgtatcatatgaattacttgcttcaaactgtagataaacttcttgatcaatctaatctatgtacctttccaaccatttgcctgctcttaatatacaagggtggcgtgtttcgatatggacatctccattcaaaatcaacatcgaaggtgatcttcgctgaatttgctactcgtacaagtgcaatcttctcgtacgaccatggttcaatctgtgggaagccgttgtctgaaactgttcactctgttacgtgatgtaggagtatgtgcctgtgtgtatcttctgttgtattgaaagaaatttccttgtactgtaccatacgacactttattcttcagataaagccagtattgcaaaggacctccacaattaattttacaggaaatcgatacccctcgttgtgtactttttcttaattgatcccatcacactagctcgttcgtttgactacctatgtaaccttgtactcacgctcctgcaaacaccatgttatctttgacattggctcattctctaaactaaagcttttatcactattgcacaccaggggatagagaacacataattattggatcatattttgcatactgtgtacgtaacagaagcgatcattgcccattttgattaaataattattaaattttgtgtcagctagatatgtgtacgacaaatagtatgagacagattggtagtagagtatttgatacacctggtggaactacaatattacgaaatcactttacttgtttgattttcggatatgtaaacgattttaaatgagtgtcgtacatatcttgttgagcttcacaattttaatagtacatatagaacgttatgaagaaaatatacatatgagtgacaccatttttcagagactgatacaacttaaggcgatcgtctctaaaatttaatttttcataagctttcgcttgagagttagcatcatcagaagtgggcgtccataccgacccataccgttattacatcggcaccaaggggaatcgttactagctcatcctagtctcatgtaacacatggaaggagcgtaacaatggagtattcaagagcgaggaaacagcgctacctgggatcatcaatcgcatcatagataagctttgcgagaatcctaattagcgcatacgcatgaggaggttaagtcgcgcacgttttctggcctctacgcagacgtgtgttttcctttttttcgcaacgaagcaatctcagataaaaacattctattttttcggcacaacaaatctgccgcatgtgcggaaggcttagagaaaaatatgattaacttaatttttatacgtaattagttcctactagttgccaacccgcgcgttgcacgggttactgttaacgatattaccgtgacattcaaattttgaatgatatatatcactcagattaaaataattttagtaattttaacataaatcttactttaatctttattactaaattggtagtcgttactaaatataaattttttacttagttcggagtctgaattatcattcctctattatggtttataaaacccaagttcaaaatcaatattaatacccttaataattgtaagatgcttcattagagtttattattctttataaaataaaaattagaaactataatattattggactacaaatctaaccactattacaactcaccctcctatgtttaaacaaaatatgttctttcgtagtttatggttgaataatgaacttttattaaataaatttacagatgatagagtttttcatatttaaataaaaatattcaaacatggaaaaaaaatctagtaaaatgatactttttataaaattgatgtgaaaaaagctaaatttttttccataacattgtattttcttatttttataattccaaaattaaaaattagataatgtgaaagttgattggggcgataaaaagtcgacaaatttaacatgcatatgctccatgcataatcatgatgtaataaaactaaataaagacttgatctggctaagtgtaagtcaacagagtttgttcccttcttctatgtcgctattatagcagattgaacgtgtgtgtaaaaaagtaggaaaaaaattgttgagtcacaccattagggcatgtacaaaggcattaattagtgggctctctttattgctatgtaagcatatttgattaggtggaagagagagaaaatagaaaggagatgcatcgatgttttgcatgccatcggcttgacatcggctctcatcgagataaacacgagcacacgagataaacaacgaaccgttgtatggtccatcttcaagaaaagtcgcttatttagattcaaagtgcagaaaatcacgtaatcattgctactagaatttaattactgcatatcagtggagagacgataaaaaaagccagcctttgtagaattactgttttattctgacatagcatatctatgagcccatagtgggctcaaccgttgaacgtgcccttagaacatccacaatggttatctataggctctctacaagagatccatgttagcatattttcctacttggaaaagattaaatgaagagagagagcaaaactatctacgtactaacctagagataatctatacagaaaaacgaggcaatgtattagagagctatagatacccatgtagacatattattgaggtggtttactattaatctagtctattactgagatgtacatgttttatagagagcaccttactttactattgcgggtgctcttatagcagcaccgtatatatggctctgggacttgataggcgttagcgttccatcaaacgggctgacattaattgtagaaaaataaaggcactacaaatctttaatcttttgagaagtccatgcaaacacaccgagttagctcttctccagatatcaactgcttgcatcgacaacaggccatgcctcttgccgcaagctaagattgttgactttgccgtagctgctctagagtgctgagattaaaatttactttaccggatcgtgtattcgtgatcgaataatttgtcttggtccatccatgagattcagcaaggcaatcggtatggttggtggtcacaaatcaaaaaaggaaaaaaaaaaccccgaacatatatatacatgatacacgtgggttaataaagacatttgaacgtatatttttgtagcagaaagtatatttactcaccaggattggatggctaaatcaaattactgtagagtttagttggaactgatcaatcgacctcatcgtcttaagtgcacagagaattaacatgcatgttaatttagatgcataagagcacccgcaatggtaaagtaaggtgctctctataaaatatgtacatctcagcaatagactagattaataataaaccacctcaatagtatgtctatataggtatctatagctctctcatgcattgactcatttttctctatagactatctctaggttagtagatagctttgctctctctcttcatttaatatcttccaagtagaaaaatatgctgacatggatctcttgtagagagcctatagataaccattgcgggtgcgctaaggtagacggctatatcagccaccagagaaacttgaaatcgatcatgtactttccgcactggctgccggtacgtaccaaaattagctagcttgcatgtgcctgcccttttgatcaatcagtgcccaaggttttgctttttgggcagatgcgcttcccgatgaactacttcggtctagccatccttgcactctttgccgatccagatgaagagagtacgaaggagatgcgacccccttgatcgattattaggataggtttcgtcgctaaacgccgccgatctaaacgaagagcgcacgaaggagatgccgccgtcttgtttaattagagattagagatatggtgggggtcagatccataaggagaccgaacgggctttaattggcccacagtgtaaatagatctattagataaattatttacatgatgtacggtcaggatgatacaatcgacacaatagatggttaagatttttctgattaacgtgagagctcgtagaaagtgcccaattagtataggtatagatagatagataaattaggccaatcaagataaaccttttgttctagaacattattttccttttttactacaaatttgcaaactttaaactcaaatttggaactttcaaatcaaattttgaaaacttttaacttgatttcgaaaactttcaacttggttttgaaaaaatttaactcgagatttgaaaactttcaagggaagatctaaaaactttcaactcggattttcaacttgagattgaaaactttcaagtctaaatttgcaaactttttaagtgaagatttgaaaactttcaagtcaagatttaaaaactttcaactcaaaaatttgaaaaaacgtgtgctgaagattaaagaaaaaaaatcaggaaaaagcgaaaaaggaatatcagggaaaataaactggcgcggggagggagagccagctggcgcacgcgccagttagccatcccctaaaatttggttttggtcggctacaggggaaaagagtctcttggccataatgcgcacgagaatagtagcccaaacgatcctgtctaatacaaccaaacgtagtgtggacatgcttagcatgacactctttgtcactacttttcggatttgctttctggcacatacgcgtgagcaaacgaaatcacgcgtgtttcaaatccacgcgttttgactttttctctttttttttctttttcccaccggatccccgcaagcgcacacgccagcgcgcgttttctcctctcccgtaattaatcgagtggctgcgcgtgttttctattctcccgtaacgtaacggagttagtttaggataatgacgataattaaggaaatatttccaactaagatttagaaactttcaacataaatttgaaaactttcaactcaaatttaaaaacttttaactcaaatttgaaaactttcatttcaaaatttgaaaattttaactcagatttgaaaagtttcaataatttagaaactttcaactcaaatttgaaaactttcaaattaagttttgaaaacttttaacttaaatttgaaaactttcaagtcaagatttgaaaattttcaactctagatttgaaactttcttcagattggaaaactttcaagttaatatttaaaaactttcgactcaaatatttcgaaaacacgtgtactaatgattaaaaaaagctaggaaaataatatgaaaaaaagaaaaacgtgcgaggggggaagaaaaaaaaggaaaaagtgaaaagatgggaaaaaacacgaaaaaatagccaaaaaaaataaaattgcgtgcctcccccacctcttttctctctttttctttttactccatacatgggccatcctcaaacacctcgcctgcacaggcaacaaggtgtcgttcgagtgaatgcagacggcaacgggattggcggtgcctaggcagaagaaggcggtggcagtgatgatctcaaggaagacgagggggaggagcaagaagactatggcatcgtcgtgtttgtgtcagtgtgaaggcgcagcacgctagaagctagcccagcacaatcaatccatcactcgcgtacttgctaggctagctcctagcatgctaacggcctcacgtacgtctcgctaccccgaaattctaaccctaccccgaggtgtgtcgatatgaggtcgcgagatgcctagtttgcacacgtttgcgaactagtgattctttgacccgggccagtaactaagcacgtacatctcaccttgccgctgatagctcactagagcgaaacgtatgctggagcatggattcggtaagagcaagtataatagtaggctataagcaggctaaatgctgaggtggaggagagaaaagaggatagagaggagaagtgggctgtaaacttgcagccggcttggacacaggaaccaagaaactatgtgagaaagataagtgggcctgtattaattacaaagagctaactattatatgggtaggctgagagaaagctataaaaaaccttatagccactggtggagaaaccatctttcgtcggtcggccgatttccacaatagtcccggatgcaataaaaaccggggctaaagatgatctttagcccggttcaaaaggaaaacgggcatatttgatctttagtcccggtttgtgttaccaaccgggactaaagatcatctttagtcccggttcgaatgctgtcaggacctgtcaggcccccccgggatctttagtcccggttggtaacaccaaccgggactaaagatcttaactttagtcccggttggtattactaaagatcccggtgatctttagccccagttggtgttaccaaccgggactaaagatcttaactttagtcccggttggtaataccaaccgggactaatgatcccggtgatctttagccccggttggtgctaccaaccgggactaaagtcccacccctatatatatgtcttcttcctccttcagctgcccgagcaagcttcaaaattacttcaaaaaagaggggaggtcatgccaaaatttctattgaatttattttggtgattacatacaaatcggaggtgcctaaaaggtttgcaacttcatcctccaatgtttttttttgtcatactacatttgcacctatgttttgcacacttttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaa

SEQ ID NO: 83200 - DNA, 2440 bp, Oryza sativa
cttccaaagcatacggctttctagatgtatatgacgatctctagacagatggatcttatatgaatcgtatgatgaagtaccacatgagtggatatataggaaaggaatccaaatctgccgaatcgctcatgttatgatcttctacatcctaggtctccgcgttccgtcatctggcttatgttcttcatgtagcattcagatcgaatgactctatgaaattacgtcgatacttctacatattatgggtaacgtaggagacatccctattttcccccgggggtcttaattaccactgcttagctttcaattcgcctctgaccatcaaattaaatgtgaataacccgtcctcctctctttgaaacaaggggcgcttccggttctgtgcgtgcttcaaacaattttgtcttctccatattaccatatctctagagtcaataattttctatgaggaactactgaactcaatcacttgctgccgttactcaacagttttctgttgaggtctatcccgtagaggtagtcaaattggatcagtgatcgatttctaggtttcgtcgtaaacctaattggttacttccaattacgtaaatcaatagttcaaaccgcactcaaaggtagggcatttcccattgatataggaacttttgtaccagaaacaatagtatctccaattatagcccctctgggatgtaaaatatatcccttctcaccatccccatagtgtatgagacaaatgtacgcatttcgattagggtcgtattctatggttacgattctaccagatatgtctttttgattccgtcgaaaatcgattttacggtataggcgcttatgacctccccctctatgccttgcggtaatgattcctctggaattacgacctttaccacaacggtgccgtccatggatcaaattatttcgtggattggatttcacttgcctatctatggttcccttgcgtgtgctcgggataggtgttttgtataaatgtttcgccgtattattaagtattctcctttagtttttttctctatctagaagtggaatagaataacccggttgaagggtaatgatcatacgtctgtaatgcattgtatgtcctagaatagggcccattcttctaccctttccgggtagtcgatggctattcacagctactaccttaacaccaaagaagagttcgacccaatgctttatttctgtcttagtgaatcccgattcgacattaaaagtatattgattctttcccaataaacgaagacttttttctgtaaatactgcgtatttgattccatccataaatcgactttccctcctatgctctgagttccagtatcgataagaattcgagttcttattgttcttatgttatggtatgaatataccataccaattcgttatgtatggatgatggatgagattccatggatagagagccagttccaatagacttatggaacgttccggttcgcgtgcatccagcaggaattgaacccgcaaatttaccaattatgagttgggcgctttaaccattcagccatggatgcttaacagggatcatcgtacatcgtaaataaccaattttcatatagaaagacatatcatagaaaaatgaaatcgaaaatattcggagatggcaaatattcggagatgactatgaaaacacctctctggatcctcgaattgaaagagagattgagagggatccagaatcctaattctcgctatttggaatggatccaattctattgagtctgactcatagtgatcatttctctttagcaaagaatgaccttggttatcaaaggattgaacaaccgggatccgtttacttatgatccctagttgacattgataacaaggatctaatgaattatgagtttaatagatcctctttagcagaaagacgtatattccttgctcatcacttattcccaaacctcgtatggggctaatcgttttcatttaccatctcagggaaaatccttttcgttccgcttagccctatcgggtattttagtgataggttctataggaactggacgatcctatttggtcaaatacctaatgaaaaattcctattttcctttcattaaggtacgagggcttcttattccacaagaaaagaacgaaagcaccttttcattctttcatatactgggggtttttacttggaaaagacaatgttccatactaaaggattcgggtccataaccacgagttccagtgcactagatcttgtagcacttagcaacgaggccctatgaatagacatatagaatttttggtcgggaaattcgaatgaatcattgagtgaaaaaggagcaaagaatgacaaaagacgagactctactagtcttcactcttgtggtttcctcggtttctgttttcttattcgggatcttgcttttcatggttctcatctctgcaactcgcgatt

SEQ ID NO: 83201 - DNA, 1583 bp, Oryza sativa
ctcttactgaaggggggagaaagatagagcaagaatgagtacaaccacagtactcagcaagacacaccggagatgcataattaatgcaagggggggtacaaggggataataatataggggttaagttttgcagtaaacagcatttaaaagtcacttagttgtccaaagccattttataaacacgatcctagagctatacaatattattaatcaaggtcgtggacccacacgaacctgccttaacccaaggcctacgatgattcagaccgaactggcaacccgaccctgggtcccagctcgtcccaagccaacccaggccaaccattccacattttagttgttgagcaaattttaagaatttgaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacccccgggacaggcaggcagaattgagccccctagcagcaggacaccagccctgtgccatgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtacccgaggtacgactatcaaaacccaaccacgcacctcgagcccagcctaaaaccaatttggggattttgaatagaaggagcggtgtgaagccaattccacaataaccaaaccattccatagtgtccaggtgatatgaatattcccaaagtctagagttgtaaaaccacctaatgttacctaattaaattgcgaagcatctacctaaaattaaactagtggtgccatgagtagaatgtccactagttggggttttgtttactctagggtgaacaaggaaataataacaatagcaataataataaggtcataacaaaggtaaataggcatggctaaataaaacagtgataacgcgggaatttaaataaagcgataatgcattaatttaaattaaaataatttcgtaaactgggattcaatatgctcaaggatgatgtgacttgccttgctcgctttcccaaacgtcggcttcaacttccacgaagagcggatcttccgaagctgcagcgtctacgcgaccgacggaaaagaaaaggcttttactctaataaactccatataacagcagaaacaaagcacaaaaatgggttcttgacttcttaaggaaaaattagagacttgaacggtccaattccgagttcaaatggtcaagatatggccatttgaagtttatatgctctttaaatggatatttgcgaatttcttcatttaaatttaattaaaaactcatttatt

SEQ ID NO: 83202 - DNA, 30296 bp, Oryza sativa
ctaatccaggccaggagagatccgctcagactacacggacccgaggaccccggagtccatctaggatctacttcgctcaacaccttaatatgtggattttgtacgccactatgcttctataagtggagcttgcatgttgtatgagggcgaaagcgtatccaggccctagaacagtctgggtcactgggcacttcttaccgtacttctttgagatatatgaatgctaaagtacctaggacgaggtctaggagccaatcaacctatttgctttatccctagttgctttatcctaagtaccccacctattttaaggatggtttaagcatgccatttatctcaattgtgagttaataactaatttactggggaaatggggtaccctagttcccatttcaccaacaaacaccattcgaggaatgggagaaaaagaagttaaatctctcatacttgcgcaaatggggatgtttggctaaggtcaatgttcctatagtaaaaaagcgcaaacttggaccaaagcctgtagattgtgtgttccttaattatgttattcatagtatgtgatatatattcttaatagtaaattctagagtacctgacatgcgtgttggcacaataactgactccagagatgctatattttttgaatgaattttctatgaacgatgcacctagcacttctagttaagtacctattttatcccccgagtcatttgtgccgatagaatacaatgattaaacacctggggaaaatcctaaggaggataatattgtcgctacttgacaaaggactgcaaagtcttttggtgataactacattgtatatattgtggatgacactgcaaaaaccatagataaggcatattcatctcctgacgccgactattggaaggaagcggtacgtactgagatggactctattttgtctaatggtacttgggaaatcgtcgagcgtccatatgggtgcaagcctgtacgatgcaaaagggtcttcaagaaaaagtttaggcctgatggtataattgaaaagtacaaggcaagacttgtggccaagggttatacttaaaaggaaggcgagtaatttttgtacacttactcaccagttactagcttgaccacgattcgagtattacttgctctggcagcctctcatagtcttcttgtccaccagaaggacgttaagacagctttccttcatcaagagttggaggagtagatctatatggatcaaccagacgtttatgtattagaagatcaagagggaatggtgtgcaagctattgaagtccttgtatggccttaaacaagcacctaagtagtgacatgagaagtttgacaaaacaatgacacttgttgacgttgttatgaacgagactgacaaatgtgtatactattgctatggtggtgggggcgagagtgatcttctgtttatatgtcgatgacatattaatatttgggaccaacctcaatgtgattgaggaggtcaaggacttactttccaaaaactttgagataaaggacttcagtggttgatgttattgttaactttaagctaccaagaggagatgatggtgggattacacttgcgcaatatcactatgtggacaaggtattgtgtcactttggttatagcgactgcaagccagcttctactctttatgatcccagtgtgctattaaggaaataccttagaatagcaagggatcaactgagacactcctagatcattggttaattgatgtatttagctagtgaaacaaggcgtgacatctcatttgctgtgagcaagttgagccggtttgtttcaaatccaggagatgatcactggcaagctttggaaagattaatgcgctatctaaaaggcacaataagcagaccatttcaacgagttcaacaatagaagctgaactcacagcattagacactgtcacggttgaggtcgagtggcttcgtgagctcctaatggatttgccgatggttgaaaaaccagtaccagctatcctgatgatctgtgataatcaaacattgaatattaagatgaacaattcaaatgacaacatgaagtcatccaggcatgtaaagagaagactgaaatctgtcagaaagcagaaaaactccggagtgatagcattggactatgtccagactgctaaaaatctagcagatcaatttactaaaggactatcacgtaatgtgatagataatgcatcgagggagggcttgagacccacttgaattacaaaacagtggtaacttgtcctatgtgatcggagatcgtgtgaatcaggacggcgaaacaaactattgaatgactaggaggagagtctctaaaataggtccatctctttgatgtacttcactcattttctataaggcaggatggtttataacttaatgtgatatgtatggctttcttaagcagagatgttgtcctacagaacatcttataaggaacacgcctatatgagtttgattactagtaacactctatgagatttgggtgatctctaaatactcataaaaaggtatggagtatgaagtataccctccaaacagaggggatgcaaacgacagcctagtttgagctaaggaattgagtacaaactaattgcacaagactgacaattcaaggtttagtccatttttcagttgtagccaagagttgcctcttttcaaggtggaagttcaacttaacaatctcaagcgaaacactgatataacaaacagattcagaacagagaacattttttttgtgctcttaaatttggtggagattgttggaataaatgggctagcccaatttattcctaataaattccattggcccataattaacgttaagagattaatacaatcatggatattgatgtggagagatcacaacctaaataggtagctattagagagcacatgttggccggttgaggtggtggtgggactgccacacgggggctggggcccggggctggggggttgtgggcctgggctggggcagcgaggtgaggctaggcgaggcacttgctctctctctctcgttttgcaacggatgggaaatgaatgggtttgagtcaaagcaattcaacgccattgaatcaacatcattaccattgtaacattcgagagaatcaatcccgatttgattatcagattgattctgttgattactccggtaacggacgaagatattccactccctctcgcgcactacataagaccaccaccgggacaaacagataggcatgtgtgctctctctattcatcctcactctcgcacatctcattctacttgggaaactctttgtttttctattcctactattctgcaacgtcgtctcctttgcaacggctgtttactacgtctacttcctctacatcacgatgtcttccaccgacatcagtgcaactggagtaggagggaacgacggcacacctggaggaggatggaacgacagcacaggagagaacgtcaatatcaatggaggcaataccagtgcctcattatcaactggagcgttctctgggtatttcacttctctcaacttggtgttaaacatattgctaaatgcttttgttccttttagcatattcttgtttatcaccatgctagaatcactatcctttgtaaatatcatgtttattacattaattttatggattaaagtattctgaattatgaccaaatttccaacagctacaaggttgatctgttgcagttgatgaagagtcatttcaggtttgggcttcgagcccacttaaacttgaaactgggagaagcacttgagtcggaaggaattctgtgttaactaaggctgacaacaatttctttgcatgtctacttacatgacgtgcggttaactattactcttgcaagaacctgtgttttttttaataggcacaaagtttgctacagggcatccaaaaaggtgtaattagctgatggacaccgcaagaacacaaatttgctattgggcacagaaaaaattggtaattagctgatgtacactcatagccatattttattacttctggaggaattggagagtgaaactgatgtgagagtacgattctacccctgagtcgccggtcgtcgaccacgccgctgctactattttaccgcgtcgccgtgacgctgctggaccccaaggcgctcctgctccggtcggtgaggacgcagtgggacgccgagccggtcggggtcagcttcgtcgacaccctcgccgccgccaccgacggtgccgccgccaagtactgcttgctcagccctcgtgttgggccgctcaaatctccagcctcactgcgcaaggactgtggcggcactgcgcccggagctcgccaagacgatttcctgcgcggcggcgcccgcgccggccgccaccaccgctgtcggtatgtccatgccgccgtcacccacatacacacagaaaaaccataaattgccaaatttacagaaccaacagtatgcactacctcgctggaatggctcaccaccaacgaccaccacaagcacaatcaaatacaataccccaaatctttcatatttggaaaagcaagcaaattcttcgagataaaaaaattcgagctctccataaagtcaacgtagatgtttgcaagattgatgctcccatatgcagcagtagccattgccattggagtaggctactgccatctagcggcttggagaacttgtggccggaatggcggtggtgctcttcgaggatgcagaaaggcaaaattgtccttaatgactgtttctctctccaattctgtaaaaaataataaaatatggccgcgagtttccattagctaattaccagttttttttttttgcccgatagggatgcaaacggggtgggcaagcgggcttttttttccccgcttatcccaattctagttcatttttttaaaaaaattatactaccattttggaaaatagactagtaagtgggtttttatgtgggtagcgggactacccacttacatccttagtgcccgacaccaaattcgtgttcttgcgatgtccatatgctaattacacgttttttgagtgtactatatcatattttgcctttttaatatagaaagggcaatccgtaatggttgttagaaactcccttcgctacaaaatataagtaacctagtactggattagaaaatatactgttggcccttttttggcaagaagacaaatataattgggatacctagatgccttgcgatgatatggagtcgccaaccacttcaacctagcaaaagctacattaagatgggttttgatagattaaaccggctagcagagccgatttagatgaaactagagataaacgcccgactcgtgagcgaatagaaggtttacaagacaaacctacaaaggggtttcgtactctcgcagccaaggcgcacgatttacaatacaaatcggcaaagatggatgaactaggcgaaaagtagatacagtattgaaaaaagcgattcaattggctcaattggggttgagagtagattgttctccaattgaaccggccttggcccttatataggggttcgtattgcctcctataggtcctccttcacattcaactcggagtagaaaccaatggaaatccgaaacgaaccttctcgagcaaggaaacccgaaacgaacctgacgaaaacagctcggggtcggactttgccggtcagaccagccacatgcatgtggccggttagaccggcccacaggcggcagtcagattggctccgggatggaaatcggcgctttcctaactttgcaatattttccgatcttgatcctagttgccaaatttagatataaacatatactacatatgtatacattgaacatccagattaatatactagcctgtgtttaatccagtatggtgtattagaaacggaggaattagtacacttagcaaacacggaagaatggataagaaaaacgtctcaggcaaggcgctggctaaacttgcacaatccttagttaaatgtaacatactgtattttgcattatagtagcatatgtacttgttgaaagaatttattacttccattaattgtgaggaaagtttctcagtacaaatcgtttcaaatgaaattttaattacatgaattcattaccagctaattcataagatttgggctgctggaatcagaaaatattgtgtgatatagtgtaggggccacgctgtggtggccctcgtgctgctcagtcccggggcggcacggggggagaccaggcaagcaccgtcaccactctcttccccttctctccgccttgccaccacttgagtgatgccagcaaagctgggcgggtgtaaggatagtggaggcatggctccctaccttcctctcgcagttgcggcggcttgggcgctaccaagactagagggagggcttcgggtgtcggatggcggtagccagatccagcgtccttagggccggatccagtccccacgcggtcggatctagtgccctagtcgatggatccaatggtggtcgcgatggcccaacgaggaagagaggagaagctggggctgcgtgacggtgggattacgggggagcacgatggaggatgatggtggttgagcaatggagcaatagttgcacaccgactaggggcacgtggcaggtgtaaaacctagctcggtcttgccaggccaatagcgacggtgcttcgggcaccgttttccttcttgggggtgttgtcgagcctttcctctccctttggtggggctatcaggtgatagccttgtcttggttctcctcgaggcatcgacggacagcggcgtcgatactcatcatcgatactcctctcagataggttgtgcatgcggtctctagatgtttgtcctcttgccggcgacatcctagcttatgaaacttggccatgttgataggccttgtgtggaaaagcggttcctttcttctctctcaccctctccccttcaatcccagggcatggataaagttgagtgcggtgctcggctattagggtttgattttgggcagttcggctgtagcttctttgttagtgtggcagcaaccggtccggtgttagccttcttctgggttctgtgtacgtgctgtcggtgtgtggtgatggggttttctttctttcttgacttttgccttccagggtgctagtattggaattttttcctactctattcaatctattcaatgaatcatttccgtctggtgttgttcattaaaagaaaagagaaaatcccctatgtacccttaaaagtttactcaatcccttctatacccctgagatttgctcattcccttccatacccccaaatttcagtttagatcccttctataccccttccgttagtggaccattaaattcctacgataaagtccattttgcccataggtatcaagaaaatataacattatgaagtatattaatggagtgtaaaactttaagtttattttgcaagatattatttaacaaaaataatattttagttttgccacagcgaaggcaaaacaaaaataatttttatttatgtcaaaatttatatttagaatattctttatcattaaaaactgtatatatagcatattttgtaatagtagtatgacatttttataagataaatctattgatgtgctaaataagtaatttttaataactaataaataaattctatttttatgccatatctaaaaataaattattttaaatattatttatgactttgttatgcaagatattatttatgataatttatttttgttatgcaagataaaaattatttttgttaaatactatctcacaaaataaactcatagatataatagtcgcatacaatatatttatgtactcgatcaatatacttcataaatttatattttcttcatatcaaagggtaaaatgactttatggtaggaatttaagggtgaactagcgaaaggggtatagaagggattaaatttagaggtatgaaagggaatgaacaaatttcaacggtatagaagtgattgggcgaactttcagaggcacacagggaatttcctcttaatgtttgggcacggacatatttttttaagaataaaaattgagcctctacaggccataacatgaacctatgtgaaacctgaagccaacagatatgtttttacatatatattttttcacactttctttttccaccgaagccattttatcagcaaccttttggttcgggggtggctgatgcgctcagccatgcggcgcaccgcgcacctccccctttagtctattaagtatctataagtattatgcatatactttgtatacacaagtataaactttggatcgataataaaatttttatacgtatttacacaaagtatatacatacgtatatatataatttctatatataaaaaaattgacatataaaaaatatacatgtatacaaagttgtatacgtacatatacaaagtatgtatgcgcatgtatacaaaatttgtatatacaaactttgtacaaaacgaaaaaatacatcacgtatataaagtttgtatacgtatatattaaaaaaaaacatcacatatataaagtttatatatgtacgtatacaattaaaaatagaaaaaaaccagaaataccgaaaggaaataaacaaaacagaaaaaacctaaaaaaacgcgaaaaaccagaaccagcctggcacttgcgtcccttgcccgccacaccgttccgccgccgccctctcctcgcacgccacgaggctgcgccgtgcgggagaggcggcgcatggatatccgcgtattatcgatttcgttttggttcttcttattgttattgcaggtggtgatggtggaacaggggtgttgtaatccgcttaaggttcaaatcctattcaattacttacaaattgatacgttttaatggaaactaatttatcgatactttgtgtatatttggattgaaaccaaatcattgataaaaccaataatcaattcggtattaatctctatatggtcaatatttagcttcatattggtgtgaatccaaatatgtgtaatacatcttcaccctatcaaaatattagtaatgtcaaaacttaccaagaatttgtagacaaaccatccaattaaactatgtatttactgcacttttatctctttgagtgtggtagggaaattcgtggatgtgggcatttatagtatattgttttatgcatgtttctttgacgtgatgaacaaaatttagccaattttgtcttactaatcatgtcaccatcgattttaagtcagctccacccgccagcgtgatgacgatatgacagaaagcaaaacgattggctagtagaagtactatacagtacaaaattttacaatttaattttcattttcattgaatcaacattttcaggaagaatttgctttgctgtgtcaatgaactacacggtttgctgcagttctatactactatgatataagcgggtcaattctatgtaaaatgtaacggggagagattttattgaggcaccagaaatactacatctccggcttcaaccgcagaagcatgcaaccaaaaattcgcgagtaaattaaacattttccagtgagtagttgaatcctataaattctagtaggctctaatcgtgagagcagcaaatcgtcaaagtgaccaaaagtcacttacgcaagcgatgctatacctactagctagctagctactctggtaggtagcactgctatgccactgccaccacccaccagttgttgctgattggtagtacaagtcgataccgcacgcatgcagatggttacgcatggcatttgcgaagtgatggcctaattaaccacaagtaattcgaggcacccaggaattaagtagacgaaacaaagacgatgagaatgtagaatcatatagttatatgtccgaagattaacttttttataaacacaaaagcttatctgaagactgaatagctatctagctcatagtacaattgtactccgaaaaaaataaatattgagctagccaaaaaaatcacagcacatgagttgaccagaatgagcaaattccaccgttcacattatagtgttattcaattgtaatgaagggcaaagcgttcctggaagctcacttggattctgcggaattcatcttcttctctgcttggtcttatgaagttgtgatataaggttttagggtaattttatcatttttaagaaaacaaaatttaataccttcagatattcggtatctatgtaaaaaatttttagatccctcaataaaatttaatacctaaaatctaaacgtattaaattttgttttcttaaaaattataaaattaccctaatacataatacctcaataaaatctaaaaattttacgtacttcaataaaatgataaaattaccctaatacctaatacctcaataaaatctaaaaatttttacacaaaaaaataatacctctatgtacaaaaatttaaagaccgtaaaatttctcaaggtttaattttgggttactagctatactgttggtatttcttaacgacattattaggaatataaattcccagcaatggcgccataaatggtcctggatataccgcaagcgcacggatacaccattgtagcatttcacccgagagtattataaggtatcgtatttatttaatcctaagggaagattgtaagagagaactatgctaataatgtatatatgccacttgtatgatcagagtctaagcaggggttaatatattcataagggtacagtgacacgaagcaataaactcatatatctcattatgtggaagaagaaatagaaaagcaatcaattcctatactcctagtatacactcaatcttagtttacatctgctactatacagctatatagccaataacccctaacagtgccttcctggtgtttcgagagaccagcccgggttgacaagttccttaccacaacctgtcatgaccgtccaaccggggctaaatacggaggagtaccctccccaggaaaatttcttaggaatatatactaacgtagaggaatacccatactgagctgtcaccattagtagtccaccttgactgtcccgcaacatatatgcctagataatgatacttaataatccagacaccacacctacattattaaatactactctatatccccaagaatgacatagagcaaccgaataatcgcacattaaacccacaccattgcacctctcgtagtaggctagctacacaactatatcgatacagatatgaaggtaagcccgatactcaagataagctaaaggtaccgagagtatataaagaattataagatttcattaattccgaaagtcttacaaaagaataaagaaaagctactagagccatacccgaattactccgaggactccgagagctattatattctactccacttagcactagaatactaaactaaagtgtagagagaaatgtctagcttgcttgagtgtgctttgaagtgaatgaggcctaattcttttataggcaagtaatgatggttacactatgcgaattgtccaatttgccctgcaaccatcattgagtagctatcaggagcgtccacatggaaagccgggatgagaggagctcgctagggctggcccaacatgcctccacacttcccagggtcactgacagggggcccttaaggcgattatggtagctatggcggtttctaggacagttacacctgacatgtgggcccatcttatcctttttttagaattatacagtacaacgtagacactcacaacgcacgcgcactcacccctatgaacacacgcacgcaaaccctacccctatgagcatgaagtgtcctcatttcttcttcatttatgtattaatctctgcaaataaataatactccaggtacatagctaattctcatagttaatctatgcaaataaataatactccaggcactatattattttgaaacaaatatgcattgcaagcatagctaattctcctttattttagttatagtgacagacgaaattggtctataacaaccgtcaaccaaccccccaaggttgaacctttgctcgtctcgagtaaaggacttacagagaataaacttggttgttgaccaggagttgctactatgttatatatctagaatgtacaagtgcaaaatttgagtacactatctcatattaagcaagtaggcacggtggcttaccaatacgcccaatcccgtggtggaacatgtcacgcccagaaattcccgaatagaattccaagcagaatgtgcattaaaatccccgtccaggaccagccggggtacacaaacgacaatgttgacattcagatccacgtcttacaaacatcataaaagtcttacaaaaatgcagcggaaacaaaagataactggagctaagccttgactaaactgcagcgggaacaccactccacaggcatcctcgacggcacggacgaagcctactcctcggggaaaccttcatctgacaaaaactcatcctctggggttgggaaaagtagagcaagactgagtactacccactgtactcagcaagtcataccggaataggggtatgatgcagggaattaacaaagaagagctagagtggttcatttgcataaatactggcatttataaacaggaattgaatgcgaaaacggttgtaataattaagcagtattaaacatccgctgtccaacgctaacccacgttgcgacaggcccaaccatccaccaaaactatccaaattcaaaagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacatcccggaaagaggctgtgacaggaccattcgcataaccccctctaaccaagcacaccacacctcaggtttcacccccactcctcgcaaggcagcgggcagtcccctctcgtgcctaggtgaatccggaagccgcatagaccgtcgcagggcccatccaaactccatcacgctcacccttgcctggatgcgtcggctagaggaaagctacactacaagcccagccgttgcccacgctggcttgtggtaagtacgataaatccttccagggcatcccgcgaaccggtccttaactgccatgggtgcgaccagcaaaaccatgcgcccacagcccaccatgtgattcattttaattaaccaacaccagagcggtggtactaatccaacattaccattagaaccaacagtctaaacattaatatgattttccccattgtgaactagttgaactaagcatggctaagcaattcctagtccaaactctactcatgttataaccccaagctaacaaaggagcatggtatcaaaatagtatggctgtaataataggtaaccatcccatagtaatattgcaaaacaaatgcggtatttgaaagaaaacaatagagcatttacaatataggatcaatatgatcaagtgacaagcatgacttgccttgctctgctgctggagggacctcggcgactatctcgaagtacaccggagcgtcggagggatcggaatctaacgacatacaaagcaaacattgcaaacaggctataagactactgaaacagagaacaaaaccatttttaatggattctacacattttttttgatttactgagacttgaatgggattaaacggagctcggatgaattagttatcaattttagaagattcactgtgtttattactatacaagaaaaaccttaaactatttattgcgcaatatattccagggctgacgtcagcacggagggagtgcggcgccgacatgcggggcccaccggtcagcgacccgggagagggcggtccacggcggatcgggtccacggaccggggaggagcggcgccgacatgcggggcccactggtcagcgacccgggagagggaaagaaagggcggcggcacgcggctcggcttggctcaaggccggccgaccgaccgcggcgacggcgacgacgcgcgcgcgaacgcgttgccggcgacgcatgcgaccgacgacggcaacgaccggcggcacgcgaggcggcggcggtcgaaggcgacagcgcgcgacttgaagcggcggcgcggcactaagaggagaggaaggggaaaagaggggaggggatgcctcaccgagggtggccggcgcggaggaagacgatggcgaacggcgacggcaagccacgggaggacgatgtcggcgagcggacgagcttcggggtgccctaaggaaggaggagagagggattagagagagggagatgagccacggcgaccggaagccatggccgaaggcggcggtagaggtggtgctcacccgagtgcgagggaacgagggctccggcgacgaacctcgacggaggagaggtggacggggtggatctcggccacgcgaacccgacggcggcgatggcgcggcctggcggcgaccctaacggcggctagcggcggctggagtagcggaaacggcggctgcggatgggcgcacggcgcgagagcgatgggaggctcgagagagtacggcggaatggggaaaaagtgagaggggacgacggcgatgcttaaatagggggagagaggaccggacgtggccgggagaggcgggaatcgccggccgacgtgggggagtgggggaagagagagaggcgggattcgaaaatcgaatcccggccatctcgggcgcgggcgcgagcgggagagagaggagagtgggcgcgggagacgcggcgcacgcgcgggcgtggccgacgtggcccggaggaggcggagacgtggacgcggcggcggtttcgggtgcggcggttgcgggcgcggcgtcggccggaggaaggggaaagacccgacaggtgggccccacctgtcggcgaccccgggagaggtgggaggcgggcggcctggctgggcctcggcctgcggccggcccagcaagggggagggggaaggaaaggggagaatgggccggcggcccattcgaaaaaaggaggaaaaagggagggaaaagaaaaagaaaaaggaaaaaggattttccctggaattacaatattgcttgcccaattttaactggttaaaattatttctagagctctgaaaattccactaaaaatcctgttaatgaattttgacatgtagaacttaagaaaaattccacatgtcaaatccgattattatttgcattactttcttagggttttctcctgatttgcacctgcattttcttggggtcatttataaattacaattttggcttgggaggaaaacttcggggtgtgacaaacctaccccccttaaacggaatctcagccccgagattcggaggagctggtgaagaggtgcggatgggcggctttcaactcatcttccctttcccaggttgcttcctcttctgaatgatgactccactgaactcggcaaaacctggtgaccttatttctagttcttctttcgctggtatcaagtatacgaaccggcttctccacatatgttaggtcctcctggatatcaatgtgcttcgaatcagcctgttcttcaggtacccttaagcacttctttaattgggacacatggaacacgtcatggatgccgatcatattggatggaagttctaactgataagcaacttctccccttcgttccaagattttgtatggtcccacgaagcgtggtgccaacttgcctttcgtctgaaaccggtgtactccccggagcggagtgacacgaagatacacgtaatctcctgcctcaaaagtgagctcccttcgacggttatccgcgtagctcttctgtcgagactgagcaatcctcaatctttccctgatgattctgactttctcttctgcttccgctaatacttctgttccgaacagttgacgttcgcctgtctgatcccagaagagaggtgtgcggcacttccggccgtataaagcttcaaacggtgccatctgtagactggcctggtagctgttgttgtacgagaattccgcatatggcaagcttttgtcccaagctccaccaaaatcaagagcacaagctctcaacatatcttccaagatttgattgactcgctcggtctgaccatcagtttgcgggtgataggccgtgctgaaatttaaacgggtccccagttcttcctgtagcttctgccagaattttgaggtgaactgactccctcggtcagatacaatctttttgggtactccatgtaggcacatgattctcgaaaggtaaagctccgccaaccttttgcccgtatatgtggtatgtactggtatgaagtgagcaaccttagtgagtcgatccacgactacccagatcaaatcgtgacccgatgatgtccggggcagtcctgttataaagtccattccaatctcctcccatttccattccgggatttgaagaggttggagtaaacctgctggtctttggtgctctgccttcactcgttggcaaacatcgcagagtgcgacgaattcagctatttctctcctcatgctgacccaccaaaacttttctttgaggtcttgatacattttagtgctgcctgggtgaatggagtactgggtctgatgagcctcggtgagtatcagatccttcagttccttgtcgtcaggtacacacaatctttctcccatccagattgtgccatgctcatcttcgtggaaatcccgggcttttccgactctcatgttctttttcagctctgctatctcagaatcatttacttgagctgctctgacttgatccacgagagtgggccgtgcctccagagcggctacaaacccgtgttcaacaattcccatgttgagatgctcaaactcctgccgcaattcctcacacatgccctcgatgcatagggcagtgcagtaacttttccggcttaaagcgtctgccaccacattggctttacccgggtggtagtgaatactcatgtcatagtctttgattagttccaaccatcttcgttgtcggagatttaggtccggttgggtgaagatgtatttcagactcttatggtccgtatatacttcgcagcggttgccaatcagatagtgcctccagatcttcaaagcatgaaccactgctgccaattccaagtcatgagttggataattcccttcgtgtggacgcaactgccgcgaggcatacgcaaccactctgtcctcttgcattaggacacatccaagtccgtgacgggatgcatcacaatagacttggaagtctttcatcgggtcgggcagaatcaaaactggtgcggatactaatttcttcttgagctcctcgaagctcttatcgcactcggctgtccatttaaacttctcatccttcttaagcaactgagtcatgggtcgggcgattctggagaaattttcgatgaatcgacggtaataacctgcaagtccaagaaaacttcgaatctgcgacacggtcttcggtggggtccatttggtaactgactccacgttcgatgggtcgactgccacaccctgagctgtaatgacatgacccagaaatttgacttctgtcaaccagaagtcacacttgctgaacttggcgtatagctggtgctccttcaacttttcgagtaccagacggagatgttgctcatgttcttcctcggattttgagtagataagtatgtcgtcgatgaataccacaacaaacttgtccagaaattccatgaacactttgttcatcagattcatgaagaatgcgggtgcgttggtaagtccgaaagacataaccgtgcactcatatagcccgtaccgagtggtgaaggccgtcttcggaatatcctcttcccggattctcagctggtggtagcctgatcgcaggtctatcttagaaaatactttagctcctttcagttgatcaaataaatcgtcgattcgcggcaaaggatatttattcttgattgtgacctcgttgagtgcgcgataatcaacgcacatcctcttcgtcttatcctttttctccacaaaaatgaccggagcgccccaaggtgaagtgcttggtcgtatgtaccctttctgcagctgctcatcaacttgcttcttgacctctgctaattcgttggccgccattctgtatggtctcttatagattggagcggttcccggtgccaagtcaatccggaattcaatctctctcttgggtggcatggtagtgaggtcttcggggaacacttctggatactcgcagactatgggtatatcttccaattttctcaagttcttctctacggtatccactgggatttccgtctcaatctgattcaacgagacccctttctttggtgagactagagatttgtacaccactgtttctcccttctcgttggtcaaggtgactgtgcgattcgcacaatcgatgactcccttaaacttggtcagccaatccatcccaagaatgacatctaggtctttggattcaagaagaatgaggttggctagaaatggtgatctttggatttctattagcactgaggggctaaaactgactgaggttgaactatttcccggggtatgaaccctcattggtgtgctaagctcttctttccttaacccatacctccccacaaatttctttgaaatgaaagaatgcgttgcaccagaatcgaaaagtactgttgcagggattgagttaacaggaaacgtacccagtacgacctccggtgctgtttgtgcctcctctgcagacgcgtggttgacacgagcctggataaaccttggcccggcacgcctgggctttgggcatttgtcagcgaagtgaccaagctcgccacagttgaagcaggaccctggttttgctccagtctccttcttggcttgcgcgggctggcctgactgtgccggtgccactgatgggcgtggagctgcaccgcggttgggctgacctccatggtggttctgactgccactagtgccctggggaaagttgctagggttgaacgggcggtgctgacggacgatcatggtggtaggtccaccctgctgcccgggagtgaagcgcggcctctggtgacttccctgaggtgccctgaactgagcggccttcctcttcctgtcgatcttgttgcgttgatcctcctggcggattgccttgtcaaccagcctctcaaagtcagcgtagtccccggatatcagttggttggtcagctcatcatccagacccgccatgaacttctcctgcttctcggcgtcggtgcggacatcctctggtgcatatcgcgcgaggcgattgaactcgtggaggtactgtgtcacagtcctgttgccctgatggagtgcccggaattccctcttcttttgtgccacgaccccgtctggcacctgcgccttccttaagctacggcagaactctgcccatgtgacttcagtacctggtgggcgggtggccatgtgattgtcccaccaagctgacgcgggaccctgaagctggtgtgtggcgaaagcgactttctcctgatcattgcactgcaggagattcagcttcttctctatggcatggagccagtcattcgcctccatggggttggtggtgctggagaaggtgggtggcctgacgcgtagaaactctggcaacttggactgagggggagggggaccaaactgctggtgctgctgttcgacgtgctgcatcatcctctggtgcatctgctggtgctgctgctgcatctgctgtatcatggctgccatcatctgagtctgatgtgccataacttgggcaagggtcggattctcgggaagtggtggcggaccattgccggaatctgtcacgaccggaactgacccaacgggcgttccttacgtgcgtgcattaatccttgtcccaggggcaaggtacaccaaaagttgatacaattcagagtttaacaagcggaagcgtaaatagttaatttattacatgggcagcgaaggcccagcacacacaaagacaaacgagaaacagcggaagactagggcgacgaccacaggcacttgacggcaggcacgagctagacaccaaagccttcatcttcaaggggctcctcttctgggtttgggaaaaattgagcaagactgagtacaaccaccgtactcaacaagacacacccacaagtgcagaataaatgcaagggagtacaaaggagttataatataaagggttagggttgcagtaaacagcatttaaagatatttagttgctcagggctattttgtaaacacgattctagaactaaacaatattatttatcaaggccatgaacccacacgaacctgccttaacccaaggcctacgatgattcagaccgaactggcaacccgaccctgggtcccagctcgtcccaagccaacccaggccaaccattccatattttagttgttaaccaggttttaagaattaaaacacttacttgggtacaattgctcggcttgcccataccggagggcgcggctattcgaataggttatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccacctacggccgggacacccgggacaggcaggcaggactgagcccctagcagcaggacaccggccctgtgccatgacatctcgactaccgggccgcagctcgtgtagccttcatttgccctggagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggaggtgtgaatccaattccacaataatccaacaattccagtgtgtccaggtgatgagaacatcccaaagtctagagttgtaaaaccacctaatgttacctaattaaaagcgaagcatctacctaaaatcatactagtgatcccgtgagtagagtgtccactagttggggttttgtttattctagggtgaacaaggaaataataacaatagcaataataataaggtcataacaaagataaataggcatggctaaataaaacagtgataacgcgggaatttaaataaagcgataatgcaataatttgaaacaacataattttacaaactgggattcaatatgttcaaagatgatgtgacttgccttgctcgctttcccaaacgtcggcttcaacttccacgaagagcggatcttccgaagctgcagcgtctacacgaccaacggaaacgaaacggcttttactctactaaactccatataacaagcagaaacaaagcacaaaaatgggttcttgacttcttaaggaaaaattagagacttgaacggtccaattccgagttcaaatggccaagttatggccatttgaagtttatatgctctttaaatggatatttgcgaatttcttcatttaaattttaatttaaaatcgggtttattgcatcagccgaggggaggggcgcgcggaccgggtccacgggggtggggcccacgtggcagccccacggcccacggtggaccgggcgcacccaggctcgcaccggccggcgccgtgggtccctctgaaaattccactaaaaatcctgttaatgaatttcgacatgtagaactcaagaaaaaattccacatgtcaaatccgattattatttgcattactttcttagggttttctcctgatttgcaccggtattttcttagggtcatttataaattacaattttggcttgggaggaaaacttcggggtgtgacaaactggcccaaaactaggtcaatgtgcttctcgttgattcctcggtctagctagtagtgtagtgtttgggcccatttgataatattttaatgggtttagaggcccatacacgcataagtctacctcttgatgaatttccatttgtgtagcaatatctgcaaacaagtaaagtccaagtaaaagtggagatagattattctataacaaacatgcattgcaagcatagctagttctcctttatttcggttatatagacggtcgcaattggtttataacaaccatcaacacacagctgcaagaacacatgaccacgagatccctcctcgtaatcaggaagtcatcgatgatcctccccgctgcgcaaaacaaaaacggcgagaatgcctcaccacaacgtcttgcccaacatgtcgccccgatgagttgcccacgatcttcgcgagcatctgaacagccgaaggcataattgacaagaccaacggaacaatggccatcgacaacatcgcgatcggaatcgccaaggcaatcgtctacacgagaaccaaaaccaagaccaaattcgaaatctttaagatcaacagcgttagcaggacaagaacggaggaggtcagcgcaatcatcatgaagacagtcggcgaagcggttcacgatctccagctccaaggcgagatcaagtccatgacatacgatattgagatcgcacacctaacgatagcgatccatcttcatcgtctaggggaggttcgtgacgacctcgcggtcaccgacccccactcatacccagcggcggatgcaggatatttagacccgctcttcgagaagtcaacaggccctcaaaattccatcccgtaccattggacaaatacggaggaagcactgatcctgaggaatttctatgcgtctactctactgtcctatacaccgccagcgcagacgacaatgcattgacgaattatttgccgatagcgttaaagggatctgctcggtcatggctcattcatcttgctccatcatcaatctcatcctgggcagatctttggcaacaattcgtcatgaatttctaaggcacatacaaacgacacgcagtcgaggacgatctacacactctcagacaaaacctagcgaacctctttgggacttcatctggcatttcaacgaatgatgtaatacaatcccggaaatcaccaatgcaagcatttaagttgagcgtctgagatcgctatacgatccaagagatagctacaagatggatcaccttcgccatagattgtgttaaatttctactggatgatgaaaactcaagcagttagacttaattctttcttcttttctactcaggctgaacaaaggagaaataaagctcgattattgctggcttgttgctgggaaaattgttacggagagatttttcaaaacgaacacatcaaatccactctaatatgtccaaaactcatggtatagtgttttttgaactatttcattccggtgaaaaacatctcactcgcgtgagtcaaatctgtaataaatacacaagtactccgataacttacagtggctatcaaagattccttttgaattggtcatacagaactttaatattctatgtttcaaatgacaatgcatttgtactgaatgttgatggctgaaaatttgcttaaattgatgaattggagtatatagtagtaaataaccaagttcatttgcataacctgttgaggaagttctgtttaataatccatactcaatattggattgcattttagttttatatatcttttttgggcttggaacacaattttgctaatggtatcaatatgttttctatgacggttgtccgtcggactccattcacaggaataaaccaacagaaatgttttttctgtatggaaaccaacaagaaaattgaattttttccgtggcgattttttcagctattaccgatcgtccacccaaaggaaaaaaattctaatggtaaaagcagtttttccgatggtttcgctcctactagatggtgttgacgatcattagcgatcagtttcgcccgtcaatactaccaaaataaaggagaactagttatgcttgcaatgcatatttgtgttagaataataaatattccactagcactaggattactaaccttttgcaggcaataaacataaaatggaggagaatcaacatcaaaacagacgatcaatcaattggacgatgtcgagaatcagacttgtggaaagatgggccaagaactcagaaatgacacgatcaattgggccaaaattcacaaatctggagtgagcaataggagaggaggccgcctgccaggaactgggccggttgggccaacccaaggtttagctgaaccagccgcagcgccgatggatgcagcgtttggctggacgggtgggattgattcccaatgacggttggtgggtattactgacctttccaaccgtcattactagcctatataaacccctcactctctccatttcaagacacacatcaagcaagaagcttcatacatctctcaagtttagtatagtctctagagtatagtggaatagaaatataatagaatcttcagtcctcggagtctttggaagaattcgggtatggctctagtagcttttccttcttttgtaagacttgtacttttattagattatttttctttatactactttggtattgtattattttccgagtatatgaataccagctttactatatgttcgaattatatttattatgatgctagcttacctgggagatgcaatggtgtgggtataatgatcgtatttacgatgactctatgtcatgacgatgatattagagtagtatttggtagtttaagcgtggtgtttagattactggatatcattatttggggttgtatttggggttgtatgctgcggaagcgaggtgggccgctgatagtgacagctcagggtattcctccgcgcgtgtatatagtcctaagttaatttcttagggagggtactcctccgtatttagcccaggttggatggtcatgacggattgtcgtaagaaactcggcaatcaggggtggcttctcgaagcaccaggagggtatcggaaataggatattagctaagtaatgatataactaggatgtgggtataatatatatgtatactagagatataggaatagatctttctatattatttccacttagattagataattatgaatgagtataaatgcttctgcttagtgtcactctaccctctgaactatattaaccctgcttggacttttgttattacaagtaatatataaattgtatgattctctctattataatctttccacggaattaaacaaatacgataaccttggaatactctcgggtgaaatgctacaatgttatatccgtgcgcttgcggatgaactctgtaaccataatatatcagaagtgtttctgcgctattgctgagaattatatttgtaataatatcgtttagaaataccaacagatgggacgatgatttggctagatattcgtcaagatgttacattatatagtacagcttttaagttgttgcactagcacaaaattaagtactccctccattctataatataaggcataaatagtttttaaagttgtttcataatataaggcatagatacatgcatgccattaactaacacatcttcttcaccaaaatattattattcaaattcttcaccatcaaaatctctaattttattggatgcatgtattacatttattagattaatccaaattatgaggtgataataattattttttggtttttgggttaagggtggttgtgtcttatattttggaatggagggagcagtatcacgtcgttaaagttgttgtatattgctaaaacatgggagtaataatttatttgcgaacttaatatcattatcattgttgttgttgactcctctttcatgtaaaaaaatatatatactcaaattattcaactagatggggtggtaggtaagggatctcaggatgggacctggcacccatatccaccaaccactgttgtccctgagataatagacgcgtgctttgcagagtgatccaaagctagctagtcctaccaacaatggaggtcgccgccatggagatctctacctcattgctcctcaccaccgtggctctctccgtcatcgtgtgctacgccctggtcttctcccgcgccgggaaggcgcgtgcgccgctgccgctgccgcctggccccaggggatggccggtgctgggcaacctgccgcagctgggcgggaagacgcaccagacgctgcacgagatgaccaaggtgtacggcccgctgatccggctccggttcgggagctccgacgtggtggtcgccggctcggcgccggtggcggcgcagttcctccgcacccacgatgccaacttcagcagccggccacgcaactccggcggcgagcacatggcgtacaacggccgggacgtcgtgttcgggccgtacgggccgcggtggcgcgccatgcggaagatttgcgccgtcaacctcttctccgcgcgcgcgctcgacgacctgcgcgctttccgggagcgggaggccgtgctgatggttaggtcgctggcggaggcgagcgccgcccctgggtcgtcgtctccagcggcggtggtcctgggaaaggaggtgaatgtctgcacgacgaacgcgctgtcgcgcgccgcggtcgggcgccgcgtgttcgccgccggcgcgggcgagggcgcgagggagttcaaagagatcgtgctggaggtgatggaggtgggtggtgtgctgaacgtcggcgacttcgtgccggcgctccggtggctggacccgcagggcgtggtagcgaggatgaaaaagctgcaccgccggttcgacgacatgatgaacgcgatcatcgcggagaggagggccggatcactactcaaaccaaccgacagtcgtgaggaaggtaaggacttgcttggcttgctcctggctatggtgcaggagcaggagtggctcgccgccggcgaggacgacaggatcaccgacacggaaatcaaggcccttatcctggttcgtgattcatgctctgatttagtagatagacactcactcgttcattgcatattaactaagtagctataattttttaagaaaaataataaaatatattagtatataatatattactttacaaacatataaattaaattaaatttgatttttataaataacatatagattataagatccacgttaaatgagtctacatccactcaattattagaatctgtcccctgaacttttttactgttgtctgtctacgtcatgtccaaaacactagtaatgtttgtttctcctttgttgagaatctgtttttcccacgtcgatgtgctttctgttcggaatttggtttgggaatttggggatatgcgtcgttttgcgcaccagaagaccagaacacgtacttgtcgtcatcaccactcatttgggtaacagattatcaagtagactggttgtcgggcttccaatagtaaaatctaattcgagagccctcctgttttagcgctatcattcgacgctggcagagccgtctgatcgctcgcgtcattatcgagtccatctgcgtaggcctcgcagtctactggtaattcttacgatcacagataaaatccgcaagcgcacgggtatacagatgtagcacttcccctacggagtattccaaagggtatcgaatccaaggaaacatgtgtggtcagttcttcctccggttcatccaagaacaccaagcaaaggatagggcgggatagcgaggattcactggtgagaaatagtgtctaggaaagtttaagtttaatcctaacgtaatacttcaggcactggtaacccgctattcccagatgttgctctactacgtacccggacagggaagacttaagtgatctcgagggctgtcaccacctctacacctacctcaaacgtactgtgggatacacagtaattactggataacaattacctaaacaccacgtctaagcaattaatatctactttagtatttataactcaccaaagcaatctctatatttcagttgattatagtgaacgataatcccgtatgctatttaggaactaaccaagagataattctcacaagataaatctaaattactcaggaagaatattatattgaaatcagagtaatgaacaaaataaaagaaatgagagaagattaccgacaactccagaattcttccgacttcttctactctactctcttcctattctagtatacaatatagtacaatagagcctcttataatttagctcaatcttggaagtgtgtgtaagagtgaaggagtgaaactccttatatagaggtaggtatgactgttacacgatgcgaattgtcggaaatgccccgcaaccgccatcaggagatgatcaggaccatccacgccaaaccccagcctgaacggctgagattttggttcggccgaaccaaggggttcggccgaacgtgggctaggcccacctggcctggccttcggcccatctcctccgctggtcctcctttatccatttctcggagttttgagctgagtctttgatattttgatgatcacaacccatccttgtatgaatacacgtttctcctcactttagtctgattttactcccaacttcggggttcaacacctgcatacaaatgaacaccaacactagtggaatatgtgagattaaacacctatcgctatattgaatgtgttattatctggactttatgcagaggttggcggtatagaatcagcatttaacagccgccaacatagtcgtaggcatggctttctggataaggatcgagatgaaaccactccaaccacacgtcacacgcaaatcctgctttagagagtcacagagagagaggttacagtttctcccccatgtccttttcctcttcaaacaatgttttctctcaaattacctatccgatcaacaatccgattacaccattgtgttcgttacaattaaatcatcacaacaagctctgacatgattatattacgatgaaaaaatatttatatttataaattacttttattatatatgtaagttacttttatcatacatataagttgcttttagatttgactaaattccttttatatttgacatataaaagtaaatttaataaagtctgaaagtagtttacatatattataaaattaacttaaaacaaaacggaagtacctttgtcacgacattagaagtaaattcgttgtagggataaaaatattcctttatctaaaattaaatttaattagcacaaatcaacacacgtaagtttaacaatttttaaaagtaacttcaatgttaattggaagtaacttttgcatggttcaagttgaaaggagatactagatggagtacaaactagctaccactagctgtgtagtcacgtccaatgaaaaaatgcattaattaaagttactttctttttgttatagttacttctataatatatttaaattacttttaggctttattgaatttacttttatatgtctaagaagtaatttagtgaaatctaaaaataatttagatatattataaaagtaatttattatttttcatcaaaatataatcatgtgagatcttgttataaagatttaattgttacaaacacaacgatataatcggatcgtagatcagataactagtttaagagaaaattgtatttgaaatataggtggacaatgtctctcatatatggagtggtagctggtttagacaaatcagctaccacttgctgtgtagtcacgttcccaatcgtaaaatcctccttttccgtgggaataggataatgcaccacctaaattattttaatgctaccttactctaaacttcggatatccgcacggtcttcaaagcagtgacaaatctagaatttttattttggtgtgcccacacaatcctcaaaagccaaatcagagtcactcatatacacaaatacagtaaaagttctttttttaaaggaacacaacaagggagggccccattgctaaaagattattattaaaaaagaaagaaggttacaaagcaaattacaacaaaaggatccaatctctgactacatgttgatcactcactttcaacctaaacagcaaaaggaggaagtctcctttaagaagttgcctccaagaaaaaaacaaaggtaatctgttctcaaaaatgaaaccattcctttctttccaaatattccaagcccctaaaaggaacttttctataaagcattgcccattgt

SEQ ID NO: 83203 - DNA, 1471 bp, Oryza sativa
ctattttggctgtgcacattattttgccgattgtgttttgtctaagtaaatattcatggtcgatgatggtatgccactggaggtagcatcccttggatgtggcggccgtggcatacatgcatacgaaattgatttgcagtacttagcagcgacaagaccatccttttatttctgaattgactatgcattatatatgttatttgcatagatggaagaaatgcaacgcattcggcggtccctgattgctaaagcagctggattagttgctgtaatgaatgcttacattctgtttattacaagaagagccatgcgacgtacccctaggatctcctatggcccattgtccgaaagggacatagctagacaatccaatcttagtttcatctatcatacagatgatacaaattacttaaatcagctcagaatgaagagagccccattttttcagttgtgtaacttgttacgagaaagagcgttgttgcgggacagtatacatagctcagtggaagaacaagttgccatgtttcttcttgttgtaggccacaaccacagatttagagctttgcaacccacttttaggaggtcaattgaaactatcagtagatacttcgctgaggtattattctctattggtgagctgcgaaatgagatgataaaaccaccctcatctgagcctcattcaaaaattacatccaatcgaagattcaacccttattttaaggtaaaaatttgtttgcagcgttttgactacaaaatatgttctttcaacaatcatgtcctaatatttctcactggtcattaggattgcattggtgcaatagatggaactcatgtgcttgctcgagttccatcaacaatatctgctgcctttaggggtaggaagaaagagaccacccagaatgtaatggctgcagtggactttgatcttagatttacatacgtacttgttgggtgggaaggatctgcacatgatgccctcatacttgcagatgccttggagagggatgatggtcttagtgtcccctcaggtaatagaagtgttaaaactaacgattaataaggattctcatttatctcatatgattattacactcatagcttttatctcttaggaaaatactatctcgttgatgctggatatgctgctagaccggggttccttccgccatattgtgggtgtcgataccatttgaaggagtatgatagaagaaactaccctcatgattcgagagagttgtttaatctaagacactcctctttaagggtcacgatcgagcgggcatttggcgcactcaaaaaccgcttcagaatactctataacaagcctttccatccatacaagacccaagtcaaattggtccttgcatgctgcatacttcataactggatacttcagtttgggatggatgaccatgtgccactagagagtgattggaactcagatagtgatgatgaggagtccgatgactta

SEQ ID NO: 83204 - DNA, 17521 bp, Oryza sativa
taggggaatggcgcaaattagggatgatttggctggtgctatgtggaacaatagagggtcgtctagggtctgacctgcttagggattaatttgtaactctctatctgtgaacttaggatggggtgcactgttatctattcatgcatgatgattgttgtaccctgttgcactgttatctattaatttgagacctcgagatatttgcaatgatgctgtttattacatctatcgatttatgttaaatttatttgttcatttgcatgtggtaaatataggatggctgaggctggtggcgggaatggtggccatggtggccatggtggacaccatggagccttgcattggacaaccaacatgtctagcttaatgctaaggcgcatggttgagcttatagcaacaggtgttaggactgacaagggtttcaaggaagttcaccttaaccaagttgctagatctttgtctgatcactatggaattgaaattagtagaacccaagtgtataaccatcttcgcaaatggcgtcaaaggtgggtgcgtatcactaggctcaaagaccttagtggggctctttgggatgatcagacctcaacgattatcctagaagaggagcactacatgggacatgtcaaggtttgtgtctaactatcacatacaaaacacactgcattagtacacatcatatctcactttaaatctaatgttctcatataggaacaccctaaggatgctgagtttctcaatgtgcctttagagaactatacacaaatggcaataattttttcaaataggcaagccactgggagatttgctatggggttaaatgaagcacttggaaaccctgctggtgaggctgacagtggtctgggacctcttgatggcactattggggatggtattgctgctggaccaagtggtgtgggtgctgaaggtcctggaattgctgctcgagcaagtggtgttgggcctactggtgaggattctacctcatataagaagaggaagagagcatctgctttgaatgaaggtgaagttgctctcatcagcaacatgacagattcagtgaacaacatggcttcagcaataggcgctactgcacatactgaggttcaccctgatttgtgcaacacagtgatggattttccaggtttcagtgaggatcagttggaccttgttctagcttatctaactaaggagaaggctgaaagccttgtatacattcagaagaatgaggctcgtcgtgctcgttgggttaggaagttcctgaatgagcatcaccctgagagcatctaactatttaactaactattatggagaggtggtactgggacaccatattatgtaatattgcttagatgcagattaaggtggtagtggacaccacatatatgtcttttgtagaatgttggctacctgttgattaaggtggtagtgaacaccagtagctgaatggcttttgtagtgtaaactgcagggtattgcatgacccatgttgaatctctgccttgcttcttcaatgatgattattgccactgatgaatgcttcacgccactgtttgtgctgcatatgaaaggatgcttctgcacttgctttttttatgttgttatggttccaagatgcttctgatgcatatgaagagatgcaattgtgagagatttccaagatgattaagattaatagtgttgatttgtaatgcataataacatatttcctgcacttagttcttttttgttagggtcaagctggaaaatactgcaattgatgattaatagtactaatctgtgatgcataagaacatactatatgcacttgtcattttaccagattgcatatgtataacaatttattactaatataccaattggtttagttttgtataacatcaatgtaattgtatatactcaaagaccaaaatatttgatctgttccttgtatatactcaaagaccaaccaaataaaatagacgtgcatagcaatattttaagcaatttagctcacaaataatagtaagccaaagagcaaataaaattttaacacgacctcatggagtaacctcaccgcacagaagtagacacttgagaaaattttcacaccacaaacttattagggtaacctcaccactcataggagagggtgtttacacccaagatgcatccatccaaccaaacaacatctcctgcatgcaaccattccaccaatcctttgctgcaaccaaccaaacatcatctcaacagatccaggttcatcagatgcgggcaaccaaacagctgcatgtgtatcctctcaaccaggccagactcagcctggatggaagagatgagccaggctaagggaatacgagcaaccaaacgcaccctaaagggatacaacatatcctaatattgtgaatctggatagactctttattcataattgtggtattaggatgtaaattcgtaggaccagaatgtgtcacatctctctaaaatctcttatattatgagacggatgaaatagatagtgcgtacaggcaagcgtttgttacctcctcgagggtcgtttttaggatcttgaaatgtgtcatgaggatcagactcaggttcgagcggaccaactggcagccaaggaagaaccgatcgatcccatatacatgagagagaatagataattggaaacacacatattagagtactcattcgttacggcgttacctggagaagaatggggttccgttttaggatctttacctgggtcctgcaggctatgcattggaccaatcgacgtcttagtaactggaccatgaggaaggagaatgaaagggtgagagctgggtcattaattagctagggaagggatcctctgacatgatgattttctcttgatttcacgtcggaggatccctttccggtcaccagggccacgtcgtggcttggatcatcaaactcatcgagccaaggcgaaagtgctatagctaagagcgtgttaattaattacctggaggaggcttggactcgcagttgggtgatatgggacggaccacggcgcggatcgtcagctctatgcttaacccgggatgttctactagaacgggtgttagtttcagttgacaagctgcaattaatatgccaaacaacagtgttaacagaaaactagcaatacatcatcattcagaacatacaaattaacacagtgcaacaccagccggtaattaatacatacctggagcggccggaggctcgacggccggcggagcagaagcagcagcagcgtcgccgcctgcagaaacgggagtggctgccacgacgctgctgataacgggcgccatcttcctgctactccttttggctgcctagctagctagatgtacgtagtattgtgtactagtgtgtatactagagatgttcgcttctacagttctactatatatggctatttatatatgcgtttcatatatcgatcagattcccatgacagacctcagtcacacctcttatggttattttttttatatgtggttcataaatagatcagattcccgtgacacaccaaacaccgttgaaccgtgaagaagctagaggcgtgcgtctacaccataaattaaaatagagtgaattagatattaggccacatcttattactagacttgcaagttagactaggggtaaaccaatattgtcactttgcgataaaaaaaaattgtcactttgaaataggtagttttgcacaagtttcatattggactggtgtttcctaattctcctctttctttgcttcattaagttgaggccgatgtctattagctcgagcatggtacaccaatgccactaatattgtcccatgctcgagagtgatcagatggcatcagtagtgggctctttgatttagaggaagaggagagggtggtgttaggtgaaacaaatggcaatattatgtggtctaaagtgaaaatcttggctaagacctcgtccaacccgcaacaagggtcaaaatatatggcctaaactgtaatttactcaataaaatatggcatacaccctctgttataaaatatacaaatttagtatgggatatgaatactacgaatttagacgacatcgaaattgagagttagaaaattactggagaaagaaatgtggcataaggttcagaccaaaactcggtggagaaatgaaatggttcgtctgtcaactatcaagtgctttgctcgtaccgccggctagaactctacatttttagataaatgatcacctactgatatatcaactctcacgaacaatgctatagacccccctcatcactaaaggcaaccgcaatgtataagttgaaagttggtattaacgtgaggcctcaagtagaaataactttgtgagacttaacaatatatattgtttggctaagaaaaataaggtggggtcaacccataaaaaatcatcctctaccttctttgaggtattccacgagtgatatgcttcccatgtgcaatcttttttttttcttttttttttctttgttgcttgcttgttgtaggtagtagtgtaaagacctgtaactattactacctcctcgcacaatgtgtactactagataacaaaggtatattaattgtttactacctggtttctaccacgttgtggttgctccaagggctcaaaatctttatctgtaatgggcaagccagtcaattaaaatttttgccggtgatgtggaggcttatctatagtggctcaaaatgatgagctgttagtgatatgaaaaatccaggcaacaaaatggaaaaaaaaaagaatctgctcttcctacccaagattgtcagtatcccgatttgtatcctagtatcttacgatactacgatcctaccaaaccaaaacgatatcgatcccacctagtatcctaattttcataatatctcgatcctactattcattactacacgatcatatgaaatcttaggtgatatcccgattctacgatccctacgatactacaaaatattatttaaaataacatggtttgaaaataattaaataaatatgcttaaatttatataaaactcagttaaatatatcaaaaccaacatgatttctctcgataaatgtctctatttgcataacatatatcattattaatttttttatatagaatggctatatataactaatataaatattaattaaacttaaaaaaaggaaaatcgcatagtatcccgatactacaatacgatattactttgagcaaaacgatattatctagtatcccgatcctgacaaccttgctcccaccgctatcaaagcactcgctcaaagccgctcttgccagctcaagctcggagtggctgtcatcgctatgcccactcgatgtagtcatcgtcgccgcttttccaccgcaccacccctcttcatgccggcttgagctcagagtggtcggatctagggagaaacggtagtaaggcaagacagggtggcagaagagggttggggcctgggggacaccatgtggttgccgagcatgctcaaggagttcaccatggctgcatcagtcaaaggtcaacatcatctctgtggctgtcgccgtttatcatcgagtagctgacgacgatgacgatagcggcaacagaggtgcggtacatgagtgggaggctggcaatggtgtggcttagggggaggatggacaacaccgccaacatgtgagaagtggatccgatgtagcactaccatgtcactgaatgtggagatggggcaggcagaggtggaaaggcggtgaactagtggagcgagcgatagagagggtggtggactaggaggaatgcggcataaaatcactattaagagcatgcctagctatcacattttgtaacagaatgaatgaagttaagttggacaattgatgtgtaattttgttgaatgaatgaagacattgtttaatcaatcaatgagtgaaatatagttttgtttaatgaatgaacggtcactgtatgtggtttgaataatcttagactgaatgtgggtcagcaatgctaatgcttgcgtcatattgttggtctggaattgttatcgtcggcaaaaatatgttggtcggtaaaaataatgtcggccggcaaatctaaacaactagaatatattgagtggtcagttggcaaaaatatgtcaatcaggaaatgtctttgccgactggtactggtcatctacaacaactcataataaagagttgttttaattagaaggttatttgtaacaacacctatttaggacatattacacacaatactccctctatttcacattatgagacgttttagtctttacatctctcatatagatttactaacatccatatgaatttaaacatgtagataaagcacatacatggatctatatgtatgaaactattcaaatcccaaaacgtcctataatttagaacagatgaagtaattatcactaatgggtctaagtccctgtagatacttttgactgttgatttaaatagccattatatatataatcatatgtaacatgttttttttaaccgccacaagtgacacattaaagatgtgagattctgtagaagtatttatatattttatgattactctctattttaatggaagatatgctttcaaatacacgtggttttactagcgactatccttggtcagttcggtcagagttatataccaccgcatctctgcaaagcatatataatttacttgccagttacgaaaattactccaacaacccatcggtaaaaaagtttagggtaaggcttttcaaaagccaacctagaatcatccatgccaacttaaaagtaaggtcctaactaagggcatgttcactttgatgccattttcaaccttaccaagttttggtaaagttaccaaaaaaagtggcgccctaaaccagcaccggggcaaattccaatcagtgagggctagttatttcagtgtggtagagctgtcctcgttgatgagggaccattagatgatattataattttatatttaattaaaaaaatagcataatgtgcattaggctggttggtaggatattctactccagcaatagactatagaatcggagcgcccgcggtaaacattgccgatatagaatattaacaagacggaacagagcgcacaccgttagattatatgttttgggacagccggcctatcaagacttcactacttaaaaattacatatagaggtcagcgctagatgtgtcagaacaactaaaaccagcacccatagtacatttcctatctccacatacaaaaccggcacctttaatatattatttataggtatcagttaattaaaaaccaacacctatgataaggtgccagtttcttttagaaaaccggcatcaatcccaaactgagctgaaccgggcaagccgatcacgtgcccttatccaccactcgttgtccgcctcctctctcttgctctcgccacctcctcctcgtcctcctccccgtatctggcatcggcggcggtggcttttcccgtggcggatacaacggtggcagtgtcagcagcgggtggggcggcgttagcgggttctcccacggcaggtccggcagcggtgaggtctcccacaacagattgggcgttggcggcaggtaggcggcatcgacgggtgttcccacgacgatccggcatcggtggggttcccgcggcggatccggcgtcgccggtgggcgggaggggaaggcggcgggctacaaggcgagagtatgagggggagaaggaggctcaccctcctctccatatggcaacggtggcagaggtggagaaaaatgccggttgcatcgtgttcttgatgttttttatgttaatctttttgatgttcttgatgttttttgtgtttatgtgttctttgatcttgtcaggatgaagtggagctacttgagcattgagccgctttttttttgttcatgtaacctcaaaggtgtcggttcctaaaccgacacctttgagaacatctcagaggtgccaataatgggtgccgttgggaaaactgcactgtcagtttttatccggtaatataccagacagtgctaccaagagcaacactagctgtttagaaaccaatagagttgtcgaatatcactgttggttcatctcataaacctgcaatgatattcatttccagccaaaaaatagattcataacttgatttacatttacatccatttcaaattgcacctcaatttgattggagaaaagaacgaatttgcatacatgcaaatgctccacgtatctacatacttgcatacacacagcaacaacgacaaaacttcacaacttgcagcaatagctttcacaagttgcagtaacaacaaagttttccaacacacaagttgcagtaacagcaaagttttccaacatacttgcagtaacttcaaattccaacttgcaagatttgcttagcaacaagaatctcacaactagttggtttgtgtgttgtatcgacatggcgataacttgttaaatggactctagcaacgatagtctaggctcccttgacatcgcggaatctagggctaccatctttctgatgaaacttaaaaggatttccaaactagttaagcatcattgagtgcctcatgctcaaattaagatgaatcgagtgctcatgctcagactaagatgatagattgatggtagtgtatatggtaagaatgaggaagaatctagttactactcctatatagtaggatagaattagtttatgaaaaatataagcgcacatattatatttattctttaaataagtcacgacattaaatttgtaaactagtagaaccaactcaaatgatctaaacatatatacgagaaagctacacatgaataaatcaaatagaaaacatgaagacgagcatatggatgatatgttgtgtggaggcgatggctcaagaaaatgtacacataaataaattaaacattcaaaacatcaggacgagatctagacatatatataagaaaattacacacgaatacatcaaacatacaaaatatgaagacgagtatacagacaatatgttgtgtgaaggcggtggcttggtactctaaaacgcataaccaaacgagaaaagtcacacctaattttttcggactctatgccaattcatcggagaacccgatgagatttcaaacacaaaattcacacgtatgtcacgtgtgcacgcacgcccctggagcccagccaggcgaagcgaggtgagcatgtacacggatgtttctccagttccctctacaatatatacattgctcaaatggctagaagagtattcactcttttaagaaagtctctcccctataactagctatgtggtactaaagtttcacatgcaactcttttcatgaggttgatctttatgatttttctaagaattattttcttcgagggctaatgcccatactataagtctaacattagtttctttcttttatttagtattgtttggttgatgacttatactttcatcccaacaacccacaagcccatttgcgcagcatatcgtccactattccacttaattagtgcaatttgcatttgcaatctcatttgtatccgtttcacacttgcacttgcaaacagaacgctcattggacagcgttggacagagatagatgattgcctccagatccagatcactcgatttataacgttgttttgttttgtttatgggtttagataccaggctgacagtctcacaccgagagctgctaccttgaccgctaatcatgttcacagattcattgctcaaagaggatgaaggcatgtgttcatatttggtcctattcttcggtcaagttctttgctccgggtttggtcaaaataactcatcatgcattcctacagatggatagatttctcagtctgtactgaagtgtgaataatttaagccaaaaatgcaggttcagaataatgtagtcgtccgtacatatagtttgctgtgagaatcttttaccagttcttggtatattgtaccccctcgttcttggaggaaacttttaatttggattgtgtttcaaatcagtaaaataaaaggatgcagctttctctctaaaagaaaaaagaataatgtactcatacgtacatagtttgctgtaagaatcagaaaaaccctctttgcctatggccaattaatgctggataaatcacatatctattttgggtgtgtttagttcacatcaaaattaaaagtttgattgaaattgaaacgatgtgatgaaaaagttggaagtttgaaaaaaaaaagttgggaactaaaccaggcctttctcagtctatactgaaatgtgagtttaagccaaatgcaggttcagaataatgaagttagtacatagtttgctgcgagagtaaggtacacatgaattcgttaccttaacacacactaaaaagaacaagtattaacggcagttccttgatctcactaaatttctgttaaaaacacacacgcgtgtaatatttgtggtactaatatttgaatcctactggagtccaccacacttatggtgcttgcatcaattccaatgtccaaaactaatattgttcgactaaaaccagttcattttgcggtatgtatttgctaattgtttgtttgattggattttctagaaaacttattcgttggtatacaacttttagaagacatacgtgaatgtagaattgtgaataatataggagtaattgctgacagcttcccaggagtgagagataaattcagctgaggactatataggctgaattctcgattgcccatgacagtatatacacatagcaactggcaactattctagttgcaaatgaaataactagtgagaacgccctcccaagcccccaacatcatactgaaaaacaaccactggtaggtacaaatattcaaatgtggttgaattgcattgcaaaaaacgtgtattcatggatcatacaagttcccaccgtgtcatggattagatcgaccagatgcctggtaccatagagagtatttatgtagcgtagtactcctattacaaagcaagttttcatcaactatagaagcttagccacacagaactaaatggcatgtttgggcgtcttgtcctcaggcattgtttggctttgcctatccattatctttatgattctaccaatagccatcagtgatgaacatgaaaatgatcgtcaagctctcctatgcttcaagtcccagctctcaggtccaccgggagtactagcctcatggagcaatgcgtcccaggagttctgcaattggcatggtgtcacttgcagcacaccatctccccgtcgtgtcactgcaatagacttggcatcagaaggcatctctggctccatatcaccttgcattgccaacctcacctctcttacaatgttgcaactatcaaacaatagcttcaatggcagcataccttcagtgctcggtctactcggacaactcaacaacctcaacctcagcatgaactctctagaaggtaacatcccttctgaactttcttcatgttcccaacttgaaatcttagatttgtcgaacaatttcatccaaggtgaaatcccagctagcctaagtcaatgcaatcgtcttaaaaagattcacctcagcaagaacaagctccaggggaggatcccttatgcttttgggaaccttcctaagcttgaaaaagttgttcttgctagcaatagactcaccggcgacataccagcgtctttaggaagcagcctttcgctcacatatgttaatctcgagagcaatgctctcacagggagcataccacagtccttactgaatagttcatccctcaaagtacttgtcctcacgagaaatacccttactggagaaatcccaaagcctttgttcacctcctcaactcttactgatatttaccttgatgagaataactttgttggttctataccacatgttactgccacccctctccctttacagtatctatatttagggggtaacaaactatcaggaacaataccttcctcattaggaaatctttcctccctacttgatctaagtctcacacggaacaatttaaccggtagcataccagatagtttaggccatattccaacactagaactgttgaatttgaatgtaaacaaattaactgggcatgttccatcatccatcttcaacttgtcatccctgaaaagtctagccatggcaaataactcactcacaggggaattaccatcaaacttaggttatacactcccaaatattaaaacattaattctgtccaataataggttcaaaggcccaatcccacctactcttgtcaatgcttccaatctgaaatcgctgtacttgcgcaataatagccttactgggctcattcctttctttggatcattgctaaatttggaggaagttatgttgtcatacaacaagctggaagcagctgactggagttttatttcatcactatcgaattgctccaaattgacaaaactattgatagatgggaacaatctcaaaggtaaactgcctcgttccattggcaatctttccagtagtctcaaatggttgtggctaagagacaacaaaatttctgggcatataccaccagagttgggaaatctaaagggcttggaaatgttgtacatggattacaatcttttgacaggaaacatacccccggcaattggaaatttgaacaacttggtcgttctagccatggcccaaaacaacctgtcaggacaaatccctgatacaattggcaaccttgttaagctaaccgatctgaagttagataggaattactttagtggaggcataccagcaactctagagcattgtactcaactggcaatactcaaccttgcccataactcactagatggaagaataccaaatcagatcttcaaaattttgtcacttcccaagagttggacctgtcacacaattacttgttcggaggaataccagaggaagttggaaatctcattaatctgaaaaaccttagcatctcaaacaacaggttgtctggcaacatcccatcctctcttggcaagtgtgttgctctggagtctcttgagatgcaaagcaacttattagtaggaagcataccaaaatcttttgagaagttggtaggcatctggaatatggatatttcacagaacaacttgactggaaaaataccagattttctttcaaacttcagtttactatatgatctgaatttatcattcaacaattttgaaggagaagttccagcaggtggtatttttcgtaatgctagtgtggtatcaatagaagggaataatggcttgtgtgcaagaacatcaatgggaggtataccactttgctcagtacaggttcacaggaataggagacacaagtctttggttctagtcctaatgatagtaataccaattgtttctatcactatcattctattaagttttgctgcatttttttggaggaagagaatgcaggttactccaaaattgccacaatgtaatgagcatgtgtttaagaatattacatatgaaaacattgccaaggccacaaataagttttcttcagataacttaattggatcaggatcatttgcaatggtttataagggtaatttggagcttcaggaagatgaagttgccatcaagatttttaatcttggtacatatggagcacacagaggtttcattgcagagtgtgaaaccctaagaaatgtccgccatcgaaatcttgtgaaaatcatcactttatgttcttcagtggatgccactggggcagacttcaaggctttggtgttccaatacatgcagaacgggaacttagacacgtggctacatccaaagtcccaagaacttagccaaggaaaggttctaactattagccaaagagttaatattgccttggatgtggcgtttgctttagattatcttcataaccaatgtgcaacgccactaatacattgtgacttgaagccaagcaatattcttttggatcttgatatggttgcatatgtcagtgactttggcctagcaagatttgtgtacaatagattgactgcacatgaagatacctcaacaagtttggcttgcctaaaagggtcaattggatacatcccaccaggtaaataggcttccaaacttttgactcagtttgttctttatatacttgtacagaaattttaaaaaatagagcctagccttatagttttataaaatttaatgcagagtacggcatgaggaaagatatctcaaccaagggtgatgtctacagttttggaatacttttgttagaaattataattgggagcaggccaactgatgaaaaatttaatggcagcacaaccctgcatgaatttgttcatggagcatttcccaataatatctacgaggtagttgatccaaccatgctacaaaatgaccttgttgcaaccgatgtgatggagaattgtatcattccattggtcaaaataggcctatgttgttctgtgccactgcccaacgaacgaccagaaatgggacaagttgcaaccatgattcttgaaatcaagcacgcggcctcaaacaggcatgtcagattaagctaacagctgccaggttctatttcatttatagaagaatataccaatataacatccactggatatttcactgtaaacgtagtatagttaatgacctcattagaagcttgaatggtagccacaatgcttgcacaggcatccctagtttttgaatgttgaaaccttttatggtttatattgtgcgacttacttgttcatcctctaatcactatgaagaaacatcgaattatgagtctttgagattggctcccttccatttttgccatctccggtggctaccggacgctgccgtggtgtatgaaaaacagcatacgcaaaatggtagctagtgttctacttgaatgacactggttgtgtttcagctacctttccatttttcatttgcattctgtatgtttagcgacatgcatgtttctcaatccaccgaaatttacttatcgtggcattagcatttcgtgtcgtttcttttgatataggatgataattcataataaaatgtaaagcagcataaaacatttgtagcctggttaaggacttgaagtaaaagagtagtagagacgtagagcggtaagcatatagaatgtcatgctgtaaacttactccacttctatagatggtttaggtagccaggtaggcaccgttcctgccaagttcttcaaaagcaagggttgaataactatgagcaccaatcaaattgtaaggaactcgaccgatttgcatagccctcgcccaacgggatacatcaagtaagaccgtcaaaatcgattaggtattttggcaaccaatttcgttgggaactaattagtctccgatcaaagccaaattataggtgtttgcagaagctggatttgggtcagattccaaaaccccaagttcaaacatgaccccaacacgaaattagcccaatgaaaggcatagattggagaccggatatatacagatcaatctcacaccgacctaattagcagaaaatcagatgatagatcaagcagataggcattcataggactggatagggggagcacctgctggctgcttgcctgctcgtgttcctgctaggctgctactctcggagtcccagctgccggcgccgctcactccagagtcccgagcggcggcgccgcccgtttcggtttcccttgcggactcgccgtcacctgcatagggcgccgccgccgccgtcggctgttgtcgtgggagcccgtcgctaggctacctctggttgtggttgggccatgaatcttgggctatcgttaccatgggaaaacggggagttgggccaggtgtctcgtggacctctcttggcccaagtcagctgtcggtatagaggtcggtcttcaaattcttaaccctgaaggaattcatttcaaaacttgtagccaagtaaaaatattcttctttttttctttcttgaaatatttttaacagaaatactatatgacaggaacctaactatgggacggcatacttaatgatccctacccgatgcgctatccgcttacaccatacattcgtggccctcctcctccttggctccttgcgatctctccatcatcctttttctcttccacctcgcttgtacatgtcgagaatggctcactgctcctcctcctcgttgtcgactcttgctcatcctcctactcaccactctctgttgttgctccatgcccctgctagcctgctcccgtcatacctggtatctaggtacaaacatgacatggcaggctgtggcttgctggttttggttgagaatctgagggcagtggtacaagcagttgcaccgctgtatgggcacggagatggcagtggcagcgctcgaggtttcgatggccgtgggggcgcgatatggtgttcttcctgtgatggggatgtacaaggatcctcttgcccttcctttttcttgatagatctaacggagcaagaggtcaaaatgatcaaatctagagcatcgattgcctcactcgcgttatgtgcagatacatcgtgcggctcatcatcctcggctagcacccgcaattataagccttaggagctgtttagttcacatactaaggtgtgtttagttcacactaaaattgaaagttttgttgaaattggaatgatgtgatggaaaagttggaagtttgtgtatatatgaaagttttgatgtgatggaaaagttgaaagtttggaactaaactcggcctatattgcctaggttagccatactttctttgtcaaacttgtcaaatgcgaggctatcaaaatccaagccacactttagccaacaaaattaaatcatgccacaccttttagagtcactaacatctaagaccaatattataaaagagaaatcttgccacacttatggaagccaaccaaacacctatctaacatggtcaaacttacttaaccacaaatatggcaacttattggcatcaaccaaacagccccttagtaccccagtacccagtacctagctaggtacgaggtaccaagctgctgggagaagcagtgcgctgtcgttgcctagccaaccgacaagctacctgccaccggtggggaatttaactatttgccacttttaggtttgccaattatccaaatgcccctcttaggtttgcacttaataatttgtcaccggagagagataattttttaactatttgccacttttgcctacgtggcgtgccaccgtaccgtgccagcgtgaaaagcaacgtggaccccaccatcagtccctctcctctccttcttatctacctccgatcgtcgccgtgacctcccgccggccccgcgttggccccacaccgtcgtcccctgccggctgcagcggcagcgcgtcgttcggccgtagcaaccacgcgaggtagaaggtccacgaggaggacggcgaaggcggtgaacttcttgcaggtctcgcggtagtgcctctccgcctgtgactcgtacgctggtggcagtggtggcgtccgatgtcccgggcggcgacgacgcctggtggtggtgtcggtgctcg

SEQ ID NO: 83205 - DNA, 621 bp, Oryza sativa
ataggccagccgtgtaggcggaggcaccactcggcggcgacggaggcaggtcggcggtgaagtcgtagacgcccaacagcagcggcataataggctagccgtgtaggcggaggcaccaatcggcggcgacgaaggcaggccggcggtgaagtcgtagacgcccaacagcggcggcataatatgccagccgtgtaggcggaggcaccaatcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccaatcggcggcgacggaggcaggccggcggtgaagtcgttgttgttatcagcaatggcggtggcgaagacaagccggcagagtggactcgcggccgatcgaccggaaagctgagacgcctcgagtccatgaccagcatcaatcgcctcaatagtgccgcgtaattatatgcgaacaacaacaaaaaatagcaagagattaatctgggataaaaataaatacgataaataatgataaaa

SEQ ID NO: 83206 - DNA, 6095 bp, Oryza sativa
gtcggtgactttccccacgaccctctcttttcttagctctcgtctcggaatgacgtagtaacatgttgttcatcatgtagtaacacaatgttttacttacagtaacaaaattaaaatttactcataatatacttatgatggatctacttttggtaagtactttttttttgaacatcatggtgcaaacggtttttaaaaatagtacatggtgtgagagatattacccttcaaagatttgtttttaagatttaactctccacaagtagtaatactaaattaaaagttttactactgcctgttttgcgttactgcaatcacatcatgtcattactacaagatgtagtaacgattataattttcatgtaatatagtgtcttactgcaattacttgataacgttactgcaagactataagttttgcagtaataaagcgtctaactacatattttgagtagtgttactgcataaacacgtggtaacgtgtaattgtcgtgcagtaacactgttacttttgtgcaaactttttgtgcagtaacaagtgtatgattagcatctgagacttttaacccatatatttttgtttcaattgctgaattactgcaattcaccacaatattacggtcaaaagtgcaataacgtcatatacatgcagtaacgctatattggagggaggaaaccaattttcttgagaagagggaggaatgtaacatacccgaattctaggattaaggaatttccatcaagactagctgaaagggaagttcttcaattttgtaaaccaaaaatttccattttaaacaaaggtgaagttgatccaactcttgcataaataaaatttgagaacaaattaaaactttttcatctttaacataggacttggatgcaacccaagtgaaagcatgcatactctcatagacatgtttgacttgagtccttcatatgcatttggatttggattgcatttggattttcgatttgcatttcataataggtttcatgaatattaactaagatctagataaacaactaaaccattagggcctagtgctagctagaggaagttaaaatagaaaccatacaccttaaaatatatcaacaaggccaatgtcaagccccacaaaactattttggtcatccatctgaagactagtcatgaacatggaagtgaccaaatagattatatcatatagggtatattctatcttaatcatcactataagcattctcttaatttaatactaaagtaaacttatgcataataggtaaggagcttatgacctgtgtaatgtaaattgtaattctaacatatcaacatcacctaggttaatgagagtccaaatataacttttataaacatttacatgcatttaggaaagggaagcatatataagacataagtcttgcgaattatctaaaataattcgtgcaagataaaatcatgggaaaattcatgtaggctctaatcaacacatgcaactcactgtaattttggtatgatttaataactaaatttggtacctcaaataaatcagtcaaactaataaaaactagattaactgtagttcttaatcggctaaaaccatactttgtctaaaagtgcattttactgcataaaagtgtataagtaaaataatttattcaaatactaggtcatttataatgaataaaaataatttttccagaatttatcttctctgtttaggtctcctaaaaattcgaactagtttccaaagaacccatattcctctaatttctgtgagtaatctatccataatttttgagtgcaaccaaagaaaatggaaactaggtacatacacctacctccagtaaaatcaacactagttaatctgatcaacacattaagtattgaagctacaaatttagaggacaaaataattccggaaattcgtccaaaaaccaagctcacccatgtttctgcctacacatctctcttccacctagtttacttcgacctgggcccccttgtcagtccctccggcttgctcttcctctgtgcaacttccctagccgaccgataaacactgagagggagagatcgagggccgaccggctctggacgccgcgcgacgcgtggccacgacgtgtcgacgccctaaaaacgccgagctccatctctgcctctcccagacgcgtcgccactcttcacccaccatcccagtgccgatccaaccgagggaggaagctccagctctccctctccacctctctttcgtcgccggccgccaagaagagggacatcgccaaccgtcgtcgagccctcttcatctctaactcatactcgttccattctcatatcaccatgccgaacaactttggttttgatcccattccatttcatcttctacagcagcgggaacgccgccatgtcatggtcgctctagggcgcgctctgtgcaccgccgcagcgacatcatcgcagttcccgcttatctggaccaagccgggccaagctgtcgcgccagcgtcttcgcctcgacctcctctccatttccccttaagaatcttgaaggatggtgctatgagtgtggagatcgtccaccgtcttcttcacctccggtcgccgtcgccattgtcgattccgcatcgtccggtgagccattgtccgattcttcgcgtatacaccatccctggggcctcactaacctcatggacacacatgcatgatagttcttggagctgattgagccatcgccgttcacccggaggttcttgccgccgtcatcagcctagctaccccagccatgtctagcatctcggtgagcacccttcagcctatagaacatacatgcacgcacccaattaaccaatacatgattgtagaagcacatgcatcaccacccgaaaacatcctcctttcgaactcgccgccggcgttactccgatgtccactgaccaagaaaagtacaggaatggaatcgcaatagcatgatcttcattttgtcttttggttgcaccctcaaacgagccatcgtttgtcgccggtgagctcgagatcgagctcagccatggctgttctgcctctctgcgtgagaaaagaagtcagggaccttgtttcgagaatttaaacaactatggaggttatcgaaaatgtttgcaaatcctgcatgtcgattgtacattaacaaattaaaattgtgttaaacttgttagacaaactcctattatttgcattatcaccttaaccccacatatatccatatccctcattcctaaccttaggaacaatatgactacaccactttatatatgaattttggagtcactaggttactataatgcttagccatgcttagaatggtcttccttgtcattatgggctcattacaaatatgaaaaattgatttagaaataatctggacagaactttaatacttgtgattttgataaataaaatgatggaaaacatggattttaggtttgggcctcaagtggtgcacatatggtgattagttgtgtaccgataggaggagagtgtgcccaaaccgacctaaggacttcactcaatgtcagttcatttcgtatacagtgcaaccaaatgtgctagtatgggatagcccaagcttagtaaattatttatggtttagccttacattctggtaggccggtgtgtatgagttcggataactcagaggaacttcctatttaccccgacatggtagtttaggtgactaagtctgtccaatacaacggtattgtgccacgtgggtgggttcccgttgtgtccgccaccacggcgttaagtttaaggcgtgggcccgccacttaacggttctaggtcatataacgtgtatggcttaggatggagtaacacgtatcgtgctggtgtaaggctaaatcatgaattttggaaaagctttgttgcgggtaataaatcgggtacttatgtatcgcgtgccatgctcttgcatgattattatttcgcatcatgtgggtaaagtgtacaaactctgcagagttaaaactaatcgattagctgtgctcgcggtcatgagcggcgtgtggatatatattgagtatagacttgtgttaattcttctaaatgctgaaatttaccttcaaattgtgatgagatttgagaatgatctccttgctgccatggaaggcaatgaggtgcatatttatacatgattaatgcctaccttgatgcccaatatgtcaagtactagcttgctgaaatttatttgaaagtaaacctgatttagaaatgttttatgcaaataaaacttgctttatgctaaaaagaaccatattatgccttccttgattatatgccttgcaagtagggtgttaggcttgtcttggtgcttgccagtacattatttctaataatgtactgactcttgctattgaattaaccttttgcttgcaggttttagatttagtctttgagtgatgcgggtaatcgactgcttcttctaggacttgaacttaatggggtaaacccctagtcggtgtgcttgtggattgggtagacaagcttccgctgttctatatatttatttggccggtcggccaatgtaactaaagtagatgtagtttataatcgctttcatcttatttgtgtttgctatgtataatcatgcttgagatgaaagtgtgaatctagtgcacatcctgggaactagattcacatgagtatgagttgagaatatttgagatgttgtagatctttagctatttttgtcaagtctcctgaatgtgtaacacatctggtcgccgcctacgagtggtttgacgggcacatctcaggctgaagttgactggcaagctaaaggcctagcaatgtctccaatattcttctctcgaggcgtcggatgtttcattatgtttgtttgatgacttgaattattcacttcatccctcaaatataatgaaagttccggaaagcctacgacaaggaaaaacggttcttgaggaggggagtacgtagatgcattttgaagtttaatcctgcacatgcagtaacacgataacatcatggtggaaacggttttaaaaaataatacatatcttatgactattgcttttcaaagattgacattttgaactttagccctccacatgcagtaatagaatgtgtaatttacagtaacaggggtttatacatgcagtaacatggttttaccaaatgtataaaattattcaaaacactcctacatcaatcagaccttgctcaaagccacctacaaacttacctatggcccacctattcgaacttcatctcgtaaaaatgacatagtaacactgcatttatcatacagtaacatatctacttggaagtggtaacatgcacctattatgtagtaacgcttctacttttgtgtagtaacaagtatacggttagcatgtgaggctttaacccatatatttttgtttcaattcctagtttaggtagtaatactattcaagaaaatgcaagacactttgttactgcaaagcttattgtgtttactagactcttatggtaacgttgtgatagaactgtagtaacgtacagtagtaacaagtaatgctattgtattactacttgtgaagagtcaaatcccaaaaagaaaagcttttaagaacaatatctctgatgtcatgtatggttttttaaaattgtttgcaccatgatgctagaaaaaaaaatgcttatcaaaagtagatccatcatgactatattttaactatatttgagcgttgttactgcatgtaaaacacagtgttactacacggtgaccgtcgcgttactgcacagtttcgcgaaacgagagctaagaagagatgggtggtgaggagagttagtaggtgggtttgactgagctttgaccggcgggagggagctttgaccggcgtttgaccgatgtgggaggtggtttttgggccttggaaaggagggggaggtgggtgtggcccttgagagcgaggggggtatagaatagttgttctataccccagatgtacaatagtcttaccctatatatattacatatatattacgcaaatatatatatggaatacatatatatatatatatatgcatatgtataaatacatatacatgcatgtatagtacaattcatttgctcact

SEQ ID NO: 83207 - DNA, 17539 bp, Oryza sativa
acgaggcggccggtcggtgaagacgtaaacgcccaacaacggcagcattaaaggccagccgtgcagacgaaaacaccagtcggcgacggcgaagacaagccggtcggtgaagaagtagacgcccatcaacgtcggcattaaaggccagccgtgcaggcggaagcaccagtcggcggcagacgaggcggccggttggtgatgttctgactgatccattcatagagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgcccgactagtcataaccaccaagcatcgggagtcggcctaggcacttcccaaacatgcatatgagtgacatgagttcgtcattaatggaacaaagtttcacggatcagaatttactactcaggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaattgtttaaaaaatacgatataacatctatagcccccgactcactagtcaacggcgaaccagttgatgtagtgaggcaaaggaaaagacaaaatatcatataaagaataaaataaatgatgacttagctttgtcgtattccctcgatgacagcagaagtagccgatgtgggaataaagcagtccatcaatggtgacaaaaacaccagtcggcgccagtggaaccaagccagtggtgtaaatgatgaagcccattaacagcggcggagtccgccaaccgtataggcaaaaacaccagtcagtggcggcagaggccagccggtcggcgaatacgtggacgcccatgaacggtggtgtgaccaaccaaccgtataggcgaggacaccattcggcggcaatggaggcaggccggcggtgaagtcgtagactcccaacagcggctgcataatacgccacccgtgtaagcggaggcaccaatcggcggctactgaggcaagccggtggtgaattcatacacgcccaacagcggcggcataatataccatccgtgtaggcggaggcaccactcggcggcgacggaggcaggccggcggtgaagtcgtagacgcccaacagcggcggcataataggccagccgtgtaggcagaggcaccaatcggcggcgacggaggcaggccggcggtgaagatgacgatgcccatcaacggtggtgtgaccaaccgaccgtataggcggggacaccagtcggcggcgacggaggcaggccggcggtgaagatgacgatgcccatgaacggtggtgtgaccaaccgaccgtataggcgaggacaccagtcggcggcgacggaggcaggccggcggtgaagtcgtagacgcccaacagcggcggcataataggccagccgtgtaggcggaggcaccagtcggcggcgacggaggcaggccggcggtgaagtcgttgttgttatcagcaatggcggtggcgaagacaagccggcagagtggactcgcggccgatcgaccggaaagctgagacgcctcgagtccatgaccagcatcaatcgcctcaatagtgccgcgtaattatatgcgaacaacaacaaaaaatagcaagagattaatctgagattaaaaatcaatatgataaataatgataaaaatcagattgagtttccccctgactgatttggatcaagtcagagaagaggagcttgtataaatggctcaaggaaaggaagggaaaacttccaaagcaaaaaccaagttgggcaattattaaattgattccatcgctctcattgataggaaactagacgcaacccctacctggcgcgccaactgtcgaaacatgaattcggcaattataaaacggggtagctcaccagacctaaaagtggatggatgtggagacaaatgatttagacatgttcaggccctctccatgagaggtaataccctacctcctgtttgggatttgaaatccgccgggtgtattatagatctgacgatctagttgtctcatgccccctaaagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccgagtcatgatctattacatattccatagatataagttatcccctatgactagtcggataaccatgccgtatgggtatggggtacccataatatccacagaacatatatcaaggaagtttaccaattgaaaattatattcagaagtcttgcagggaagacagacattatattcacggacattactcatcgtgataacaaaatctgatcagctaaaatattcaaaattgacaaaaaaattttcttgtcttccctaacctgatcgttagttttaggcaaatgaaattgacaacataaatattccttctcaaaggaggagtgtttatatttctatgcatgtgtgtttaattgttgtggagtgtggatgaatataaagagctatcaggtttctcagaactggtatttggaaaaaataacatatcctagctatatgtttagtaagacaccaagaaaatggaaaacaaaaacaaagcactatggccatgatctatggtagcagctaagaaccctggatatcatgttatctgaccttaatatgctctatggtttgccaggtgatggtaaaagtatgtcttgtaaaactaatgacaatgcaatgcatgtcattgatatactcatgtctcgtgttaagtgatggtagcatgaacggatgggttaaataaattgataggctaattggaaacttggcatgaaatgaagtaatgaactggagagaaatgtaagcactataaagaagaggtaagcttatatataatagccaccggtgctacggtacaaaatcatccattgtggcatgtttctaagttatttttagatatcctaacaatgccatcatattcagcaagagggataactatttttgttcagagcttggcttcaggattcatcacgacaattgatttttgctctacctaacccgaatatgcaatctgtaacgaagttatttggtaatgggagagacaagttaaattctaattgtgctcacagaaaaaaaattgcagtgcggcacatctaaagagggggaaatgatacaactgaaaagcacttcagaatattcagggcattcgtcatcatcgggtaaaatccatcaaacaaaaacaacaacatagcgttcgcaggtgaagtgaagagggaggctctgtgggctagggtttttagggatgggaattggctaggtgcggcggaggccaacgttggaggcggttcgtgaatcgccggagaagggcgagaggaggggagaatttccctagaatgaatgctagctttttcgctaaacacccttggaagatcaagttttacagttatgtcctttgaaccatctctaccgttgattcataatccaacagatgcgggcgcgaaccgatccttggaatagcacgtggccacgtggcgcgtttcaaagatatgtaaactttgcttctaggtttagccacgtggcccaatgagatggtagtgtttgcaccctgaaatcggtattctagattcgagatgaattcctaaggtaatagtacatatgaactgtgcccatgaaaaattcagaacttagagctgcagtttgaagatctcttcagtattgtgcccttctcaacacaaaatcatactaacctgccagcaggaccaacaagcccaaagattcatatctcatcacccgtcacaccaaacataaaaaaaaggggaacggatgcatacctctcgtcccctgatgcagaacgatgattggcgcaggtgaagatggcgtcagctgcgtggaggttgcaaccgcaccgtacatgaggggagtcttctttgtcctcctactttggattggaaaaagctgatggcgcacacaagatcgttcctgagtcatggctccgccgtctacctcctaagcacgccttagggagagggagggcagcgcctaggccaccacgctggcggtcgagcagtgagcaggcgacagcgatggacatggtggaggggaaggatgcggcggcgtgatggtgatcctgattgtcgtctcctccccagatctgacgaggccgaggacggcgagggcaggacgaggatgcccttgggcgtgggatgcgggtccatggctggagccgtgtgctcttggtctcctgacccctgacactgacgataatggtgcggattaggtcggccagcggcgcagacaaccgcagcgatcagcgagcacggcgcacggttgatggcccgggctcgtcaccacgcagcctggatgcgtcgcccgcctcccggaggagtagtcggcgctgggggaggaacaacgaccatgagcagctagccacaggactccacgaggtagcgggcaagcacctccccttgccccagcatggtcggctgggatttcagcgaatccatcggttgggcctcatttgatttggtggacggcggcacgatgaaccgtggaggagccagattccggcgacggcaatgcattcatgacgactttggagcagcaccctccatcgcgacgtagttgacgaagaagaggcggatcggggaacatgttgccaccacgaagcaatcgtcctcgctgtcgctccactctgaatctggcgacaactgagctctatagtgcagcgtagaggacggctgcgaccaacgagcactgtgcacagaggatggccagggtcgccgctccaaatccggctccagtgggactcagcttcggtgacttagtgtaggcaattcacaacgtgacataccatgcatctcggccgtccaaaataaatccaacggagatggcacttgggcccgcctgtaggtcgaaatatcgccgcccgccgcccatccagccatcccgcgtccgagacagcgcccgcccccaatctttcccgcacgcttgcatcgctgttgtgcctcgcccgcgtccggccgtcgccgcgagcgcgagccagctaggaggctcgccaccgctacgcctgccctaggccgtcgtgctcgccacgactggggaggggtccgggcggccaccgcgcgaggccaactccctgccctgccctgccgcgacccatggagaggcactaggccgccaaggccctgccctgccgccgcgaccgggggcgcgtggaggcggccggccactaggcctaacggcgcggtggtgcaggcgggcggccgcgcagcccgagcccgacgcgtggaggaggggacgtcatggaaaagtcgcccaggaccaggatgtatatggaattatgaatctgatggggcggctaatgggcgggtgatcgctccaggcgacctctttgtgcatgaaatgagaatgccagaatgaggctgtcgctttgaatgatctgatattctgtaattctgctcccattttttgtctaacggtgaatcaccaacaattctgaaagtcccatttggaattgtttaatgcaaaaagtgaacggtttttcagctgaaacagaaaggtgatagccgtgtcccagggcacaggaagaggtgcagcgttctccacaaacacaaccaccagtgactcctaccctgaacgaagatgggcggtggtgtcacctctcgccggcgacaaagtgggcggccgaccggtgcgggctctggatgcgggctcggacactgaaatctatcgtggagtcgaggccgccgaaatcaggacgtgcggtgcggcaggagcagcgcagcctcctccacgcactggactcaggttggtgggccgcccacctgcatcagcacatcatcaggcccggtggccggccgcctccacgcgcccccggtcgcggcggcctggcgcctctctgggatcacaacagcggcgcaggtgcctctccactcgcggctggcccggcggcctggcgcttctccggtcgcggcggcggccggacgagggcgaggtgaagcgccggcgtacgcggatctgagggcgagacgaagctgagtccgtctcaggctaagcgcgtcttgtgcgcgtgcgggcctcctgataggctgaaaccgagatatttcgacctgtaggcgggcccaagcgccatctccattggattcgttttggacagccgagatgcatggtatgtctcgttgtgacttgcctacgctaagtaaccaaagctgagtcccgctggtgaggcgcgctgacagcagtgcccgctgttgttgactggatcgccgatccggaaaaaaaggacgaatttggggaaatggatagatggtactccctctgtcccataatatagcaacctagtaccggatgtgacattttatagtacaatgaagctagacaccctgctgtccagattcgttgtactatgaaatgtcccatctgggacatgactacatagagaccacactctatattgtcttaaccagagactcatcttagacctggttgcatactagtacacctaatgatacatgttttttttcttcttatagattttccttttaaattatttatccgatttataatccaattacaccattgtgttcgttgcaattaaatctttacaacaagatcttacatgattatattttgataaaagaaatatctatgttgtaaattagttttattatatatgtacttttatcatatatataaattacttctcgatttgattaaattacttattatacaatcataatgttgtgagttgtttattttattatcttttttagtcaattccataatttgtgctgattaaatttaatttttagatagactcacgtttttacatctgtaacggatctacttttaatgccatgacaaagttactttctttttgtcttaagttacttctataatatatgtaaattacttttaagctttagtgaaattacttttatatgtctaagaagtaatttagtgaaatctaaaagtattttagatatactataaaagtaatttgtaatttttcatcaaaatataatcatgtgagatcttgttgtaaagatttaattcttacgaacacaaccgtgtaatcggatcataaattggatgagtagtttaaaagaaaattttatttgaaacataggtgataggaatatattttctacttacttgatggagactagtactacaggtaaggcatctagatagggtctctcgttagcacttaaacgagaggcctcttgatttagattttgcccccatccggtactaggttactatattatgggacaaagggagtagttatgggtgggtgggttacaaaactatcgcaactcatgactttgtcgcatgcgttgtgatatgcattgcgctataaatcgtcacggactaacaatattcacttaaacaaaattgttagtcctctctaatcgtattgtcattaatcatagaaaaaattaggggccttgatgcactttcatccacaaaaataaaagagagagaaaaaaagaaattatggatcagatctagagaaagaacaatggaggagctctggatttggatctgaatctgtcgccggtcctcctcctcgtcggcgtcgtccctcatcgccgagcagctgtgcctttggccctccttgcctcaccgagccgctgttgctagctccgctttgccgagccgcctccattggacctcctcgtcagtgccgagcctcgccgagccgccaccaggcggcctccttgccaaaccgcactgaccccgccgacatctttccgccttgccgagccaccgcctctggaacactcctcgccgagccgcaccgaccctgacaccgaccctcctcctcctcctcgccacgctaccgccggccctccctgccgaaccaccgccggacctcctcctcctgtcctagctgccaccgaccccgccgccggctctcctccttgtaggctctgaggagagggagagggagagggggtgagaggagaaggagaggggtctgatggagggatgttcttcaagattaaattcaatactataaagtaatatccgtaggattgctacgtaatggcatattgacatcgtgagaaaaaaacttacctagcatatgcttagctaagttggtacaccaaaatactaaattgtcaagttcttgtactaaaccgcacccacttgtcaagttgttgcactcgaacgttcaattcttaagttcttgcactggctcgcacccaccagccaagttgttgtatcgtgggcaatgttctaaatctctggctatagcggcacgctatagccggagatagcggataggaagggaaatagctaggatacttcacttttaatgctatgatttagcaaccgctaatagtggcatttagctagagatagccgatgaaataggcttgacttaggctaaaatagtcgctaacataggccagaaaaattggaaagctaaattgaaaatgggcttttgacatgcgtggcccacaaaattcagcccaaaatcaaaccctaaatcccccactcgttctctctcctaagtcccctcaactctcatccgctcctctccccaaaagcgacggcagcggctatggccaagagtgacggcggtggtcgcgaccggtaggcggtgaccctcggcggccaggcgtcggagttgaggagtagaggattcccacccttgttgtctctcactccctcaactctcaggctctcctttccccaaagagcggcggcagcggcaatggttgtgtccgggagcggcggcgggcaccgtttgcgaccgacgatagtggcggcgctaacggtttgacctgcagcaacagcggctcctcccctcgagaagtggcggcgagctggcgacattgaactgctgcaccaacggtggctgctgcttcccctggcggcggcagaggcttttccccgacgatggtaggcaccattcccccatttcaccattcctcctctcccccgccctgaggagcattacctagctacatgtctttgccgtagcaacatacagccatacagtcaaggatttagcccaaattctatcaaatttttgaatctttcttaatatctttgaaaaccactaaatgccttagctacagctatagccggctatagctgctcttagctattgtagagctcaaccgctaagaggcttagccggagatttagaacattgaccgtgggtgcaatttactcaaaaagaaaattatatcaccacccgcacactgacaacaccaacacacagatccaggagaaggctagcaccagaccggccaccgctaggccaacaacggaacacaactgagatcatccaaaacccgacccttgcaaccaacacaaagctcaactctatccaagtcttcagcatttaggaagagagggtgagagagaagacaaaacacctctccccctaggccctccgacgcggccaacttgtacaaactaggatgccgccacaagaggatgagaatcaagagcgtgcttgcaccaattgcttggggggtttcggcaaggggatgcttagacgacgtctccaagaagaggagcgacgaaacacctccaccgatgtccgtcaaggtctcaaagagagccgagaccgagctttcgcccgatagccatcgagagggcgagacggcacgacaattccctcaggaggggaatgacgctcgaacgtcatcgttgccggtccaaccaaggctgggctgggttttcacctgccgatctatcacagaagcaccatttctccaccgccatctaaacctccgctggtgtgtgggcaccattgcaccggcgccccccgccggctagtgtccgcgcgcttccaccagttgcgcctcactaggccatcggccaccagcagaggcctctctcttcccgctgcgccggccaccgcctccacgcctgcaagccacatcgcgccgcacttgcaatttggttgcgcctccacgcaccgcggccacctcctccgccaccagccgcgcctcaccggcctctgctgtcgccagtcgctccactatgcgcgagctgcctccagccagccgttgctcctcctcctgccagcgtggcatcagccagattgcttcaccgcctccaccttcgcacggccgtgcgaccacctccatatggtcgagcctctgcctccacacggccgcgccaccgcttccgcctccatacgaccatgctgccaccagcaccacacggccgcaccttgccgccttgtcgcctgggggtcggagctcggacaccctgccgcctccacgtgcttcaccaccgccagcggctcgggacggcacccacgctagatccacaccaggagagcgccggatccggcaccgccgctgccgccttcagtcgtcattggctccgcctcctcaccacgtcactgctgtggttgtcgtcgccttggaactaggtcggggttgtcggctccaagcgtcgcgacctcgggggagaaggccccgcgccgccgtcgtccttgcggccgcgtggtttccatcgggccgcttgggcggcggcgaggaggaaggagggcggcaaggggtggtgtcgcggcggcggctcagtcgcccctgccctaggagcgacgcgaggcccagtgacctcagaattgcacaacatccaatagatatacaatacatatattacaatctatattttaaatgagaggataaatcaaatcaatctatactcttggataatttatgctagctgtatttaccaccagtattttttaccataaaaattctcaacaagaggtaggttttgaccgtggcctccctctcacatactgtacatgcatatttccttatgtaccacggtacagtaaaagaaggcatcttcgaaaattgttaagtagtgctatctatgttcctctatcacgatgacacgtgggctcctctttctcttatcatttcctatttcaaaagaaccttatctattagaagttgtctgattttttttagtaatgatctcatcaatttattggatggttcagagtttcggatcatttcaccagtaaagaaataatcttttataccagttgaaaccctccccttttaatcccggttaattatagcaaccgtgaccagcaaattgagactaaaaatctcgatctttaatcctagttgccaagtaaaaaaaatatgggatatgaaattcgaactcaagatctctcaccttaatcctcatgcgtgttatcatcccacctactctacacatctaactttaatagagatgttttccttctgaactaactttgaggacatctctagtaccagttagtaacaccaaccggtactaaaaaatatatctttagtacggatcggtgttaacaagcggtactaaaatgcatctaaaaagatccactagtattagtcttggttggtgctaccaaccggaagtaaacatgtatttctaataccggttgataacacaaaccaagattaaagatatttttagggacttggtcttttagaactggtactaaagagttttagtaccagttcttaatgcatccgagatatttgtgtgtatggggcattgtataaaaggcgagttatcctgtagtaattttttcatattcgcgcgcactcctatgcctaacaccctcctcccgatgatcaccctccaacctacttattggaacggtggaactatgcaagaaaaaccggccatcacatctcatctcaagacttgagaactaaccagacttgagaattaattaactgttgcatccacacgatcgggcccccgcgtcggcccccgcgttgggcgactcgggcagtggaaccctagccaccgccgccacccatcttcgcccccttcctctgcctcgctgccacctgagtgagcggctggcaaagccggcggctcacgagaacggcggcggcggggctcgcggcaggcacaaaggcggaggccggccagagcggcgctgatgtcgaggccggcgcacgggtggaggtgctgtggacggagagcgcatgggagaaggtggtgcagacagcccgatgcacggtggatgacgggggccagagatggaggcggggattggggcggcggcggtggtgggctttcaccgcatccgtgagcgcgaagcaccggtggaggcaggcgaggagaaggcggccggcggcagggttgcagcagcggtggcggcgaggcagcggcggccgtggtgggcaccgccagatttggacccccttggccagatctggcggctgacggcagggacggcgggcgcacgtgctggcacgcgagcaatgccagcagccggaggtggatgtggggagaggaaactggcgacgggctgggctgcttgtgcagagggcacgtgatggcaacgggaggtcggcatggtgacgtcatcggttgcaaggagcacagcgctggtggcatggaggcgtggatgccttggaggcacggctggtgacggtgacaggccgttgcggtgcatggaggagaggacggcgtggtgacatggccggcgacggcggcggtgcgggtagtgccgagagctttcggtacgagcgacggcagaagtcgtcccgaccgttggtgcggagcgccgacgctgtgactacagggagctggcggcagggaggccggtgaagctggccagtggttggtgccggttcagtgcccatgagctgatggaggtttcgatcgtggcggagcattgcggcgacattggtggatagacaggtggcggacgatgggtgaaaacccagcctggtcttggttgggccagcaacaacatcgctttcgagcgttgcattccctcttgagggtgttgtcgtgacgtcccatcacctctaggggttttgccgggtaaaaactcagtctcggctctcctttgaggcctggacggacaacggcggtggtgtttccatgactcctccctggagacgtcgtctaggcaacccctaaccaaaaccgcccagacaaccagtgcaagcttgctctagatttcagtcctcttgtgtcggcgctctagcttatacaagttgaccacgacagaaggcatagggatagaacggttcgatcttgtcttgcaccctctctccctcaatcacaaaattgtggttagagtgcagttctgtgtttgtttgttagggttaggcttgggcgatcccagttgtagtccctctgttggccagaggcggccggtcacgcttagcggtgactggttcggtgctagcctcctctgaggtccatatgttggagctgtcggtgcgtgagtggtggtctttttctctttttcctggttacgatcttgtaattttttttcctgctctgtcactatgaacttcgtattgtcttgtacgagtcgttaaaaaaaacagaaaaaagagttgagaactaccgccctaccacacagatggtaacgttatatttcaaagagtttctagcagctgccccttttcctataatattcaattttcttaggtagtctagactttcatctagcttttgaaaatgtgtagctataattcagaaaataaattagacaccgaaactgaaaaaaaagtaataatcagttttgggatctaaaagctgactactatggccgtgtttagttctttggccaaaatttttttaagtatatgaagacaaatttgaagtattaaacgtagactaataaccaaacaatttatagattgtgcctataaactatgagactaatttattaagtctaattaatccgtcattagcaaatgtttaaggtagcatcacgttgttaaataatgacgcatttaggctcaaaagattcgtctcgcaatttacatgcaaactgtacaattgtttttttttcgtccacatttaggccaaaaatttttagatctaaacacaccctatagcacaaaatgttgagctcacctaaaagcaaataaaactactacaacgtggcgtgtctcccagctgccggggtagctacagcgcgcggtggaaagacatgctcagcacaatcaaccaatgagcgtacgcccagcacaggtcattcaatgagcgtgatagcgatagccataggtgctcgtgatagccatacgtgccacgacccacgaaccgcgaagcaaacatgtaacatcagtctctggaattctggccaaaatttagtagtactcgtccggtttaatgtttttttatagctgaaataaacgtatatcatgattagattctttatacctcaagtaaatatatctcaagtaaatatatatctggatcatataaaacctttcattcattactagtaatatgtccgtgataacgtcacatctcacctcaagacttgagaactacccaatcaaaaaaaaagactttagaactaccgccctaacacacagatgataacgttatgtttcaaagatcgagtttgtagcagctgctccttttcttataatcctcaattttcataagtagtctagactttcatccttttgaaaatgtatagctataaaattcagaaaataaattagacgcggaagctgaaaaaaagtaataatcagttttgggatatacaaagctgactactatggccaatttttttgaagtatatggacacatattcgaagtattaaacgtagactaataacaaaacaaattacagaatgcgcctgtaaactgcaagatgaatttattaagcctaattaatccatcattaccaaatgtttacggtagcatcacattgtcaaatcatgacgcaattaggctcaaaagattcgtctcgcaatttgcatgcaaactgtacaattggttttttcgtccacatttaacgctccatacatgtgtacaaacatttgataagatatttttgatcaaatatttttggatctaaacacactctatagcacaaaatgttgagctcccctacaatcaaataaaactactgcaatgtggcgtgtctccctgctgccggggtagctgcagcctgcggtggaaagatatgctcagcacaatcagccaatgagtgtgcgcccagcataggtcattcaatgagggcgatagcagcgggatagcgacagccataggtgctcgtgatagccatacgtgccacgacccacaaaccacgaagcaaacatgtaacatcagtcacatctcatctcaagacttgagaactacccagtaaaacaaaaaaaaaagacttgagaactaccgccctaacacacagatggtaacgttatgtttcaaagggtttctagcagctgccccttttcctataatcctcaattttcgtatgtactttagactttcatctagcttttgaaaatgtatagctataaaattcagaaaataaagtagacgaggaagctgaaaaataattaataatcagttttggtatttaaaagctgtctacgatagcaaaaaaaatgttgagctcccctaaaagcaaataaggccctgtttagatgggactatttaagtccctatcacatcggatgtttgaaaattaattataaatattaaacgtaggctattaataaaacccatccataatcttggactaatttgcgagacgaatctaatgagcataattaatccatgattagcctatgtgatgctacagtaaacattctctaattatagattaattaggcttaaaaaatttgtctcgtgaattagtttttatttatgtaattagttttgtaagtagtctatatttaatactctaaattagtgtctaaagacagggactaaagttaagtccctggatctaaacaccacctaaaactgctacaatgtggcgtgtctccctgctgctaggggtagctgcagcgcgcggtggaaatatatgctcagcacagtcaaccaatgagcgtgcgcccagcacaggtcattcaatgagcgcgatagtgatagcactggctgatagcgacagccataggtgctcgtgatagccatacatggcatggccacgaaccacgaaagagacatgaaataacagtctctggaattccggccaaaatttagtagtactcgcccggtttaatggttttttttatagccgaaagaaacgtatcatgactagatttatattgtttatacctcaagtaaatatatatctggatcatataaaacctatctttactagtaatttatccatgataacgctacgacgtcaccatagtttggttaataaattatattattaaattgcatgttattcgagttactttttctcggatcagttcaaatgagtcaggtcatatatcaaatatatttaaagaaaattaaaaaatatcatattatttgaaatgttaacttaatatgtaccatgaataattatatataatcacttcaaatattatttaaggatgatacatatccacgcgtccacacatggcagtaaaaaaatgatttgagctccggagtgaaaataacatgaccggtggggtaatgaccgtcggcacgacttttcattaagaagaataaccatcaaccaaactagtcaagaaaagccacaaacacttagagcaagtttaatagtataacccactactaacttcaaatcatctatagctaattcatacaataattgcttactatactattaatgtctggtccacctgttatacacacattacgtcttggagtccgtgctgtagctggctatagatttgtagcccgttgctctgctctctctttgtttatctctttcaaatatgtttatatgtttatagctcgtttatagccttcttttttacctgatcttgtgttccttatggattggtccttaccccgtgctttgaggccctgcctcgtatgcacataaagttgaaactcaataaagttaaattcaataaggtctgcacacattcaaagttgtttctcaaacaatatcctagtatcccacacagtcgacctgttctgatcggagccgacatgcatggttttaattttttttaatcttccaccgtattattatgaccatttatttaagttatttgataggtttatttataaaatattcaatttatttcattcataagtagatcacggtcgacgtctgaggtcacgactatggtatttgcatggtatgaggatcgtcggtaccagggtatatgcgaggtaaaagagacagacacaagccggtgttgctctttattcatatgaatcacacaagtacaataattgggataacctatctagctctcgccgacttagcggtatacataaccaacatgtagtcgacaacagggcagtcttaact

SEQ ID NO: 83208 - DNA, 19364 bp, Oryza sativa
gtatttaattaaattttggagcaaattaaaaacctaatcggcaaatcaaagcatcatctacttgtgcactaatttgaacactagggtataactttcataatttattcaaatactagattatttatcatgagttaatataatttttgtagaatttttacactttgttttgacctcattaaaattcaattcagttctcagcattccccttttcacctttttgccagaattaaaatattacgaatttttgagtgaaactttgaaaaatggaaactaggtaactcaatctatctccacaccagaaaacacatttttgacactcttgtagataggtcaatctagttacccaagaatgagaggaagaaaatgcctgcaaatcaactagtttcaatgtgtacctatgtttctaaccttcctttatctgtcccgtggacccagctcgacttggccccacctgtcactgacctaggctctccaccaagccccatcccacctccaggtcgtgcacccagctcaggttcataaggcaagcaggaaaccctttcatcttcttcccctttcttcctcccttgtctgttctcccatgagctgagctctctcctaattttctccttcccgaatcttcttgaaaatgcaagaatcaagccctgcatgtcacaccactagatccttgtgattctaagctttccatccatccaaatggcttgcacatgcatagatttgtgagggagatcgagaagaaaagagaaggagcttgctgcttggtgcagtagcagtaacacttcgttttcctccacttggtgagcttccttccccatccatagcttctctcttaggttccctaatatgctgagcattcctagcctcctccaccggtcgccggttcaagatttcaaggataggagcaggttgcacgttgttttctgtcctttggtgacaactgctcggtgtcttctttgcttccctgttttggtgaggtatcagctcttcacctcaagccaaaaagtgtcttcttagcagtaggatcaagtccttaatgtatgtttttcttgcatgtgatgttcttgacatgcatgcaatagagcgatccacccacagcgctgcatcgttacatgcatgacatcccgagcgctggcacttgcagccgctgcctgcacctgtccggccaccactgggctgggtagagtataggaatggaatctcaaagacttgatctgcatggtctcttttgaccttgccccaattagagccatcgtttgctgccagcgagcttgagatcgagctcagccatggctgtctatgattgctgctcaattggagaagaagctggaccttgttgagaaatgggaaaacttcaaaaagccataagtatttcattttaactcatctttgaatgaatcaaatccctgtgtattcataaccttgtagaccttatgtttgtaaaggaaaacttttcaacttctgttaagaaaatgtcagtttttcatatgacttaggttagttcatatgtaactgaaacaatgccattttcagtgtatatggcttgttatttttatacctctcaaaccataaatgtaaatgagttgattcttgttcctaaaattagtttatcatactctctacctactgtaattaggccatgatttatagagcatgttgcatatgcatatttatttgaatcttatttgcatatttgcctcttattggtagattcggagaatttggaatacgtggagcaagactcagaggttgagtgtgtttccgcacagcagcaaggcaagcgtctatggatattgaacctatgatttcacaaaacttatttgcttgcaaaaactatatatatgcataagttgaattgccttaaaatgtcggtaacgggtagagttgtttatatccaagttcatgcatttcccttcctttaatatattgttgccatgtaaccttgtcaccttcaattgtaaatggttaggatggtttattctatcatcgaatgcttagccatgcttaggtctactgttgttagaaatcgatggatggagccatcggatgaacttattcaccacccgcgatttatgggcattaaaatctgattacctcactcaatgattaatatggaaacatgctttagcttggacgtgtgatagggcgatgacgggatggtcattttccctgatgcaagtagccttgtctgggttgttaaggaccgaacatgttgacgtctattcaagcaccatacgtacttccacacaccttatttgggaccggcttgtcttagtactatgttgcactgtgctcatctacgtcttgctggtcattcgtgagggtggttttccctttggattgccccgggtgtgcctgattttggcagggggtttctcccgcgatggtgagctggccacatcacacgcacgtggctaagtcgacgggggcctaggcgtggtttaggtggttggggtgtcactaggaaaggacatgttatgagcttgtatcacttgtaggtcacacctgtgtgcgtgtgaagcatttgatccttgttcatttcgtgtgggtaaagttgtacacctctgatcagagtaaaactattcgaatagccgtgtccacggttataggacgatcgcttgatgtgttagtcagtctatgttagcatcaaacttgggttaaatggctggtttagtcatggatatggtgatagttatgtttggaatccatggttgggcaacggtagcccatggatggtgatgagagcaccggttgtgctcatttgtgattcaatttcagatttacttgcttgctgtcctaaatttcggattatgctattttgtacaaatgttatatttgcaacttactacttgctcaacaaaattagctctatgcaaaatctgaaccacttagccatttcctttgatgtagaaatttgcatactcctttgtactatcatatatggtgtaagtcttgcggagtacctttcgtactcatgttgctattttcaggtgaggatgccggcgttgatgttgtgccctactactatcccaccaagggtggcgagggtagcgagtagttgaagttcgctcttgccccgattggttgcccttgtggggttgttggcacaccacaggtttttcttttgcttatgagaaattatgaaacttccgctgctatattttgtgttgtatgatgggcttgtgaaccccgttatgaaatatgtaccttgctgtccttgtatctagatttatgcatttgtgatgtttatcaattgcttgcgatgaaagtgcgaggctagtcagttttctggggactagctgagcatgagtatgaattttgagcaattgagatgttgtagagctttagcattttgagtcaagtctcctgagatgtgtaacacttttggtcgctgccttcgtgtggtttgacgggcatgtctcaggctgcagttgactggcatgctgagtccgaacaatatctcctttgctcatgattcggcattgcggattttatatcgaatggtgttaaattgtgatcatgagcacattgaggtatgagtggctatttatacgtgtatggatcccactcatccaaaattatgtggtggtcacgaattgcactggacgatataatgttcgagtgcccacatgcgggatcattgttcgctatagcccattaatttatagtgattactttactgtttagctagcgctaaagtagttattaattgcatagacgtagagtctgggtaattaatttccggtgattgcttcgtatcccaccgtaggtttgaggtaggcgtagaggtggtgacagcccttaaatacactaaagtcctccctgtctgggtatgcagtagagcaacatctttgagcagcgggctggccagtgcctaaagtatcacgttaggattaaattgagctttccgtagacatggtttctcactaggaaatcctctttaccctttgcctacatttgcttcatgtccttgggtgaacctgaagaggagctgaacacacacgttccctgaggaaatcgataccttggaatacttgagggtgaactgctacatcggtatcttccgtgcgcttgcggattttatttgtgacgttaagaaataccaacaatagcaccaattataaaatgagtaattaattatatggatgacacagcgtcacatcccttcatctgttgtagggacttgtgaaccacatcgatggtggatagttaataatttcaacttacaactaatcacaactgattatacgaaatatatagttaatgtcacacccggagttttcccttttttgtagtttctaaatcattgctaaatcgtctatagaaaatacgttgttaaccaagagaaaaccctaaataacaaagtgtttaataattggaattatcagggagattttttttttgaattctcattgctataaatcattaacgggatgtatagtggaatattcagagtaagggaaataacaaaagttaatttaaaatgtcaggagttgaagtaataataattttcttgcccgcctttggccatgaaccgtgcctggttcacttatccgttagtctgcggttccattttgtataacgagccgagtccgaatccgcttctagttccgtgtccgttcttttcctaaaacggcaccgcatcaatttttcttttcctttccctttttggtcgccattttcggttttcccctccacccccttcctgccgcgcgccgtgccctcccaccatcgccatcgtcgccgttgcgtaccggtaatccgcactccctctccgtgctatggccgccgctattctccatctatgtatattctaatctactccatcctaggtttcgtttagcgtcgtcgtcgtcatcctcgcagggttaccgtccccgctgttccaaacccttgccgttgccgttgttttcctcggtgagaaatcttttccaacccttctttatttagatggtgtcttgatcgtttagcgttaaccctaaccgcatgaccgagtgtttgtcgcgttgttgtgtcaccgcggtaaaccctagcaccgctgccggccaaggcgccgccgctgctgtgtgtcgtgccgtgtaccgccgcccgctgccgccgcgccgctgccgctactgccactgcagccgagccgccctgctgcgccaccgccgtgcgccgttgctgctgccctagccgcgcagccgctgccgccgctgccgggtgccgtagctgagcatcgccgccgctgtcccgtgtcgccatcgctgttcagctgctgcccatagctcggtagttgagttgcttagccgctttagtacatgcgagtctctaccggcctattgtttgccataccgggtcattgccgcaaaccatgcttagttgccgactttgctgcagccgttcgctaagttgctttaggatcattcgcacgtagtattgccaaagctttagtccgttcggtcgttctgagtcgttctttagtttagagtcgttctgagctgccggttccgttcgccggtttggttgacggtcccgtgtcacgatgtgttggctggttgagtcactaatttgtgaggcttgcttactggtgatatatttccattgatctatttctctatgggcattaatatgtaataattgattaaggtttttcggttgttagtaattacacagctcatattgtaaaattcatatctaaataatctgagctccgttttaacccattcaagttgcagtgaattcattaaaatgtatagaatccattaaaattgatttcttttactatttcagtagccttattgcttgtatttcttgtataatttgtttgtcgtatagattccggtagttccggtgatccagcttattttgaagtggttgctgaggttccatctgttcaagagcaaggcaagtcatacatacaacattgaacatgttgaacctattttataaaatcccctgctttttattaaattgcattattttagaatgtcatgtgggatggatgcctatcgtcctcagcttgttgatatcttatgctattgataacttgggatataattgattagatgtttgttgtagaaatgcttagccatgcttagatcaattagttcacaatgtgattcattataatttagtccttaattatatgatgatgtacccccatggttattgtttaattaaactaaaatatgctttaatagtgggttgtggatgcgtggatttggaagtcatgcccatgacaattaaggaccgattctcgggaatccttggaagatataatcgtacttaccacatgccagcgtgggctccaggcttaatctagagtataatttaacctagctgacataccatggtaagggtagaggcgatggtgcagttcggacctggcttttggtcttcattgtttctggatttacctaggaataaaaggggactggccgacttggcataaggagggcgtgaaacctgaggtgggtatgttcggttagggagggttatatgacaggttttgtcacgattttcccatttgcagtatcgcggtggtacttcggggcatggtaacatgtgtggaatcgtgccatgtgggtaaagttgatgttgatggtcattatcgatcagtttcggcctccgatattactataacaaaggacaactagctatgcttgcaatgcatatttgttttaaaattaactatttccacttgcactaggattctaacatcttgtagagaatacaacacgaaacggagaagaattgacagcaaaatggacgatcaatcaatcggacgctgtcgagaatcagacttatggatagatgggctagaacacaaaattgacacgactcacaaagggccaaaattcacaaactctgaagaaagaagaggtcaaagaggaggcctgccagaaactgggccggttgggctagcctagggttcgaccgacccagtgccagctctgttggattcagggttttgagggaacagtggacattcactcccaatgatggttggagggcgtttccgacctttccaaccgtcataaccgtcattcccagcctataaaaggccctcacctcattcctttcatcacacactcaagcaagaagctccaagctttctctcaagtttagtttagtattctattgctagtggaataggaatagaatagtttctttagtcctcggagtcctcgggagaattcgggtatggctatagtagctcttccttcttttgtaagacttatacaattattagaatattcttctaaatatatttacggtactttacttcactctgattttttgagtaccgactttctgatatattattcgagatataattgtctagctagcttacctaggagatgcactggtgtgggtataatgttcacttatatgattgttctatgtcatgacgatgattttagagtagtatttggtagcatacgtgaggtgcttaggctattgaatatcattattaggtgttatatgccgcgagacagtagaggtgggtcgctgatggtcacagctcagtacgggtattcctctacgttagtatataatcctaagttactttcctggggaggatactcctccgtatttagccccggttggatggccatgatgggttgtcgcaagaaactcggcaaccaggggtggtctctcgaaataccatgagggaattgtaaagggggtattggctatataattatatagtagataatattatctaaagttgtatgtattttagaagaataggaatagattcttttcttattcttttcctcttagcctagacttagtatttatgagagaatgagttattttgtttcgtgtcactctacccttgaattaaattaaccactgcttagactttgattatgacaagtaacatataaatattagcatatttctctttattataatcttcccacgggattaaacaaataagatacccttggaatacttctgagtgaaatgctacaatggtatatccgtgcgcttgcggatgtgatttataaccataatataccatgaatatttctgcgccattgctgggaattatatttctagtaatgtcgttaagaaaccaacagttataaacctctgatcagagttaaaactattcaaatagccgtgcccgcggtttttgggcggttaaccagctcaacgtgattagtctcactataataatttgacttattgaactggtgttgttcaggtggtttggttgggcctgttgcaacgtggtttagcgttggacagtgatattttaatattacttaattatatctactgttttacttattcaaattatgatttataaatgctgcttttattgcaaatatcctatggcctatcctttgcgaatatcttacatcataccttcccgttggtatgacttgttgagtacggtggttggtactcagtcttgctttatttttccccaccctagaagcagagattgattcagatggtgagttctataaggattgagcttgtttcggacattgaggatgcctgtggttctatggaggatgcttcgcttttggtcgtgaagattaagtccagtttagttgtttattttcgctgcgtttgtaagaattatttattatttttgtaagacgtggatctgtttatcaaattgtcgtttgcgtactccggctagtcttggacagagattttaatacacattctgcttgaaattttggtagcgaatttctgggcatgacaattaatcatccaagggggtgtctttcgcatgtgccatgaggggtgctaggccaaccctgggcctcccgttggattcgccaccgcatccacttatgtttaccatacatccacatgtgctatttatggggtggccttatccaattaagttatgtaatgtctagccttcctattgacctgtaaaggtagtagggttgtctagaggagctacttatttactcgctgagagtagtttaggtctctaagtttgtccaatacaatggtacaatgcctcatggggaaacatatgcttttgccgccactgcgttaggtttaaggcgtgggcctgccacctaatggctctaggttattcctagggtgaattcacatttgtcgtgctggtgcaaggctaggcattaggtctagtttaatgtaaaggctacattttaacctctagaccacattcaacgtgtagagtgtggttatgctgacgggtaccgaataaactagagcaattcacatcatgtggataaagctgtataaactcggcagaatctaaaactaatcgactaaccgcgctcacagtcagtgagtgacatagtgatgtgctgtgggtatagttttgtgttttataaatgcttttggaacttgatgatttgaaatgatgttgagtaacgtatatgatattgttgccttactaccggttgggtactaaggaatgatgctatatgacgttgccttactaccagttgggtagtaaggaatgacacttatttatttactagtaatcgtgcacgtgcaatgcacgttatgatcgttatttgattgaaccgtctatgtacatttatgtgtagaatgtttaaaacatttgatatctaattgtgcacagcagtgcttactattttctggaaaaaaaaagataatagtgatttgaagttctttttctatactaaccattaacccaaccgaagaacagcagggcaagatatatactatctttgaccaacgacaataaaagaacaatgggagacagatgacaaatatcactaccccaaacctttatgccccaaaatttgatcatatcggtcacgtcagttgccaggtgaagaaatatacattcaaagtttctattgcatgtaccaatttacaacaataagtaaataccatttgattggaacttgagcccaattaatcaactttgtataagtagttttgcaacttcatagtgttacaaataagcaagtgctaagcgtctaacaataaagaaacaaaaacccttaaatgatcatttcttaattcacacgatcctcgttttcaaacatttttcatgaacatgaaaaaaaaacaagaacaatactatatgggcaatcaaagctaaatatcaagaagtgttcatagttctcacaagctccatttattcttgaaggagtgtatccctgccattctgtcccaaaggaggcttaccttgctccaaaacagattcggcttaccaacttgtagttttcaccgaatcaccgtgttcaatgccgattacttcaaataatagaggttattcttcttaatctctggtcatggacgacaacttgcctctcgatcactgtcattgttggtggacactaccaattgaacaaaagactcccaatatcacttctgtcaatagtatagatccaaccatgtcagtgcacgaaccaacttcaaataccagaaatatattgaatatttccctaattagtttgcttcagcacctcaaaaccttccttcataatccacagttatgagccttcatgttggctatactggggatggaaattaaatttaagtcatgtacattagaagctacgaaaattattttgatcaacaaattacgattcctaaggatgacggtaactaaacttcttcaagataaggtggcaaatggagagatgattataaaatttatattcttgaagaaagctatatataacttaaaccaggtcataaaaaattctttattagcaaatatatactattctactccataatatattagatgtttcctactttggcatttcaatatagtttctttcagattgctgcatttatagctaaggaagacacaatgcaatgcaaatactaagagtgcacaaagtgagctggagacgtaaaatatcatctggtaagaaaacagagtatttggtaacttaatagtttcacattattccagtgataaaataaaggcattgtgtaaaaaccataaactaaagcatttaacaaagttaacaggaaaaaaatgttttccccaaacaagaaagtatcaatttggtatttagatccaaagcatgatcagatccttcgcatcaattcttcactttgtttgctaaactaatatgcatgaatcaatcttccctttgtttgttaaactaatataaatgcatcaccttacagactattattccttcaagcctcattactcatcattcctttctgttgactcttctcagtgcatatacacatgtagaaaaataaattgaccgagccaaggatcaatagcatgaatccaacaaattcatgccacagagctgtatatacagtttgccagtgttatgatgatccatatattcagatggaaactgagaactgaactaaattgaaaaattatgaacttgcctgtgaacaaattgtacaggcataatttaattcatttggaaacataattgcagcaaaaagaaaaatataatgacctctactttatgctcacttgctctacaaggggtaattgtttaaccagacaggaaaagcagaaattgggtgagacattttcttgaagttagcaacaccatatctttttatactcaatttaaatactttcataattccttctgaacagtaaaaaaaaagaaaggcaatactttgttgtacctgaagcctttggagtatgtattgtgatctcgaggttggtggacaccccaaagccatcacctctgaagctactaacagagccatctccagtatgtatatatctgtatctccaagttccatttccctgtaactcattggctgtgggcaattccttgcgtactaacagatacaagtgaggaaaaaaaattccaattcaaccagagaatagaaaacagccactctacaacgtggacaagtgcacaacaacaaattgaccgctcatttcagttgctggcacatcgtaataattgtgcacacccgagcgcaaggaaagcaaagcggtttctgtggttcttatcctcccaagacagtctcccaaagttccaatcatcaacatccaacttgtcataagtcataacagtagtagttgtagaatgcgagggaagcatttcagtgcatgtcatgcattgggtaatttcatcgaccatcttgtgtgcataaagaaaagatttaacacctgattagcatcagaaatatatgcagagagattgcattagtaaaaaaaaaacagctttcaacaatctcctcataggtaaaaaaagaacagaaatctgtcaccatgcctgttgtttccgcaagattgccagcatctctggtcggctaaaaattaccaccgacatctcacgttcttagctggagagctgcattacaatagcccatggttagcattaccaatatagcataaatctcatagcagtcgaccacaaacaaatcaaagaaatttaatgactcacatgagttggccggtggtttgttgacggagagcaggtgttgacaggaggagctgcgacgacgaagattgagtgtgtggccaactggccatggagattgagggtgcattggtggcgcagatgagaagatggctggttcagttggagaagtgctccatagcgctagccacgcacggtatggagaagaggggacattgatctgtcattcacggaggagaaggggatcgagatggagttaccggtgcacggaaggggatcatcaggggatgaaatgcgtggtctcgtgtcgcgagagccgagaggaaaccgtcggccggagcttgggcgtgaatctaggggggtcgcgcggtgtccggcaaggaggtgccaatcgcggtgactcgcgacctgcggcaaggaggtgggaggaatagcggcgtccgtatcgtgccggcaccggtggtagcaccggagtcgttggtggaaggccggaggcgtagcggcgctggtccgggtctgcctggtggggtttggctgtttgcgatttgggatggcggcgctggtccggcggtgcggcggcgctggcccgtcgcgaggaaggaggatgcgtgcggagggaggagaagcgaggaggcggcggggaatcgcggggcggagtcagcgcggcggggatttgcgcgacgggtcatcgcgtgggtgcggaatcggtgcaatcggcgaggaggacaacggatggataagattagagtcgatcgtcgatggacgaatgagatgagaggggatgatttcacccgtaggattgctaggcacaactcctcctttttatattagcatagatgttaacaccatgctgtgatttatatgctttacatattgcaaatgtttactttaaatacgttgcaaaatatttgtgaatcaaaattggctttatgcgaaaattgagacaacatatagcctctctttgaattatagccttcatatatgtaggtttgattgtgcgctagctttgccagtacattaatgtactgactcatactttgttcatatatctttgtttagacttcactgcaagtagataagtgctcggtaccgtttgccagtttaggatggccctatctagtggtctacccctagtctgttgcttgtgggttaatttgggtagacatgcttccgatggacattaacatttggccggttggccctatgtatgtagctaagttatttgtctatatttgtatataagtaatgtctttatgtaattgataacttggcttagatgaaagtgcaaagatagcaattttctggggttagctgagcataagtaagaattttgggtaattgagatattatagaggtttagcaatttgagtcaagtgtcttgggatgtgtaatacatttggttgcctgtttatgtggtatgatgagcacgtttcaggctatagttggcatgctaaagactcaacaatgtctcccttgcccaatgttcggcattcgcagactttataccgaatggtgttaatttgtgatcatatgtaaatattaagaattcagtggctttttatccatgcatggattccactaatccaaaatcatgtgatggtcacaaatggcaccggacgatgtaaattcgacaatgctcgatatatctttagtcggataagctgtttatatggatatatgtctatatggatatatggtacccataatctccataatatgcaactttaattataatgttttgtaataattgattttcttctctgttttttttttcgttctgtgtagatgcttggcaaatcaagcataacccgccacaattttacacatgcggtgggatttttttttccgtctatctgacctttatggttcagtggctggtaatagcggctcaattttggagcaatatttttgtttttgacaaacatcgcaggagactatactttagatttatttttagcagcctctgcccttcagatagttctgctctttgaactatcgtatatgtagcaaagttcacatatttaccatctcataaatcatattcacaaagctactaaatcagattcacaagtctttggacaacccttcatacagaatgacacatttataattgatgcaagttccagtatattgaatatacaacttattttttcttgcacttatcggaggtttatacactaagtgactttttgaggtacatatttgtatatattgctttcacactgaacaataatcttctgatattaatattttggttccaaatggagcaagcgcatatgccatttacagagcattagatagagcatgcaactgcacatgtgtggcgacgaattttccaaatatgacagcaaaggcaggaaagccgtacagaagtgtatgaatttgcataagcaaagcagccggagtgctgaaccaagcgagtttgatgccctttgtgccgcaagtttgcagtttgatgcaccttttgattagtgcatttcctatgttttatactttatttatatgttgcatgcacatatcataagttgaaattgcacaaagttagtgcaagtttcacgtaattatagtgcaaatctgaatattttttcggttcggattatattatatgcaagacaacgacaacattaacttctgtaacagtttcatcgaatttgcccagtaagaacattaacccacggcccaacaaagattcacatctttgattctagatcggatgacacagatcgactgatggattgcaatttttttagcgactgacaattattctgtcccttaatatatgtatactccttgtgaaaaacaaaaccaatcaacatacatcgaatgatataacacaacgacagttcaaacccactatttattcgcacggtaataacctttcacaagaataaaagttggtgagagtaatgacatatgggcccactaatcctagatgtccttaaaaaaagataagagttggtagtggggtggtagcagaatcatcaccactactcctttttataaggagtatagatactcgtgaaaaaccaatctaccaacatacaacaatgatgcaacaccatgacaaaagttcataccctctatttatttgatgccacacacacggaaataacttttcgttaattatattcaactcgtaaatctttatgcaatattgtaagcggatgggagaagccttggtaccgggtgaaccaccaatggctctgccctttgcagcaggagggtaaacgcctcatccatattgagcttgtctggcgtctggtccgctggtagctgccagtcgaatgcatgcaccagcgtggccgctgtcatggtgaccatccgcaggccccaactgaggccggcgcatatccttcgccctgcaccgaatggtataagtccgaaatcatttcccttgacatccacatcagtgtgcgtcccaccggggaggaaccgagagggcttgtactctagtgggtcaggccatatggctgggtcacgggcgatcccccacacattgaccagcaactctgcacccttggggatacggtagcctgcgatctcacactcctcagatgccatgcgtggcagcgagagcggtgttgatggatgtagacggaatgtctccttgatgatagcatggaagaaggtgagatgtgatagatccgactctgagaggagcctatcacgacccacaacaacatctagctcctcttgggcgtgcttgaggatatctgggtgtcgaatcagctctgccattgtccactcaactatggttgatgttgtgtctgtgcccgccacgaatagattctgcatagtcagcagaaagacatatgacatcataggatgggtctatataaaaataactaaaatttaatatatgaaaaatggtatataataatatatttataatataaacacattcatgtggcaatgttttcaatatttttataaacatattattaaaaatgataatgtaacatgtattagtagtacttcaaagaggggcggacgggttcctgccttcccggtatggactggcagcatacccaaaatttgcaaaataattttaaaaagcagtatgcagcaataggcctaaatgatcggttggtgcctggtcacaataaataaataaatgccgaaatagagtgcaaggccccgctgcattgtctggactccaccagcacacgaatctatcgggcgtgcacgtgcgtgtatagggttttctctgtatctcatctctcgtcttgtggcacatgcgaagcggcgagcgctgcacaacgggcagtgagatggagtccagcgtagtggtgcagcccacgacacgcaggcacgctatggccgacggtagttgtcaccgccaaccagtcaagtagcaccaacatttactatataactgatctttttattgtggtatccaaaataaaaaatatcttggttggattaagaactggtataagattctttagtaccgattctaaaagtctaactccctagaaacagttttactcatggttaatgttactaatcggtactaaaaatacttctttagtaccggttggtatcaccaaccaaaaataatgctggaggatctttattctctgttggtaatactaacttggactaatgatatttttactaaagatgtctttacgattagattaaaaagaaagcatatttatctaagtcagatgtgtgtactaggtgggatggtaacgcacgtgaggattggggtgagagatcgtaagtttgagtcccacatcccacatatagttttttgacttggtatgcatctttagtacttgttatttcaaccggtactaaagatcgagatctttagtctcgatttgctggttacggctattataaccattatcctaaccagtatagggggtaatcaggcaagttagtaggctcgtagcacagctaattttctagcttttacaattttactttgtttggatgatgcatatttgtgaaatgtgaaatcaataagttacaatgaatcattaatgatggtgcgtgcaagcatttctaagcttaaaaaagtgtttcattaacattgtttcatttctttgtttgtgttatgtaagatatgatctacactactatcactgtttaaaatgaatggtgcttttaggactggaatgttctgtgttagaatgtaagaggcataaattctgatgatgggtggttggctattaggaataagatagaggaaagcggatgtgcatttttttttgtttacatgaaactaagagaagtaattttgatcattccttcattaggaagttcacccctaagcgttttgacaaatttgcttttttccccttctaggggtgcatttgggggtattttggtttgctgaaatagttatgtcttctctgttatgaatatcacaattgaaagttttgttgtccagctcacttttacttctaatgattctagtttatcttggacaatggttactatttatgagccctgtactggtgttgaaaggtctaatttttttggcttggctttatagtctccaaattcctgttggtgatttttggctgttgcttggtgattttaacttctatcgttcagttctaaatagaaataagccaggagcggatatgaatgatatttttctttttaatgaggtcatcagtaatttgggtttagtggaagtccctattaagggcatggcctttacctggagtaacatgcaaaatcaccctcaacttgagcaattggactggtttttcacttctactagttggtcttcctcttttcctaatactttattcaagcctttagctaggtcaacttctgatcataccgcctgtattgtgcagttgttattcctagatcaaatgtgttcaggtttgagaatttataggttgagcatgaaaggttttttgatttagtccaatctatttgggctaatcatggcagttttttggatgctgctagaaatatttcatctaaactcaaagctttaagaaaggggcttataaaatggagtaggaatctatgtaagcttcagaaactcatcacaaaatgtaatgttgtgatctttttttttttgatatcattgaggaatatagagatctcactgtgttggaatggaatttcagagtttttgtcagatctaagttgcttacatacttagaaatataagcaaacatactggaagaaaaggtgtactattagatgggctaaatttggaggggaaaacacaaattttttccatgcaatggcaactgaatcatacaggaagaattctatagctattttggttgatgtggatgggtcaaccctctctgatcatgaggctaaagcccatactgcttggaatgcttttaagatgaggatgggaatttcttgttttgaatgtatgccttttgatctcccttctttaatcccttcacaagacggtttggaaatcctggatgcccccttttctaagaatgaggttgataagcttattaagaatctccctattgatagagctcctgattcggatggttttaatggcctttttattaagaaatgctggcccattatatgtcaagattattataaattatgcgctgattttcattgaggctctctagacttgaatcctttgaatcactctttcatcactttggtgcctaaaaaattgtgtcctgagactataaatcactataggcctatttctcttatggggatttctctgaagattttgacgaagttgttggctggcagattgcagatggtaatcctatcagtaatacatccaaatcaatatagttttataaaagggagaactattcaggattgccttgcttggaattttgagtttcttcatcaatgtcaccactcaagaagggaaatcgttcttttaaagttggactttgagaaagcctttgatactattgaacatgaagctattttgttggtgatgaaagctatggggtttttagaaaatggttaaactggattcagaagatcttttcttctgcttctcttcagttcttctgaatggagttcctagaaagaattttcattgtaggcggggggggg

SEQ ID NO: 83209 - DNA, 3165 bp, Oryza sativa
catttttacatgcgaccaaaagtgaattttacatacggccaatgaaaatcggacttttgcacgcgagcaacgcatcttatgttgtcacctataccggccgcatgcgaaaataaattcggcaaaaaaaaagataaaaataaaaaaccccaaaccctagcccgccgcctgctgttgtcgtctccatcaaagcgctggatctgccacccccaccgcccgctcgtcaccaacatcgcattctccatcccaaccgcccgtcatcgtcgccggcactagaaccacgctgggatgggccaccccgccgtcggatccacgcgggacggcgccacctgaggccgccgagctgcccagccgctgcccactgccgcccgctcccactcggaggagaggagaggagagagagagacatcagtagacggagggggagagagaggatgcgaggtggaaaaaaattgaagtggtgagggaaagagagaggaggggaaaaaactatgaagaagagcaggatactttcacatgcggactaagtaagaggcctgcatgtgaaaatatacttatttttgcatgtggccccttaagagactcgacagtaaaaataaatttttgcatgcggatctcttaagtagctacatgcaaaaatgaaggtcgattttgaagttcccgtacagtaaaattattttttaagtagagatcttactatattgtgatttgcaagtttgtgacttcactaaacagaggacaacaacaaaaataagacttaagagggcacataatttttctacaatctgcaacctgctccaacaagtaatatgacaaatttttcaccaatgttcttttcccaatcacaattctccaccatttaattttttcacccaccttcactttttgtccaatcataaattttccctatttaattttatccaatttcttaataatcgtgtccctataaaaaattcctcaaacagagggagtagtgcagtagtgacgtttggagtgacgcagtttgtattgcgtcatcggccagtgcagcagtgacgtgtggtagccaaacgggttgaaggtttttctttcctccctcttttcaatcatggagtcgttagcgcaggcgcagatcctagctgcggcagccaatggagacctcttgtgatgatatgatgagcacgtacgtaccggatgtcgccgccgccgccacggtggtcggcaccacgcttctcgccttttcttccgcagggcgcggcaccggccggacgctgccgagggcggccacggaccgcttccacaggatggttgtgattattgagcctgtgtgttgttcccgaacaaaattttttcaacctgtcacatctaatgtttagacacgtgtatggagtattaaatatagataaaaaaaactacacatattacgtgtaaattgtgagactcatcttttaagcctaattgtaccatgatttaacaatgtggtgctacagtagatatgtgttaatgacggattaattaggcataataaattcgtctcgcaatttataggcggaatctgtaatttgttttgttattagtctatgtttaacacttcaaatgtgtgtccgtatatccgatatgacacgccaaaactttacaccccctggatctaaacaacctctacatatgagtgtaagcgtgtagttagggttgacgaaacagatgacaatcctttttcagaaaaaaaaactgttcaaatgtaaccaagttatgtcaaaatttaaatattcagtttgatttttttctaacttaaccagtttaaaatgtgctctattgtttttttcttttttgaaatgtaaatttaccgagtggattgtgatcttagaacctccagatttcacaaaactggatggtttctaccagttttgtaaaccctgattgcaacattttgtttcatgtagtaggagtatgcatgtagcacagtgcacagatgattgatggtgcagccgaaaagcgacaggcacaagtgaagtgaatattttctccataatttttttgtatcccatgttattattgatgatggctggtgatgaacaaggctagtcaggccatgtcctcgtgccgctctttctgaaggtctattgccgacgaaaataagtacctactgaagttggagtagaatctgtcgtagtggcattctgaacaagtgttattcgtgcctgttgttgctgcatgttggcctgagattttactcttccaccagcaccagcatgtccgtaatacatcggcgaggttctggagatgagatgccgccctggttgcaactcggcggtgatctgccgacggaattcagaaaggcgtttcctgaccacgtttgcaactcgtgaaaggtgcttcctttcgaatgctttttgttactacctccgtcccaaaataagtgtagccatagatattcgtgtttagcattttgaccatccgtcttatttgtaaaatttataaaaaatattaaaaaaattagtcacacataaagtactattcatgttttatcatctaataacaataaaaatactaatcataatattttttcaaatagaacgaacggtcaaacgttgaacatgaacagtgctaaaactgcacttattttaagacggagggagtacttgttttctttcccctgtcattagtcattacaactgacagatttcctccttttgggatcgtgtgtgaggatttggaacaactgaacaacatgctgatcagatcagcaaggatcaccaattcaccactgtgtcactgcgtgactgtcgcgtgagacgagcaaataaatatagttctcttttgaaaccgaaaaggaaaaatagctcttgtggagttgtgggtaaccgtctccattgaccatgtttttaccgtgcccaaagccaatttctgctgctcctagctagcatcctagcacgacatgtttgcctgtagaaatccagtgacatgtttcacccaattgagggcggattaaggttccaaacttactatacttcgtaacacatgcgttgtcatgttttgtggtggtgccatggtacaagaattaaatttgaaaatatactattcattcaattttttctcagaaatatttcggatgtaaaattttttacataaatataccatcggtctcgcacaaacgttacgcgaaagtgacgtgacaatgacgtcgcggac

SEQ ID NO: 83210 - DNA, 7914 bp, Oryza sativa
taatatggcgcaaggatcatccacatgctcgtttcatagactttttttgatagacggcgtctatctagcaaatccggtctacaccaaacaccaagacgggaaaagactaaaaaatattcttagctctattatacctttgccttgcgccatccaacttggggtcaatgcttgagccaagatcaacacttgtgaccatccgattgaacaatgtttatgccaaggtttttaccatcctttgtcaagactttattctcatcacaagcttgacttcattcttgccaacatgacgatgtcattggcttggttaccattaatccatggtgtcattcattagcctcatcgtagtgggacctattccttttcacatctaaaaggagaacattagtctcaacaaatcgattatcatccttcacttgatgaccaaccggttgcatataaaagatatggatatgtttgttgagaattcattaacatcacaagtgtcatatactcgtatgcaagctcaagtgcaaagatccgatataaataataggtgaacaacatggatctaaaacatgcacaataaatgtataagatttgctccccctaaatatatgcatacaaataaatatacaagagatgcaagtgtatgcataattagagaatgaccaatgggggtttatcctatacacatagagaaggcatatgtagtaatgatgtagaccaacataaaacatataccttcatgatctctatgttctcaatgtaaatgagactaaataagataaggctcgagtaaacattagtctcacacttatatatcaataacatggaaatcatatatatgaacctatcaaaaagtaggagataagaagtggtacatatcgttttatctccatgcatttcatccttgtcatgattaaggtccatcacaatagaatgcatgtcttccacatctcattatcgggaaataacctagtagacaacttatgcaaaagagaggttaatcccataaacattggtttatcatctatcacgaaagtaacaattacacaaattgtttaatccaagatctttcaatcttttctctcttgggtgatggataataacccgatataaacaatatagagagatgggatgaaagatgatttcaaatcaagatagaaatcttataataaataaaatatagaataagctccccctcaagatgtgcatacatatggatataaaggaacacatatgcacataatcaatcaagattaatgagggagctcacactatattttggatccacaagagagaccaagttagaatatgtgaagtttaatacatacatctcatcatttttattttcatatccaaatgagactagtcaaagaaaggctcataaaaacgttagtctcatataattagatttatcattaatcaccaatactaaattaaggtacttgaacttacacctgtccatattcgtagtagtacgatgtgtcatatccacccaagagtaattaagtatatttgtgccaaggtcgcgtccagtccgcagtcgttctaaaagaattagatattgtagtacttaatggaaggctgctaacggaactctagtggtgatagtatttcggacagagctattgtacgatgctattttataaaaacatgtatttatcaatggtatttctaaaatttggatatttgttaatgatatttcttggattttctcttaatttaaattttttataggaatcttgtaaagttacctaaattctaaactcaacgtataaagatgtcacattattgtccactaataattattatatcttaaacactatacaagcatactatattatcaataatttattaaatattagagctatgaaatgcaaatatgttaaattatcatctcacataattcatatatttaaacatatctctccatcattttttataatatcctatatatcctcacttggttaatgttatttctctcttttcttattaaaccgtagcacatcaattgtttctagcctttagatgattaatctatggtctaaattatcttccttatttttttttctctcattaagccatgtcatctcttttttttaaaccctcagatgattaatctatagcccaaattacatctctccttttcttctctcataaagcctgaaagccatatcaccttattatcattctatatactatttaaattatcataaaccatattaatttatgtaagcttatgtcgtctagttattttacacattatttatacttattgctatgatactaaactctcgcagcatcgcgtggggtttcatcatatttttcctataggataatccttcgaatttcctatatatttcaaacatattaaagagaccctataagtcgatttccatggggcttttggagggatacttatcagtgggagttttccttaacacgcctttcggatggaagaaattggttgtaggaaaaaatcaagggaaagtttccttccatgctgatttcacatgaaaaccacaggaaaaattccatccaccccaagctatttttttttcatttgctttgtataagaccgtggaaatcacgcaatcacatagttggtaatccattatcagagcaaaaaccatctcttaagaaaaacaaatcagcacaagaccagagaaacacccatggtcctatggtcggtgggagtttttaacaaggattcagaatttagaggagtggggctattaatattttgtttggttgggagatactccctccattcccccccaaaaaaaaagaggtccaattctaggtatgaatatgaatattagattcatctctagaattggattttttttttatagagggagtagaattggatctttttttttgacagagggagtatgagagtttcttttttgtgaaatatagataaaaaaaattgagggagaaactctctccttttcaatgcgcgggtagagtggtaatgcaacggaataactctatactttgcctaaataaattttagccaacccttttcatttaaagatccaaattcgaactaaacttcttatcagttactaccatctataccaacaaattagaccttaaaaaattaaatttccatattaatcattaattttctcgtctaaactttcaatcattttctctcgagttatctatcatcatcagctactacagctcacaggctgagctggtcacaagctcgagtttgtgttagccggccgccttgcccacgggctgctccactgttcacgccgccggagttcgccacagcccatcgccacgctgccgcttccccgagcgctggagctcatgtagggatgtaagtgggacgggtaagcggattttttagtccgcttatctcacttctagttaatttttttcttatatactactatgtaaaaaataaacaaacaaacggatttttatacgggtagcaggatatccctaacctcatgccgtccggttcgtgttggatttgggggagatgaaggtggtactattagtttgagtggatagcaacgatggggaagaaatcaattactgtgcatttcctttgagactttttcctgtgctctgattgttcttatcctttatattcctctagtttgtatttatttgtttttcattggattttctttcatattcttactttttcctatcttatgttccgaatgagccctcagttgtttaggagaaaagacattaaagaaaaggaagataactctggaatcaatacattttggaggattggcacaagattcctatggaatttttttcctttgaatcctatgaaacgaatacacgaatagtgtttattccagaggaattaagaattttggtgcatatcctccaaacctaaacgtgcatcagatcaaagcaatcgaatggtgaaataaattgccacaagtgtcatcgctgtgaatcaaagcatttccaacaaccatactcgtcaaaccatgcagagatatgattaaatcgcccccatatcctcctgagaagtttatttgactaataactactactagcatgttaactctccagaatcagtgtaatgatagagagtagcaagagctcatgacaaaccacatgtctgcaaacatatttagaccagttcagcacagctgcaagatgcaaatgcttggttcatgaagcaagtaaacatgtttacagcaagaaattgtatagcatctttttttttctgaatcatctactgccaaatgctctttcagaagatcattcaaacaaatggcatacatgggttaaaaaaaaaagaacagatgcttaattaataccttgtgaggcataatataaccctttctggcatgccttgacaaactcctgtatccacagaatcactcccatcctatattttacaagtcactggtatttatagaccttaaggtgcttacaaccatgatgcacattatgtaatttgcagtccaaccatcactcttttggtattctctaggttacaagaccagataaattagcagaacttggtcctgttttggtgagattaatcagaatatgaaaatgccaaggccaaatcagacatgttcttgtaccatgtaatatcatggtggcatgtctttacaatgcactcagcacttgctcacttccttcttttaagatcttcataacagagcttcatgagaatgcacacacttataatacaaatttaaaaagcattatattgtctaagcccatactaaactataaaactaaaagatagccactctctgtctctctgaatccactgtatagttgaatataacaactcaaacttcacgaattcatttacattccaatatatatctaacaactgtacgaaaaagttttcttaaagatgaaaaatgacagaagtaacaagcatggatttacatatcaaaactggatttgctagttgataattttccaagattgattccaagaggagaatattatttattttctttcatcctgaaatttccaacattacaggaaccaaaattaccttagtgcaataaaaaactgttctggaacaaaaagaaccacagcacattgtacctcacgccctcacggcatatgcttggcgtagaatcccaacgtcaagcatatgcctcttgctcatcaaagcgtatggcgtttgctcttgatggtaaggccagcaaaaatacagatgaactcatgagctaccgctttgtttaaacactaaatcatttcacacttctaatccttaatgcatcaatatgtaggtacaatgaaagctataaactcataataaaccaaaacttaatccaagtaaacatcaagaagaattaaccaatccagaacaataatccataataagagccgaaagcaaaccatcccaagcatcttaattatcatactctcgttcctgaacatctgaaatgtcaatggtctgcaaccgctcttcctccggaaccaaacaccaatttggcgactgcactgccctgagccacttaaagtcatcaacattcgcccaattaccggtctcctcctcgagccccgcatccctcaaatcctccccaatcccttcatacttgagagcatgcggcgcgaacctcacgccgcagcaatcctcaatgatcggcctgctcctcaccctcaggtagaaatccgtcgctgtcgcctcgtggatcctgatctggtgcgccgccatcacgaatgcgcagcgctcgacgtcctctatgagcaccgagccgaacacggcgcccacgaacacgcggcaatccttcagcttgtgaacgtgcagcgcccggcatttgcccttgaggtaaacctgacaggagacgagatcagcgagggtgaaatccccatccttctcgtcggagaccctcagatccttcaccaatgtggcgtccctccggccccggaacccgagtcctggcaggatcgcctcgacgctggggtttggctggtctggaggcggcggcaaggtgggaggaggatcttgcggtgggttcttgggggctttgctcttgttcctgaaggagaaggacttcttggggcggagatcggaggcggcgagcctgtgggcggcgcggaggtcggaggcggcggcgagggcggagcggagctcgtagggtgggagggagtgggaggcctcggcgacgaggcggtcgaggtcgtcgatggccgcggcggcggcggaaagcgagggctgcgcgtcgtcgggggaggagcggcaggcggagagggcggactcggcggcgagcttggcggcggcgaagcgggagaggaaggccgcgacgggggagtcctgggacggggcgggggcggcagcgcgcttggagaggcgctccagcatggccaggtgcttgcggtggccggcggcggcggcggaggtggagggtttggtgtggtcgggctccggctccatctcggcggcggcggcggcggcggtggatggcatcgggggagagcaaacagaagtggtttcgctactgagaaaatggtctgacttaatttagtagcaggtttaataaatttcgttgaattccaaattggaactttgacgaatttcgtgaaatttgagcggtttagagggagaattttcagaatataccacccaatacgcactgcttccagaatttatcacccaattcacattactttcggaatatacatcactagagtgtgaattttcttcgttctgtaccactccgtcccctggcgtcagtcgtgtcgtcgtcctccgtcctcccggcgccaccgtcgtcagtccgccgccgctcgcgcccgcatcagctgcgccgtcgcttatccattgccgctggcgtcagccccaccatcgcccgtccgtcgctgcccgcgttagccgcgccgtcgaccattcgtcgccaccatcggcgcacgcggtgaagggccggaggagaggggagcagcgggggagggcggagggcgtcgagctctggcggctcgaggctgcggtgccggaggttggactggcgatggctcggggcgccatggcggcagccggagcggcgacggctgagctcggggacgacacgagcgagctcgccagatgcgtgcgggcaaacggcgcgtgggggaggaggagctcgccggcgtgggggaggatgagcttgctagcggccagattgaaagcagtgcatattgggtggtatattatgaaaattctcgttcagaggagctacaaaatcccgaatattaggggacgaaattgtggaccctacctcggactcgtgtagtctgtttagcggggcacccgaaattttggctgtaaattaataacgtgaataaatcaaaattaaactataataccatcatttggaattatcgacgggttatatccgcagacggtatttgtatagtataagaatggttgaaaccagggtataagcagaggtaaccgagatgggagacatagatttttatataagtttggtttccttaactgacaggtaataaccctactcattttggccaaaatcggtgtcttttatatatcggtatcacacgagtagatgtttgaaatgacctaatctggactttgttgacttggcgtcatagaggtctcacacctagtcgacagctagtgtactcttattcctcgaacatgaactcggtgagattgaaggtagttatagatccctcatgtctagctatgtggctgctacattgggtttgtctagataggtatttgcctctgttggcgtgtcccctcttttttttaggaggtcttgtatttatagtgaagattatcttcctctcccagtagaactcggagaaatataacaagatacgaactaagaaaactttatctttcccgattaggactctaacaccttatattccgagaagataatttccttttttatccgtgtatactattaggtatgttattttcatataccgtgaacccacatatatagaggaggtatgctttat

SEQ ID NO: 83211 - DNA, 7874 bp, Oryza sativa
atgtagctcctccacttgtgctctgttcttccatttcagataacaaagtttcaggaaacgcttggattggagtgcgcaccaaataaacgaggatgattgtgcattatttgatcctacacatggcgcatggcagtttcaaagattaagcacatcacatttgaaattttcctccaattcagtagagcatcatatgcctaattgcctagcaaattgcttcacttccttgcaaggctgaagccctggtgaggcctgctcttggacctgctcctgctgcccctatggctgccgctcccattatccctcccccggttcttcaccgacgagccggggctctggctcagccgccgcgacgacggcgtcggccgcctgcgcgagctccaccctccgttcccgagcgccgccttggcgacgctgtccttggccgcctcccgcgcgcgctgcggcctcacgggctgcttgttcaggtactcgagccgcgacaggaggcccgacgccgacttgcggagcgcgtcgtcgccgatgtttgtctgcaccgggttgccgacgaggttgagagccctcagcgagctgtagttggcgacgagctgccccagcgccttcgtcgtggtgatcttgttgaagctcaggtccaccaccgccagcttcagcagccggtgcagcccctccacgtcgctgatcttgttcccggcgaggtacagctccctgatcgccccacagttcgacagccctgaacgaatcgaaaccacaaattgttcacttcttttgattcaattcacacgaatagtataattaactgcagggtacactgtcatgtctcatgtgatactagctcgcatggtgcatggaaacaagctaagcagtgcgtaggatggaccagagcggaccgatgtggcatccagtcacgctcgcgcacagcggtttcttttcttttctagggacgagcaaacctgcgggacatccactcgattcccaaggttctgaagaagttggccgaaaggagcatggtacacggtcacgagtatcgtctatcagaatgtacgaattgtactatccgaaaggtaagaatgtgatatgcctagattggatatctgatgggtgtcagcatgcggcgccctgtgtatgtactcgtttctgcttatcaatctggagtcgccggtaaataaggtgaagcacatgaaccttgtatcgatcccttcagtgtcacagtgtgtgtgccagcattagtttcagagcatgacatgacgcatcgttactgtgcactactaaagtctgtaccatggaccatcctagtacttagcccggcccaatgtctatcgactgccaccgatccagaagtgcacacgagcattgcacaatgaacaagatccacgcaaagcctggctttcaccagtagcaataaacttactgaaagaaacagctgtgatatctgacgaaatgcttaccgtgaccaatccgtgaaatcttgttgtagctgaggttgagcacgcgcaacctcgtcagttcgcgcagcccctcgatgacagatatcttgttcctcgacagatcgagtgagtgcaatcccttaggcaatgatccagatgatatttgaactgcagaacgaatggattgatcagccaagaacgagaaacatgaagattaaattgccgcacgtaaaatgaaaaaaaaaattagcacataattaattaagttttaattattataaacttgataaatgaatatatttgatattttaaagcaacttctacataaaaaattttcgaacggattgtaccgtttagtagtttgaaaagtatgctaacgaaaatcgatataaaatatgtatcttaacgagaaaagaacgtgataatttaccgatgaggttgccggacagattgactgcccggaggctggagaacggcgagatcaccgggatgacagtgagccccatccccgatatgtgcgccacggacgaggacgtggtgagcgtttgtatgatgctgttcgccttgatggcctcgccggccatgcgccgccgcgcttgggcggggaacttgccgccgaacgacgagggctccccgatctccgtgcaatgcgggcgagccgtgtcgtcgtcatcgtcgtcgtgctccacgatgcattcctcgttggctttgaacgggttgtccacgaggctgttcacccacgcgctgacccggtccagcgacgtggcctccgacgagaacgccatccattggttcgggatgggctcgtggcctacggcgatccccttgttcttgacgtcggccgtggcggcgcccgcgtcgagcgtgtcggacgcgtacccgtcgtgccgctgctccgccgacggcaccgctgctggtacggtcgccgccggccggtgcaggttccggtggcttcgcaggagcagcctccaccacagcttccggctccgggacgggagcacctggctggacgaacacttcttcagcatgacgtggtcggcgctgcacgtcgtcttcacggacgcggctgggctgtcgtcgggcgcgccgactggggtggctgtggctgagccaccggcaggcaaggccatgaggtcgccgtaggagagcgacttcgccggaagttcgaacgctttcgagccacgcctcgccgtctcgatgttggagcacgagcgttccagcctcgatgccatggccggcaccatgaggccaaccccgggctcgctagcgtccggtgctgcggcggcgctgctagcatccttgtcggcggcgtcgctattgtagccggaagagtctgcgtcgccgccggcgacgaggtcgacgtcagatgtgtccctcttcaccgagacccatgtcatcgtccttgtcgcggccttcacaagccaactcagcggcgttgaaagcggcaacctttgtgtcacatgccaggacaatgtcaccaccgcctttcacgatgtcgacggtgtccgtcccctccatgaactccaacggtttcaccttctggaactcattgccaccagacttcttgccgtaaccaatcttgctcgtaacctgccatgttcagagctgataagaacaaaaacttaaaccaaaattcatcaaagaactgggtctcctaagaatataatccaccaacctttgataacttcctcttgccggcgagaagagcagagaagcagctgatcttggacatcttccccagccacagcactactaattctcttttacacctgagaaatctcacctatttcccttgtaaaattaacagaaaaactactcccgaaagaagcagccttgtaattcttagccgttgtctatgggagagcccttcttccagaggagaaaagcggcgaaaggaagggtgcctgcatcctcctgcggccgcacgacggtcggggcgccgcgcggcggtgcggcggagaaggccagatcgatcgagcggcaggctgggtagtgtactgtgcacaaaacacgggggaaagtgcaaacgcgctcgcgtgggcgtgggcgtgggcgtgggcgtggcggaggcagaaataggcagcggacgcgagaatcacagccctcgactcggatggtcatatcccttggcatttttatacggtatatcagcggcgtacgagagttggtgctggaaaagcgcggacgccagcctacttggccaacaactacccgcgagggcggtgggtgccgtgtgccacgcgcgggcgcgcgacgacgagacgagggtggcgcctggcgcgcgcggggcagcttccgacgtcaccgcggcccgaaacagcctcgcgccgctggagaagttgctcgggtttttttttggggcgggcgctttcgagtggcgacctcgggtcggtcgggtcttgcacgtacgcctgctttacgtcgtaccgtgatacaattgtgttgtattttgggtttgactttgggagagggatcggagacggagttctttttggccccgagcgtgtctgcgtgtaatttaactctactttggccgcgcttcggtcacggaggatgacgttttgcgtgggtgttcgcctgttcggtgttgtctggttcagtttacacgttgttcggcgcggtaggcctacataatcgacccccacccatgtcgaaattcacccctcgccacgggccagggtaggcctgacgccctgaacctgattaaattatcggtccagctgcaaacagggatactcatgcaccacacgagggaaagtatataaaaaaattcataaaatttgataagataaattatgataatacaagacaccgtataaacgtgcaaatctaaattcgatttacacaggaagaaaaaaataacaaatttatgcttcactgacttatttcattatttttctttctctagttatagatctaatatagtcttgcatgtttgtgcatacacttataattattatatttttttattctctctataattagttaagtcatgtataaatgatttgtaccatggtaactaggtatataaaatacttatcccacacgacatgctaatgacaaaaagataagtcaatgatgcctacgtcgatttcatctggggacttggcagattcgagcctcacaaaagcgaatggttcaccgtttcgtccgtctcgatcccgcgcgcgtgtgtaggccggcgtgctccggcacgtacgcgcgcggccgccacctcccccagctgggacagccgctagcatccgaccagagaatacgctgcatttggcttgtattttacgccgattcgtcagcctaatccgtgcaccgcactattatctgctctagttaaatctttcattggccgtcctcgtacgtgcagtgttactcccgtccctttcgttcgctcatcttactggatcttactgtttgttaattacactgtgaggtactcgccgagcgagttgagacttcttctccgagtttgacgagagcattgtataatatcattggatatgcagagatctaagagatgcaccctggtccctgcgccggttttgacaatgtcatgtatttgaagaacggtgcacgcctgcacggccactttgcataattgcatttgttcctggatgccgttttcattgcatctcggtggagataaaattgacagcatgtattgtacttatcagtaactgtttcttctactacatttgaacaatcggttggacatctaaaaggtgatgcctgtactgaggaataagttgcataagcagcaaatacgtactcgctgctaatagatatgactggttcgattcgctgactttcatgtcattcccccaagaggagagatttatcaactacaactttacatctcgtgccgctgccaccaccgttgaaaattgaatgtatgcaaaatggaaggcaagaaaaccacaatcaagagtcgccatcgatcatggcccgcccgctttgatttgagtggtttcttcgattcaacgatttctacggctagtcctttcactggtaataaaagccacaaacccagggaatataatctttttcagggagtcgtgttattatcgaacgctctcgtctgaagattgtgaggcgggtaacaagtcttcgcgtacgatttcaaggttctgatttctcgctatctcgttcagtcgtttaattgcgatgcgcacgatgcgggcagtttgcttgcgagttgcgagtaatgaataacaagtgcacgggcgcgagtggattgtctgtcatcttctaaagatttcaacctcgtccggtcaaattggggcacattccattatgatttggtttgtctttgatcggtcgcatgcactgtcgtcacgtgccttaatttctttagtacgagtacactgtacacgcatatttatttttgaatgtatcggcccctccaaagtagaccaagggcatcaggtgcctgccttatactgttcaaacaaaattcaacctacagttcgagcaactgaagtttcaaccacgtgcacaactcacaaaccaactctcacgatcacatcgaatggaggcaaaagaagcaaatatttcctcggctattccgctgatataaacgagtgtgcaacactgtagtagctggataatttgcctttgctagtttggctccacctgcagcatccttcgtcttgcttggaaacgggcaaacctggtgctcccgtctgcgtcaactcgctcgcgcgccacgtttttttcttcagaatgtcgcggcgggcaagtggggggcaagtgcgggcggacgggatcgcgcgggaatgcgcgaccgcgagacggcgccatgactttcccggtcgagtttgctacagctagctgatagtaacacagcgctttcatcagcatggatggagcaagtcgcatccatccgtagttttctctgaaaattctgtctgttatgcggaagcatcaggaaatcgaacgcatgctgaagagacgacgagatcatagcgcaacaaggcgcgcggcttccaatggggactagagatggaacatggaagacgatgaccggaaactgccgaggacggcggactactggacggaggaaagggcggcgccgtatctggtcaggtggctcagatgagatttctccggtgaggatagaggagtactggagcagtggtcggggaaaggagaatggagaaaataagtttcagcctactgggcttgatggctcgttggtgctacaggcctattaggccataaactgcaacccagctcactttggacccagctacagacgttccaacttggaataagttcactatttgaccctcaaaagtgatcgaaatctaatccatgaccctaaaccacaaaaccggatatctcgacctccgaactcttaaaaccggtgcaatttgactccatagacggttttgaagggcggtttcgttgacgtggcgcctacgtggcagtattgactcggtcttctttccacgcggtgttaacgtggcgcttaagtggcattagaaataaaaaatatgtatgggacccatttgtcattctcacacaaaaattaattgtggggcccacatgtcatcctctctctctttctcttcccttcacaagcgacggcggtcaagggaggccggcagtcgacattcaggcaagcatcggcggcaggcaggtggcactagggtggcgacaacggcggtcggggcggcggcggaaccagatcttcctcctccctctctctccctcatatctttctcccccgtttctcttcacgggagcaacgacaacggatgggggtcgggtttgcgccagcggcggtgcccactgggacctactaggagactgccacgaagcacgtcgcagagcggcggcggtggtagctgcgacagcaacgtggcagggggcagcggagcttgagagagtagggcgtgaccactcctcgtcgccgcaccacgtggagaaggaaggacagggagagagatggggtcgctaccgccggcgccggcaacgacgctgcgggaggggcggaggaggctgtggatgggattggaggaggcgtcggccaccgccgccgccgaagatccggcccctgctccggtgtagacctccgtttttataacaagaatcactcgtgtcactagtaccatttccctggattaagtagtgtggtactcacgattacatagctgaaatatcaagtgcgcatacaaggattgtctagcgcgaattattacatcataggcccgctggcatagactggaacataggaccgaatggtccataatacatgcaaaagcagaaatagataaggcagcggaattcaggcagcggccatgccattgccacaggcaacgaccgtaactaagacctacgaagcgccgtcatcctccgcatcctcctgaagataagcatagggatcctcctcgacttcattgccatccactgattaaaatttgtaatagcaagagtgagtaccaaccgtactccgca

SEQ ID NO: 83212 - DNA, 1844 bp, Oryza sativa
agagttgtaggtactgtctaattctgtggattcacaggatggttcagttagtatatgtggccattatttcccttgtgtgttcctgcaggcagatgagaggagaggagttgcacaggctgaatgtggaacagctgcaggagctagagaagagcctcgagtccggtctaggctctgttctcaagaccaaggtacgcgcagcaacatgagactgtccattggacgtacgtagttgcaatgttgcacaccgtgatctttgatcatgttcttcttcagagcaagaaaattctggatgagatcgatggactggaacgaaaggtaagagcatgatattttggccaatctccagcttcagtacacagctacagagcgaaactgaaatgcagctgaaattaattatcttctgttagatcttgatttctctttctcatcacaaaactgctccatttgtgtgatcaaacagaggatgcaattgatagaggagaatttaaggctgaaggagcaagtaagtacccttaattttatctgccctgtcgaaactcgacagaggctcggagatgtgaaccattttccattatctaaaaagaaaactttctctctatgcttgctctgctcgttcatttgattaaacgacgatctgaagctgcaggtgtccaggatgtcaagaatggaggagatgcagcctgggcctgattcagaaatcgtgtacgaggaagggcagtcgtctgaatctgtcaccaatgcttcttacccgcgacctccacccgacaacgactacagctctgatacatctctcaggctcgggtgagttctcccatactttcagttccaactcctacctgaatttatgtgtcaagaaacaacagaggttagttcgatgatgaacattcaggttcagatgatgagttgtttactgattgattttgcatgtggcaggttgtcactcttcagctccaagtgatggctggaaactaaaactgagaggaaacagctggatggcatgcctgcatcgccaaatgatcagtgcatgcactgcaagactgcaacaaataacacagttttagattgccagatgatgatgtgtgtgtgctgagagtcactggctattatcgtacacataataacaatagaacgaacaagttcttctgttcttggatgttacctgaattctactcccatacatgttgtcaatggctctgtaatcgagtgtctgcaattccagctgaaagcaaccgattacagggaaataagctattttttcttaaagttctagctagcttggtacagttcataagccgtagaaaaacaaaggcaaataggacaatatatcaaaagtcatttttaggtaaagcttttatatctccattcttaccggtttgaaagcaaagtctgcaaaataagactacgatgaatgtcaccaagggaggaaaatccacaagcgaagcatatcgcatctaactttcaggctaatctgcatgcattatacaaagagcgatttttttgggaactaatgaattgacatgcatcgtccattaaaatagaggcctgcatgctttgggcgggcaagatatgttccattgcgtcatatggattggactaaaagtgagatgtcagctttagaatcttgagctggaaacgcattatctgacagttgaatgtgcaaaggttggagcaaactcatctcgtccaccgggaagacgataaaatgcgtccagatctcgctcatgtacataaaaatttcagattgcgaaattatccccagggttaaaagttagcactagtaaagtacttttagtttagggcaatgatgcacaagcctttagcgtgcactggatcggaaaatcagt

SEQ ID NO: 83213 - DNA, 24021 bp, Oryza sativa
ccactcctccccgcgccgttccgacctctcgctcccgccgccgccgcggcctccgccgcaccgcgccgcgccaccgccggagaggggggccgctcgtcgctcaccggggcgttctgttcctaagcatcggcgccgccagcgccgccgccgtcgcctgcaggacggggtgcgccttctcccgccgccgcttccccttcctcgggtaaccttctctttcctctttgctcttagattttgtgtggaacccgcgaaattgctaggcacgtccgaacatgcggctgctaaaaaattgaatcgctgaagtatggtacaagagtgtagtttatccatgttatgacattgatggatgtgtgaactttggaggttaacattgctacgcttttatctagtttgaattctatcttcttgtagtgatatctgaatgcaaaatttctcagggtaagaggtctcagctctgctcggatggagtccgcttccaccaccgtgccatccattgttgtgtatgtgactgttccaaacagggaagcaggtagtactttactgtgtttttgttcttgttatattgtgtgcgcatttcatttgtggaacttgctaggcaatatatttcatttcctccaagataaagcagttagagttgagattgatcttgcactatttgtcttgtgagcatcatgtttctcctttcaatattgttgtttagcgtttatttttttgttaattaattttagcatctatttctgccttttgtttaagcagtctttaaaagcatcatgtttcacatctactgcagggaagaagctgtcacagagcatcatcagtgagaaactagctgcttgtgtcaatatagtgcctggtttgtcactttgctcatcacttccgtttctctgacactatatgcctatgaacccagatcatatgtcagtgttattggccctctgtattccatagaaaacatctttattaccttcaaaaaatttaatggaaacactgaaaaggtttagtagaggtggcagtgtaaacgaattagatcaagaaaatccatcatatgtgggaacaaacccttttaaagctttgcttaccttactttggactgaaacaagaactctgttgaatcacgaaatataatggtgctttggttgtccaatgattgttgcgctgcccttccttatgctgttaggcaacaggtgctgtgccaagattcgcaattagcttgtttcatattatcgtttatactgaattatactgaagttctgtacatttttcaggcattgaatctgtttattggtgggagggaaaggtgcgttgtggaaatttacctatagactgaatagattattaatagttctcatctttgtaattcagtggtttatcattccttcggatgatgtatttcctgctccttagcagacctaggatttagtgatcaataatctgccttcttgcaggtgcaaactgatgctgaagagttactcataatcaagactagagaatctcttctagatgccttgactgaacatgtcaaagctaaccatgaatacgagtaagcttcattcagtttattgatcttgctgtacaatctgtctgtttactatagtttacttgtaacttttctccctgaaatcttaatgtaatttggttggcctattctttcggccggcccgggagaaaaatgttcctgtcagatttactggtaacttgttcatgcagtgttcctgaagttatcgctcttcccataactggtggtaacaccaagtacctggagtggatcaagaacagcaccaaggcaaactgatctggcattcaccctgttgtatacgcgcgctgcagacccgcagctcaaaaatatccaacaacatgaagtaactgatcggatgttctctgtttggcctatgtatcacagtgacatttgctgcaaggaatatatgtgtggttgccatcttgtgagttctgatgagtaacttgggtctataattctgctcacataaaaaatcgattcagtactcatacttgtgaattgctgcccttgatttggtattctcatatgaagtttttctagcgatgcaaatgatgaagatctttaagatcgatgtaaacataccaattcacactggtaaaaccctgagtacgtacgtaatcacctagatatagccctattggcacatacagatgagacaggcgcccgtgaccaagttttgatgtcacgtataccttattgcacagatcggaaagctacaagcccacaagaggacaccgtgatttcagaaagggaaaagaagagaatacatagactgcacaagccgttctcgtgcatttgctagcagcagcttggctctagatgagatagcggtagatcatcttaattaatcttaattcttaattagttgcaggactccttggcgaagccgacgcgggagttggcgacgtcgaagacgacccggatgttctgctgctgcaggttggcgatgacgttgacgacggagttgacgttctgcggcgcctcggccatggcgaggcaggccagcggcgtggcgctgctgtggatgagcgtgttctccatcggcagcgccaggtccacgccgccgtccatgtgcaccgtcaccgcgggggctccgccggcggccacctcgtcggtgttgaagcacgtgtcgaacgcgcccagcgacgtgtacccgctcggcgccgctacctgccgccggaactcctcccgcagcgccgcgtacaccggcgccgtccaccgcgtgatcaccgtgccggagtccaccaccgtgccggcgccggtggcggcgtcgaacgcgaacgatcccgcggggaccttcacccacgcgtgccccacgctgagccccgtcacgttcacgtagtagagagacgacctgtgcgggttcctcagcatcggcgtgtaccggacgctcctcggctgcccgccgccggcgcccagccggagcgagccggagaagtagtatgacctgtagctcgggaggcagtaggagaagacgccattgtacaagctcccggcctgggagagcagcgccatggggccacgcccgaggccgagcagcccttgccttggcatgttcgtcgtcggccccgtcaccgagctcacgcacccgaacgtgtagttcgggatggcgtccttgcccagcctcagcgtgtcgctggcgagcgccgcctggaacgacgcgtcggcgaacggcttggagaaggcgcacgtcggcagcgtcgccggcggcggcgccgcgtcgccgccgccctgcggcgccgggcacgcctggccctggaacagcgggcaccacgacgaggagcacgggagggaggcgtaggaggaggagttggccggggcgaagaggctgctgctcgggcacgtgccgcacggcgagcagtgcgcccacgtcgcgtcggcgctggtgtcgagcgccagcagcagctgctgcgacggcgagccgaggccggcccggacgacgtaggacgggggggcctggccggaggcgacgggggcggaggagacgccggcggtggctgccttggaggagaggaagaggaggcgggcgtcgtcgtcgcgggcgagcgcgatgatggactcgagcggggacggcgacgaggggtgcacgttgtggtacacggagagctcggcggcggcggcggcgacggtggcggccaggaggaggaggaggagagggatggtggtggtggccgccatggcaatggagctctcctggctaagctagcttgcttgctaagagagtgtcactgaggggagtgaggattgtgactgagcgagctgggtttatatagggtttctggctgttgatcctgtagtctttggcgccgatcgattgaatggtttgagcttaattacggcggcacggacaacatgacgggctaatagcgcacattcaaatcattaagtactactctagtactctgtccaaaagaaaaataaaatctctaacataagtagtatctaggttcgtagttagaattggacttgtttttgtttttagagacgaatgggtattttaaaaattttgaaatatatttattttttgacaatgaactttcgtaaatagtttctgtaaaaacagattatttattggcttgaaaaaacgtgctcacgaaaaagagagataccataagctaataagttcatcattattaaggtctcctttgattcaaaaaaaattcataaaaattttagaggatttcatccctgtagaaatttttcctatatagccatttgaatcaaatgagtgaaatcttttggaatcctataaaattcctatagaatgtctaatgccacgtaaattttggaggaaatctaacacgaggttctacctcatggaaatcgtcctttgagtttttatctctcctctaattcctgcgttttttctgcggtccaatcaaacggtcattactgtgtttttcttatgttttgcaatcatctattttactcttacattcatatcaaatttttgtgttttttctattattacattttctcaatcatgcgatttaaaggggccttaagcttttaggaccatttatatattaatttgagttaatagtatcgccgatgatttttacagaacacgttaatttgaaaaagaaataagtctttaggattaacttgcttatactcttatagacatatagttgtttcttaagtttaattgtttttcgaaggttatagtttaattaaccgtttgaccaagcacatacggacaccatcttggcatcttttgactaacctaacacatgctcaaagaatgtgaactttggtcgttggtattatgccctcacaactccaccgccgtacagttcgatgctttactatttacctcaatcatcatctcatggtggtagtaaataaattatgataaggtcttgatttttgaacaatgttctgcttctcccttggagtagaaagattatttgggataagaatctctcactagacaaaaattgtcacaagaacaatgattaattatggagaagcaaaatactggcttatcacatgcaaaattgtagtggagtgagatgcacagaaccaaattgacccttttaattacttagttaagctgagacagcgaggaagacagattaaggaagttaaacacgcctaggagtgcgaccaaaagtcacaaagatgggcaagaatattgtaccacatcctgtcaaagtttttgtccggccactgcaggtaaaacctgacgaaatccttgattcctgacacgtcctgagacagcttcttcacgggtcaacaaggacaaggatcatcacaccctgtcgacgaatcaccaggtgtgtcttagcttagttatcaaccaatcaacaaccgttgagtgtctgttaataattactgttaatttgcattattctctgggtcattggctgtgaccggcgatcaggttaacttgtttaattattaacttggatgtgtacaaataacatcaacgtagatgctcgcatcctggtattttctgcagtctgcagaaacatgtgatccgaatgatttgttcaaggaccacgatccattggtgagtaacgcatgcttgtacgtgttgataaccacacttcctatagaggggtatcttagaaagatatttaaggctttttttaggaggagcttttagcttttttatccatattttttatagctgtattagttacataattaaaaggataactttgtataattcagaaaatttataagaaattagaagttggttttccaatttcttcatattctcgtccgctgcttctcaagatataaaacgtaacctacatgcctattcctcctacaaagtaacatatgcatgtctgccatgtccgactctctgactctcatcctgtagtatatgtaattgagatgcacttgatagtgtaatagtagtcggcgtgtggtttcaactctgaggttttatgttcaatccctagccctctcacaatttcacatccctccaaatctcttttttttttctctctttcagtacatgtatttgcttcctcacaattaatctccttttattttctttcagtacatgtatttgcttcctcactattaactagctagggaaatattgatgtggactatggatattttctcggtgaatctattgtgctgtgacgcctacagatccaaatgtgtacaaatccccgttcctccacgcgtgattccgcggcctcctttctttgggggttggattctactgctcgtctgttccttcttcacgagcagccagcggcatcacgtcccatcccttccatccagctcggcatgcattgcgtgcgcacgtaaaaagtgtactacgcagccgcgagcggatggcccgtgcattgctgtactcagcgcgcagatggctaagtaaccttcttctcaatataaatgcatctgcgatagaacttgagatatcctacgattacgaatctgcatatagttatttgtccagatttgtatttgtagaactataaatctaaatctaaatagttgcttgatcagatttatagtcgtaagatataacacatctcgcactaggtatatttatattgtaacaaaggaagtattgacttgctaattgatgagaatctaaaaatacacttagcttttttttctttacttttttttttagattttacaactcaagtatcttagaggcttccatcgtttgtcctataacttattagccgctgccacctaaaaattaatcttagagttcattttgattttctttttcattgtagttgtagtttatttttcaaagttgactttaaatttattaagaatatatatatatatatatatatatatatatatatatatatatatatatatatatatatatatatatatatatatatatatatattaaatttgtttggtgctccatggtgcccgggcaccattgttgaaattgagtatatacccaattcaaatgagtatgaaactttttcaattacttaggtattaacattaactactttactaactagttcaaagcatgtttgtactgaatttgaacttgtttttgttagattttgattctaggtatatagcatccatacatataattagttaggtatgtaatcatggattgtgaaataaagttaaatttgagttgttttgttgataggtatagatatgaatcgaattattataactaggtatatactcacaatttgaaaattttgaaaaatttgagtgattttgtacattagataccatggtgccctatatatatatatatatatatatatatatatatatatatatatatatataaaactacccataattttttttggcgaatcagtggtaactagcatttatgtgagaactgcttaggagaaattaaaattctagaacaagcagttgtccgaaaactctcctatcgtcctggcagaagagagcacagctgacaaacgcaaattgtaccttcaaaagtgccttgcaagcaggcaacatcaacaagccagccagccaaacgaacaaaccagcagtcaacggtgcaggacgctactgaaattcagcacgaagatcgtcgtccatccgtggcaagcatcgttcccggccatggctatgtacaaggtttagccacttatcagcaaattaattagcaggagaagcaaggataaggaacatagacagatcttcctacatctattaatgcatctatctcgtgatcgaattgtcggtgagagtaagcccaaaaccctcccctgtttcctcctaacacaaacagaacaaatctatactccatatattaatctaacacatatctgctaatcttcgggaggccaactgtacgtcagtttgctactccattttatattacaagttatttcaggtttgtcctatgttaaatatcaactatatttgtagaaaaaaaagtagaatatctatagtaccaaattatctcatcaattataaacctataattgaataacattttttaagtaagtttgtttcttgctgaaaatgcttatacaatttttaaaattttagttaatttgaaagacgtttgatttagaacaaatttaaatgacttgtaatacgaaacagagggagtacagttggttccctatgcttccaaagggagcaggttcacgggcaccttgttccttgcgggttgcggcgaattagcgatgcacgcagagttgcagacaaagctcgccttggatcgttctaatccacggctaataatgcagttttgttctacgtgcgagcctcgcttgcatgcgtccatgcggtcgcagggatcagatccaatcccgtgcaaaagctcatgggaggatgcagttttatccagatgtagtacagctcatctgaatttcctgccacttcatctgcagtgcaaatgggttctgaacccataggttatgatgctttgagcttgcggcaaatgggttggaaaagccaatcgttttcttcttttttttttcattcaggaactctcaaattcaatcaatcctagctttttttttttttgaaataagcaaaaaggaatgcctgatatgactatatggagcatggagcagttttgtacgtacaagatttgcacaaggcacaatcctggttcgtgctcagatttgaacacaagatttatatttgtttccgtgtctctgacaggtcaaaatgcttcactggcgttggcaccagccaaatgatcatacataaaattccatgatgcgaatacaatcgtatatctacaaatgcaatcaaaccctgacgttttcacaagccctacaatattaagcggcactgataaacagccaagtggacagacaccacgacagaatagaatgatggagaaatgggaaactcatacaacagggtgttcgtcctacagacggccgatggatttcagcgaagtgaggtcttgccggcgagatggagcaacgcctgcttgtggtaggcggcgcggagctttttgtacttctgaacaaaggttgggaggtcaatgtccttctccaggaacttctggtgcagctcctccgactcctcgtccaactttgccatcgattctgagcaagcaccgaagcaattcatgaaaatgtcagcggttgcggttgggtgtttgaaaaattaaattacatggttggacttcaaacaatgacagaagcataaatcaaggtttcacgaaatggaactaacatagacgccactatgacgctagtaccagtcctagcctgatcattggccggttacagaagggtagtgcattcatagcaaacaatagatacatacaaaacatgcccatgattcggtgcactaattcacataatgtattcaactacaaataataaagcacagactcttattaaaatacacagcaaaaatgatgcagatgcagctgttcagaacccttactttggagcttgtcgagcagtgcagcaggagaatatgacctcataatctcatccttttgcctttccaactcagccaacctatcttgagcagcagctagttctgtagttcttataatggtgcactgcacaataataaatgcgatttgaatctcaggaaaaaaaattgaaacgcagacaaaatccattattatagcattaactgtatttaaagttcgtttaacaatgaacatcatggctacagtagcttatagtttctgagatggaggtcacagtactaaacctgattcctgagctccaagatccgttgctctttttccaaattttctcctgtaagttcagaagatccaaccatatttgatttagaaacagtagtaactaacaagttgtttatatctttttcatagttaagacaatccaataaaaaagcattgcatgccgataacagaaacacgaataactcacttgcaagttgcactgtctcctttctaagctcatcgcgtaactgaacattaagaaagaacaagaagtgagcaaattgacaagaggtctagcattcagacaagtcaactatctaaggttaaaagcagcaccgaatataaattaaagaataatcacccacattaatgcccaaatcacaggagatgtgccacagcccaaagcctcaaatatgaggccagaaaaagaaaaagaaaaataattggagcatatagtttggagtttcctgtgtatctttaactactggaggaaatacagaaacatctaagtacagccaccaatacaaatttcaaacacctgtgtactcagcaacaaaacttacgttgttctgggttttaacttgatcgagtgaattgaagaaagcattatatgcctctttgtctttcaacagcctctgcaactcatcaacactgcagaaaaaaggacagtattatatacagcagttttgcattccaaacaagcatgctcacaaggaatagtgtgaaaaacacatgtagtaaaggtggcgattataaaaagcaacccaaccatacataatcacttcttttagcatttatatacatcccttctgaattgcacaaattgtcgtgccctctgaaaagctagggattcttcattcattaccaattgatagaatatagaatatcagccatgatatcattattgcaattaaaaattcattactctaatattattagttagattctagtgactctcttttagtactaatataaacactagaatatgtaaaataccatggtaaaaagtaacaaggctgttgcaattttaacccacagtatagataagataaggcataatacaatgaaacttcgtatacaggaagctacaagcaacttatcaaaaaaaggttagctgctgaccttttgtcctttaaccgagcaattatccctgcagcctcagctggagatggttgagcacgcgatgaagactgggaattatcagaagctctttgatgtggaccaacattggaagagcttggtgtggatggatgtgaagatgaaccaactacagactgagggtaccaaggttgcgtagggttgtcctggaaatttggatcaggttgctgctgctgcgagttgctgctggcaagcattcagcagaaacaaagacagtaagccagaggagctcgtttttcaggaaagcttaaggcaataagtgaatcatattaaatagccacgttaatttacttatgctaaaaattaaattcagcgtaactgaagacccaaccataagaaataacagagtagctgagtggtggacactgttcggatgataaaataaacttttggaacaaaagcaaagcaattttttgagcatcaatatctgaaggctttttagtatagaaagaaactaaggattacgaatcacatcaagcctgctggctggcactgatcaacaaatacaatactttctaccaaataaaagaggaagctcagtttatagaatacaaatgctatgcgaggaaaggttaggaacagacataagaagaacaaacgaaaaaagtattgctttcagtaaaaataacatacccaaaaagaggaaatctccagctcattgtactagagcaatctgcataaaaagaaatagcaggttacatatgttccaacagttggtggtaatcaataagctgtacatgcatatagattctaacggaaaataactagtagatggtaatcgctaacgccaatgccagactaattgttggttgcatcagaaaaataaaaggaagaagaatggatcaaatctagaacaaattgaaatcaaacccctcaacgcagagttcctattgactattgtcaaaaaacgatatacttgtgataagtctcatgttcggtaggacgcgttttctactccaaaattactgcctgcgtaatcaaatcaaaatgccaagcatttggatggcaaaatgttctgtaggctacggcttgcttctactctcaaattgcctagataccgtagagcggttaatccatcactgaagattaccatgagctgctgataactaactaacttgggtgtgactttcaagaagtcatcagaacaacagcataaaaacgtgtcccccactcccccccaaaaaattccttgtaaaacctgtcttgcaaaactaattcctctacctgaatcacaatcgccgaacggattcgacaactttaacgggatcgtgaaacaaaccacagcaccggttttggatcgagggcagacacaaacctgccgagatcagcctcgaaaccgagttgccggtgcgggcggcgctcagggacggccggcgagggtcgcggaggcctggtctcaccgccgcgaggtggcggggaggggagcgcgtcgcgttcgcgttgcttcgggtgggagcaagcgaagcagcgatggacggtggccggcttgtcgaaggagaataagcaattgggatttgggggagaagaagaagagagagaggaggcgagaggcgacgcggagtcggacgcggactgggccgtggggagaggataggtgggctttctgttgggccgtgtaacctctgcgacttgggttttgtttgtgtttgcatcactgggccccggataggagaatgtgtagggagaagtggtccaaaacgtcgagaacggtagcatttgttcgaaacgattttcggtcagtcgaacaattgatcatattagcaatttattacttcctctgttacaaaatatttgacgccattgactttttatcatatgtttgaccgttcgtcttattcaaaaaatttaagtaattattaattcttttcctatcatttgattcattgttaaatatatttttatgtaggcatataattttacatatctcacagaagtttttgaataagacgaacggttaaacatgtgctaaaaagtcaacggtgtcaaacatttcgaaacggagggagtattacgatagaaatatggtgtttaaaagtgaatagaaaaaacaaaatttctatttgactaaaaaaatcaagaacatatatattatttatacgaaaaatgatgcttgatcggtagagaatttcagcgaatgttttcattattaagaaagtgtcgtccaatcatcactagatgtgtgtttatgacatgtttatcagggatttagctcaatctgatctcacgagcatagtctagatcgagtggagttgtgaagcagctcggagatcgttcaatcatggtgatctcgaagaagttgagttgtgggaaatcgttcgatcaaggtgatgttggagttgacggcacaatcaaatatcgagatcaaggctgagggggaagtgggaagtgagtcgtagtgcccggtgagggagacagcgtaggtacgtaattagagctagctagtaagctaagtacggcgccgtcgattaaacaccataaaaccacggcggcacacgtacgaccgatcaatattcgatcgatttaccttcatcttgtaaggacacgataggagcatcaattcctccggagacaatctcagatcgaaggggcgatcgttaacgaaagcgcgagattaattttatcagctctctagtgtgattctctctggtatatgctgagtatcattcgtaagtcgcaacccaccgtaagctatgcaatcttataactatactaattttagtgttgatccatgttaatcatacaggaaccacctatatatttatcgacaaattttcttttaaaaatttgatagatataattatagtacaatcgcaatgtaattacactgtaacttgcatgtaactacagtataacttgtatataactttcacgtaattttgaatcattagatctattacaagatttgttctagtgacgaacaaaaagatcacagtacacacgtatatgaaaggatttgttcccacgacctcgattttaccgaaataacatgttacggagagatttttgaaagttacatacaagttatattatagttacagtgtaattacatacaagttacagtataattacactgcgattgtactgtaattacatctgttaaatttttggaagaaaatttgtcgacaaatatatagcaaaattgaatcatatatatccttccttccttatatagtgtggttgcatctccacatttttcttttatttttcaccggtccattgactgtaacagtaaccgcgtcgccctagcacgatacggcaccaccttagactgtggtcttgacatgtgggccgacatggcacggtccgatataggtgatgtggcgtgttaggttaagccacccatttggcctgctatataacaggtgggtgcttggttaccaggtcacaatttaccacccctaaaattaggtgagtttaattttattagcagttgtttggttgtggtcgcagttagtagcgagagtatctttcaataaattggatctcacgcgttattagtaacataaaacgtgtatcaagatcatgttagccttgctaacatgtgattaagaatttaatcatttcaacttaaataaacgtgacgataatatttattgataaacggtgacctgaacgaaccacctactcctaaatttgtttgcaacactccaccaacccgtcttccaggctccaacacggcaacacctcatcacaccgcctagctactgcatcgtccacgcatcaatccatcggtcagtacgttgtccctcctgacctccctgttcctcgattccttcctccatcctcccgagaaaaaccacccaaaacagtttcttcggcgagagctcaaaataggatactcctacccctagctactctacaaaagctcatcaatttctgaacgatagcaggaggctttgccgtcatagaaagaaatggacggacgatggaccgactgatgccaacgtacccctcttccacccccccttcccctcctctctcctctctcatggctatgtttagggcatttgaccggatgtcagaagtcctctctcctctctcatggctatgtttagggcatttgaccggatgtcagaagtcctctctcctctctcatggctatgtttagggcatttgaccggatgtcagaaggagttttcggacacgaataaaaaaactaattttataactcgcctggaaaccgcgagacgaatcttttaagcctaattaatctgtcattaccacttgtgggttactgtagcacttatggctaattatggactaattaaactcaaaagattcatctcacgaattcctccctaactgtgcaattagttttttcatttatctatatttaatactttatgcatgtgtccaaagattcgatgtgatgtttttagaaaaaaaatttgggaaactaaacgggcctaatagttccaaagttttctttttccaaacttctaactttccatcacatcaaacctttcatacacacacaactactgttctatcacatcgtaccaatttcaaccaaacttccaaacttcagtgtgaactaaacacagcctaagagttgattcttttaatccctccatcctaaaataaatttaattttctacatatatcaatactccctccgtcctagaatataaggggctattgagttcctaaaaacatcacatcaaatctttagacacatgtatgtagcattaaatatagataaaaagaaaaactaattgcacagtttgcatgtaaatctcgagacgaatcttttaagactaattagtccatgattaggcataaaagtgctacagtaacccacgtgtactaatgacggcttaattaggctcaaaagattcgtctcgcggtctccagacgagttacgaaattagtatttttattcgtgtccgaaaaccacttccaacatccggtcaaacatccaatgtgacacctaaaaatttttatttcaccaaccaaacaggtcctaagaaattttagggctggacacggttattaagaaagtaggtagaagtaagtggttgagggttgtgattggttggaaagagaatgttggtgcagaagttgttatattttgagacaaatcctgatggctaaaaattgttatattttgggacggagggagtataaagcttaaaacagaataccatatttattaaatcctaatacagtcattttccagtactttatctgcttccgatatattttttaattttcatgaattttgatgtaatgattattaaaaataaacttattttaagataaatgaatgaaacttactcctaaattttattataggacgaagggagttacttttattcttcagtagctcattttgtagattacggagttttcggtagcttatattttttaggaccgaacatttcagaagaaactcactactacaggattgattatcctggacaccaccccattttatttccatgcggtccgtaagtcagactgcacggaaaaatggtgggagcgtcgcccgcacacgaaaatcaatttttgtgtgcaggtgacttaacaggcccacacgtgaaaataaccctattttcgcgtgcgggcctcctaatccacccgcacagaaaaatagtcgtccctcccatcctattcaaaattttcctctctctccccgcggccccttctctcctctctctcccttatcttctcaccttccttctcctccactcattttcctccctctttctctcaccttcttcttcagttgcctccttctccacaacccacaggcgggacggcggtgagctcggcggcggcgggcggacgtggggaggcggcggctggcgtagacgggatgggcaggccccagctcctcccctcccctccccagcagcaactccggcgcgcgggcgggcgatgacgggcgaggagccgcggctcctcccctccccggcggagacgggagcgcgcgggcggtggatccggcggacgggagggcgatgaccggcggccgcggctcctcccctccccagtggcgacgggagcggcgggcggtggatccggtgggcgggagggcgggcgaacgcacgggcgaggcccgcggctgtccctgcccggatccgacggcagcgttcctctcctgcccttccccgctcgagggcgacgacgacgaggcgggagcggcggcggcgaccacaatgacgacgatgacgacgacgaggagggagggctctcctctccctactttcgcgaggcgacgaccgggcgggtgcggcgaggcggcggcggcgagggccgacggcaaccggcccccacacgcccggatccggcggcggcggccgtccctcacggcggtgagggtcggcggcgggcgcgacgatgtcgacgacgagttgcggcggccggttcgcttgcaggccggcgggcgggcgacgatttttctttttttttggttttttttattccgtgtgggtggtatagtatgaccgcacgggataatcgattatcccaagcggtccttccgtccgcacgcgaaaatactgattttcacagacagcggtgtgcaggcgggtcaaatgaccgcacggaaaaatggatatccccgtatggcaaaatgagttacgtagtagtgactgtagctgtcaaaggatctgtttaatttgaggagcctctgacagctacgatttcttctaggttctcactcgttactttttagaatttggagaattctgtaatatatctctaggccctttaacaactgtcaactaaaatgttgtagtcgaggaatatacaaaagtacaactaaaatccagaagccagaagctatttattttcagctcatctcatcttttgtttttcagaatctacaaacatgccataggctgtgtttagttcatccccaactaccccaaactttcaagtttccatcacatcacatcacattcaaaacttttctacacacataaattttcaacttttcccaaacttccaactttttttagaaactaaacacatcctatggagtgggacaactgcagtttcttctaaaatactccccttttctaaaatataagtatttttagtacagtgataacccaaacattttaaactttaaccattaatagaaaaaagatcaatcatgaaaaaaaatgatgttactggatttatcatcaaacagactatcatagtatgtaactctttttatttaaatcatcttacttttatagatattgttggcaaagtagcatctcgaaaaccgtgtcagggtccaaaaatgcttatattttgaggtggatggagtaacaagtttcccaaacaattaagcttttcgtccagattctaagaagttgaagtcagagtctaaaaaacaaactagaagtataaggtgtgaaacctagttttttagattatcagaagatgactatcaaatgctccctccgtcaaaaaaaaaaagcaacctagagccacatctccttctagtagtacaacgaatctgaacaaccctcctagatccacatctcctcctaaattgtctttttttttggacgaatcagggagtactccatatgtcaaaaaagaattcaactctacggatgaatctgaacatatagattttcttttaatagaaagagtataattactccatctgtaaaaaaaaaaaccactaacttagttaaacctatttgatgtgattgattttttttaacgaagtgaggagggtgtttgggaaacagagacttattccaagtctctgtcacatcgaatgtttggatactaatttagagtattaaacatactgtaattataaaacccattccataaccttggactaattcgcgagacgaatcttttgagtctaattacgccatgatttgacaatgtgatgctacagtaaacttttcataattatggattaattaggcttaaaaaattcgtctcgcatattagctcttatttatgaaattagttttttttattagtctatatttaatactctaaattagcgtcaaacatccgatatgacatggactaaaaagttttagcctcacctaaacaccccttaattcttaaaattttaagctcttcgaaatagttccgaaggctcttgaacccagaactatgtgacttttcaaaatgtcaaaagttgcaggggcaatggcgtggagggagggtacactagtccctgcgtccccaggggatgtttagatatacagttgtaaagttttagcgtgtcacatcggatattgtattatggtgttgtatgggttgttcgggctctaataaagaaactaattacataatccgtcaataaaccgcgagatgaatttattaaacctaattaatccatcattagcaaatgtttactgtagtatcacattatcaaatcatagagcaattaggcttaaaattttcgtttcacaaattagtcgtaatatgtacaattaaatttttttctaaacctatatttaaaactttatagagatgttcaaacgttcgatatgatatggtgaaaatttttaagttgagatctagacggggcctgagtcctaaccacctcgtggcggacacctgcctccgtccctgtggctccaccacttgaaagcctttgccataaaaagtaggagtcgtcctactcctacccctacccctacccctgctgcagtgctataggctagccctacctccctgctcctgtttcctctctttctctctcgcctccttcgcttcgcttccattggtggtggtctccattgctcccttcctccctgcctttttcttccataagtagtagtagtagcgggagtggccgccgccgcagccatagatctgcggcgccgcgtatctcgcggctggtttggctggtgcggttagcggctagggttttggttgtttcgtctgatcgatcctccccgattttgcggcggcggtggtgaattggtgtgtgatctgatatggctggcggcggcggtggcgggggaaggggggagggggaggggagggcggcgacggggaagagggagaggatagcaatacggaggatcgacaacctggcggcgaggcaggtgaccttctcgaagcggaggagggggctgttcaagaaggccgaggagctctccatcctctgcgacgccgaggtcgggctcgtcgtcttctccgccaccggcaagctcttccaattcgccagcaccaggtatgcatgtatatacagttatacacacaccaacacatatatgcttctctcttcctcgccggcgtctccttcgctcgctcgcagttatttctgtttaatttgcttgcaattaaatctcgatctgggtgatgatctctctgtcggttcttggaatatcgtactattgttagggctctttgtcgatcgatcagggtttcttttttcttctgaaatttccctaattgatttgccggtaagttacgttcttcatttggcgtgtttaattagtataaaatttatcataataaacataaaattctagtttatcgtgcttctaattgagttgttcagttgaggagttgagattgaggtcatggctttccaatttcggattttcggtcagctcttttttcttggatatactccatatacacaacagtgatagatgtgtatattttttctcatcatcggctctttcaatcttaaaacagttttgtctttggtttatatagaattcgctagtgtgtgtactgtgtaaaattctttcaatcctacaacagttttgtctttgtcttttgctttctctgattctacaaaatgcttttgattgttcggcgctttgattcattttcttctagatgagtaatgtaatatgttcttctagggaatgttctttaattcccaggaaaaaaatgtcccagcttcttaaatagagctctctgtatatgatgttattaattatagctccatagtgcgcttaatttgaaatattgtttagcacttatgtcgtgttctcttctatctttcactcgacccattttttataatgaaaatggttaatttacaccgataggcacacggctatatatatataagcatatatagttttttttttcactcttgaagtcagcaatcttattcagttaatttaagaccgtatggaagagactcggcagagaggggtgttttctctcttttggactggatgaccagagataaatagcagattttcttgggaaaaaaaaactaaagtaggacaggttttgcatgcatgtgtgaaagcactcgtggaaaacttaccctgttctcgcatgatttgatgtgtagttgttatacatatagataaccatatctacattattgcttctggttggatcttctcataaaactgcatctttctccatctttttctacaagctcagtggacttccaagtatcttctctgctaatttcttgacactgccgttctttccacgtttgttacattattgcttttgacatcactattttaattaattagatcttgtagacaacaccctggacgcttatcaggaaacagactatatatcgttcaaagttttttgttgaaattttaacttgtaaaaaccatctggttttagttaatctcatcgatattattttcttcattaaagcaggaataagaaggcatgtagtttgtacatgcatatatatactgaaattcattattacagctttcagagatcagcagcagatttgtcatgacaattacatattcttcatgcgtgagtgatatatatatatatatatatatatatatatatatatatatatatatatatatatatatatatatatatattcaattctgttgcttttgtcacgaatagttgttagttttaaccgagcgtgcttaaactgaccattatttttaagcaacttcaaaataaaaaggtttaagtccaactcattcataaattatttttttattacaaatctaatggtataactttgatgctaaatactaactagatttcttaaaaatattgttggtcaaacatagctaggcaactcaatgaaaactaacaactatttaattcaaattatttttaatggatatggtatatatcggtatacagtctaattaatttgtcaactgaacttgggttactgatggttctaaccattgtgtatacatatatgcaaacaaatttagtcctaattatatgtcgtaacatgagggtacgtactgtgttgatcgttttgtgttatgaactaatcacatggaaagaagtgcatatatatatctaatgtcaagagtgttgttaactgataccccacatatatataccagaatgtttacagtgttaattaacacatggcaaaatcaagcaaaaatacaaccaatctaaacttgttaattgttcaatctttgtattcggggtaactaattaagctagagctgtcaaacgaaacgacctctgatagtagcacacatatatgggattctccaaagtgataggtttgcgactgttaattgtttgttttttttttctccacaagcgacgacagaaaactagctagtcgatctattcttttcatgtacatcacttacactatttgccagtgcatgacatgatctatcagcatgcatggatatagagtgtgcataccaattggcctggtagctagaaaaagattgaccaatccaatcaaatggatccctgagcttacgtaccgctatcagagtttgtccaaatatattttcaattataatatataaaaatataagtagatatttaattttattaaagtactttttaaaactaatctatgttccagtgtttttttaagctaaatatttaaaattgttaaagttctagtcaaacatgataattatggaattagaaggagtacgtacataagagcaagtataataaaactcaagatcgtgcttataagactcaagtgttgtcttttaacagtgttatgttgcatttggtgatgagtgtggggtaagtgaggagagagagaacgaacaatctctcagtataaaaagcagcctctacataatttaaaaagtgcaaatactagtgtgatagtaaacaaataaataacattagagtttgtgtattatggatgagatatattgtactacctttgtctctaaatacaaaagattttgcttatgtagatatatatatgggcaaaatctcttaagatgaaggtagtacacatgttttatatatatatatacacctcctgatcgaatcgatgaggagatatgagggataaaattaaaggcggtagacatctctattattaaacttggctagcactactactagtctacatgtataaacatgaaaccattaatcacacacacagagagataaaagaaaaaaaacaagaaaacaacagaaatgactgcttaaatggagcatatatagaaaaaacataatataattattggaagatagatagatgcaaagaatattttctaaaagattggacctcaagttaaaagttctctaatatccctatgattcgagccaaccataaggaatttcataggaatttggaatgactattccttcgttccgattagacatatatatagggttttctcaactttataaaatttatttaaatttcctttgtttgaaaagagccataagatatagtactagttcatcatgtcataatacataacaagaaccataagatatagtcatgtgtcttcgtcttctagacttctactattcctgctgcctgtgccatgtcatgcatgcatggtccatgcatgaaatattgatggccacagaacaagctacgcgtggcttacctcttcacagaagcaattgtattttcttcttctcgttctctgaaacaatcaatatggtagttcagaacattcatatccttccaatatggtagttcagaagcaattgtattttgaagggcctagaagaactacctaacaatatttggtactactagcatcttgatgaaaacgtttggattcaacattacaaaccttagctagctctacaaacatccaactctgtctaactttgttttctatatatacattgatgaagcatggaacagattattgaccggtacaactcgcattccaagacacttcagagagcagaaccttctcaactcgacttacaagtaagctgaaaatactttcacttgtattacaaaagagaaatgcaacagctatatgtgatgttgatgatcgatataccctctcatatcactcaactttctagaaagaattagtgtggaccttaattaattagtcagttcttaagaaactgttgctagtggtacttctctgaacatttc

SEQ ID NO: 83214 - DNA, 10035 bp, Oryza sativa
tcttagatgggctttaaaaatggcccactatgttgtgataaacatgacacggattacgtgagttttaaatgtggcccacaacgttaaacttgggacacgattacactgcacagtgcacgagcgactacttcatcccacgtgacatataaatcctcctttaccatatagaaatagcaataaacacttatatcgatcggtcattaattagtgtatctttctttgaaacctcttttgatgtcttatatctttcaaaccatatattatttttaagatctttttcactgttgtactctgctcaaaatatatgacaaaacaagttcaatgttgaatatattctaaagtaatttatttaaattgcaaaagtaacttaactatgcaatagaagtaactctttatagcactagaagtaattacactgtgagtgtgagtgagttgaaataagaaactatgtggagtaaatccacaaacaaagttagagaagattttcaagtaaatacatatattctttatctaaactaatctctattttatttttctaaaaataaaatcttgcgtcatatagaaagtaactcttcacgatattaaaagtaattacactactggagagaagtaaattttaaagaaatagaagtaactcttcataatattagaagtaaatacactcctagaggaaagtaactatagaaaaataaaatagaaataacttcaaagtattagaagtaagtacacagcttgagaaaattaacttttcatggcgttagaagtaactacacactaactacacttctagagtagctacgaaataaaaataatttgaatatattcaatattagactcattttgccacattttttaagtagagcataatggttcaaacgtatgttaaaaataatataccgtcatagaaatataggtaatcaaagattctatggtaagaaaatatactagtgttgttagcctctgtagcatgtacgtaaattgatatgacaactagcagatcatctggtcctatttttctggttagtggtctcgtttctctatcttggtcaggacaatatccatgtgttcgtatctcagccatcatcaacgaattggtcaagataactactttcaatgctttataggtagttacttctattgcgaagctaagttacttctacgatttaagtaaattactttaaatgtttgaatatatttagtattggactcattttatcatctattttgagtagaggatgatggttcaaacgaaagtgaaaaataatgtggtttaaaatgcataagccatcaaaggtattgttaaaaaaagaattggctagtgtaaccaatctttagttttgatggatggtggtgcatagatttctcgctttgatgccattgcagtggaagcaagcatgtcgctccgatagcaccaagacacggatggatggttgtcggacgagtcgcgcgataatacaaaactgagagcgttttcgatttagatttcccataaacttataccattaactagaattttttttaaaaaaatgtgggagctttcgggtccaattagcataggtttagatagatgttttctcaaatccaacattcttctatggtcccgtatccacaaactaacctcaagttcaacttagttctgaacctcttagtactagctttcaataaaagataaattttctaacataatatttggaatgacatgttttagcctaaggccgcccgcatgtaatacttactacttcggtacggtaagggtgtgctatatatgtttgtcctagacatttttttccctgaacgcgcgaaaacttgcatgtcaatatattagcaagagagaaaatattgtacaacggcgatattccgaagtggtcacgagggagggttttacacgaggagaagggagagtaaggctaaggtaagctaggtaaaaacaggtcccgaacaataaaaatagctggaaaatgaaaaaaaaaagaaacggggactaaagtaacatattaacgcttacctgctagtttttgtaagttcctcttgaatttagcccgtttctcttcctgcttgaactgccccggaaaaatagacagaatccttcctggaagattggaagtagacagaatcaggcgtcctggccattagtccattacctccatacgagagtctccatgaccagttgagagaggctctctgtccaaccaatgctctgttactttcatctgtaaagatgaaagggaatttcattgctggagactgctccatcttccatggaatccctcaattcagtgccacccattcgtcactgctgatccactccttctctatttccttgctgtgaagcagtccgctgatctgtttttgcactgcatacgcttcgctgaagctggaactcgatcaacctgctacctctaggactaggagtactccgaccatggccactccgactaacagcgatcacctccggtttgccgagcaaactgtaagcctctctgtaacctttccagtgcgtcgatctcccactccagcaactgccatatatatctccgatttctcctagctttcctgtagcactgcatcctgagctccagagtccataaacgcttgctcatttcctctctttccatacgcctgcagcttgatcaccggtgccattgcatgaacacacgctctctctctctctctctcaagagtttgcccaggtgtttgtgtgtagaaattctacagaagacccggtgctcaaaggttgtgcatacactgatatagacgtctatatggtgtgcaaaccattttataggaaacaaggtagcacacgttcatgcgaacgccgttttttcatcttgactttccgcgatcggtcacggcggcaagatacaggcaaaagccaaaatggaatgtgccaaccgatcgacaaataattcaacaagcagaatttccgcgaagcaacacaaaatgcgggacatgcaagcaaagcgtaccttgatgcatcttccgggaagtttcgttgtagcttgctcgagagaaaaaaatctcccgtaattctttgcgaaattagctctgttgattttcgcagaagcttcgccaggggaaatttctgtccagctgattcccatgggaggtgttggtgtcggccggcggcaagaaatcgttgcttacttctccgtaaaaaaaaagaaaaaaaaagatgtgaccctttatagtttgtccagattactatggctgtgtttagatccaaacttctaactttttccatcacatcaacctgtcgtacacacacaacttttcagtcacatcatatcaatttcaacccaaacttccaactttggaagaaactaaatacagcctatattaggagagatcatattcctttataggttgttttttggacggagagagtacgtttgatggtgacgtatttacattttaagggttcattcagattgttgctaaagtaaaccttatcaaaatttaacaatagcaaaattttggcaaattaataatattgtcaaaattttagtaagattggcttaataatatagccaaaattccatacacatttataatatttagtaactaaatataaccacgtaattattaattttactaaataatgttatggttgaaaatatcatcaatcgaaacagctcctaaaaacctctgtatacagtatactggaccgatatgcaatggatttatgggggcagatcgccacagcccaccggcctagtgagcttcggcgaccgtgcctaaccaaaactcatgtcctttctaaaggactttggcgttgttaggccttgttcagatcccacagaaaaaaatttacaccccgtcacatcgaacgttttaacatctgtataaagtattaaatatatactaaaaataactaattacacaaattgcgattaatttgtgagacgaatcttttgagtctaattgctccatgatttgacagtgtggtgctacagtaaacatttgttaataatggattaattagacttaataaattcatctcacggtttactgacagattctgtaattagtttttttattagtacccgaatatcccatacgacaacctatataccccagatccaaacaccgcccttaattcgtcgacccaagccaaaccaacacggtcccgatcaaacccaaacttgggccttctagcaccacaaaaggaataagtccagtttacctccctcaactcatggccgtgtatgaatagtatccctcaaccacaaaaccggatataacctatcccccaactctgaaaaccgttgcaaatcaactccccaagcagttttggaggcggttttgtcctacatggcaattgacttgcttacgtggcagttgacttgctgagtcatcaagcaggacccacacgtcagcagtcttcaactcatctcttctccctcaccatgattcccttcaagaaacgggaaaggaaaaaaatcaagaagcggaggcgaggcgatataatcgagcagcaagatcaacggcaagacaagtagcacatggtggttgccgaattcagagaagacgccggcaatcacgtgaaacaagaaaggggaacgaacagaacaaatcagagaccacgaaatcgtcgaagaacacgagcaaacagcaaacaagctagcggagttcttctaacgtgcgcgcgacgcggagcgggtgtccgccatgcacagctgcgggcaatgccgccgtcgtccccgtgccggagcctctccgtcctcatgctgcagtacaacccgacgctcggcgacatccccagtggcttccttcttggacggccggcgagctcctgccccgtgcgcggccggccgacgagatcctcctcgcgcgaggacggccggcgagatcctccccgcgcgcggacggccggcgagctccttcccgcgcgaggactgccggcgagatcctccacacgcgcggacggccggcgacttggaggggctgcctcgtcctcacgacctcctctcagatgatgccccggcgccctcccgcctcctctgcgtgctcgagccgagccgctcccccgcgcgcggcgcggccagccgacgagctcgtcccccgtgcgccgtcgtcgccgccctgctgatagaaggtcagaaggtgagaggaggaagatatgaaagagaaaggggaacagatgagggagaagatgagatgaggtggagactgctgacatgtaggtcccatttgatgactcagcaagtcaactgccacgtaagcaagtcaattgccatgtaggataaaaccacctccaaaaccgtccggggagttgatttgtaacggttttcggagttgggggatgggttatacccggttttgcggttgagggatgctattcatacacggccatgagttgagggaggaaaaatggacttattccaccacaaaatgaccttacgatttgtgcgttaaacgtcgccggccgaggatagcctgctatcacggcctcacgggccgacagcgcggccgcacgtagggcccaaaagtgacggcggtgacgcctctgtacgtgcatgggccgatgggcgacgtcgcagtcaatctatctgcccgtatttcaagccccagtcgctgttgtcgtggcctagtcggcgtagtgactggcggctgctgcctgcttgactgcttctgcatccgtagaggccatagcgggagtcagattggaacagcagcaccgtgtcacgactcacgagccatgtgtgctgtgtgtgtgagaatgacatatggtacactgatatctgatcaggttcaaaatttcagtacgaaatttcggtcatatcggaaccctcccccctccccatatattattattcactgaaatttttaaattttgaaaatttcgtctatcgataccctccgatagaaatgtccaaaccaaaagatttaatcctgtagctgatgggtgatatgagtattccacatttccattattccctaggatctgatgttagctgaggtcgatcttttttctgcgcgctggctgttatctctttcctttctcgtcaaatatactgattaaaatttaagaactctgtactggcggatgctctaattttctagcactactacttgtagtggaacgtacgtactactctattagttcagtcaggctccttgtgtggacattgagagtttttttttttactaaagagagtttttttttaatcgactaattccaccttaaagatataaacaaataacctactcgtccattatggcaaatatgaccgtgacgtggatgcgactattctacgagtgcggagaactaccccttcggaagtgataagcatgcatgccacagaaacagaatggtcggcttccagaaggaaaaaagtggagagcagatttggcacatttgcgctttccgacgcctttgctgcgcgactcgttcttcctccgtgagttccaagcaaggcctcaggcagtggcggagctataaattttaccctgtgggatcgaatagcattggtttatattttagtgagatcatttttataaaattcaatggatttacatgtaaaatgaatttacatgtaaaatatagattaataagtgccactgccatcaacatacctccgccaccggccgcactgacctgtatatgcagggttgctcatgcacaaagtcaagggaacctcttaatactagccttcaatagaagataaattttctatcataatatttgacctagacatttttttttccttcaacgcgcgaaaccttgcatgtcaatatataccttgaacgcgtcaaaccttaaatgttactccgtattagagcaaggataatagtagagctcacttcctactattagcccatcttaaagccaacatatataatagattagctataaggttggctacaattttcttctcctctctctatctctcacctgtgcatttaatgtatttacatataagtttgtgttaagctagttcttgcatgagagccaacatccttgatattttgttatctctcttcacataagtttatagtagacttatagctcactgttatacttgctcttagcaagagagaacccaccgcacgtctccgtcatagctaccaccggccggtgtagcccgctttatccagtcctctcctgggcccaatctggtttggaatctatcgattatcggatccggcaacatcaccgatcacatggttccacctccgcacgcgacggcccgacccctccgagacggctgcgcctgtccgtgtcccgcctacgaattgccgccacgccgatcctttgcgccacagagtaatacagagggaggtgggaaggaacacacaagtgtgcttgatatcgaattccgcagccgcgatggccggtgttgttccgatgatcatcgttctggcgatgggcggcggcgcgctgggcgggcccgaggcgctccgcctcttgctcaccttcgccggccggagccccctcgtcgacatcggcatcgtcgtcttcgtcatcgccgcgctcgccgcgccggcgctcggcaccatgcttcttgcgtgcttctaccgcacgccgcgcggcgcaagaggtgcggcggcggcggccgctgacctcttagccaagatgacgctggcggtgtccatggcggtagcgctcctcgtctccgcgtccctgctcgtcctgccgctgttccagtccgggaacgtcgtcgtcggtcttctcgcgctcgccgttcccgccttcgtcgtaggcgccagcgccgcgcgcgtccgcggcgtcgcgcatctccgcagggcgcgcaatgcctccggcgcggtgacggacgcggggcgcgccgccgtgacgaccctgacggtgtccctcgccgccgtatgcatcctcctcggctcttgcgtcgcggtcggcggcctcgacgcgcaccacctcttcacctccttcgccttgaagaacccaatcatccacgcgcccaccggcgtcgccaccgccgccgtcgtcggcaccacgcttctcgccctcttcttccgcaaggcgcaaaatgcggcggccgcggccgcggccgctgccccactaccggccacggagcgcgccgccaagattatctcggacggtgccaatcccggcggcggctgcacgtgaaggttcccgcgccgcgagcccgcgacgcggccaccgtgtactacctggagtctggaatcaccgtactgtcatcgcagtcgtgcagtgcagagtgtagtcctgtaatgctaatactcatgctcagctcgtgcagatggggaacgtgactgcgtgagctattgtgatgttttaattgttgattcgttctgtattcaggtgagataattaacagtgaagtttcagaaactcatactcaccttttttttatttcatccgcttggctcacatttttttctttcctctgtcttccaagtggtcgacattacgacagttgttcgtgcgttattccctacctgaacatcttgtttagtatttatagtatgaaaatgcacgagttctttcttgtgttcactagttctcctgtttcttttgctagataggcatatacctgtattttgtatgttctccatgtggacttttggggatttgggagcagagcaccgaccggttttgttaagtactcccagtaacagactggcagttgtaaaatattgagcgtgtcatggcggccttgggggtggggggggatgtggatcctctgacataacgtcaggtgactttgtgtcacttacatgtgggtctatctcactataggcccacatgtcagtgacacaaaatcagggtaaggtatgttagagaatcttgttccgtcgggtgtcatatattgtgagagttgttgctagttggtacaatgcgattgttgtagagtgattgcagcacgaaaccacaaaaacagccactttgattgtcaagctgagtcaaattccatgatttgggaaatcgtgaaatgcgtcaatccaaacaaaagaaaagttgtgatggcaatattatgttgcagacggacagccaaaatgcgcaaactaagtgaattccactccgtgtgaccctttttgttatgggatcacgaagattgttgatgatgaaccaccacgtaataagtgcacgaagtgtttccagtgcaaagacgtctacggttttccagtgcacgaagtgtttgcccggttagaacgtccttaatctttctcaaaaaccgttgacgtgtatggatatatacgttcaggctaattcagctcatgaacaactaatgggccgtagctcggtgttaccctgaaaggaataagttcacttcatgaccctcaaaagtgatcgaaatctaaaccatgaccctaaactacaaaaccggatatctcgacccccaaactcctaaaaccggtgcaatttgactccctggacggttttgggaggcggttttgctgacgtggcgcctacgtggcaatattgaccgagttgttgttacacgtggcgttgacgtggcacctacgtggcggtagaaataaaaaatatgcgtgggacccgtttgtcattcacacacataaaaaatgtggggcccactgacatgtgggccccacatgtcatcctccttccttcttcctcctccctctctcccttctctctctctcccttgttcaccctcggccggcggcggggcatgggctgcggtgtggtggcggccggtgggagctgaagcgccggcggcagcaggagctagctggagcgggttctggagcgccgccggcgtggtggacggaggtggcgcaaggagctcgtcccctgggtcaacggcaacggacctcggcgcgacgaagaggcggtcgccccccttcgacggtggcggcggtcccccgagtggaggagtcgacgatggcgaggctagcgcttggcgagatggggtcggcgtcgtggaggaagtcgaccggcgggggttgcccttggcatcgtcgatggccgaagacggaggcgaaggtcgaaggcggcggtccacgcggtcgaagccggcggcgcagccgtgccggggtggaagagggaggcagccacttggggccgttgcgagacgagcaggacggcgg

SEQ ID NO: 83215 - DNA, 7068 bp, Oryza sativa
tcgtttgacgagacttctaaaaattataaaaaataaaacccaacaagacaataaactctaaaaacaacaaggcccaatttttaaaggtttggaacttctgaaaagtaaaaaaaaaccaatgataatcatgttcgatttttaaatctcaatgataataaagaagggaggcagcgggcgagccatagataagtacaatggcagagccactaacggtttggtgggacttctagaaagtaaaaaatgaactcgaacgataattatgtttgatttttaaaatcccaatgacaataaaaaaaattggacgggccgtagaggcgtataatggtaacgtttgacgggacttctagaaattataaaaagaaacccaacatgacaataaactctagaaactataagattcaatttttaaaggatccaaggagaatgaatagaaatagtgatagatcgagcaagcaaataaagaaggagatgacagaagtaaggggaagcaactggtgtgacttttaaaatctatataattagaaacacgaggatgataaggtttggtcttttaaaatcttaagacaacgagatagctatttaataaattttaagtaaagttatagtaaaaagtatatgattttgtttgggtgctagccgcgcaattgcgcgggccacccagctagttaggtacatgacatagtgatcactaaattaaagatgaaattaagggagggtatttttttcctttatcaaaattccaacgtttttcatatttttacctcaatttttttttaaaaaattcaatgggttttaggtatataaacaaatccattgaaaaaaaattagatggatagatttgtggagctacggatatccagtttaaaaaaatcatggatccaaaactattagaatctaatgggcagtcgtgactcagttgctggatacatatggatatatacatggcactaatatttgggggtatagtagactgaaccctacatattaatggttttatcggaagaatgtaattaattataaacagtagaagatattccataaatatttatggtatagcagaatactttatttttttataatccctaaaaaatggattttgatcggaaaaaagtacttcgcataaatatgaactgttttgattttgcgaagtgtctttcataaacttttaggaatcagtagcaaaaggttttttttttcgtgttagaatatatttttattagcattggaacatggccaaattgcattctataggacgcttgttccttttgaaagggagcgaacacaaatacactaatcgaacataacagaaggttaggagtagaaagatattgttcagttctgatttctcggatgatcgagaaaaagtagagtggacagctgtgatgcttgagagatgataaaacccagttaatcgtgaactatatacgtatgttcatctcgaggactgcaattttgctgccatggacctgcagattgtttggaaacttggagaagctgtggtgccatcactgaattaacgtgagtagtagctgatacatctcttgtacagatgggagcaccatgccggtcaactggtgccacatcattatacgatgatttcgattttaccgacagcggagaaaaaagaggagaggatggagggtggccgtgcccatagtaagatggaagggatcggagtttgtttttatgtgttagagataacatcttatcattaaaaataatgggtccaccaatttaaatgacaatcgaaggttagatttatttttcttcttcttataatttttagtattttttctaatttattaaaatgtcacatgacaatctaggagcgtttgtaggaatcccacgtggtggcatgagagcgtttataggaaatttaatggacttttagtatataaagatagatatttttttcaaattacacagcgctcccatggaaagtcgaacccaggacctcaggtgctactgaagctcttataaccaattacaggctctttcgcatattgagtattagtatgagtatgagtattaagtatattaatactcaatatttaaagtgttgcatctattgtttaaggttatcttttttacatattgaggatgctcttatgtatgtttaggccgaattcggtatatatctaattaatcataaccatatctttactgttcattttgaagaggtttttttatatataaatgtaagtcatgtctgaacacaggaatcagcaattattcgatgtaaatcacacaaggggtgtgtttagttcacgttaaaattggaattggaatgatgtgatggaaaagtgttgggaagtctatgtgtgtagaaaaattttgatgtgatgaaaaagttaaaagttcgaagaaaaagtttagaactaaacgaggccgccaagatgctaactagttcgatgaattggatcgcctatgaaaccctagcaaccgtgacacagcaaataaagatacgagaaggatatggatgcatggatgttggatggtggacacccactgggcagtgggcactggcatcttgacacgcaggtgggtgatcatgtgtcagcgaaaaattccattggaaagttgagacaattttgaattctatgtaagggtgtgtttaggtcgcgaaaaaaaaaaattgagtggtaaatcggtagtttgaccggatgttggaaagaggttttcggacatgaataaaaaaactaatttcataactcgtctataaaccgtgagatgaatttattaattaggtctgtaaacagtttacatatgtgagttaatgtagcacttattactaatcatagactaattaggctcaaaagattcgtctcacgattttcatgcaaattgtgtaattattttttatctatatttaatgcttctatgtatgtatctaaaaatttgatgtgatgtttttgaaaaaaaaaaactaaataaggcctaaatcaagatttcaatgtcacacagtgtgcagtcagtactcagctggagcacgtactggtgcctggtggaccgattaggaaaagaaaaggacgaaaaaaaggtttagcactgtgaccgtgaggagcatcagcaatggtatctcagacccgtatccctgctcacggcgtcggcgtcccgtttctgagccgtctcccagcgtgggtgcgcgtttgctcgcagagggacgtgcccctcgctcacttttcgctgagacacggcacgagggcgcgtgttggctaggcgtgtgtcccgtggacactgctccctcccccaaatttccccttccacccctcgccgcagcgcctggacacccctctcccatatttccccttccacttccgctccctcccatggacatcgaggcttcgcctagagaagcttctagaagctccggtggggaagccacctcgagcgacacgcggcggcgggcagagctggagaggtggggcatggcggcggcgtagaccccgcgacggagacgacagccatgacccggcgacgacctcgcgatggagacgacggcgatgaccctgcgacggcggcgacggcgcccccgaccagatctggccaccgctccccgtgcgccgctcgctgcgggaaggttggcgacggcggcggcgggaaggttcgcgacgatgtgatgggcggcgctggcgacggcgcgacgggcgccgacggcgcccccgaccagacctgtccaccgccccccgtgcgctgctcgctgcgggaaggttggcgacgacggcggtggggcggccacggcagaggatgaacgcgcgggcggagaagacgaacacgcagaggaggatggggactggggagaaatggggaaatagggaatggctagtggtgatgggtgggctgagtaaatgagagagagaagaggctaggggtagggagggaaataatacctgtggctatatggggtgaagcaacccgttgtgggctgaagtagtcttatcctgttgcctaagattgtgaagaacctagctacaagtatcctccattgcaagatgggtgccctatggagtggcttcggttagtgagggcacccatagagtgtctttgattgctgatgccctaaggccatgtacaacgcatgtcttcggctcgtagccctagcgacgtcgttcggttgctgtcacttttcaataagcagagagacacggcgtatctgtgagcagagaagacgtgtctccctgcgctcctcgactcctccccgatccacaacccatggctccgtgttgagcgatgccgtggccacgcctccttcttgtggtcccggctcccgcagggtatttttccctttcactctcggcggcgcggtgaggagaggctggaggcgatggactcaacaacgcgttggggcggagtcagtggagcggaggggcggagttggtggcaaggtagggaggggtaggaggcgtgacccaccagatctggcggcgacgaacagaaggtgagagaggtaggggtgggcagaataagaccgaaccgagaaaaccaatgccgagaaattaggtctcaactagtgaaagatcaaaatttattcgctcaattcgatcagtggcatccatcaccgcctctgcctccatcaccgcggccatccaaaactacaacgcaccagggctatcttctacaatggcaagctatctcggcgaaggcactgcgttgcaaagaatgcaaatgcatcagaccaagaatgcatatgaatcgacggaacaacatatatatgcatgatcaaaagtgattgcacgatttatatatctgtgtgaacggcaagacgattcattttttacaagggaaaaatggcatggcatggtgacatctacggagaaatcgttgaaaaataagcaccaaatacaaatttaatggcttaagaatcgacgcccgaagtttcgtcgaagctgccttcgttgaaaattggacgccgacacctgcactggcgaagtttcgcggaaagctctggtggtggtggaattttctgtggaggctggccggcgacgacacaaacgaagttcagggaggaggggaacgaactggacgtgaggagcgataactaggaaatcggagctctgcctgagtgcctgtgacctatagcaaacttcaaacatatcatacatggtgatttctcgttacaaggagttgtatggtcttgttgttgtaacggaagtgcgtttactccttttcatttttgtggcaaagcatgatcatctttaggccgaattgtatactggattttaattatgcatgtccacacctttactgttcgttcgttttaatgagtgaacctaagcccggtttgaacatttataataatcggcaaaaggtcgatacgaatgactttactgtgtgcaaaaagtcgatgaattcgttcggttgtggatgccttgcaaaagtgagagagtggaggtatgatccaaggggatggtcggatggatgcatgaaaggtttccttctttatttcgctgtgatctcgcgtcgagaaattccattaatccattgtgaagttcagaccttgaatttgcacgtacaggtcgacaggtaacaggttagataggaaaataaaagaaggaagaacaggtttaacactgtgaaggtgaatctgacgaattaattagcatcttctatgcaaccgctggatttgcccctcgcgttgagaaagccaaaagactttctcttgaatatctttttctggtcgtaaaaaaaaaactcgaaaaaggctcaagttgcggttggtggaaaagtctatcacgaggtcggaatcacaagtaatatctgcatcaaaagtagaaagaacaatagtacaaagctgcatctgtgtttttagtacaagtactaggaaatcaattaaatattccgctgttcgtgctctttccagttttctaatcgcgtcatcatgctcatcatcgaataagattctcctataatccttcggttccaaaatatatcaataacttcttcaccaatatttctttttaaaataattatgatccttcaccattcaatttttatatctacctttacttctcaactaatcacaatcttacaccatttaattctacatattttctttattatctaaattttttttacctctttctttaataaccgtgtctaactttaaaactcattatattctgggacgaatgaatcatatcattattttttttctataaaatgcacgaaagctgacacatctccgcccaaatctctcgttttccgttcgcttcaccagtcacagctctatcatggcttcgcgcgtgccaccgatcgtcatctcggccttctcgatcttgcttggggccctccagtcgctcgaatccttcctcgccgcgtcgagcgcgacctcgccgtcgctggatcgtggcgcccaactcgccgcaggtgctctcttctttaccattctgatctctgtcgagctcacttgtctccttctgttcgcatatgtcggcaagctcggcgccgctggtggagcggggcacggtggcttcttcgccgtcgccaccgcaacgctcgccgccgccgccgtgacagctctcctcgccgagccatccttcctttcttttccgctcgcgcaggcggaatcgagtaggtgagggggaagtgagatctatctgatcgctcctcctccggtcgtcgccgtcaggcgttgatcgaggcagttgggcgtgcttgtatctttcgtttgtgcaggtctataaagctattggattttgatggaaattggaaatactagcaattctactcgattattatatacggccactgttacatgcatcttaatttcatttccttttcttcccggtttcaatcggcaataagctgcagacctgcagtatcaaatccgagacgatatgatggagcttgttatttttctgttcacggaaaattattgctttttctggatcttttgtgaaaactttgttttctttatcggaattgctagaggactgtcgacagttttttttgagtgaaaactgtcaaattttttagccgtcgattctgctttaagatttgtactgagatattttgctattagatctaaaccctcttttcacaagctagtcccatcattgcatgtttatg

SEQ ID NO: 83216 - DNA, 8502 bp, Oryza sativa
acatgcaataatatataactatagttacaatgtaattatagtgtaactacactataactatattgttatctctatataaattacatataaagttgcatatattattttaatacatatatataagttattattagtatagtatagatctagtgaaattatatactatagttagatttgaaagttttctcctcaaacattggacagttttttagctagtccctttctttattgtttgaaaaagttagattttgtttctttatgtccttgtcgggttccgccagcatctggaatagagctaccaatacacatggaagtagatttttcttgtcactttcccctttttgtttttaaaagctataaactcgtactcctacttctttcgtggagtactacaataatccatactactccctccgtttcaaaatgtttgacaccgttgactttttagcatatgtttgaccgttcgtcttattcaaaaaacttttatgagatatgtaaaattatatgcctacataaaaatatatttaacaatgaatcaaatgatagaaaaagaattaataattacttaaattttttgaataagacgaacggtcaaacatgtgataaaaagtcaacggcgtcagacatttcgaaacggagggagtacaaatatttttagcccacacttttcaaccttgcggcgattttatgtggtgggcgcatgtgtggcctatatagtgggcctgatcggtacggcagcagctccaacacaaaatctgttatagatactgtagatttttactttttcttctaacgtttgaccactcgtcttatttaaaaaatttatgcaaatataaaaaataaaagttgtgctaaaagtactgtgaataataaagtaaatcacaaataaaataaataataattctaatttttttaataagacgaatgatgcaagtaaaatatcaaaatacttatattatgggatggagggactaccgatcaagtccagtcaagttagttgaagagaattggactttccagtagatagtgcgagaacaaattggactttccaacgttaacttattttatataaccatagcacacaaaaaacttttactagccagccagtattacgagggtcaggtacacaatttttttttactgtggaactgtgctatgaattactccctccatcctaaaatattataatttaggatgggatgagacttattttaagattataaatcttaaaaataatcgttactgtacatatgcggcaatgattccaccactacttccaaattaagatagcatcgcaggaggatcttagattttgttgcgaaggtaacaatggatggaagcattgaacaattgaactaaactttagtccctctcacaaaagaataagtcactaccctaaggacttatgtttttaagagaggggctaaagtttagcaactagagactaaactttagtccctctcataaaagtgtccttaccctaagaacttatgtttttgagagctcgcaaacacccccttaaaaagtctcatttctcagggcagtctttgcatggggcattgattgacctgaacaagtgtggtctgattggagtgggctggtagaaaagcagttgaaaagttgggcacattggacctaccgcccagtaccgacctgtccgagcctcggagacacgaagtggatgtgctgctgcgtgacgacgaccgggcgaccatgacgccgcacgcctccgcaccgagccactcgttgatggcgctgtatgccaaattcctcggcgttagcggtcaagcgagctgggctggggtgagcgtggttggttggtacaaatcgcgtttgaagtttccgaagctgcagacagattactcaaagtagagacgcagcgaaaattgaagctgattcctggaataaaccaaacggcatatttacatatgagaagtaaggtgttaataaaacttttatatacgtgttcttagcaacctaaaagcaaaaactgaaaaataaatttcgataaaaaaaccccaaaattagcttcaaatttaatgttgaaaatgtaaattttggctaattagtataaacataagcgaaaagatgaagccattaatttctccattactacctggctagctagctgtgctgtctgagagaatgtaatagtgtcgtgaactagctagagagagtatgcagggtgtgtttagttcctgatattggggagaagtttggaaaaaattgatagtttggaaaaaaaagttaggagtttatgtgtgtaggaaagttttagatgtgatgtgatgtgatggaaagttaggagttgggaagaagtttgatgtgaagtaaacataccgtagtaacgagctattaagtgaaagcctttaattttcacgttcggcgcagacagccagccagccaagccacaggaatctacggcgctcgcgcccgcaacactcgcacggcacgttttatctagcgcgcacgcaccggcagtccatcgatcggctctagcgacagtacgattattcagcgtattcagcgtattctgttcactgctggccgctgctcgcgtcgcgcacacgcagccggcagctcgatcggtggatcacttaggcccggtttagttttcaatttttattttctaaaaaagtcacatcaaatatttaaacacatgcatagagcattaaatatagataaaaataagaactaattgcacagttagaaaaaaaaatcacgatacaaatcttttgaatttaattagtccatgattagtcataagtgctacagtaacccatacgtattaatggcacattaattaggcttaaaagattcgtctcacggtttccagatgagttataaaattactccattcgtctcaatatatagcaacatgagacaacgaatctggactgtcacatgagacaacgaatctggactatccagatttgttgttctaggatgggcctcatcctattgtagggtgttatatattgagacggagggagtagttttttcattcgtgtcacaaactctttccgacatccgaccaaacgtccaacgtccaatgtgacacatgaaattttcttttcacgaagtaaacatggccttattcacgttccgacgtacgtacgcgcggcacggtgtggatgtgccacaacgcgttaaagacctcacaacgcggaggcccgatcgaattagccgaacgctacggaaatttcttcgtactaatgcgcggcctgtagagtttggagtgtcttgaggcgcacaaactggttaattcagcttgtacatacaatcgtcgtaattaaaacaacgctgataaaatttcaataggattatgtgggtcgactcgtttgaagaaattaatgatctttgctaaagggatatccataatattcaaatgtttatgaaaaattttaactatatagattaatatgtaatatattactccataaacatagaagatcaaattaaacttttaggacccctttgaatcgcatgaataagaaaacataggaataggaaaaacgcaagattttgataggaatgtaactgtaaaacagaggactgtaaaacataggaatggtcgtttgattggatcacaggaaaaacacaggaattagatgaaagataaagactcaaaagaaagttttcaagagattttatctcatgttagaattcctccaaaacttgcatggcattaggtaattcataggaatttcataggattccataagatccattcctttgattcaaagggctatatatgaaaaattctaatagaaataaaatcctctaaaattcctataaatttcatttgaatcaaagggggccttacatgttgcaacgaaaaatgtttgactataaatatacgtgaactagcaatactttaatttgtttttttgcaacttgtacatggtgaattttaatttgcatatttgtgaagtgatatatcgcatattaatctatcttctatttttttttaaaaaaaatcataactatttcgataatatacaaacaacgagtgagtatcccatcgagagtttaaaatttgcacccactgtaaagagagaaaatacctggtacattcttgccaaacaattttacaaactacggtactagctgatgttgagttaatgacattttacatattcagaaaacaaaatgcgtgcatgtagccgcgaagtttctttcatcttgcccagaaaccctccacaccattgacttgtgagtctgaagaaaaattgttcgtgtagcaacactatctcatcttttgatgggcgaaaagattagaaatcaaaacggaatggtactgtttaccgcgaacggctagctagtaaacgtactgactgtcatgtgaccgattaaacctcgatgccgtcgtttgccgcggtttaatagtgcttagcctatattatccccctttactcgctcgatcctccaccccctcttctccacccggtggacgtgaggggagaggtgagaggccatcgccatgagatcgacctctaattctctgtatgatcgcgtgttatcttttctaattttctcctctttcctcgcagataattctgcggagctcgccatgttggccatcctggtctctgtcgccttcgcccagatcctcgcgatcctgtccaacagtttcgcggtgggcgacgccgccgcggggtacgagtacgacggcgcggccgaccaccccgtcctgcgcatggctgtctccaccctgaccgtcgccgtcccggcgacgttctacgtcggcgtcatggagctctacgcccgcgtcacgccggtggcgccgccgcttcggcggctcctcgccgttcttgcgccggggatggcgtggatcacactctttcttggtatgccgccactcgtcgttctgctcctcggttgaagctgccgatcgaggcgcgtgacatggaggaggcaaagcaaggagagagagatcaacaccaaccactccttcgtcaacacgctctgcggttcggtgaaaattcttatcttatggctgcaccatttgcaactatgcaagaacacaataattctcgctcaacctatgttgagtctgggtgaattagcactgcatctacaagaacgggtcggctggctgccgttgcttgctattccatccatcccagtgtaacttagtacggctgtaacatattctaccactacgaatctagataggtagctatctagattcgtagttctaaaatatatcatattcgtgctaggttgcacttatattggtatggagagagttgcgtgtagtgctgcagagtctactggcaagccatagaacaaggttcctgagtcagttcaagtgtactactactgtactttcattgctagagtgagtccatcggtgtccaagctcagacatgcagacaagagtttatcctggcatcctgctgcctgctgtgtactaaggatttacagatagtatatgctcatacagcaatagaagcatagaactacagtacgtaaagtcattaaacagtgtgtaagtcattactattataccatcaataaaatcttatgccccaaatttactcttgtgattttattacccttgttttggaaatgttcaggcatgaagccgttgtggctttctatcgaaagctggatcgcttatcttttgtctaaaaatgttcacacatgagcagcaacagggcatttctaaatgtctaacatgccaatcattttcaagtgtgcaagtcattactgttgtgtataatccttgtttgggtgttctggatgttcggacataaatagcaaaaaattgctactattcagtacagtgtatagcgaatcagcggtcaaacgatctggtaactcaaatgaaagtgaacttttttctaaagtaggaaaactagttgcctaatatattaataaataaggaactgtaaatgtaaataaaaactttgatcaatcatcggataagctctgccatgattacaaagtcacacgcggataaacccgtttttaaaactgctatcgtattcataacctctagaaaaattactcattctttggaatctttgaaataggctaccctaccccaagtaaaaacaaataaagaaagagaacacaaaacacacatacacatcggcaaacgcgttaaggacaagcgcgttatgaatggtgttcttttgttttttgagaacgcgttatgaatggtcagtctaccacatgtccacattacttctccaagtttgcttcttgaacgatttctctctcttctaagatgtcatatattagtaggttcttgacattgtgggttgatttatgtacggattaatttatatcagggataagatataaagtacagaaaaataaaatattacagggccttcaggctccaacatatagagaacaattccggaaattttacatcaataaatacatccctcttatgtcagaaatgcaagaaaagaaggataatctcggcggaaaagactggctcatgatattgaaaggataaatctcagcatgacttagataattacggtcaaagatacataggacgtgttcacatggattttattgggaaatcaagatttagaaatagaaatgggactcaagcttgaagcatgatggtatacccagttttaaagcatatgttatttccaattgcgtgatttatttaacacggactatccacaacctacggtcatgataatatgatctaccaaatcaatgattagatatttctgattaactgtcgaatctagatggattaatcataacttttcaggattaataattctaaaatttgtatttagtaaatatcgacttgtatttgatttgaagtctcaatataataatagtatttttatttttaatagctagcgtggtggtccgcgcagattgtgtggctagcatcattacaaaattttcttacacaatagtagtgaacgtactttcacactttattgtgaaagataaatactaaaaatgacaattaattttgaattatggtaaacttgatcaaactcatacttataatattttgactaacatagtaatttctatgtctataaagtaaatatgatgtatcctttagtattgtcttaataatacaatagatcaatggatcgatataaaaattttacaatatatttgtttatcttatttcctcatatttatctttagactcatagtgacatcttctcactatctccgatgacattcatccacctactaataaaggcatggtagtttattacatatttgtgatagttcataaccaatttcaaataacaaaatgcccctcgttattaaaaccttttttattagccggcttctaatatttgtaatacattttggattacaattacttgccttcactattaagttactgattccaaaattcaaaatcaatgagtacggggttgtactccgtttgtatctcaattatcgtcttttcaaggttcaatacttctaaaatttagtaattaagcactcattatgttggagtttaaatttagtattttttaatctaataatttgaaatttggatttgataggatcagtgacttagtactccctccattctataatataaggcacaacaactttttataaatgttccataatactccctccattccaaattgatctacatatagttttttttatactattcctaaatgatctacatatttatgttcatttattaggtctattcgttatttgtgcattggagtaaatgggcattgatgtatgcatccatgcacacatgtatttataacccatatgcaatatcttgatttgctattggctaggaaatagtggggatggtgcatacattgagtttgttgctagaataaatatagtatgagagagttattagcttttcttggtcttggtatacctatgaaatatgtagatcaatttagaacggagggagcataaggcatacatacaaacatgcaattaactatgacatcttcttcattaaattattacttttttaaatcctccactctcatgttatctaatcctattgaatgcatgcattatatttattaggatgatccaaactacaagaggataataattatttcttggtctttgggttaagagtggttgtgtcttatattttagaatggaggaagtactcagtttccagtcttggcttttcgattaaagttaaaaagtttaaagagtccatgggattcacattgggatttttttttatcacgtagtactagtatattagatactgtattaggtggtgtttggatgcagggacttaactttagtctctttatttagacactaatttagagtattaaatatagactacttataaaactaattacataaatgaaagctaatttgcgagacaaattttttaagcccaattaatccataattagagaatgtttactgtagcatcacataggctaatcatggattaattaagctcaatagatttgtctcgcgaattagtccaaaattatggatgggttttattaatagtctatgtttaatatttataattag

SEQ ID NO: 83217 - DNA, 54912 bp, Oryza sativa
  unsure (1)..(54912): unsure at all n locations
gactcagtgagcagattccaagcttgtgggggtataaaggtgcaacccgcagctagctaggattggtcattatctacttgttcttgtataatagataaattttatgctaaatttatgccctcgtggcagatcatgcggtttcttttctatttgctgcgtccggcagctagatttgacgtcattttaattgtttttatcggatgttaattacgtcatttttcggttgaatgccggtaatttttttttttggggtgtaattgaggtttgaaaagaatatggaaaagatggcaggacctaattgcattgacgcccatagagaagataacctagaactcactcgatcagatatgccactcactggtatggtcaatggtcaaacagtcctccataaaaaaatccggtcaaattagctatcaaaatgtagacatctaaagtttggagtttatttagcgtgtccccttaactttacgggaacagacaataatattccccgaggaacagaagaagtaaaaaattatatgaaaaaatgatcatccggtacacacactgtttagtactccagtctgagcattatcacgcagacattctcaggcctcactcgattacagttgtgttttagttcacactaaaattaaaaatttgatttaaattggaacgatgtgatagaaaatttggaagtttatgtgtgtagaaaagttttaatgtgatagaaaagttagaagtttgaaaaattattttggtactaaacaaggcgtacttggaaatttatgcggatgtagctcaggtttacggagttttgcctacctaatagtctggtaacggcagatcgtgcaaaggatcaaaagtggttctgagtttgaacttgcgagacggaccaaacttggggcaaggcttccttttttacttttcttcaaactgtatgattgcttcgcacgtacaacgtttaaataccgtttctactttcttgacattccagggccaattagtttcggtactttcatttggcatatatacgaaaatatacaccaccatgcaaaatggtaggcacagaggtcagaaattagactcccggccgttatcttaattaaaaagaatctaaactacttctggtcagggacaaatttctaatttagctaaaaagattgctcagttttagagcatctccaatagcctctccaattgactcatttagccattctacctaaaaaaacatactccaacggcttctccaactcactagccaagctatttggctggccaaatcctcctcatcactagctacatttggtcagtctatttggttggccaatggtgagtcccacactgccaatctcctccatccccctctctctctcatccgtctctttcctacccaacctctggacgccggcgtacttctacgggaggcggcaagctcgagcacaacaaccagacgaggaggcacggggaggagcatctacgggaggcgaagacgacgcccgcccgccgctcgccgcggcccgccgcagccgttggccttcgctcgtcccgcattcgtcggcctccgcctcgccgtggcctgctgccccgccgccgcggccgccggccttcgcctcgctgcggcccgccgcccagccgccccgccgccggcctccgccttgctgcagaccgctgccccgccgtcggcctccgcctcgctgcggaccgccaccccgccccgcggtcgccggcctccgcctcgctgcggcccgccgccctaccgccgcggccgccggcctccgcctcgctgcggaccgccggccgctgtcctccgcttcgctgtgccggctccgcccacccctccgtcaccccgcacgctcgccgtcgccgcatcggaggaaagggtgtcgggaggaggcagcagtagtagtagaaggaagggagatgtatgagtgaggaaaatggggtggaagaggaggaagaaggttaataggagactgacatatgggtcaaatttgtcatagacttgtaatggagagggtagatagagaggctgttggagcaatcaatgactctgactagccaaatcagatggagagttggctatatgcgtgtttggagagtctattttagagaggctgttggatatgctcttatacgttatactttgtattcctcgtgtcccccgagcactagggggccgagcgcgggggagatgtgtctcaagcatatatcacgaggagctgtgcccgaggataggggtaccttgagcagtcccgctcgagggccgatgtgcccccagcatagttcacgggggtcgtgctgggggattggtggcagggatgtcttaagagcaggtacgataagctgactaggcgggctgcaaaaatatgccacatcatcttattcctatgtggaggaaagagaatagatgagagagaaggaagcgggcgactaatctgtcgccgggcgatacacttttctcaacgcgctaccgctcgattgcagcccgaccctggtgataaaaaacgcggtttgtgggacccgcacaccacagccgatcccgcaacgctccctccgcttccccctcgacgcatatgcggcgcgcgatctctgcctcctcgacgcccgctcgatctccgntttcctccagcgcgccatctctggatgcagtcaggctaccggcgtgggcggccaggtgcagcggcgtgctcccaggccgggaaagcgtggggcacgagacgtcgtccttgtcgaacagcaggtgcacgcatccagacggccttgcctgggacccctgagctaggtgcaccagcatggcacccgcgtccctgacgtagacgaagcgagagaagctcgtaagtcagcaacggtccggtccctgcttgggataataatattatgggttaatctagttagttgctatggtatttgagttatctattagtgcttgtagtttccatactacatagaacttggtttatatggtagtggtagtgtttgatgaataaaattcatgtcacagcacaaatggctacagggatataattcactcttgatcctacacattgacatgtacatgttataattaattatttgattataagatgtagtcatccaatgaataagctattgtacctatagttggctttaggagtgggctattagccagcagtgggctatactattagccttgctctaagtagcatatcaaatcatttcatttgaatgacttctatttcctctgttatttagtaaagatatcaaggtaaaaaatgaaatattctctttcagtcacccaggggcggatccagaaacaaaaaattagggggggggctcaattacacagtttcttcaacctccagccatttagggacctttagtttatcattcatggttaaaaaaatgaaaggggtgctccgggggtatccatggatcttgtgggtgtagaggggccctgcacccacgttggatccgtccctgcagtcaccttattggtcaaattttaaatattgatttgcttagacttcttaagtatccgattggctagagaatgtatggaatttgttcgtgcattaaattagtgctcaagaaatattttcgtcgtagtatacattttgaatcctacgaatgcttaaattttgaaacaaatggagatcttatattgtatacaaaatttaaatcctccaaatgtatattgaggaagaaaaaaaggtacacgaacatattgacgacacggcaggatttcaccggggccaaattaactcgtactacgaactggtagccacgaggcaacgactattgacgcagtttggaagcgagtccccctggcccctggtggtcaagcgtctcggtgatcgcgacgagacatcaccacaccaccgtcccctcgctgcctgcctccacctcacctgtgtgccgcgcgccaaatattccaagtagtgcacagtgcacaccgcgacgcacatacccacccgccggccacgcacgagaccccggttaaccacgcgtgtgtgaaccgcacactcctttccctttcctccgctaattaattcgcccaactaaactactcacctgcgtccactgcgatcgatcgcttaagatgtcagctatatatatactccaagctcggtgagccagcatcaccaccaaccagagctaacatagcagtagctagctagatcgatcgatcgatcgtctctccttgtaggctagctgctatacgagagcatgtgcttgccgttctcgtcctgctttggcggcaagaacgagctggacttcggcgaaaccagcagggaccccgactaccatcccctctcaaccacgcccagcggcaacagctaccaaggtggtgacgccaccgaaacgaggtatgcctaccagcagcaacggaagcccgccgccgcaccgtccaccgacgggtcggcgaaggcgccgcctctcgctgccgctgggtggagcaacaacaaggtcgctcatcacgcttaggcacaccgccaatggcagatacacaatcgctagccgctcctgcgatcttgattcaggtatttacatggtagcagctggattagcttcgcctgcttcagttatgtatagtacaagctttggcagttaaccagtcgtttaaattagctgcccttttgtttttcttctgcatgctggttcttccatctgatgaaaatggaaggcgactggaattatattagctgccgttttgttctgttggtcctcccatctgctgaaaatggaaggcacctgggagcagagttcatcactcatgtggtactccacacaaggtccaggcaacttttgttagcagaggtctttgtcagttttgttggctttgtgcttgtaggcttgtagctcccttcttcttgtatgatataatcgaagtggatcttgtgtacattcagtcctaatttcagctttggttgctatttggaattgtggatcttttcttcagtcaattttaactttacagacttgcatgcaaatgccaaatgccagtctcgttgagagcaaccatacaacagacaacactgtgaattcctgtttaaactcggacgaattctcgctatctcgtcgttgtcacaaacattgatccggaagagcatcgaggaaactgtttattgacagtgcttaaaggtcatcacaattgccaggattaattcagcctaactaaatcgcattcacctgaactagcatcctacacacaagaaaatcaatgtcatgaatatctcttctcagtgttgacgtcatttttcgtgcatgtcgattacgtcatatttcaccaggatgccatgctagtagaatggttataattgaggtttaaaaataatcgagataggaatagcaaagacctaattgcaccctttccctgtgcatccctgagctcagatgcctctcagaactggtcagtggtcaaatagtcttccctgaaaaaaaaaacacggtcaaatgagctatcaaagtgtagaaatttgaaatatttctacctcatgactttggagtctatcagtgtgtccccttaactttgagggaaaagacaatattccccggccattagagagaaacagctggtacacacactatcctgtcagtgaagcctttatctggccttcgtcgattactatgcagaagattaacaactgcatcatttgcttatcaactgcactttcaaagttttaaaattccaaacttaatatcaaagttgattatgtttcgtggtttattttttatattggcttttaaatcattaaggatatacatatataaccgtttggcatataaaatttgtattatgttgctagacgtaggccaaacgattaagctgtaaaatttgcggagtttttggctgcctaagtttggtcacgcaagattctgcaaaaatggttctaagttggaaatttttttttgaaagaatcggcaagctgccaatttcattgaatttaggaggagtaaactttacaagtgaaaaacaaaaaagcaaagctcaggaccttcggtccgagcaattaaaaagaaagtcaagtactcagatctctcacgcctgctaaggaccacgatttggcctcctctttgattttggccagaaggctacccatcgaaagctccttttgctgaaaggttctgcggttcctttcattccagatttcccaggctaccaggagcgttagtgtgcgcagagctttctttggagcgtcttttgtgtttgcggtagcctcccaccactccgataccgttgaagcttggtgccacaggctagggtttaattgttcgcatgctgtccactctgctatcgccccccagattctccgggtgtatctacactccgcgaggaggtggatggctgtctcttggcgatggcgacataagggacagatggatccattcggccaacccctggtggccagtctgttggatgtccagactctgttttggatgatcaaccatgcgaaggttttgcacttatgcggcgcccacggcttccaaatcaggttattgaagtttgtagctgtggtgcctaggagttgtgctttgtaagccgatgtcgtcgtgtattcgccgtggctggtgagcttccaagttattttgtcctcttcgtgctcaatcaggtgcagattctgcactacgctccagacttcgatgagctggtcaattagctctatcgaccagccagtgttctccggtaggtcaagatcttgcatccattgatctgagagcgaagcctgttggagcgtgctggtctttttcttggaggccgcgtagactagaggggctacgtccttcagtcttctcccttgcagccaacccgagtcccagaagctaacttttgtgccgtctccaaccgttatagatgttgcggctgcaaaaagtagcttgtcgatgtcgtcacatggcgttcctgaaccaacccacgcctttaccggtgatctccactcgtgccatagccaccgcagccttaaggctcttgcgaatttctccaagtttaggatgcctagacctcctgaggcagttgggaggtaggttcgtgaccagttgattttgcacttccacccgtcaatgcttcacctcccgcccataggaaccttctcctttgtttgtccaaagcttctaggggctccttggatgttttcaggcccgtcaggaggaatacttgctgcgaggtaagcaccgatttaactagggttgaacgccccgctaagttggaaaatcacatgaatgtttccttttagctttacattattatttttgtttaaatactttttgttcatttcgacatcccaatgcattattagtttaatagtttcgatactttcatctacagtgatatgtgtgttgcataatgttaggatagaggtcgaaagttagatcaaatgcagtgttaaattgaaaggtgtatcagagagaaggtcatggtgccgaccctatacattgtgaattttttaaagcatgtctcagcctaagagtagagagatagtacgcctgattctagcagagagaaaatgtgcttagtagagagagtatgtcacatacattgttccacaatgttagagcatatatcacatacattgtcacatacattgtgtctactagtagcacatagccacctaccggctgcaattttcccttcgctctatttttaatgtggtgggtcctataataattcctaaagctatttttatcttttcgcttatgcttatacttattagctaaaatctaaattttcaaccttaaatttgacgttgattttagggttttttcatcgaagtttacttttcagcctttgcttttaggtcgctaagaacacgtatataagttttatttataaattactttttgtttgcaaatatatcgtttggcgaataagccaaacgatgggaccttttgtacgatggaacaattttctcaggctgctaaggatctactatggttgatatgggtcccatctttactagtatctcacatgaattatacactaagggatgctcttccacttccatcgtcttagggcatccacaatgtgttgagaaatcaggtaataggcattcaatgctcctctacaacctggtaatagccattgtggaactagtaaataagtagtaccgggtagtatgcttactaccgatagcaagggaataaataatgttgtttacacaatcgagacacagagagttcaggatgaaagtatctttacttatgaatggggggggttttttttggaaacaggtggagaatattttattggtggaccccaccttaaaatctcatacacattgtgctgcctgcgtacaactactacctgtgacccaaaacctgacactaatgctcacttcaattttatacattggtgttgcccttaaaagaacacactagttatggtgagggaataaattcctactccgttcatttttcctgtgcatggacaggcatatccaaggcaagattatttcgctggtgtcaaacttgtcaagctgccagtaactagtatagtaagggacggatcagctcagtttccagtcgtgcgagccgagcatacgacggtcgaggccctggtgattgcaacgagacaccagcacggcatcgccgccgccgccgccgccgccgtttgctctgatacagattctcgtgggagcacctggtcgccgcccctgcctgccaaagttggcctgggtggttccccgcggcatcagctccacagtccacaccacgtcacgcgatgctgatgctgccggccgcccccgcgcgcgcgacacgcacatatgtacagtacagcaggcagcgcgagcccgcggacgcgcgcgaggcgtcaggcgccttcggttaagctgcggtttggggtcacgggctcacgtctcaaaggtcgcgcgacgcaacgtagcggaactagccgtctgaaccggaacttcgctggaacagacgagatcccctgaggagggggaaaaaaacgagcaataatggagtacctcgtccaattatcgtcatgaattatttacttgaaggttttataaaaacacgttttcttcctgaaaaacttatttaacggtattgattggatcactcatcctaagctactctatctggtcatataaacaataaaaactagatgaatccccgcgcattgctgtgggaatttagtatgataaaaaaaataacgtgtaagatagctagataacatcagattaagtaaattaatgtggtttatgataatttaaacttaaattgtagaatagtgattcaaacgtaaaaagtaaggtggtatgactttacgaaagaagaaaagtaggaagatagtttggaccgtagattaatcatctaaagactaaaagcaattgatgtgatacgacttagttagaggaaaaaaaggagaaatataatttggaccatagattaatcatttaagcactaactaaatgaaaatgaactatataagtatataggatatcataaaacataataaagatacacattgatgcatgatgtttaaatgtgatgattgtagtggatgatgatgtggcatcttgttaattagtggatgatgatgtgacatcttgttagtgaataatgatgttgcatctttgcatgttaagcttaaggagttagtgggggtctgcttaacgggtccgtttcccacttgcttgtacaagacttggaagaaaaaatagttagaattgtgataagaaggtaagaacaccacttacctgccccacttacatctaggataaatatttgacacagttaactttggacataacgtttgaccatctgtcttatctaaaaaatatgtaatcacattgtttttggcttgttttattatgagaagtaaaaattatgttaaaattttttgagatggcgccccaccatcctcttcatattgttatggggatcattcttgttgttaagtatttaagcatacatttattattatgatgatcttttgattgagtattatttccagttgtactgctgacatgacgttgtattgatcgtatatacacgtaacgtctgacaattttagatgtattgatcgtatatacacgtaacgtatgacaattttagtctgtttatgagccaagttcgtactgactttgcaaatatttctgacatccgaaacaatctgcactgcatccgtcctaaatccacttaagaaatactccttcggtcctaaaataagttcatttttttctcctcctgtttgttctaaagtaagttcatttttaatacaaatttattggaagtaaataaagtgaggataatactaatgggatttgatggagctaagggtattctaattctttttaactttgtattggtacgtgtgaaatgagtgaaaaatatggtatacaaacaactctaatgggaacaattaattgcttatccgtggccttgatcaattactgtgcaaaagtacccggatgaagccaaaggtttgtctgagttttggctacctaaagtttggtcacaccagattatgcaaagtggttataaattgaaaatcgtcttccattatagctttggatcgaatgcttttgtttattttgacatccgatgccaatgtgtgctaactgcataactataggtacagaggtcagaagttacggttccatcgtcttaaaaaaaaattctaatataaattctccgtataataataagagaataagttcctactccgttcagtttctccccggtgtcaaacttgtcaagctggtaagcgaggatcgactctgtccccaagcgagcaaacaacggtaaggtcagcccggtgcataatatgattgcaaccaaacgtaccccaccaccgtcccccgccgctccggtagattcttgtcgagcagcatgcgaggccgcccgccgcccctgcctgcccaatccgcctgtctctctctcgttcccctccaatccaccacgacgcgccgatgccgatgccaataacgatgccgccccgcgcgcgcgcacgtacgtacgcacgcgacaccgcccaccacagcaacgcacccgcgaatagtcccatgaacgcacgcacgcacgctcgacgcgcctacgttgggttgggttaaggcagcctcggttccacgtacgccgcgcaaccgcaaagcaacgcaacgcaactagccgtctgaaccggaccccgcgagatgccaagactcttccccccaacttaggtcagctcggtctatatatacacataacgctcactgcgccactatcattcgtgtcaaggcatcgccaacaccaacctagtcactagatcatcggcttgtctagcagcagcagtcgagcatgtgcttcaagctgggcacctgctttggcgttggcgttggcggcggcgacgactactaccgaggctacaccaccgtggccaccgacgagacaggccgcaaagccaacaacgacgtcgcaagaaaacccgtcaccgccgccgccgccgcaacgagggatgtctacggccgcgccgccgaccagccgtcgccgaagccgccggccgctgcgaggaacagcaaggtcgctgatgacacgggggtaaagcagccagctgatgctgctgctccggtcatctcgaggtatccgggtcatgtctactagttgcatttactacatggtaacgcacttggataatttgcagacaatcgagagagtttagtgcagagagtttttctgttctgtttggtcctcccatctgctgagaaatggaaggcacacatgggagcagagttagttccgtcttggagtcttgtgtgtgacaaaaggttcagagaacttttgttagtacttagtacaggtatttgtcagttttgttggcttgtgtagttgcttgttcttgtagctgcctcctcctcctcctccttgtatcatataatcaagtggatcgatcttgtgttcattcagtgctaatgtcagcttttgctatgtggaacctcttcttactttacagacttgtgtattgtgctagtgcagtgttgttcagaacaacctgataatgagtactaccagatgacattgagaattcctgtttaaattccaattaattatgactctttcatcgtttgcacaaacattgtgattggaataggatgggcaaactgtttattgcaagtgctttaaagttgataaattatcaattgttctgtgtattcacttgaactagcatatactacccagcaagaacatcaattgttctgtgcataaagtactcactattggatgttggacattaaaagcgagggtacaaggctacaggaagacaaaagtttatgccggcaaataaaaaagggacatggagataacaactgacactgtatttacacataagaagatggatacctccttttctctatacggttcttctgtttctctgttcagggttcttgacatgtggacagctgcagttttattgatgaaatcctaagaagattttcctatgtgcatatacttgtgctcgtccaatagcagctcctttaagccactcgttccttttctccttttcaacttattccatttgttatgccttgtgtttaaccatttccgaagagcatcggaatacagatatagatactgaggtaaaaatctatcatccatattcatcacatcaacttgtctgcgtgtgcaggaaatggaaaaggagtgcttctttcctccttttatttgtgtttgtggaacagtgaaagtgaattagttgctttctgtaagttttttttttaacagctgttataccctaaatcattaagtgttagtatattatattccaaacataggttcatgaagtggtaaagagtaaagactgctttctggctgaacacctaaacagagaattcggtgcgattctaccagaaaggcaaagacggcgcatgtttactatcccatccataataaaccaccaaagtatgcgacatttcttatgtggtaagtgtatttaataatgccaatcatgctttttcgacaagattaacaaaacatacaacagaccgcatttgcactcatggtgtaaagtagagaattcagcctagtgctttagcctctaacttagcaattaagatcttgatctattctctttagcttggaataagaccaagaatggagaatcaagcggttattcgatggagattgcgctcttgcctaagaactgacagagttaggaacactacaccgttggacggtgcaacctggaagacatgttgaaggcccatgtgactgtcattttcggacctccattatgtttcgttttttaactcaggaataagttcccaatcagtacttccactagcaactaaaacacactaagacatggaaacgatttggacgcaacaggtagacgtagacctggggacgactacgctagcatatgctaactttatgatttcacacatgatagttggataattcagtatgaggcttgagctctagttgctaatatttgttgattacaagcatagaaggtttagtcatgcttactgtacatgccgcttcctcggttttcaacatgctagggatgttacacacgaccagcttccagatcatttcttgatgtcctgctattgtgtagtctagatagctcaacatgatgcccacacactgactgctggctttctgcattgtgggagttggccacttgaagctcctcaagcatatggaagtatgcatacggtccccaaccttaagatgaaaaggaagagagccactttcaaaaaggaatattcaaatttgcttaaggaagagagaaaccattccttggtgaacgaatttgcttaagaaagctgaaaaaccttgatgatggtatggaggtggaaagaagtgcaagtaacagagcatcgccatgataaatcctgaaacatatcaattcaatgtgatcattatgagtatgaaagtgtgcaatacgtatgtggagaaggacagggggagaagaacagacctagtaggccgccagcaaacacatcctcccagtggtgtcgatagtcatctattctagaaatcccgacgagtgaagcaataagaaggggaagaatcataatgcaaagtttggcaacatgaccttggcgatcaaacaccttaattttgccagataggtagagtgacagaaatccaagtccagcaaaagaccctggaagcattatttgtgtaaaataatctagtcatggatttagaaaatcagtgtacaaattacttcacagtttttcatgtaacaatggaagtggtattcacatggtattcacctgacataactatgatcatgccagacagacaataagacatacaacacgaggatccagactatcgagtcaaggtccagccgtccaggtacaaaacattatttttgaaacaatggtacaaaacattataataactgagctacgggtaggatacgcagcacttgttgacaacctttaaccagtgattgatgcttgatacctcaaactaccagctactaggaaatgcaaacttatccatcaaaaatcacatccagtgtagatacgcactaaagttacaaacttacacgacgtgtgtccactaggaaaactcttgcgtccatcctttaagaagcttttctctccatgacaaatcacatcacctgtcacttgatcatataactgagataaaattaccagaacagtgccttgtcagtttcaaaattgacaaataacaagcaacataaaatggtagaactatttgtgcataaacatttgaggaaaactctacctgctttccatcaggaaaacaccgccaaaagaagtctggcctaggtcttcctactgcattctttaccacagtagttacaactgcagttatcagcaccgagtaaagcacacctgcagaattaacattctgatgagtttctcggtatatgaaattcagaactttgtattcagaagtagtgaaccatcagaagaaaatggagacatcgacaatcacctaatgttgcgtgatgaagatcatagacatctctcctagcgatataaacggatagaaagataattacagggcaaactatggatattatctgccaagaggaccgggtatccaatatcagcgatgaatgtgtgtattgagtttgtataaggaaatggaaatgcagaggttcggatacatacaggaacaccccatgctggtacagtgctttgtttcaccgggtaactaacataagtcatcatatccttcccaacaaaccggctaaatggaggagcgaaatgcagggcaatcacaactgcagcaagtaaaataagaacgacccaatcatgcaggtgatttctggccaatctaactccatgtgtctgaatcgtgtgagggcccagctgaacctccctcctcccatcctgttgaaaattaatacttataccaagaacatcagtattctacaagcaggcgtaccataattaagcctagatatgaccagcatttgagtttcaggaggtaaacataacttgcattactgcaacatgagataagttcaactaggatgttaattagattatattgcttcacatctaaatgtgaacatcatatctgaacatgagtcctattgagtattggccccaattttgattctgaggcaaatcctaacgaaacttggtttcatgtaataatcgcatcataaatattccaacacgttactcaagacttacgacgaaggggaaaattgcaggccacagattagagcaagtttaatagtacagctcactaattacaattagtcaatgttaaagctaacatgtatagtaggttggctataaggttatctttatttttttcatcctctctctttctctcaccatgaatttaatgcatatttcttggagtttgtgtgcagttagctcttgcatgagagccaacactccccacttttgtttatctctctcttctacataaacatatagcttgcttatagcccactattatccttgctcttacaggaagcagcattagactaattgcctaacaccctatgcaagaggaaggtcagatacagattacacattaggggcaaaaagcaacactgaaatcacaagcatcgccaactaagtatccgatcaatcaatgtaaagcgcattaggatttaggaatttcatgcgtctcaatggtgcgaggaatttcagatgtaaagagtactatacatctgtcaaatcgaacatccttttgcaaagcacatcagagcagtcaagagttgaacagaatgcaaagagctcattggtctcaccgtattctctccacgcattgaggactgcagaacaaaatcaccgcagatggatgcgaacctgtgccccaagtcagtacaaattccccgggtttccactgaaccaagcaaccaacttcctcagaattttcttcaagacatcagtattgcattcgcagcgtattccaaatccctaaatccaaaagcacaattagatagagaaaaaaaaacttttattgacagctttaaagtttaaaccgctcctaaaccctaactgcctagcatacgagctgaataaccaggactgtaaaaaccgaaaaaagaatgcaatggttgtggtgcgtacctagtagcgatggaagcgagaactcaacgagctcattggggaagaagaagaagaaaatcctcttttcattcgatcgagtctttttttttgagagagacgatcgagtttttttagtagagtcgtgtggaaggggacgaggcgagaaacggagaaaagaaacttcgcgagcatcgggaatcgtgagagagtgaattccggtcggctgcgcctaaagcggtggcgacatgggctgggaattccgcatcatcatggccttctcctttcgtatgggctgaaaccaagcccacaatataactaggtctgcttacaatctgggccaactaagcctaccaatgcaaagagtctctctcttatctttctttttctttttcttttttgacatggcaatgcaaagaaaatcatactggttctttcaacaatgacggctgctctcaaaagaaaatcctatatgaaatccccgcaaagaaaaaaagaaaagaataaatcctttatataaaaaaagagaaaaatcaaccgatttggattggcttgcggcggtgatgctcctgcaggatgccacgtgcttcgtacacgccggaacagcgtcacacgtacgcctctgacgtggcagcctgccgtttcatgtgcaagactgcagcaaacacagtacagccttagtactgtagtatacgtactaatcctgtttcttcttcgtcatagaactgttgattttatctgtttaaaagaaaggggtttttccaaatccaaaatcacgacgaggtctagctggaaaatggagaagaggacgcggcctaattttgcaggggagcaaagagagattcgattctctttaagctgctcgttgccctgtcaggatgtggggcccgcataatatatgctcctcctcgtaggatccacctcatcgttggatcaatttgacattgcatgattcgctgagacaacaagagtccgtcgcttgcacgtttgcatcttggaatcacatcctcactcctcagaatagttcattttcttctcccccgactatctcaaaataagttttttttttcaaaacgagaataaatacattaaaatagatttaaaaagaataactatattatgaattaaagaaaatgaggtactctaactttacatggatatgtataggatgggtgaaaaataaatttattttgggatggtgtgtatcctgtaaattttacctatagctttagggtcccttcgttttggaggaaaaacataggaattttagagaatttcaattatataggaaaaattgctatgaatgcatttgaatcaaagtatattcctatggaatggacaattctatagagattttggaggaaacttaacgagagctcaaagctattggaaaatttcttttgagtttatctctcttattcgatttctatgtttttcttacggtccaattaaacggtcattcatctgtgttttcttgtattttacaattctctattttacactttcattcatgttagaattctgtgttttttctatttcttcattttttttttcattcctactatttaaaacggtccttcgtttgtccaatttggacatatataaaacctcaaacttacatttttaaaagaaaataataaaaatgttttatatccatgggctcagatcatattagctgagttaatttcacataactcagatcagacggtagagataaatcaactgcttcttaaacagtttcagcagcaaaaggcatgggccctgatggagtatatgcagccagagacatcacatggatgcatgagtttctccttgagagatcgatgggtccataagactactctaatccagttgacaagaaaactagtagagcctattgtgctatcctgattgctctctacacacatccatatacaccggtcactttcagcaccattatacaactctgcacacaagttaacacacatagattaagtgatctacaaggttcagaagtaggtttatggagtgctgcaatgatgagagaagaaacggtagctgcacattgaactccactcagtttcctgaagatggtgagggagaagattaattagtttatcatgttatccaatccatgtcaacgtcgtatgaactaacatggaaaactaagtcaacgactaaggctgtcgtgcatacaaagcctatgttgagcctactagacaccaaaagaatcacaaaggaacaatctttttagctgaacaattcttctcatgtgcctgatactatcgcttcattacttaaatcaaaggaaatttaatggttactgtatactcatcctaatatatatcctccaggtatctaattacaatgtactaacagatttgcaaggagtacaaaacatgaaagaaaatgatatgtgggtgctttaccctttgttcttaagaaattagcatagatgcatgcatgacctgatgtccattaagcccacttgccaaaaataagtttttgctggtacaccaaacatgtcctcatataattgtttttctaattactaaaccaaagggcctctcatcacccatgttctggtaagattcccattatgatgagcatccattaattattgacactgagcttctttttaaactaggagtttatgttcattagatggcaccaggagtacgaatttggagtgtcttttcaaaaaagaagtacaaatttgcattacacagggtgcagagaaagtatggtgcactgtttagccatgtgcacagcagtttatcaacaaaacctttgtctagcacgcaggtaagctgttttacttagcggcattcattcttgcgcgtaaaatcaaagcgaaactctgcaaaagtgctaattaagcatcttcagattattattgttgctgttgctgaatatagactgaaagccagaatatgagatgaccttcttttgctccagttatgctctttctaatttgaaccaaacaaggtggggtgcagaccaaacatcaccttggttcgaatgattgaaatgataatatttcagaaattggataggcagtagtgaagagaaatatgctacagaacagttgcatgaaaaaacaacaggaatgcgtcgttgtcacagagcaatcgacaatcctgtgttgtgttgcctagaatgagcccaatcctgcatgcacgtatacgtcgtcttctccgtttcatacttgagagacttcgaggtggtcgaattggcactcatggagatggagaggtgtagcaattgtcgccatggataatgctggatattggagaaggaacattggggtggggccctcccgttgttatggcccactctgactaatccatttggtccatcaccctgatcagctgataccatgatggcccggtcacccaatcctattggcccatgtcggatggtgggccccacatgcatctcatcaacttcacaaataaatgggcgtagtaaataatactccttagttcaacctaatatagacgtgatatatctaagattaagattgtcaatatctcaattagtattctagtatcttatgatactacgattcacgaagaagaaatgatactgatcccttcgtatcataattttcatagcatctcgatctaactattcatttccacacgattttacgaaatcttagatagtatcctgatactacgatcctactaaatattatttaaaataaggtggattaaaaataatgtaaataaatatgctcaagtttacctaaaaaccaattaaatttataaaaaacaatatatatactttaatttatacaaatagtatatattttatataaaaatatgtaatttctacaatctaatggtatcctgatcctaggatactataatactataaatcacgtaatactaaagatcagaaaaacaattctacatagtattgattacgactatgaatttgtattatgatgcatttatatttggacagaggagtcatgtattactgaggctaattatcgcgtcagttaaaacagttggatggaagtgttagctgcaccaggagatcgatcagctgttgtgtgcatcagcagagcaacctgtatgtctctttacctaattttgctgctggtaaaaacattcactaagcacatgtaggttctgctaattggagtacctaacaaatgcaatacgagataaatggcttcttttttacacgatcaaagttcttgcacaaagtgcataatgatatgacctttccctataagagatcaagcaatcagatatctgcaccaaattttttttttagaaaaaaaaaagcagaggtagctttcagctcgagagagaaactgggacgtgtaggagaaagcaggtggctggtcataatcgccattcaccatcaaaatgctgagtcttttctatcataggatcaacaccaaccacctctgcaattgccggactatttaatcggcagctagcgacttttgaccgagggatacacaaactcacactaatttgtcgccgttggataacgatcggacggcacggtaacattgtcacatgcatatatctctcacgtcgcaagaaatttcacacgagactatatttccatctgtttatttgtctgttactgttgttgctgttcaatgatcacttgcatgcgcatcggatgtgaagttgtgaacatgaccgatcgactatggtattggacaattcccatcgtgcttgaattcacccgccattggggacttgtggatgtccatgtccaattggtgagtgttttgctcatatcttcttattggggttatgctatatatactgatgtagcactagttatgcatgaaacaagatttcactgaaatggggcatgagtagatgattaattatctttcatctttaatttgcttgtggatatgaaatgtgttctttcatggacatgaggtaactcggatggcgatgggtttgtcctccttgatatatactaacgcttgctagtttccttaattcttattcagttatagagttgctttctgacgatgtttttttcgctttatgcgtacatgaacgacaacttgataaatatacgagttgcctacgcattcaagcgacaagaggagaggggttgttgcatcagcaatcgctgattgctagctccaaattaaaaaggtcatggctcgatctctgccagaaaaacaaagcagatagataaatctatcaatcttcaatcgtcgacagttcttcacaagtactcgtaccagtactatctagcgtactagtacagtagtacgtgttagggttatccctaactgcgaattaattaaattaattagtagtaatttgttgcgcttgtcagtaagtaaattcgtcagcaacgtagtaaggcatactacgtacgagcgcaccatcatcatccagcactaggggggacaatccgtattgatttgttcaacgaacacacacgccgatcggtggaaagtgagaaaaaagacggtgaatccatgcgacgaccggcctgcgcatgcataatcgtcgattcgatcgatcgatccaaagtattcagtcaagacctgatcgcagccatgttcgcggagaccaattattcagtcaagtctgtcaagacggggaactactacacactactagtgcagaagagcataaaagcagctagctaatgcactagtattaactagtatcgcggcgtacgtctctcaccggttggtgcatcagttgtgtgaggagtgaagaatcgaagctgcccggccggccagcacgaaggcgtacgttgccaggtagcagctggacacacagcgcggcagcacgtactcgcgagagcgagacacgaccacgcacgcacgcacgcagcgtcacgaacgcggagaggccctcgcgcgcggccgctccacggctcggcacgcgggcggggacgccgtggatgcgcgcgcgggggagtcgagcgagacgtgcggcttcctagcgcggagtacgggggaattcgctggatagatcggccgtttgacgcgacgttctccttttccatccgctgcgtcagtcatcggatgtcgtggcagacgccgtgtgcgctgcctctccgggcggacgaggggcactcgcctcgcccccgcgtccgactctgatccgcacatgtaggacccggcagccgggtgatgggttggattattggattggattgggcgaggcgttcgcttcgagcaaaatccgcccatcgattcatcgtgtcggcccagtcacggaaaaggaacactctctactgtactactctacatacgtgatcgatcagtgcgtccgtgctagctgtgcatccatcaatggatcgattatacatgatgacataggatcgatagagagaaacaaaaaatgagatatgaacaacacgctatctgtatcacgagtcatctttaacaatatccatctcatcattttattgcctgccgaaaaatattcagttcagcctccacaccgctcggtcgccctgccccgggggcgacgcgggcggcgaaacaagccgtgccgcccctgcccctctcctcccccctcccgcctcgccgctgcccaagccgcaaggacggcagcggcgaggcactccctccctcgctcgcggtcttcatggtcggggcgtcggcaaaatcggagcggagggcaagacgccggcgccaagggaagccgccggcggcgtccagatccggcgctgggaaacatggatccaggccccccatggccggatttgttgctccgggcggcggggagccgagctagcgcgtgggcggcatcagcggtgtggttggcggccggtggcatgcatgctgctagcggggttgtacacgaggcgttcggtggcgagccggacgaggcggcggcatggacgaggtttcgcggcggcggcatgcatgctgctggcgacctcagccggcggcggtggcgtaggggttggggggcgaggtggctagatccgcctccctacccaggctcagtgcacggcggcggttgtagcagcggtggtcatgcaacagggtgcggctgcatggagggaacggggaggccgactcccgtgtggcgacggcgacgacgtctatggcggctgcgtggctgtggctagggcggcgaccgtcgcggctgttgtggaaatagtcggcgtgggtgtgggcggcagcaagtggaggcggggaaggagtctaccggtgagatgcacggcgcgcaggcctgacggcctcgggcggcttgctggtgtggaggcgaccgtggtgcggtggtaggaggcacggttgtggtgaccgtggctacacaaccatggctaaggtggggcgaggcatggcggccttggacggctagccgagggcgtggcagacggctgcatctggccggcacggcaacgtttggaggaggggtcggatccggcttggcgcagagtggcgcagccgatggcagcggaggccggctcagcgcgagaggcgcgggcgacggagatggaggccggcttggcgcgagaggcgcggccggcggtggaggaggcgacctcagtgtaaggaggagctgccggtgggtgtggcgcggtcttcggtgcacgaagactagccggcggggggcgtcggtgcagtggtcccacatgtcggtagaggttgagtggtggaggagcatcggtgcgttagccgtggatttgcaggtggtgaacggcgggtgaaaacctagcccggccttggccggaccggcaacgatagttaattccccctcctgagggcgttgtcgtgctgtctcacccccttaagggtgtttgccgggtgaaagcccagtcggagcttctttgagcctcgacggacggcggcagcagttttccgtcgcttctcttcttgaagacgtcgttttggcatcccctagctgaaacctctagatcgattggtccaagctcgctctaggagttgggctttgtgttggttgtgagggcttgggcgatcccgtttgtgttcctttattggtctagcggcggttggtcacgcttagcggcggccggtccggtactaaccttcttccggcttgtgtgttggtgctgtcggtgtgtggtggaatttttttcctttttcctggttacgacccttcagggttgtaatcttgtaatttttttctgctttatcaatataacttcgcaccgtctcgtgcgagtcgttcaaaaaaaatcagttccattttattaattcattttattaattcgtcatcagtcatgcattcatgtagtccaatatttccatctgatgtaatcatcctgaaacagcgcgacacatgatattgttattttcctctcctactccagcacgtacatacgtacatcacccaagctctcgttgaccaatcgattgctagcgttttaggttgctctaatctgcaacccattgcattgatccatcatgatgatctatcgattgtacctactatcttttactatgtctcaacatatagcagcaccaacacataattaattaaccggttaagatacccttctccaacaaaagcacatccgttgttaattaactaagttagttcagttcttctggtgcgtacccttttgccacgcaagaactaccttagctttttctccagctggtgcttgctattactctatacgcgatacctaacttatacgtcaaattatatcaatatcaaaagattttaaaagtacgcaatttatataagaatgctgctcgatcggaaattaggcgtttcgatcagctggcctgcactgtacgtaagcttggagtctacttcatttatctcgacagaaattagttgctctcaatgtctccatcatttttcgtttgatatcctctacgacatgtacggagtatatctgtatatgtaaaaatatttctgattaatccatactcgaaaaacatttttttttcttttactgatacagtaaagtcgatttgatctgttgatgtgatcagcctggctgtcagcccggttgttcaattcccaagaaggttaacgtttctgcttgtccaacggccaatcacaaatcttggatcttgcatttgtagcattacttttgtaattcttcggcaggtttccattgctcagttccttttttaaaaaaattgtaccagtacgattctactgttccatcggtgtcaaatgcaatgaaccttgctaatttgttgtttcaagctgtcacgaatatattaagtcatccgatgatcttagagcatgttcattttaatgccatttttaaccttactaaattttggtaaagttaccaaaatagtggttgtatttaatttgctgccaaattaattttggtaactatataagaaatcttgccaaaattttggtaaatatgctaaaattttgtcaatgctaaaatttggtaatgttttttttcatcaaagtaaacatgcccttagtaagaagaaaggaataaaattctttgctttgttgttttctcaacatcttattgctttagatttatattctcagagagaaaataaagtcgttgccgtggaaatcagactaataccattggcaaagggcatcatctacactgatattctttcaattttgtgttgacaagtaacaaatacagtacatactgaagctcgaatttgaaaaaaaaaatgctgtcttgtttagggactttcacttagtaattcaactattttaaaacaggttaaatagctcagtctcacttttcccttacaagtacaatttaatggtatctcaataaatattaagggcttctttgatttggaggaaaaatatatgaattttgaaggatttcaatcttacatgaaaaattcatataaatcactttgaaccatatccaatcctattagcaagagcttaaagcccttagaaaattttcttcgagtctatctctctcatccgaattataatgtattttatatcaagagttatcaatgagaaaaaaaaacaaccattatcattgtaactaaaccctaaaattcgaagccaaaataaatcttagatcctcctaaatctaaaagattcatttcactgctagaacctagaaggtctgtcatctaaaataaaacagaaatggttgagcctttccttttggttaacggaggaatagggaaagaaaaccgctccaggtgagccgccgtgcggcagctagatcacagggccgcaaacaataattcgcgatatttccttcaagtgggccccaccaccttcgtcttccccctttcctcagcctcctccgcgtttatattccccgtccactccgccaaaagcccctcttccgatcttcttcttcttcccccaaaaatctaattaaaatcccctcccccaaaaacccctctcacccgaatttcctcatggactcggtgccggccgccggagtcggcgtcggcggcggcggcgcgggcgcgggctacccggagtccacggagtcatccccacgcagccggggcggcgactcgtgggacgagcccttcccttcctccgccgcggcggcggccgcggctgccgggggagggaggctccgcctcatgtgcagcttcggcgggcggatcgtgccgcgccccacggacaagtcgctgtgctacctcggcggggagacccggatcgtggccgtcgagcggaacgcctcgctggccgacgtccacgcgcggctctcccgctcgctcctcggcggccagccgtttactctcaagtaccagctccccaacgaggacctcgactcgctcatctcggtctccaccgacgaggacctcgataacctcgtcgacgagtacgaccgcatcgccgccacctcctccggcggcggctcctcccgcacgtcgcggatccgcctcttcctcttcccggccaagcccgagtcatcctcctccctcggctccctcctcgacgactcctccaagtccgagtcatggttcgtcgacgccctcaacagcgccatctccggctccctcgacggcatcccgcgcgggatctccaccgactccgcctcagtcaactgcctcctcggcctcgaggacgactcctccacgcactcccgcggcggcccgcctaactcttctcccgccgaggaacagcgcgccaaccagcagaagctcgccgcggccgcggccgttgctgcggcgaggcacccgcacgacgtgcagtccgtgccggactcgccgatgattgacaagaactcctcgttcggatcaacgtcctctgcgccatcgctgtcgaatctaccgccgatacgggtgcggcccgaggatcgcccgccggatagccgactcgccccgcaggttcccgttgaggatcacttcgcccagatggggatctccgatcagccggtgcagcctgtaattgggggatacatgcagccgccgccacaggtgccgatccccaacatggctgtccccagcatctccccctcggatgcgtccagccgagtgttctccgacgatgacaagtccgatcacggcggcggcggaggtcggaagccgcagccacccaagccggaggttccacctgtcgctgaccccaccaacaggtaagccatttgtttttcgattcttatactggattagtaatatgcttggattggctgtatggaaggaaaccttatgctggctatgtgttcgatcaaatgtttcagagccatgtactacaacgatagatcgcctcctgctgaattgaagcgtgacatgccggttggaactgatgctgccagctatcgtgtgcctgtgccagcccaagatgctgctgccgccgccgccgctgcggctgctgctgcccagcaacccccagctgggtatgtgtatgcacagatgcatgcgccgccaccgcagcagcaacccccaccaccacagcagcaacagccagtcccacagcaatatgtcactgcacaaaatcagcatttcattcacaatccagctactggcacattcatcccaatccaatcctattaccaccatccggtccctcagcaagcaccacagccgcccatgccgcagcctgtgccacagccacaacaatcacacgctttcgacccaaatactggcatgtattacattcccatgcgcacgaatgcgcctcaggcatatagcatgcctcctggtgccgctgctgtgccgcctcccacccttgttgacactacaccaaaaccaaccgtgccaattcctcagatggccgtgaagcagcctgaactgcagcaacctggtttgtaccgaactaccgcagcacctacccctgtaccagcgtctaatgctcctgcgtatgctgggatgggctaccaccatgttattcaaacacaccatcatccagcgccacagcctgcagcgactgtggcaggcaattttggatatgactatggtgatcccacgcgagcacaggtcttctactcgcaggcagcggcaccaccaacattgccacctcagtatcagcccatgggctcgcccgatgctggccaggctgacctgaaacaggcccgggcttcatagctcaaggatttgtgaactctggtatgttgagaatcctagaagtgtagttatcctgccgttaattatcactattgttattacatgttacatgagtcagttggcaaccagtggatggatgatggcattaggcagctgtgcatttgggatcaaaataagatgaaaatgggatggtagttcttgtgttgggtgaaactcaagagggtgtttgtgattggttctggagatgccaatcgccaatgctggagcaagtggcggggagtggcttccaattccaattgccgtcttcttattttttaaaaaaataaatatatagtgtctaaagaactcggtacaaattctgaatcaagaactcatcatttgtgtagccctttgtatatttgaacctggaagttattgaggttgaaatgtcagataaaagtgtcattactttgcttgtagaaacttcatttgagttaaatatcatatatatacatcattcctgtctctgtattttgccattgatgttgatatgtttcttatggtttattacattgacttgaatcttgctgctattgggtcatcacagttccgtgtgtgtttttcctttgggccagttgcttttgaattggaacttattggctcgcaagtccaggtgatttgtttcttttcaatgtatatcgctttctgtagactgcccgcttgcaaatcaagtcagcatgaacatctatcctgttcattctataacgtaatgttacgggcacggagacagaagattgtgcatttatatggactgcgagccttcagtatcagtcccatgtattactaggttatcaaatgagcatatatattttttgacgcaaaaaatgagcatatttgcttagctgctaattcattactttttttactgtggatttctaatttgtataagtaatcctgattttcttgcaaaatttgtataagtaatcctgattttcttgcaaggaggaattcaccctgctatgatttgccaatatgatggatgcactaattcagtggggggtatttgtaagagttgctaggtctttctcagttgattttcgcatccgctgaagccgcgcatatatttggcacgagataatctgttgatacgccaccatggtactcctaggttgcacctggcctgttattttagcacataattatgcgtttctaatgtggtgtgatttgccggggatcatattctttttcggtagcgagatcccagtgccgctttgcgatctcgaagcgatggttgtaatcgattgcttggactaaagaggcaacactttcttttctttcttttggagccacgctagcttaagatatagggtaatgctaggtggttgatcgatgggatgatcattgatctcgcccttgcctttacggcttgtctgctaaataatttaagcgttgtgtgtagtatatgattacatgtgtatctctcggtggccaagtcgaagcacagctctgcccatgcgcaattagtttggtacgataaaatgatctcacgaacaccactttacggctatctttctactcttgagtacagtatattcaatccaaagggagatctatgcccattaatcaatctctccacttgcaaactcgcaatcccttcctctttctggttctcgtttcagaaactcacctctcctctccacttgcaattccttcctctcctctcagttctcgtttcagaaacttgtttgggtgtgcagtgttcttgacatgggattaccgctgtgtgtatggtggttcctacaaaactgcgcgagttgttttgggtgaggcgcacgatcgaactgtgggaggaggcgttggatccggggaatccaggaggacgcggcacgaggcccgggtacgcaatccaagctggagatgggcgccacacacttgcacgtggcgtctgcgccctcccacaccctcgctcccctgctgctgctgctgcgtcgtcaaactgatgcccacctgagcagatcgacgagaggtgcgcgcgtctcgggcggagccgacgccgacgccgacgacgaggagcaagtgaacaagcgcatgtgtgtgtggacggtggatcgggtgattctcctgctgcgccaccatcgcatcgtgagtcgggaaacatggagttttggacggtgcgccgtatccattctccggcttctcgccgtgtccgagaactccagtacacgcaggtgaggtaggggccaacgccacgctgccgctgcgtgccgtgcctttgcccacatggggggtactactactactactgctactcgacatggcagattggcaggcagagagaccagtagtgcagtactgcgatgcaaggggaaagccaggcaagcgtgcctcccaaaagcccagatgcgtgtgcatggttttcctctcctctcctccccggcgcagcaacagcagcaatcatacatggctttagatgggtacattgccaccattgcatctctcctcttttgactgcctgcccaaaggccaaaaacctggctggctggctggctggctccatttgtcggaggagagatatacatactgtgtgcctgcgccaagtattaccagctgctgtgacatcaagctggagctaggggatccatccatcagcttaatcaatcaataatcatcattgatcatcacccactacgacgtactgtactacgtgtatgtacattttgaccggcggtttcggcgacctacctctcatctcaattctgacaggcagaccgtcgtgcgatcggcctacctaatcctgcttcctgttcttcaggctttcagctggacggaccacgcatcacatactccatacctggccttaattgctactaccagtagagtacatatggtttggttgatctaatccttgctgaaaactgctgatatccatagatcagtttctatatatatactgtagccgactctggtagtaccggtagatagcagatagacgggtgagcgagctagtcataaagaaacacacatggtgctgtccttcatcacatatacactttgtggcctatgtcatggtgcatcatgatgtgtctgcatcttgttcttcttggcgtgatcgatatatggagatacttaaggaatgagtaggtattaggtacatgtatatatatacattggagttttgcgagatcacatccaaatatcttaacccctaggggagaatgagagagatggatatgagatgatcgtccaagggaagatcatggctgttggtcattaccctcaggcagagggaatataatcttttaccggataggtgtgtgtctctgtcctgtccggcctcgccattaatgggtggagcccatgtgtttcgcagtcggtcaatattgccatgcctagtagtactgtcctcttgatcttcttcccatggtgatcagatcagacaagatcaaaggcgatcgtgaaagcgaaaagaacggagaacgaaagctgtgtatgttactatgaacaatattaatggaagaacagctttgtaacagccttttctttcctttcggatgtacatgcacggatcatattcttaatccggtttaaagagcgttatatgtacacatcacatgcatgtgatgttaggtcatgcacggtcgatcgatgctgcaatcttaattggtctcgatcgatcgatctccttggttgattagttgctgatcaattgattcaatttgcagtggctcctctccctcttgggatcttcttgaaaacaccagaatcgatgtcgccgacgtggctccggagatcgtgcaccgccgtcgacaccaggtggtcgacctcgctctcgtaattctcgtacatcacaggcagcgtcatggtgcctagcacaactgcgaacagaacacagccatgatcagaaaactaccatgagcttatatatctctgacgcatgatcaagagatcaatcagaaatggagttctctgaagaattaactgggagtttctgaagaaatgggtatcagttacctaggtacaggagagtcagggagctgaagcagcttgcgatcactgacgctatgaacagggagaacaccgtctgaaacatgcacaggagcagataacgtatcatattgatacaggaagtatcaatctttgtgtgcagtagcagacactcaccaagatgaacattttgatgtcctttccacaagcaatgtcgtagagcctgtgcacgaaccaagttagcctgctgtgcaaggccaggatcacttgcctggtggttctctccgacacaaaaatttcagggattcttggagccggcctgcagttaccatctcaaaacttagaactttccaggattgagaacgatacagcccatgaaaaacgaaatcttgggctaatttggtagtatcaaatggccgtgctttgtgtaaattaaatgggctttatccttgatgaggcccagattttcagataaaatggaagaacagagagagggaggaagagtgagtggcttacaggttgaagaaagcagaagcattggcccatatgaagacgacgagcatgccgagcatggcgaggtagcatgccagcgacaggaaatggtactccgccacctcgaacagataccatgccaccgtcgctccggcgacgatggacgccgacaccctcctctccctccacaggatgatgtctgcagctgcattcatcaccaatgcaaattcagaacagatacacttcgagtgattcacatcgattgcaatgagctcgtttaagcaaatccatgaataatgtactagctcgcaagaactgatcagaattatcaaaattagtcacctttgtgtccacctagggcgtcatgcagtggcctttccctgccgaagagcttggttgtcctgtgagttcgtacagttatagccattctgttgatatccgaatttgatgtggcaatacaactgcccaggatttgttcttataatcggcttcgccattgcattgtcaatgaacaaggcgtccattgcctgggaaaagcaaggcataactttggctcctggcttctgttatcggtattgatcctttggtgtccaagtgtgattgtttggggttgggatctgatccaattcttgtgattttggattctgtatgatcgcgtttttttgtttggttgttgaaatgtgcgttacttgtattggagaatgagacttttcagttgaaattctgtggagtaaaatgagcaaacttgggagcttctgtacgagcatctctcaaagacttcttacaaatgcaacctctggatttcagatttggtgcttgaaaattcttagcgatcaacttgaaaacttgagaataaagtttgtgcaagtgagaaagattcggcattaaacctttaaacaactaaaaaaagtacaaggttctttcagcaggtacgtttgtaaacatatacagtatacttgtgtagaactattgattcagaaatactgttactactgtactactactcttcagtggagtgatcagaaattcagaatacttgcatgattcaagtaagaactgaacagaatttcactctttttgtactgtgactgtgacctgttgttgatgatttgaataatttcaaacgattttatatttttgttgaaaccaagcacacctttatgttttgctatcgtcctattgttcatcccaatgaaacaaaagttccactggagtactacatagtgtcgttcgaatgatcaaatctgacaacagcctgattgaacattcagatcttcaaacaacggacagtaagcgttttcatctaccgcgtctgtccttacatactatttaacatgtcaactcacaagcaatttgcaagagattagatccagaatgatattctttggagtgacatgacctggccaagatgcttatatggtggcttttggcctgcttaaattattaaaccaccatgacaaattgacaaagacacaatgcctttccccattagcaaaagtaggagtatactatggtgccaatcacatgatacacgttagagcagacggccgcagcgtcaaatatccgcatctaacctcataatcactcactgtatagcagtagtagtagcagaaatagttcgtctctttggtcccacattaaggtgtagggtgcggttgttgcgtcgtggagaaaacgatgcttttttgctttgtaaatcatgttgtttagtaagtctaatgggtcatttgcattgtatagttgcagtactactagtatatcgttgatcagtgcgttcttatctgcttatcccttaatctggccttgggcgtttgcaaggggcaggttttacacaggcacagtgccagtgacagcgtaattaacgacttaatcacactgttttttctctcccgagtacttaattacactttgttagtgctaaactgctaattatttgtttcggccgacggcgactggccgcggaggaggaggtggttgccgacttgccgtcaactgagacggacgttttggcgggagtatcacgggagggcccacctgtcatcgagctgttcagggctaatcgccacgtttcgacggtaacccggacgtcaggttcggctcgctccacgacgaaacgcgcgacggacaaaggccacgtcagatggccctgtaggtcacaggcagcgcgggcccacctgtcatccgcgtggcccacgtgtcctcgacggcatcgatcggggcccaccacaattacaggtgggacccgcaggaggtcccatggcactgtttgcaagacattgttgccggcttcctaattttgttttctgcacgcttttaaaactgctaaatattaaatttttaataagtttttatacgaaaattgtttaaaaaattatattaatttattttttaaaaaattatagcaattattaatgtaccgctccgttttcatttttgggttgggaacatgttcatgcgaacacacctgttcacgaacagtatacagtacttggctgtagcgggcatcttgtcctggcatgtggggcccagtagcagtgacggggacagatcacgtgggcccacatgtcagtgtaccatgtcaaacctgcgcaccaactcctactctataaaggaaaaactcgtggtcgtcttcctcctcgagccattccacaaaattcggcaaaatccagtgctccagtcagtggcagtggcagtggccatggactccgccatctccacctcctcgtccttctcgcctctcaggttgtctcagaatcatgggagcatcatgagcggtagcaccagggctcaggtgctcccggtgggcaggcagcagcagcagccacccgccggcggcgccacccgcctccgcgccgtctcgccgtcgccgtcgccgacaccgcccgcgccgcagccggcggagacgttcgggttcgatgccctcaaggaggccttctccgtcgacgtggtggcggccgaggcgcggccgctcaacgtgcccctggccgcgcccttcaccatcgcgtcgtcgcggctggacgccgtgtccaacgttgccgtccgggtggagctccggagcggcgcggtcgggtggggggaggcgcccgtgctcccctccgtcaccgccgaggaccagcccggcgcgctcgccgcggccacccgggcgtgcggcgctctggccggcgcgcccgccgcgcccctcggcgccgtgctccaggacgtcgccagtgccctcccgggacacgacttcgcctcggtgagacatttcacgcaatcccgtcgaacacctgactccaatttcaccttaatcgtcgtagtctgatactctgatctaagataattactgtcacgggattcacgttgatgagtcacaactgtgcctttctttcttggcgttttctctgcagtagctgcctaatttgtgtgctggaattttgtgagaggtcattctctctggtaattggagtgttggatactgccgatatttccttgaaagcaaaagatagttttgctacaaatatgtggttgctaagtgataatacaggctcatgcccatcatatggcaacacgactcgtaattcataatcgcacatgagataaatcctagatgaacaatccaagttactcctgtaaagacccttttgggaaaaaaaaagttacctgtaaagaaccatgaattacaagcctacaataacagaggtttcacatccaaaatcaggttcacctgttcttttttaattcacatacaagtgcaataatgtaaggcatcatcaaatggttctggcctttcttttaggactacactatttcgttgtttgtttggtacaagatttatccattgatgtctattcaattgtgctcttctccaatgaaggctagagcaggagtggagatggctttgattgatgcaattgctaacagtatccgcatccctttgtggagattatttggaggggcgtcagacagtgtcacaacagatatcacggtatggccatctcagcatcctctgcattgattacagaaagcattctttcttatgaaaatcgttaatttcttctacttttgaatttagattccaatcgtgacaccaaatgaagctgctcagttagccgcaaaatatcgaggacagggatttcagactctgaagctcaaagtcgggaagaacttaaactcagatatagaagttttgaaggctatacggcttgcccatccagattgttcatttatcttggatgcaaatgaaggatacacagctaatcaagcaattgaagctcttgatagactaaacggtttgtacccctgtaaattgtaaagcttcctatattctgaaaatctttgcttttttttttgcggggaaaaaatcttagctatttaatatctgagccgtccaatcttctcctattaagctatttttttgttactgccattggtttcagaaatgggagtgactccagtattgtttgagcaaccagttcatcgagatgactgggaaggtctccgcgatgttagcattgttgccaaggagaaatacagagttgctgttgcagctgatgaaagttgtcgtagtttgcttgatgctcagaaaataatggatggaaatcttgctcatgttattaacatcaagctagcaaagctagggattcttggagcccttgaagtaattgatgctgcaagaaaagcccgcattgcgctgatgataggcggtatggttgagactaggatcgctatgggctttgctggtcatcttgcagctggtcttggttgtttcaggtttgtgtgataattatataatcattttttttccagccaaagacattgccaccagtatgattaaaatgaaaaaaaaaatgtcacattttcctgggtttctagaccttacttctgtcaaaatagccactgatgttttcccccctcttgtgaattcagttttgttgacctggacacacctcttttactgtctgaagatccagtgttcggtggctatgaaggtacaaaaacattttatttcaatctcctttgtacaatgttcgatggttaagtgaaaaaaactgttgaatgtagttcatatgacttactcaactaaacttctttcatcagtttctggacctgtatacaagtttacaaatgctcgaggccatggtggtttccttcacttagacaacaacggcttggtaagaagcatttcactcttgctgtttaagttaaatcttcatgtcctgcaatagcattgtttctagtatccaaatgtaataaaatgaagaaaacagtttttccttcaaaagcatgaacgaaacagtttggaaccaaattataatcaaatttacctatcaaacatggtaacaaccagaggcacctattcagattgaccagtataaaatggtgttcttattttaatgcaaatggtctcctcagtgactaaaaagatgtataactgattggtatatcattttattttacagaaataaggaatgccctagccctttgggagcttcacagacaacggtgacacgttcaatgaacaattaattgttcattatttaccttcaacaataatcaattggagttgaaaccaaaggagcagttgtaaacttgtaatcctatatgaccttgaagaggctaattattgttgccagtccagttaggcctgaaatatttgatcagtctgtagatggataaaataatgaggcattttcagctggccttgttgttctgttcgataaataaattactaaatatggtataaaagaccttatgtatgcagcctcaaatatgctcaagtacaatgtattatgcttacttttggtgttacctgcttcagtgctactcatacttgacaagttgctgccgccgcctagctcccttgccaccgtcgccctgctgccgctcgtcgccgtgcgcccccctgctgccgtcaagaagacatgggaggagagagtggtaaagaaggaagagaccgaggagagtatgacaagtgggcctcactttattttttttaattttttttatgactgagatgacacatgggcatcacgttagcgaattggacagtcaaaatatccggtattgtgattgacagatacgaatcagatgagacctataatttaaggtactaagagtggacttattttccacaattgacagccatccatgtttatgtgacctgattaggcctgcgccatctctccggaagagagctcaaacggcccgtcatgtcatccgatctctctccatatacagttgggcgggaaaggggaagcggagtacgtctggcactccggcctataatgttgggcccaactgacggcgagcctccggggagcggcccaatcaattattcataatccggctggacattgcacgagacagcctcagttttatgcgattaaactttgaccttaggtctgtactgatgtacatgaatccaattagcccggagccccggacacagaaatttgatctcaaatttgttcttacatagcagaggagcaattcttcttcttcctcctgtctactgaggcagctgggaagatcagcctgaagtggttcatttggacaggtattgcggccgtggtgtcacccactgtgtgcttcctccagaaaacctgggtgctagaagcggttctcctcttacacctttgtttcttttgccacttcccgattgaccaagaaggtgtccacggccgagatttgatttgtttttttgtctagttcttgtaatcgtttttgcttttgctgtactcctctactcgtctcttgtttgtttggaccataaaaatctgtggatcagaatggcacattgacacctcaataacgaaaacgaccaacatatatccagttcttattatcttcttccctttcagttcaggaagatgacgttaagtcagtgagctgctcctgcagatgcattgcacttagacagacgcgaagtcaaacaagcatgagcaaatgaagaacagaaacacgataatattatctcgtaaacatttgcattaacatttgataatatcaatcatgtcgtcatgagaatgatcaaacaaacaaacaagcaggagcacacagcatggtgtgatggagagcgaggcaagagagattcatggagcgggagcagcggagtgcagcttcctgtcgagcacctcggagcagatggtccccatgatgtggtagaaggaggcgaggtcggagagctggtcgatggacatcttcgccatgagcgccctcgccgccgcctcccgctcctcgttcagcttcagccggttgatgtaccccgacgcgttcctcaccgtcgcgcccatctgcttcagccgcttctcctgctgcacgctcagcgccgccgtgttcgactgctgcaccacacacaccacgccacggcggttagctttgaagtccggcggctggcatccgtgcgcgccggtggaggtgcggtggttgggctgggtttttacctcgaggaactcggcgccggcgtcgaggtcgcgctgctcggccggccgcggcgtgccagcttcggcgccggagacgtacaggttcttggcgagcgagaagctccggacgagcaccttgcgctgcttctccatctcctggttcagcttcggcgaggcgggcatggcggcggcggcggcggccagcttctcctggtacgcgacgacggcgcggacgaacgcctggtaggccatggggcagcccgggtagtcgaactcgtcggagccggccttccgcatgcgctccgggtggaactggagccccatgatgaacttgccctcgccggggttgtacgcgtcggggtcgtagaacccctcgacgaggccgtccggcgcgaacgccatgggcacgaaccgctccgccagccgccgcacgccctggtggtggtagctgttcaccgtcagccggctgtcctcgccgtcgagcgactccgcgaaccactcgtgcagcggcgtgccggggaggacgcgcaccgggtggcggtgcccgtcgtagttgtcgtagttgatgtggcgaacggcggcggcggcggcggggagctcgtggtcgacgtcctggtagagcgtgccgccgcaggcgacgttgagcacctgcgagccgcggcagatgccaaggaaggggatgttgcgctcgagccagcggcgcgcgaggcggagctcgatgaagtccttctcgtggtcgatgccggcgtcgctcgggtgaaggctccgcacagcgtcgagctgctccgccgagagcccccccgaccccgcaccgccgccgccgtacagcgacgggtcgacgtcctcgccctcgcacagcagcacgccatggatgggctcgaacgagtcgagcagcgtgtgcacgccggcgacccgcggcacgatcaccggcactgcgccgtatcccacgatgaggtcgaggtggtactcccctgcgaacatgcatgcgccatgcagcgcatttcagccaacgtcctaaccaacaaaaaaagaaaaatccatggaggaggaggaggaggagatgacgagagctcaccgacgaagtcgacgaacttgttcttgcggacggtgcggcgggagacgatgagcacgcgggggaggatccgggcgagatcaggggagggagacatcgccgctcggctcgacgaacacctgctgctacttaatctctgcaagaaatcaaccgatgatttcaaggcgattactcgagaggattaatcgatcgattgatcgtgtgttgttgatttgctcggatttgggagggctcaggggtggggtgaggtatttatagaaggtaatcaatcggaattgcagcttggattactagacggaatcgatcttatcaccgaattaatttaatcttttttgctttgatgaagcggatgcgcatgtgagtgcgagagctagtgcgactatgtctgggcgccgcgttacagctaccaaggtcaaaggggcaaatgactggaaattgctacatgtccccaagagatgtctatgccttgtcggactgatttcatcagtactagtactggctatgctaatccagcagtactattaaatttctatttaattgtgatgaaactatataattcggattatctttttgtagctataatccacaaatataattgctccgtttaatattacaagtacttatagctggtttggcgtctccttttaatattgtataagtctaacttcattacaaactttgctccagtagtcgctcaccggaaaagaggatgaacttattagagttagagactttgagaagaagatggccgggacatgaatctcccatatcaaattgatacatatactaaaatccgactaaatttcactaaaatgttgaaaaacaagcaaacaacttgtgaggatgttattagttgggatatatatacaaaatacacacaataatttctttagttctaggataaacggtgaatattgcataaatcaaagttgaactaatcatcacaactatgagggaaaaaatggtcgaggagattaagtgattaaatcgtttgcaatccgtgacaaccctgaaagggacatgttaaactagtgctggatgccatcatggaaacaagataaacgtgtgctaggacatacaagctaacaaaagaataaaaggaaccatatggtttttaataaatatgctacatcattttatctctgtggatattatggatttttttaggtccataattcacaacaatagaagtaacaacccatatcatatgccccgatgcttgtctattgatgtggcaactatctctttgctttggttgattatcctagttattctgtactacgctgaacacaaatacatgatggtttttatgtgggcgtttattcattgagttctctatgatttggttcatttatagatctactgctcggtgacccttgacattctattgggcttattggctcacctttgatagattcaaatgctagctctttgtcccaagggttttatagtctgcattgctagcttatatgtgttttatctttgcactagaaaaatttctaggtacacctcttgttttgacccgttatcaatgtattttaagcgaagttaaatattaatatatgcactagtgaactatatctcaaccaattgacaacaaatttatggagggaacttttaagtgtgccacataaccgaaaatatgggtaagaagatatttaaggaagaaattgctagagctcaaatttaaatattgtaaactaatatacaacctcttgttaaacaaaacaaattaaattgtgcatggagtatggcgtcagcaatatatnnnnnnnnnnnnnnnnnnnnnccatgcaatttgccgatttaaaatttcagtagtaagtggccggataactgttggaccaaaattcggatatacaacgtgtatgtacttgataagcatactcatctctaagtagaagatcagcatatgcctattagcaagaagcatgtactactgtcttgggtttgattgtgacaattagttgcgttgtttatgtaaaatttgacaaattctgcgatatgattactagtactactccagtaggtttgacctctaggaatgggaatggagtactcagtgccgacgtgtttggtggttatccaagggaggctgatgcggccagtgacaagcgtctgatgtgtcggtctgagtgcgtgtgcgtttaaatagccctaataaaattagaaccatttcatacacgtttatttattttgccacgttaatttacacggacaatagtgatcactagtgacgtgattataaatatattattcgtctatctgcaagactatgggagaatagactcgagtgaccggtcattttattctacaggaatgaacggcgtgcacagcttataattaaataaagactaaatctttctatcaggttaaaccttctcttctaggataaactaaagaaattgaagagcatttgtaaacatatgcaagcatggggcacgccaaactcatattaagctcgaaaagatactcgcttgtcttttatagtagctgattggttaggtccagtagagtacagagactagcagctgtgtacacagtgcatagggaacgcgatttcggccagcccatgcgatgcacgcttgagactcgcgctgcccatacattgtgtttgtggcttcattcggagatcgcacgtatgagtggagtattctattttaaaataaacaaatttatagcgtatcataataaaaaaaatctacgtctagaattgtagcactaatatttgtttattttgaaacgggagagaaaatcagtgcggatggatgcagtgttacagagtgggggtgtgtcaggtgatctatggggaggcggggatgcatggaagcatcgggtgctgcaaagtgcgaatccaacgacgaactacgggcagatcggtcacgtacacgatagatgcagatgcaggtggtatctggggtgctctgaactgccgcctgccggcggcttggcttgccgcgtcgcgagccgaccggttgccatccaggggaggtgactcctggacttggacgctccaaatcatttggagcacgcactcctgtctctgtctgcttgcctgaatcctcacttgctcagtgcagaactgcagaccacaaattttaacaatgcgatcttttctgaaaactaattttacaaatgaaccgtggccaaaacttattttaaaaatgaccatttttttcagcgccaaatcgtatggcgctgaacttagacacctcagcgccaaatagccggcgctgacattggcacgccgactcagcttctcatccgcgatgacacgacattcagcaccagttgacgtggcgctgaggtgtctaaattcagcgtctctgaaataagttttggctacggtttatttataaaattagttttcgaaaatggttgaattgtcataatttgtgcagtgcagacagtggctcactagtcactactcaccggagaagtcacctacctacctcctcttcttctaccagaagagccattctttttctagcaagatcactacctaatgctgaatattctaggattgatcatggttcatggaccagtttttaccacctgcaaaattcagagttaacacagcccaaaggggccatcaactctgatgcacctgagaagccggagaacggaagaagtgaaccccccaaaaaagaaaaaaaacatttcgtcctaattgtgtttgttctcaaaatcagctgtgatatgtcggttgattttgagaatcccagcatttcctaatcaaacaaaacacaacaatgtatatatgatcctcgtttcagtttctttaagttcgagtctacgaacaagtagtaatgaagactgtgctgaatcatggatccacaggaacagagctagtagcaatgtgcacatcgtgcagcgcgttggagtctgaagagcccattgggcgtcaccggtgacgccatttctcaacaaacaaaagctttgcttcaacttctgtaaccatcatgcaactgcgcacaacaacaaccgtcctggaaagggttaattatcgagttttttttagagtaccttcacgtgttcacagaatcacactaatcgttgtacgctttatttctaaatgctacggccgatttcgctctgtcactcgcaagttcgaagcggcacagaagtacacagctgcttgtgtgttttctgaattctggtaaaaaaaatttcttatatatacagtacattattggctgaacctgtttagatgggactaaagctttcaagtccctatcacatcggtttggacactaattataaatattaaacatatactattaataaaacccatccataaacttggactaactcgcaggacgaatctattgagcctaattaatccatgattagcctatgtgatgctacagtaaataatctctagttatggattaattaggcttaaaaaatttgtctcgcgaattagcttttatttatgtaattagttttataagtagtctatatttaatactctaaattagtatctaaatacagagattaaattaagtccatggatccaaacaatatcttaagcttttgctgaaaccattgcaggaacaaaacaaaaacatcatgcagacatttaccctatgtgatccaactatccaagtacattctgaaccctgacaatctacaaactgaacgagacagaaaaaaaaaagcagagaactgctccgcattctcgggctgcatcgatgggctgtgtttagttcgcgaaaagaaatttttcaggtgtcacattggatgtttaaccggatgttagaaagggttttcaaacacaaatgaaaaaactaatttcataactcgcctggaaaccgcaagacaaatttttttaacctaattaagccgtaattagtacatgtgagttactgtagcatttatggttaatcatgaaatgattagtctcaaaagattcgtctcgtgattagtttttgtttttacctatatttaatactttatgcatgtgtcaaaaatttgatgtgatgtttttgggaaaaagattttgggaactaaaccgggtctcaatggagatcactaaactgaagcaggtgatcaccgttgagtcatcttctgtacacgacgcggcaaccttgagcctgtacgatgggaggcacatcgccgtcgtcacggggacgccgcgctatcgcggatcgccgctgttgcctttttggctcctgggtttcgccgcctgagaaagatcagtttcaacgtcacgtcacgcgtcacggctcaagcatcagcaggaaagcaactgaagaaagcaagtgtagcttcttcagagattttctgaagtttttgtgcacgtgcgagctgcgtggagagaggatgatgtgtgaggaagcagcctgcagccgtccagatcacgcagtgttggtcctgtcgaaatcctgtatattggatagtacctgcaaatcatcatcagacgtttacagttctgcaatttagcatcagaagctttaaacttttgagctagtctcagtgatcattatctgaagaagacgactcctaaacatcattcaacacaagtacctccaacagtagaggttagcttattcttttttctttcttaaaaaaaaaacatagccgattccattttaattatatgattccgaagattttcttgatgtgggaagcgcgtgggacgcggtggagaataggcggaagcgagattaatctgataccatgaaagcgtaggtgagtaagcccgataattagattgattatagacatgactacatatagggacggtacattcttatatctataaccaacttataaaaacagaattgggatatgattaaaccgaaccggatacaatacaatatatctctaacagtgagcagtaaagacaccagtgcagatgaacgatattgggccgccacatggcccatggctgcggcccatacggtaatcccagccgcctgcgtcaccttctgaatcgtagccgcacgcgcgccaccatccaacggttgccttggacccagcaggggtcggagaatttccccaaacggctcgtccccctcctccccgtcaccgtcaccgtcaccgtctcgtctccgtctccgccgctcgtcgtcgacccttcgtcgagccgccgccgccgccgccgatccttctcctcccacctcgcccgcgccgatggagcagctcaacgccaagctctacgacaagtacaccgccctcaaggtatacataccgcctcgtctcttcccccattctgtaaccctacccatggacacggatttgatttcttctcaatacgtttcgcactgccgctcttgatgcgcgtagaagcggaagctgctcgacgaggggctggaccagaagcgggctgccgacatcaaggagctccagcaaggtaaaccgaggaggcggatgtatttcgtcggtttttcgaagggaggagggtttaagacctgggagggagagaaatgcacatcttttggaattgggaggaatttctgttaggttgttgacttcgctccgttttgttgtttctgatgatgcagccatgaaagattgggtcgccgacctccagggcgagaacgagcgcctcattgccaagctgtaagattcaaatgctgctcctgcggcgatagggtttcacgcgttcgtgctgttttgggcttccgctgtttcggggaaatgatgcctgatccgttgctttctcttcttttgttaatttcttgatgatgccaggacccaaaaggagcagcagcttgtggaggtccagacacttttgctcgatgagactaggaagagtaagaattctttttgctaagattataattttataaggaaatggttggtagtatgcaagtataaagtataaaccatgattgggtggaggtggaactgatgtgcgtctttggaaatggagggaaacaatctgttgctgattgaaagcactatttggtctgagttctgtcttccatttactttggtattaatgaagttgacttaattcaattttgtttacaaaacatgcagcaaaggagctcaatagtgaaatattgaagcttcagtgtctcctggctgagaagaatgatgcaaaccatatagctacagggtctcctgacacaaccgctgaaatgattatagaaaatcaaactccaattccacctgcaaagaagacaccaaagtcaaagagcagggagagaaatatccacttcattgaaaaagcgactgttccttgtaatggctttcaggaggaaggaagagatgtaagttttccgtaacaggaactacttattagtgaagtacaagtatgcaatagaatgagtgtgttgagctcttctaatttctgtttatgatttggattggttttgtagcttgattcctgtagaaggcatatgagcatctcaggttagtggtaatatacacacatgcagtagtgaattgtttgaacttaaaagtatgttgtttgcagggagtgcgacagaagaaagctccagtacctgtatgtttcatatgctggctgaatcagtagttgggatgaaattttcagtgaagaaccaaacagaaggattttcactttcagtctcccatgaagctagtggtatttggaacatcaaattttatgctattattttagccacagcatagtactggaatatctcatcatagttattattcatcatgttttacttgtgttcatttctctttcacattcatttgattttgcatatagccacctccatgtttgccaagctagctgagtattcaagcaaacagttatgcaaagaacaatcttcaacctgaaaaatgtcctttaaaccaccagaagagttgtgtgaatacatattttaatgctttaatatctttgtcaagcatgtacacatctctttggagcttagccgtttgtagcagaacttgtataccagcatacagtgtagttacatgttgggtgcagaacctgaggatcatgtcaccaatgttagaacatttgatttgtaaagatcataatcaagtgtaaggaacgaattacatttctaactgaattttttaaactgttgtaggctacagtttcaccctgacatgggtagaccaacctggtggcggtgaatggtcatatcagtactcgtcgttgggcaccctggacaggattgctatgggctggatgaaggaggacataaaattcagcagggccatgtgtcctgtattctttcagcagatatcgcgcatcctcagacaaggctaagctcaactgggaagcttagtttggattttagaggtcctgacttttgctagacagtggactgaaactgacttgttttaggagtgacacgaggctttatgtatcctttcgtttggcctttgttgttcctgttgtgaacataacaattagcaagtgattcgagatgttggtcgcctggttgccgtatgtctttatgtatagcccctgatttgaactctgatggttctgaaaataagagcttcgacattgctgtccaatatatcatactcggtgtgaattttgaatgggtgcctgtggaaaatgattcggaatacaaactttgcgtatgagagtaagacgtccaaattgttactgaacccttcaagaatttaaccaagcaaggagtcgtttgggcaggtaatgaggatttcacgtaggcaagtgccaggtcaactggcctaaggtctggtcccccattcggttcggtatggtggccttagagttaccgacttaagaataatttattagagccttacgtctgagatggctagggtttgaataaagagcaccaaacaaaccttggatcggaactgaaacaccctatgatgaattggataaggacttgtttgtggtgtcgactaaattccttattggtgatgggcgaaaggcgagattatgggaatcaaattggattggtggccaaagcctaaagagcctggcgtcaaacctctatcggcactccaagaggaagaactgcactgtccaagatacaatgcaacaaggaagatggatcaatgacatccgccataccctcaccgtgaccctttttacatagtatctgcgaatttgggtggtcctagcacgtgaacccccccccccccccactaacggagggtgtgaaggactcaattgtccagaaatggacacccaatatggaatataacggaaaatccgcctaccatttccacggcaaagctgacttgggaggtgggaggtgtgggctccagcaaaatgtaagatcttcagctagctcgcactgcaaaaccgggtgtagacagcagaccggttgcaactcaggggatggccaaataactattatttttcagctttgcttcagaacaattgaccatctgttgtttgaatgtccaatctcgaagtaaatatggtttggcatcctaaaatggctacgacaagggcacatcatcctgaggtggaacaccagcatagactgttggattggtgactacaagggacaagcctcccggaggaaacaaaacaaaaagggtttatcagcgtattttgctgaaggttcagtattttgctgaagtaactatgaacacaatgccaaccatatctgttgtttttttagtagaaaggcatgagttctgtctctcttttttttatattaagaagggaagcaagcggtacagagttcagtcaaatttctcaacaaacaaaactttgcttcaacttctttaaccatcatgcaactgtgcacaacacaaccatcatggaaaggattaattatcacgagttcacagaatcacactgatcttcgtacacttgtattccaaatgctacgatggacttcgttgttgtctgtcactcacaagttagaagcagtacaacagaagtacacagctgcttgagtgttactcgtatctgagttttggtacaacaaaatatcacgtttaaacataaacactagaccagctggcataaaagaaaacacatttttaattgtcttctaattctatatacattcttggttaatctttctctgaaaccattactggaaaacaaaaacaggatgcacgctttgtgatccaactatccgagtacagtctgaaccctgacaatatacgaactgaatgagacacacaaaaaaaaaaaaaaagaacacagagaacttctctgcactctcaggttggcaggcgatctccatcgactcatcatcttctggacacgacgcggcgagcggcgaagaagcggtgatccgggtggtgaactccgaggaggccgagccaggcgtcggcggcgtgcgagagggaggcgaccagctgcctgtctcgcccgcccggtgcccacgccgcgaccttgagtctgtacgacgccatggcgaacgtcgggaggcacatcgccgtcgtcacggggacgccgctgttgttgccttttggctccgggcagatgccgcctgaaagatcagtttcaacgtcatgtgtcacaggctcaaagcgtacagcaacccaaggaaagatggtccagttgttcggtgttttttctgtgaagtgtttgtgcacctgtgagctgcgtggagaggggatgatatgtgaggaagcaggcgtccagatcgcatagtgttggtcccgtcggaattcggtatattggatacctgcagcgatcatcaggaacgaagaattcagagtcaaatattttactccagttagtctgaactctgaatggtaaacattattcaacacaaggacagtattctgctagtaccatgcgacggacatccaactggttggcgacaaatcacagctcctgagagtattcagctccggaaatcccctggcaagactacaaatctgcacgagttttttgattcagaggagtgacaaaaacacagtcattttcatcagggagaaacgataagagttcttggagtaattgttggcatgccttgtcagctagcggttcacgctggtagggaggctcggattccagaaactcgaagatgagctgctcgtgggaaattctcgttgattcgctttcgtcgctcgatgcttcgctggtggaggtttcgcaggtggtatcttggactgagaacgcatccgtgctgcttggacatgagtcgtgctcaaggtcgctcatctcttcactgcctgtgtcttgacagtagtcgccgtcgctgtcttctccacttggcctacgattggattgaacaaacaccatatcagaaacaacactagggattaacataagctgattccgttttagtgatcctcaggttaaccctctctcctactctcctatctgtttctgttagttatctgtacccgtacggtgctcccagcagttgcgtgactgcgtcagcttgaatcgtagccgcacgcgcgcctccatccaacggttgccttggatccagtgggaacaaaattgcatatactaacagtaaccgctccttggattacatttgtgatttgtatacgatgaattggagacgtattgtaatcactatgggttttgccttcctaatgaagtttcttaagtgcattcaggatacgaactttgcgtatgagaaatccaaattgttactgaagatagtgcagcctcaatggagaagtgtagaaacagagatagggacctatagtaactcgtactactgaatactgattggccctgacactttaagtcaatgctcgcaaactcactcttcagagttcagatggctttacaagacttgttttgtctttatgttcctctctcttttttttgagaattctttatgttcctttctcctgatgcaatggtcacttaagcacctaaaattcattttattttcctgtcctctcataggagacgcaaaatgtaggagtacttctcaaggaatgtattggcaaatgtacttgttctgtaattctgtaattatgaactacattacaacctgaagtgttgttctatttctaaggttgagcattgtgctgaagtaactatgaacacaatgccaccatagctaataaaccatttgtcttaagaacatctacaagaagtgattcaacggtgatttgaggatgtattacctggaatggtagaaatgcctccttaatcttccataaagctggattgcagataagtaagggacgtaatactgcaccacaccgtcactgcaaccattcagaacaattggcacagcgataccatatgcgctgctctctctgaacccatcccagaggtcgcccaaactgaagaatggcagcgcattttcttcatcagattgcttccaaccattcatgctcttctgcaaagataaccatacgaattttttcatgtcacagaagctgaaaagaacctctacttagtcagaaattgttaccgaaatgaattaaggcagttgttttctgtttcttcttagtcagaaattgagttatagaaacaaaaatgaaaaaaaaaacaacatctgttttggaacatacataattccgtattagcagtgaggcaactaatactcttgaaagatcatcttggatagtagtatcagaattcagaaatgggggaaatcaggaaatgcaacagatcgatgcatgggatgaaaagcgtatcaccttggaggagcaggctgtcgtcgggacaaccggcgtggtggcctcgaggaacagctccagattacaccgtctcgccgtcgccggagcgccggcggcggcaaacctccggccacaattcgccatcagctcagcgccctgtgttctgctaatctgttgaattggagctcgaaagcaatacgcgattccgattcagttgcttgtttggtggatggcataggccatagggaggtttagtggagtttaattgagaagaccatataaagcaggtaacggctacgctattaataagctgccgttttggcttccttccagaagtgcgttgaaggtgccgacgcgtggttgaggatggacacgtgtagggctgggatggggttggcaggtcatgagaacgatgggtggaccggccttaatttgggcggtgggagctggctgggcacccatggacggtgtcgtttatggggcaagtgacgcgtaattaattaagccggtgatgctccatcagcggagtccttggccggccggcgccactagctactactactagctacgtcacctcgtacaacttcgtcacgagacgagacgacttcacctagatttttatgggccgtgcgttgcactgcacgaggcggattagccggg

SEQ ID NO: 83218 - DNA, 18668 bp, Oryza sativa
ccacatcccttaagttagaactctgaataataagatcggataacataacacagggataggccctgagagcctgaccttttcaacgatcttattcgagagcgatcttctcggctctgatggaagcacggtgatagcgaccatacgagtatacgactcatcacgacgcgaactgaagctatgtgggaaataatgctaaggaatagcacgtcgtttgattcggctgttcagttgcaggtggtacgccgtgtacgcgggcgtcgctctcagtgtggcaagcggcaagcggcaacgaaacatgtacgacgcgtcgtcccatctcgccgtgtaacgttagtctgtcatcaccatgaacagtgtagtaccagagcagtgaccagtgtctgtatggacttacctttctactgttctgaacattgctgatttgctgtgcactaccgtcgacgttactacagtaacgaactaaccaaccgaagtgctctgcggatcttttcgattggcatttgaccctccacgttccattccattaggaaatggcgaactttccgtcctcgtccacgatgacgtcagcagacagcgtcacagcgcctcggacgccgcaggttctgaccaaactagcatctgtccccgtcccaatatttcttgtccgaatttcccctatcagtgatcgatccaatccgctgcttatatgaccatccacttccttcccctctgttctacacatagcgaagaggagagaaggcgagctagagagagagcaccgggagaagaaagggatttcttgttcttgctgccagcgagagctcgtctttttggtgttcttgagagatttgttcttgttgatcgccatggcaggtgatcttgcgatggccactgttctctccctgggctgcgccatggtgggcgccccggaggcgctccgcctcttgctggacctcgccgggcagagcagccccatcgccggcgtcgtcgtcatcgtcggcgtcatctgcgccgtcacggccgccaccgtgctcggggctatgctcctggtccgcttcatccgcgtcgcgggcaatgcccctgacccaaccacggagcgcttcgcgcgggtgactctgacggtggccgtcgccgtcgcgctcctcgtcgctgcctgcctcctcgccgtccccaccgttccctccgccacgttcgcccgcgcttgatacgaggctgttcttcacttccctgtgggtgtttgtcagtgtgtgtgtgattgctcagctctcgtctctcgacaagtttacagcttttactccatcacctgtgtggttttctactgtttatctcgcagctatgtgatgttaattggcgaaagcgattgatcttctgagatcagagctgaattttgaatgtgtcgaaccaattcgaacagagcttgtgatacaccatagtacatcctaggatgatttccttttctgacgaatccgaaaaaaggcgccccgtattcgtgtttggtttgttcaatgttatctctgttggatctctctttggttccgtacgcttcagcatttggatatactttgatagtgacgtatcaacaggtaaccaccgtgcgtccatgccgatcgagggagaggaacaaatgtacacaaaaaaaagaagagttgttgggcaagccatctctgtgtctcgtgtcttctcacgcttatgcaaaagctctaacgcctgtgtttttggctttctgcgagatgatatacagacacatatgttttggacaggttctagcctagagagcttccccctctttcccgttccaggagcacgatggaggcgtttgcactgcgaggtctcgacacgttgggttgtgccacgtcccaaaggcacaaacaattttaccaacgttttattgcagaggactaacggcagattgctatggatagatcatcaagggcgagcaacaaacagttggccatgagaagtttcagttgataattgataaaaaaaattgacaattactaaactaccctgtatgttattttctatctctaaagtaccctttaacaaatcaacggttgatgtgtaataacaggatgcctcccgagcactgtaaaaggtaaaagctctcatcacgggtcaatgacgacagctgcgaaagaaaaagggcagaagtcgtggccatacaccgagagagaaaatgtgattggacggtcggtcgctgtcgccgtgtcaccgtctcaacatgaaatcgaacaaaaaaagagtgcaatgtgcaatgtttgtgtgtgcaaaaaaaaggggagcacaagttgatgcattcgtgaatcgtgacagttgaggcagcaagccagcaacgcggacatgtttgtgtgtacacgaggaagtctcacgtactgtccgagagtgcacaaggctaccccagcgtcatcccttacatcacacaatttacggagaagaatttcaaaagtcgggtcgagagaaatcgccgacggtacacgtcaaggtctcctcgacttggtggctttccatgtcaatggacaaccgcactccctgacggccacctgctaggaccacgatcaggagctgggttaatttgcagcaaaaaatgcagatgtggtgtgttcaattgccgttgttgctcgcgctcagatacctgcaaactggcaaaatggccggcatggatactctattactcctgtccggatgtagggtctgcctgcccatcagatcccggttttatcaggttggaggggaacgtcgcatttgctcgtcgtcaccacacccatcgtgcgcgtgcacatgtgggatgtgcaggtcagaggcatcagtttcctagtcgacggctcacggctccaaaagcaattggctgccttcaaaaatatagattcccacctgatcatggaagatcttccttttccctacgggctccatcgctatgcttcggcttatccaccgaacttgtccttttgatttcagatttttcagcggaagcatttctaccgctgggcaggttatgattaaacgatcttctatgaattggtagttcgtagccctcctcgtgtatttctttttgtgtgtgtgtgtgtgttcgtactgggggtcacaggatcagcctctaccaacatattggcagctattacctggcccacgtaattcggctgaaaatctcacagcctagtcaacaaatcgatggggttcagctgagaagccacaaccttgtcgttatttttctccgtgtcttatcctcaagtagttaacctcttggcactgggcatattgatttggttgttgttattaggggagacaaagtaggggaggagttagctggtgttccccagcatgctacctttctttactttctgtcgtttttttgtttcttagtctgtaatgaactcgtattctttttagtaaaagcttggcgtaatgcctttcgtccaaagtaagggaggagtaagaaaacaaacgacagaatacgcattatacgacggattcagcttgttgctacgatcaactttactctcaccattatcttatagctgaacatatctccatgccaaaattttgccaacaaagtattcgaaagcatagggattaagccaagatgatggcaaaaccacatggatagggagatctaacacagtgacacggacaggcacatcaaatcagtcaaagatcggattagtccttaatggcctccacactccaatccacctttttctttcgctgccgagatgacccgtcgcgccgtgccgacttggctggaacgaggcgtcaccacctaaccatgcccaaaccaggtgccgaatcgcctatattacccggagcaaatgctacacctagcaacacacaccagtgcacaacctcttcctcctctgttcttctctacttcttgcctgatctactggtaacagtgaacagggtgagcaaggcagagagagagagagaggagaggcttttcagaggactctgctttctcttttggtattcttgcgaatttttgttttgatcttttccgtgcgtgctcttcttgatcgccatggcttctgatgttgcgatggcgattgttctctccctcggctgcgccgtggtgggcggccccgaggtgctccgcgtcctgctcggcctctccggccggagcctcgtcgacgacgtcgccatttgcgtcttcgtcttgggcgccgtcaccgcgccagtcctcgggaacatgcttctcgcgcgctacgtccgcgtcgttcgaggcgccgccgccgcggcggctgcgcctcatgctcccgccgtggatcccttcgcgcgggtgactgttgcggtggcgctcgccgtcgccctcgtcgtcgccgcctgcctcatcctcgtcgtcccctcctccgcccactccgccagccgcgaccccggctccggcgctgcctgacgcgccacgcgaccctgttcgtcctgcggaacatgtccctgtggagtggtgaacttggtgtctggtgaacatgtccctgtggtgaactttagcggttaatcaagctctccttgcacacgcacctcatgcagaggaagtagctgtagatgttgggttttttttttcactcaatgttgtaatgttcgtgtcaatctgcagccgagagatatactactaccatgtagtacaactttttctctcaagataaaacattatactaccttttttcgccaggcaaacaaatcaccgggcaaaactctctataataatggtatttaccaatacgaacggctgcactccgaaacatatgcacatagagtgtgttgcccggtgaaacgctggaataagcaaatgaaagcttgtactaatccaaacaaaaaaaatgtttgccatcgtcgacaagccacagggatagggtgatgaaaacattcggctagtcgcctcgctctgtcagccacgtgaccacgtcggacgagcactgactaatcgcagacgaagaacacaacgacgatggtcgtgcccgtgtggcggatttgcagcgcgtgtgcgtcgcgaactgtggtaactgaaagggacagtgtttcgaccgtcgtttcacaccgccttcatgtcatcctccgattgtacgaacggctgcactccactccagtgcttcagcaacaacacaaatggttggctggtactgtcggtgctaccaaaattttaatactagcatatctgggcaacaaaccaaactatctatctattatatactaaaagtctattaaacttcctataaacgctcctaagccgacatgtgacggtctaataaattagggaaatccaagaaattctgagaaaaaaacaaaacaccaaaccgttaattttcacataacatagtggacccattatttttcaccattagatctatttaaaaagaattcctaaagcccaatccattaattatcacctcccaccatacccaccacctcctgggttgtccccttatgtgtacgtacgtgacctcctctcccctcatatacgtagatacgtctctccctctcctatccttcctttcatcttccaattttctgcctaacaaaatttaatatgtaaacaaaatcaaacgttagataactaatgattgtaatttttataatatattttatttatctatattgggcatgtttggatatataagaatatataatttgaaaaaaaaactcctatcttttacatggcaaataatgagcaattaaatattattaaaatataataacatatatgtgatctcttatctctctgcttgctcactttctcctcgctattttgtaggagtagcaagcaaatcattatatacacaataaaaagtaaatttcacaaagctacatatttaaggtgaagtttcaaaatctaaagatttaatcgatcaaatagacaaatacccattgtgtaataaagatccattaaacatcatgtagatcaatctataataagctccattaaacatcctctacagtgctactaacctaccacatggcacatctgataaattaaaaataaatctattatatagtaaaagcccattaaacttcctacaaatacttctaagtcgacacatgcatgacactttatataccggtatcgcgttgggatagtatcccaacgggatcgctccctgtccacttccctcagacgcgagagtgtaggccaccgtgggagcagcacagatgcggctaacgccggtggcgcggccgcggccggcgccgacgacctccggcgtggaggacgcggccgccggcgacgagctccggcatggaggacgcggccgccggcgagctccggcgtggggcatggtcgcatggacggcggaggatctgcgtggtgacagagacgacgccggcgacgagctccggcgtggggcgtggacggcggaggatcctgcgtggtgatggcggcggcgccggagacgagctccagcgtggaggacgcagctgccagctgaggcgtggacgacggacgtgactgccggtgacgagctcccgacggaggacgcggtcgtcggcgatgagttccgatgtggaccatggacgggggaggatgcggctgccggcgacgaggttcgggttcagtgtggagcgtggacgggggaggacgcggccgccggcgacgatgcctcgacacctcgacgcctagctcctggtatctagtaggtatcatatgaatatgatacctcacaagtatcaccccgatacgtcgtagaaatcgcacgatacctgataggtatcacatgatacctcacgagtatcacctgatacgtgataggaatcgtctgatacctgatacatggtagaatcgcatgatacctgataggtatcacccgatactagctacttatcaggtgatacctgtaaggtatcatacgattcttaccacatagaagatgatagttgcgtagttgcgaggtatcaagtgatactcgagtaggatcataaatctgggaggtagcatgatcctccttagtatcatgtccagtttcaccaggtttcataggtgatactttgggaggatcatgtgatacctgagaggtatcatgatccttatctgtatcttgtctggtatcatcaggtttcacaaatgatatcttagaaggatcacatgatactcatcaaagtatcattatgtgtggtacctatgcagtaccacatgaccctacttaggtatcatgtctagtaacaagatcctatgggttttaaagatgatactttagtaggatcgtgtgatacttgcgtttctaccacatatcagatgatacttgcgaggtatcaaatgatacctatcaggtatcatgcgattcttaccacgtggtgggtgatgcttgtgatgtttcaggtcctgatatctaaccggtatcaggtgatacctaccaggtatcatgtgattctactatatatcaggtgatacttgagaggaatcagataatacctatcaagtatcatgcgattcttacaacatagaagatgatacttatcaggtatcatgcgattcttaccacgtagaatatgatacctatcatgtatcatacgactcttaccacgtagaagatgattctaccacactccacagccagccatgaccaagttaacaagttctttgcacaccatcttgtctctttgctcccccaaagtagcagatggataggatgaaggcccggactcgcagcgggatcgacggccggcgacgaaggagccgaccggagagggcccgcgacggagttggggcgccggtggagggcgcaccggccggccacgcagatggagccgagggtgggcgttaacggcggcgccgtggatggcaggcagcggtgctggagctctcggcggcaatccggcgaccacatcatcgacagccacgtcaccggtgacggagttggggcgctggcggagggcgcaccagccggccacgcggatggagcaccaggcggcaaatccggcgaccacgtcaccggcggccgcgtctccggtggccgcgtccttctctccccaagcgggacttcttccctgcgccggagtcaccgacggccacctcctcctcacagattaggcgctcagcgtcgttcctatttggatgggaaaggtggacgaagggtatcccgtcgatacccttcccgacagtataccggtatatagcatttccgttttacaaatgctactaggccaccacgtggcattatgagaaaaaaatggaccatctattttcattgaaataggtagacacaatattttaaccattaaattattaatttaaatatcagttcttatctcaagaaaacaaatcatgtacgtagccatgccctccttccaatatattccaacgtatatacgattcggaaggaaaataaaaggtacccacttatgtaccaactacctcccccttctcagctaaaaaaaaaaagaaaaaccagaaaaactccctccccatggtgcatatacgtgcttgagccgtgagcagatggtgcatggtcgttggaattaatcttggctggtcggccggtctggttgttttataattaatcttggctgtgattgtttctttcaatcatacggtcatacagatgtaaattttttgtatttatcttttttatcatacttatgtatatctttatttttatggataaattgtacatatgtattttctctcgtacataaacaggagattaggagtgacccctctgaccccgtctctcccctaagctaacatctatatatatatgaaaaataataacaagatagtttataatgaacccggggttgcctcaccctcattggccactttatggaaatagattttgtaatggttttgctcctagagatctatttaatagagttttaaccggccacaagctaatattgaatcagtttaactataaaattttttttttgaagtcctacttatatttttctctttttttttcatttctatgtttctctttatatatacaagtaaagtataaagttatgttttggtttgatacatatcaagagacgaaggtcaataacaaatccataaagtcatttcattcatgtctttgtggtagcttcatgggtttctccacatcttgtatatacaagcagctcaaaatatgtggtattccatatcatgataaaagttatttcttcctattaaatttatattttaagactcatattgcctatatttttctttaaaaaaataccataagggtcccacatatttcagaaaaaccatgtccactatttgcatatttcttcaatacatgcatacaacaaatttattaattcatatgcaagcatatagcaaattgcgtgcatgtgaaccaattaaattaagcacttgatggtaaaaataaaacattcatcggcgatataaatttcttgaagtttcttaagaaaaaaaagatataatgcacaatgaattaaaaaatagtatatcttactttcacaatttgttatatctgtttaaaaaaaactaatacacatgcccgcgcgaatgcgcgggctacctttcctagtttcagaaacgatcgtgcggtatttcttttcctaattctcgtgattaaccactttgatctacaatcatgtcctcctcaatcctcataactgtccgcgtatatagaaactttaaaagttagtccgagcggtcgtcgctcagttcacaatcacacatggtctggagtctggacccatcctaaaaaattccacccaacccgacggaagataaagataatcggactttcacgctcgcgacccccaccaaagaataggcagcgaagaacgaaaaggaccgcgccgcgccgccctgactattgacctggtccgccgcaagaatataacgcagatggtgcaccaataataatcacaaaaccggtcagttggatttatctgccgatgtgtttctcggtatgagttggaagaagtcgggtggaacggattttcagagacgagtcgacgcacgccaccagaacgggcggcaccatttagcgagccactcgaaatatcgaatactcgatcggtcgaaaatgccgtcagacttgcatatttcgtgtgtgcaaacaaacgtaccactcctggcgctaagtacattcttcctgcaagttcagctttgccggagagtagagtactctggtagtacccgtagtccaagcgcagctttgccaagtttcaacgggaaaaggagaggctgtcgatcgtcctgccggatcgatccacaccacgtcaccatcctacctcgaccgaactcaacttggctcggatccactgaaagccacctgttgcgtacgggtaggtcgttgtgtttcgctttacatgtcagtcttgtggtgcctagctgggactgatgcaatgcaatccatctgaaatctgcaacgcagttcaactggtgcccgtgccaaagtgccattcttggcctccatcttttgtcttccgttctgcaatatggcaccgagctaagcgatcagccaatcatttcgatcgagatctaagtcgaactacaggaatccaagtacaagtagagtagtaaacagagttttaagtctctctttgtacacacgatcatatgaaaattgttcgattgtttgggttgataaatacagggaaagcgctggaaaaggagatatgctgactgaaccacactcacactctgcccctacatcgggtgaaaaaaaaatcaccttgatcgagtaaacacctataaaacgtgtcgctggttcggcgagaatcgcacattagagactagagaggcgacaggaagagcaaaggagatgggcaagcgagcctcatgaaccgaccaatcctttgccgaagcgctgaaaggcgacagcgagaccgttttgttgcgaggtttgtgtgcaaagcgagagatcacaggagaaagggacaccgatggaaaatactagtaggatgactagatgagtacagtacatgttgggtgcaaagtgaaacatgcatatcctctcatgtaccaaaccatatgattagtggctcctagtcgtgctctcttcacatacgtcaaagtccgaaagtgagcaaggctatatgtagcaggacgttgtcatatatagcgacgtacgtgcgcgtcaacaaggtggacgtgaacgagattggtcacgattaccagcatcgctcgctatcgacgcctcagaacgtaacgaacatggtcacatggacatgatcacaaggactattctgcagcagtgcacgcccgaattacggttgattttcttctttcatcttgtcagtagtgcatgccctgcccaaagactcgcaagtcgcaacttcgcatggaataggggcaaaggatcagcatttgttgtgcggttctgtcgagtggccatgtcgtgccagtcgccacttgtggagacggtcatacaagtgatagcaaaactttttcggtttactgctttacttctggagtgttgctatacgttcgactccctcgtccgattcccatccaatccaactttatctgccaatcgttacgcttcacgcagaccaacttctctccatgtggctagggcaattagcagctaagtgctggtcagacgtgagttgtacgtagcgattttcttacttttgtccgttctgtggcgcctagcttggactgaaacatgcagcacaatcaatcgctcttcaattcgtgccatccatccttggacttcgttgtcatccgctccgtgatcggcaacgagttacgcgattatttcggttgatccttcgaacctatcgaactacatgaatccaggagaaacagagccttatgtatctctctcactctgtgtacatcgagaacccaaatcagcaatccatttctacatcttcaacttttggtaggggtctgccaaatatatacttgcaaacctacgaggctagcgtattatgtggatacttgcaatccatttttttttacttgcaatcgcgtagctccagctccagtaccgaatcttcacatcttctatactgggaccacagggtggaaaagatgtgctagtatgcatcagcacggccgctcggcaaatcagcaatgccccctgggcccctgctgctgccaagaatatgccgttaatcaacacctataaattaagccggtcgaggggttcagccacggcgagaagagcagagccgcgaaggagatcgatcggcagcttagcctgagtaagcacggaaggtgagagtgttctcagctgttgagccccatcccccatggccgcaattcttcggaataccatcgttgtcgccatgggcgccggggctctgggcggaccggacgcgctgaggctcttgctcgggttcgccgggcggagccccctcgtcgacatcctcgtcgtcgtcttcgtcatcgccgcggtcaccgcgcccgccctcggcaccattcttctcgcgcgtttcttccgcaagccgcgcgctggggccggcggaacgggtgcggcggtcgatgacccgttcgccaagatgacgctggcggtgtccctggccgtggccgtcctcgtctccgccaccctgatcctcctgccgctgttccagtccgggggcctcggcgcgctcgccttcgccggagccgcgctcgtcgtgggcgcctgcgccgcgcgcgcgcgcggcgtgcttcttgcgaatgcccacggcggcgcccccgccaccgagcgcttcgccaaggcgaccctgatggtgtccctcgccgccgtcttctccctcctcgtcctttgcatcgcggtcggcatcctcgacgcgcctgcgcagcgcctccttgccttcgccttcaagaacccacccgccaccgtggccgtctgcgtcgccacagccaccatcatcggcgccacagttgtcaccttgttcttccgcaaggcgaaaaatgcggatgccgccgccgccgccgccccaacggcgatggccatggcgctcttccacaaccacaagatgatcttggtgatggttacgcccttcgtcgtcatcttcttcctttgttcataggtggtgcggtgccggtgcagcgtgctgggcaccggtggttgaaaaaaaacgtaatccctcgtatgagtacggtggtgtatgtacatatgctatatgttatctttcgtgtaatcgggaagagaaatgtctttttggttcgtgtttgcctcgtcccatttgctatatttatgtgatttagaaatacgagttttcgttgccttattcgggttgaacttgaatatcatcatctcgttgaagtgagtaatcgacgtgaagtattaacagaactagtttagtgaattgctactgcagtctccagccgtgttttagaaaggcccgcacagataacggaaaatatttcgtagtactttgctatcatcgggtacatcaactagtggggtgggaccatgggagtactttgctatcatcttttttctgctttgctctttccctttccaacattcgcctgtgatggaaacgccacgagccttttgtcttggcactcgttattatccaatgttctttgatataaatacgagttaccacatttgagggatctgggagtgtggatcgcacagctttgattgtggtttgccgtccatcagcatttcagcaactgtcatctcctcgggctcgttatcgtacgaggcgcagcctagcgaaagttgtggtgattgttaggaagtggcagccaccagagtctcgcccggagcaacacggccggttcgattgccatatgatttttgcaacttgtttcctggatggaggatggtttctgccaaaagcgaagtgaagtgaaattttctcaacgaaagttttgtcctttcttatcacgatgcctggtgtgaacaaggctagccagcccatgtgcccatgccgttttctctgaacgccaattatcctttctaaaatactatacttaacttaggttgtgtttaattcatgttaaaattgaaagtttggttgaaattgtaacgatgtgacggaaaaattaaaagtttgtgtgtgtaggaaagttttgatgcgatgaaaaagttggaagtttgaagaaaaactttgaaactaaacacggccttaagaaaaaaaaagaatatgtagtgacataatgaacctgcagttagtttcttgggtttgttggaaccatgccaccttaattttgcaaaatttgagatatgccacccgtatctcaatgacatgtaggacccacatgagtcaatgatatgtgggttagggtgacatatcacaaattttgaaaatttgtgtggcatggtttaaattttccatagtttcttttggtgctttatgttggcctcggattgtactagagtttggagatcagagtctttgtcccactatagtttctttttttgagatcagaaggatcgccggccaattgtgacgcgctgcaaccatgcattactcgtattttctccttcatgtgtgcactgggaaacgtattttctccttcgtatttgagcgccacgtctcacacggaaagggattttttttctccttgcactgttgcacacacgccatcaaggcatacacaacacaaccgggcacggcgaaaagcccaacaggccgaaggtcgaagggcagaggccacgcgagcgaaaggaacccgtgtggcatatacggaaaatatgccgttcaaacagttgaatactcgtgccttgccgccgttcacaccagagtagtatctagctgccataagacggcaataatcctcctgatctctacatgaaaaaagtgtgtccgacggatgttgtggcaagcaaataaagttatgggcaattgcctatagccgtctggtccagtttgaacgtggcggaaatgtggcgaaattgtagagtaagcgcccctggcgagtgatgtggttcatttagctgcatgtggaagtacattatagtcgattgatagcgcaaagttgtgtgcgctactcagtggagagaaagggaacagaaaatgaccgtgtgacatcatttccttctagggaaactgtttgacttggctcttgtatattcatgtgaggaattcatgtgatcatgtcctcagttgttgtccacgagcagcatccgttgttcttcctcgaagcagatctaccatcccacactggttctcaaaaaaaaaaaaaaaaactcacccacactcgctatccaatccaatccaactgtccgcatccatatgatagcgaaacgctgccgaaagctaaaacccgcaacggcgaatcctcctcacggagaaaaggggtcaagacgtactgctcctatgagctttttcgccctcttcttccgcatgtcatctcctaagattatcctgttctatcttggagtaacggaacttcaaatggactctgttttttttattaaaaaaatacaaagaccaaagtatatgaagttggaacaggtccattcttaaatggtactcttttttatttagtatacttattttttgctatatcatggttaccgagtggtattattacgcatccaatatttctctgtgtaaatattaggatccagaatttgaaggttaaatgtgtaatagtgagcttggaagcaaaactattctagtccaatgtccaattgtggtaatctgagtcatcctataggttttctaatatacattttttttctgcgattgccatctactacttctggtaaacgtttcaggcgaaaggacatcacacatgaacgctaatatacgtagatgtttatttggaaaggttcaaaacgacaccataaatgaacagatggagtacatctgccgtcattgtgtagactgtagtactcccacgtcccataaaaaaccaacctaatagtgaatgtgatatatcttattactacgaatctagacatatctttatgcagattcattgtcctataatatatcatatctagtattagatttattgtttagacaaaggtagtacggccatgtttagttcccacacaaaaattttataccctgtcacaacgaacgtttgaacacgtgtatgaaatattaaatataagctaaaaaaactaattacatagattgcgactaatttgctagactaatcttttaagcttaattgcttcatgatttgacaatgtggtgctacagtaaacatttgctaatggtggattaactaggcttaataaatccgtctcgctgtttactggcggattctgtaattatgtttttattagtgcctgaacacctcatacaacacactatataatacccgatgttacacatcaaaacttaacacccctaatctaaataccaccctacgtctactaatgaaattgaatacggcattctttaggacacctatagtgttggtgggattagggccctgtttagtttcatgggctaattattagccacccaccttttagccctgaattagcccctaaggatccaaacatgtgggttaatttggggctaaagtgaattagcccccctcaaaacattagcctctccaaagagtgctaatgggactaattttctgtggggaccataaaaaaaacagtcctatcttcctccccccctctctctcctctctctccatcttttagccctaaactagctcatggatccaaagatattgtcccagactaatgtttagcctaccaattcaagactaaatattagctcttaaaattagcccgggactaatcttccaaacaagacctatttcgattgactcgagcgaacaaaatctcaaatcaatcgctacagtgtagaaattgatttgtgggaattcgcgtaaaaaaaatctcagggcttgtttggtttagggtcataccaaaacatcggtagtgccaaaacctaggtatgttttggcactattaataatttggtagggtagaatactaggtaatgtgtttggattaataccacttggaagccaaattttatattatggtaaagaaagttctagaattgtaccaaattaaccatgggcattactattcatttggcttcaaaccaaaccatcatatttactattcaaactaccaaaaaattggcatgtcatattttggcatcaatccaaagtggcccttagtctgggtggttctaacgggcgatcgatcgccaaggctatcggggagcgatcgattcccctccccctccctccctccacctggtttccttttttggcaccgtattactttcctattttagtaaatttatacacctcaaagtttatacaccttaagtttacacatctaaagtttagagaccaaaagtttataagtcaaaagtttatatatccgattcaaatttgaatttgaattcaaatatcttttttatatatagtgtcgacgtttgatgtctcaactatggtatttggacagtatggagatcgttggtactagagtatatgcgagattgaggtaaaagagatggagacagggatttttatacaggttcgggcccctgaattgtcaggtaataaccctacatcctgttggccgaagcaggtattgctcttattcaccataatcacaccagtacaatatttggggtagcctatctaactgttgttgacatggcggtctgaaggtctgactcgtagtcgacaacaaggtagtcttcctcttcgagtttgtgcccggcgagattagagacgacgctagatccctacggccgacctctgtaggtaccggacagggtcgatccaggcatatctctgatgtcgatatccggcggcttatcttggtgtatgttggcttgtatattgatcttgtgtcttgatctattattccgtgtatgttgattgtgtcctctcctcctagggggtcttgtatttatacccataggtgtcctcttgtccaagtaaaactagggaaaccaatatggatacaatccgagttgtccttgtcgtttccatgtagaattatggttgtctttccttatccggaactcctcctatattcacaggttgtttccgcataggatatggcatgtggtgggtcctgtagagatttaatcaactcctattagatatgtgttatacataaccctgatagtttcagttttaactaaacttctaattttaacgttaactaaacacacccgaagcagtaggagtattttctcgcgtaggagtaaaagtccatatgcatgtaaaaatttagaggtggggtggtggcagcgacatcctttttgccaggtggtggcatgcggtttcggcaggattgggcagcgacgccaatccaatctgctttccgccgtgacgcgacgtgcggcggatcaaacaggagggagacgagacgagatggtcctgtgaatctgtgatactactccggctactgctgcgccacaaagccctgtgatgagttgacttatccctgtgcgtgcgtggtctatctgcgatagctcggcgatgggagtatgtgcaagtaccaatgcgccgcgccggagtgggactggaccggaccgtggcggatggaggattgggcgagcgagagatgggcgtgcgacagtacgagtccggccggcgtcgtgatgaccattaccttttctattggattatactcctctcgtacgcgtccgtccctcccggtcgctccaacgcatgcagtattccaactatccaaattatttatgctgctgaaatgttcgcagtctaaggccgagtttagttgtaaaactttttttcaaacttttaactttttcatcacatcaaatcaaaactttcctagacacaaactttcaacttttccgtcacatcgttacaatttcaatcaaacttctaattttaacgtgaactaaacacaccctaaggacctgaatagtatgaatgaaaaaaa

SEQ ID NO: 83219 - DNA, 32362 bp, Oryza sativa
catccgccgtggcacggcattcagcgccagctgacgtggcgttgaggtgtctaagttcagcgccaaatgatttggcgttgagcaaaagagtcagatttgaaataagttttggcgacggttcatttgtaaaaatagtttttgcaaagggtcagattgttaaaatttgtgccttttgcaggtatcagctgtgccgacttcttcagaatctgccctgcggcctccacttgatgtctgctgccttgggtggcaagtacccttctcctgttctaccggttagttttccttggccttgacacaatgcctgtattccactgtcatgccactctcccctcctgtcctgcactgcacggtggtctggttgtggttgctggtttggctggtgactttagtttctgataactctgaactctgaagtagaagcaaagacagacaggacaaggacaagatatgcctacttcagttcgccattgctgtcctctcacatcgtcgcattctttccttcccatcacctcagcctcctcctcgccggcatcggcattgtcctcttgatcttgtcgatcgatggagatcgcggcggcggcgagccgtgccgtggtggacacctcccggccgttccagtcggtcagggaggccgtcgaggtgttcggcgaaaggtgcctcagctccaccagccgggcgagcagcgagtccgccggcggcggcggcgggaggccgtcgccgccggcggtgctgggctgcctgaggaagctggaggcggagctggccgaggcgaagggcgagctggagcggctgcggcagaggcagtcgcacatggagacggccgtgtccagcgtcgccgcgcagctcagcaccggcctcgccatcctctcggccggcgccgcccgcggcaagggcaaggagctcgccgtcgtcgacatcgacgtcgacctcggcggcggcggcggcagggtccgcagcgaccggtgggacgagagccgcgccgaggagtggatggcggcgagcctggagtacctgcccagcctgtcggaggcgctggccatcaagatggtcgacgacgatcgccacctcggagagaggaggcaggggaatgcgaggaagaagaacaccaagaacgccatgaacagcaagaagaagcagcagcagaagaagaatggcgtctcatttgttggaagaatcttctcatcaaggaaagataaatccaggtgatgaatgcgattatcatccatatatgctactgtgctttgtccatatatatatattagtttcctcactttgtgtgtcttgttttgaatagttcataagctgcatgctgcagtagctgcaaagagtgcgaggacttctttgggaaagcaggaattttgcattaattagttcaaatgctatgaaatttctctagaagtttgtatgttacaaatgagccctaaatgtccctgttggaatgcaggaattctgtagaaatttttcgaaacggaaacacggattaaacagtttatactgtgttcagtttcccaacaaaatttcttcggaaatcccgcgttccaatcggaattgtgagttttgactctttcatctaattggagtgagctttgtgactctttggtgtgttctttctatgagcaaagctcatgtttggtttctgaacaagttggttggcaggaggtatgccaatttttaaagaaatattatggtttttgtcagcccaggcaaccaaatttgtgggagtatcacagctactgatgaaatgccaaacaaattaagctaaaatatcacagataattcatacataacatagcttagtttgcaatgccaagcagaataataaactgactgatttttttcccatggtgatacctatgacagtccatagttactcatactgtcatacatgaccaacctcactgtgaataatatcactgattattttaagaaatgaaaaggcaacacactaattaaagactgggcagcatatgtcataagatggtagaggataaatgctgccccaaggttattatatgtatatatgatgctaattctaaggttaactaatagaggatatcaagtggaagaagagcactggatcgtatatgttgctgaatcagacgcgcatcctcttcacatctccttggggcacatgagtctctgttccattgccagcagggatgccttttccagcctaagaacaggaaattgcagaatgatatatccatcagtctgaatgttgttgattgcaaagaattaatgttcagtccattggtgtggcggtggagtcgtgaggtatatgactccatccaacagggttcaaatcgtggtgtcaagaaatacggttgcgtgcatggtgcagaggccggaagttatacttcctttatccaacaagaatgttcagcccaatgtgagagtgttttttttttaatttatttttcttctttttgaaagcaaaacatgaactcaccttctcatccggcacgatggcatatcgctctgatggcgagacccaaactttagctgaaaaacaggattatatgatgtaagttctctgaatgaatgactgaagaattgcatgagcagagagacctgccagtagaagctgaaaaaaggcatgatgtgatgcattgcatatatttacctgacattgggacggcttttgatgattccagctgcttgcaagctgatccatccgagctcaaggcatcgatcatcttgggtatgttccttcaccaacagaaatattttcttgattcagttaccgcgcattaaacctggattttttttttttgcaaatgcgcaaatccttcgggtgcgagaaattacctatcaactatttcaccatggccaagctgtccactggtgccccttccccatgagaaaacatttttggcttctgtcagggcaagagtgtgcctccatccacaagcaacttgaacaactttctgcagttgagtggcatatgatacaaatgagactgaaactgaaaatgcgaaacttataacgtcaactgagaggaatccttcttcagatggagcggtgaaatagccttggtgatgatcacaagcattgcggttatcgttgcggaaagatcataaccattgtgtttagaaccacatgacgcaattaaaagttaacagagcaaaagggtgagaacaagtactccaagacaacaccgtttacctgttcgtttggaaaattgacctgcaccggggagcagtgatcttcattatcgccaacaccgacttgtccaaactacacatgacaaaaaaaaaactaaagattagcataagtgatgataaaatgcaaggataatggtggtaaattggtgctcagaggataaacatgtcagagaacacaagtacagacgattctcatgtagtacaccttactcgagactcaaaattgtcggagtatcgacgtggtttcacaaactcttatttcgccagaggcatgtcgttttcaagatatttatgccaatagaggcatccaaattgaacatacatgttgaattgaactgcatatactaatcaattcactgaaatatgaattactatagagtggtcacatatcattcatactccgaaaatcaagctgacaagtggggtttggtagtggtgtttggtggattggtgaaacacttggtacctaaaagtggaggttgtagtggtagtatggtgccctggaggaacagggaaaacggttgctatctgctgctgtgagatttttctttttccagatcaagacacttggctcttctagttccattgtgtcttaaagaacactgaatgtcattcttcagaaatgttttaagatttagtattcatcaacatataagaacatgttcagagcaagattggtgccttgttcccatcagcaattaatcaaacaaggggagtaggcaattcaccaatcaccttgttccatccccatccatagagtttcccatctgctgcaagtgccattgtatgcctccacccacctgaaatcttcatcacccaaaaaaaaaaagatcaactctacagcttcttcctattgaaaaaaacagtgtcacaaatagaatttcgacagattgctatattacaaaattcatagcaaaaggctatccatttatacttgagatattttttagataatatttatacttgagatatagtagtatccttcaatgcttccaacttgtgtggaaccaggtgatcctcaaaatcaccatgccctagctgaccatacttgctccatccatatgtgtagatgctaccggaggaggacacggtgatggtatggcgccacccgcacgctacaagcaccatcttttgaccctggaaaatcaacgaaaagggtagttttatcatccttgagaatgtaccgcaatgtatcccatcttctagtgtaaacttgatactttcagttgctatgcttcgaggtatcaaaatttttagtgtaaatttttcacacctacttgtactttctttgagtaccgtaaaatttctccatgaaaaaaatgatgatgtagaacataaatgataactgcaataagagtcagagacaaccaagagtaagattactgacattcacagaagaaactttttctgggattaagcggtcatcgcgatcgcctagtcccaagttgccataccgaccccagccccaaccgtagagatcaccatcttctgttacagcagcggtgtgctcggcaccagcagcaatcatttttacacggacaccctgaatccacacagtcttgttgttaattagagcaagtattgttcctaacagcctcaatgtgctgtttctgaattttagaggtgtcattctagatatttgaagaattttgcccatcaatgttgctattgtcacaaagcaaaaatgtttcctttattattattttattctttggtgatctcatgcgcaaatcgtgaagtacattgaaggcttgattgcgaccactcactgctcaacttctgatggtatagcttaattattttgcgtgatttcgaaattgtggcatcagttcatgaatacttcgtggtccatggttggggggctcatggatgttattattggcactcatagcctcggccaagaaaatcgtcaggtggaatacatttgtactccctcggtccctccctttatttttagatataaggcgtattttgactataaaattaagtctgcaagactaaactctgaccattaatttctcgtaatatatttttttaataggaacaaaaccaatattacgtggaagctctttgaaatacaaaatctataggtataactttaaacactaaaaaatatatttgtatgcttaataatgcgctcgtcaaaatcttcaaagtttgtccgtttcgaaatcaaaataagccttatagaagtgaatggagggagtagagtacataaagatatttcccgcggatgctgctatcattttcacttattcttttggtctattttgccttaccctgttccaacaaacagagctagatgaagacgttttgatacctcaaaagcttgaatcttttgtgggagcaaggagtcctcggtgtttccgaggccaagctgaccattttgattgcgtccccagctgaaatcaatcaaccagcacacaagaacactttgattatagggatagattaaatataattagaaacaaaattagcaaatagctcaaaaaataaatggtctaaggaatacaatacagtagaagaaagtttattaagaaaacgtatttttcgagacgcgtactaaataatcgtcggtaataatccaataaagttgctgaaaagaaatagcgatttctacgtaacatcactacctttcctctactccgagaaaccctatcttttctcaaaaggtagttttcctctcttaataaaagactagacatttcgctactcaaaaaaaagaatggtatttgggctcgcctgttcgaggggactccgctcaagggataacatcgctctggtctcacctactgtagagcagtagcgatcctataaagtcttaccaagatcacagaaccctgggtagatgattcaatcctagtttaatttacgcgatgttaattaagtatatcactcaataattagatatcactgataatttttatgataggtttgtcactgccgtcgttgagtccgatatcctcgggtaaacgcttgggcaagtcgtaatacatgaaagagttattttcattttaaactcagcaaggtgtatttgtattaaaggagagggaaacaatgtacaatagtcttaagactaggagattacatcaaacaaaagaaaaagaaagcgggtttgggagggtgtcgtaatacatgaaagagtagaggtacctgtggacatggccggcgacggtgacggcgaggcagtggctgtcgccgcaggcgatctgggtgatccggacgccctggagcgcctggatgggctgcgggttgaacacgtcgctggagttgccgtgacccagcctcccgaagtcgcccctgcaacggcggcggatcgaattctcagttcgcttcacggcggcggcggcgagatgatcgatcgatcaagcgcaagtgcgtaccatccccagctgtagagctgcagctcctcgtcggagtaggcggtggtgtggtcggcgccgcagatgacgacggaggcgacgccccccggcgcgtcgtcgaacgccgccgtcagcaccgtcggcaccggccggtcctccgcgtcgccgtgccccagctgcccgtcctcgccgcgcccccacgagcacaccaccccgccgcctacacgccatgtcaatccgtcaagtcagataattaaccaccgcctaggcgctatctctctctcgcgcggcttactgagcagggcgacggagtggctggcgccggcggagatgaggacgacggaccgctccggcgcctccgggaccgcctcgtcgtcgccggcgacctccacctccatctccatgccggtcgaatgcatggtagtagcagacagaagagaacgagagcagagtgagcaagtgtgtagatacggctggtttaagtagccgtagactagcagcggctgatgggatgggcaacccgccaaaataatggcgccaattattcacactaagctactattttcgttttatattataagtcgtttgacttttttaagttaaagttctttatatttgaacaagttaaaaaatagcaatatttacaatatcaaattagtttaattaatttagcattaaatatgttttgatataatgtttgtttcgtattacaaatattactatgttttactgtaaacttgattaaactttaaactttaagaagtttgactaataagaaaaaatcaaacaacttaaaatatgaaacggagagaatatttctgactagctataccttaattaaaagaacagattttataattcaatacctacaagatctagcgtcagtgacgaacccagagattttatggagtatggacggaacaaaccatggctgctagactttggcatcgtcaatcatcgctgggatgaaatacttttttttattttttttttacttatggcatgacatacttgcaaattgcaattctactatgagttggcgagcttggagcttggacggctgcctagagttgttgcccttatgcatgtttcttcccgtgtatgatgtgtagggggtatttgtatggttagatttattctgcagcagtttaattgttagttttaaattgtactcccataatatatgtataatttgacaatgtctcgtctttttttttcccgaagcccatagctccatcctttggcctttgctatacagcttaatagcaaaggagttgattttgatttttttttttactttattttttatattggttattaatttgctaaaaacacatcaaattctttttgtcaataaaaatactacagcttataattagcagtagacgaaacgatgggactgtcatgtttgaagcgtgtgcgatgaagtggattatttaaatttatctaaacccttaccacacaacatctccccgcgttcaattagcatgcatattttctatgcttgaacatgggtactactgttcactttatgttgatgatgtaacaaatctatttataaattagatgaatatgtttaattcgtccattaattcgagcttgtgttgaaaaaggatatgtcacctattcaatcacgactgcaacaacattcatcagttaccgatggcagaggaggcaaaataagatgggaaagtgactggtgtacaaatcaatcaaactcatttttcgataattacttgaaaaatgctaaaagaaatggaaatggttctaggtaggaggaaggaacgagctccataaattgtagaggatagctagtgcagcggggcccggcgtatgtacgcgcgacggcgacgccgcctgcatcactgcgcctgcatgatcactgcatctgcatcatataagaagagattaatgcttgattgtaacccgtcctagtgattaagatgcttggaactttgtatagttgaaggcacgcgcaacaccaataaatgagaggcgcgttgagaaataccggtggtgcgatggtaatgtagttggttctgtttagttcgcgaaaaaaaaattagtatgacatcagatgattgaccgaatgtcggaaggagtttttgacacgaataaaaaaactaactcgcttggaaaccgcgagacgaacatgttaaggatgtactcgtgactgtgtataaaaccgcgagacgaacatgttaaggatgtactcgtgactgtgtatggtggtgtgcacgtgtacatgtcttttatgtaacagaaaaacaaataaatagggaatctttcacaagaaacatttttcatttgattgcaaataactaatggaatttcaaagggaaaaaaatcagctaaacactcagaaagaatagttatcctttatatcctagaagttctgccaaattcccattaaatttatgcgttctagaaactaataacgctgccccggaagtaaaacagcgactgcaagtacatggtgagccccctgcgtcaaaactttcatgtgtttagaaaatggattagaaagggtgggattgaaaaatggaaatggacgaaaggatatgatgaaatgagaagagaagaatgaatggctaagattgaaacttacccttttaagatggaaaaacatattccaaacctatttttcaaacatgatcttactacattttagtagtagctttcttgatgaacttgtactgctattaatactgccgtccagtcaattaaacaggctgggacagaggatttattattggccacgcatccggcgtgtaaggccaggccagtagtactactcgagtactacagtaccgagtacactcactggtgatgttgcgatctatcgatcggtgatgatcacttgatcgggattcaggagtggttggcagctcgtgtcattctccctagagccaacgccatttcttccacattccagttccaagtcagaatttttttttatgtttgacaaagtttataaaaaaaatatattttcaacacaaaataagcatattatcaaaatatattcaatgttagatttaataaaactaatttgatgttttaggagtagctaaatttttctatgaacttgatcaaacttgatacttcctccgtttgtaaatatttgacaccgttgactttttagcaaatgtttgacctttcgtcttattcaaaaaaatttataaaatacgtaaaactatatatatatatatatatatatatatatatatatatatatatatatatatatatatatatacatagaagtatatttaataatgaatcaaatgataggaaaaaaaataataattacttaaattttttaaaataagacgaacgatcaaacatatttaaaaaaatcaacggcgtcaaatatttagaaacaaagggggtaaaatttgactaggaaaaaagtttatttgtcaaccatggaacagcataattataatgattaaacagtgatcctgatctgtaatctggctacttataccggctcctgcttacaaattcatatgctagtaggagtaccgtttactttaaatgccaatgtactgcactctctatctttgtagtatattcaataatactagtaacatgtgtcaataagtttgagagccgctctacttgctcaacaacttgcccatagatgcattcatttctctccactgtcttcgttttctccgtcggcgacatggcaaggcacattcacatacattttgaagtaaaacaatggactaaccaggcattgcattgaatagaagggaacactgtgaattatacaaaggaaaagagatatgaaaaaggctgtttaggaacttttcacatcccatgtatctttcttgacatgatggagaaagattgaaaccaattagccattttgcctgtaaaacgatttgaatcaaatcaattattcctatcgggattacacatagcgcagagggagccaatgggcaaattaattagtaaaagaaccgcaaaggcaatgacctatttgcagaatatgtttctacctctaataaactgacagtaacatctgctcctattaaatagaattacgggcgcacgcaattctgatacacctctggggctctgataaacaggaactacaatgtataaaccactatttgaggttcaaaaaccaggacttgggtcactccctgcctctaggtcctggatcaccctgctcctgagacgttggaggcagcaggcaactttcaaaatctttgattattgttaggaaatctccgtccttgatgattgtatggaaattttgttctcgccccatttctccaattcctatgtattctcccgtctctatttgcagccctgccacaatgtcccaaactgttgtgttcatgctgagacatctgagtggaaggacaaggactccctcttggatagggcggcaatggtggaaagggctggaaaggcacaccaggtgcgactttccagtttttgcgacatggccctccttcaacttctggggttccaaaatgctcaacaaaagcgattggaatcccgtatgaaatagtcaagttatgttgatacctctccaagtataatcctggagaaacccccgattctaaacaagcttgtccaggccgactttcctgctgagactcaaatccaggaggtgcttcatcatctgcaccatcggctgaacttcccaccacaggaacatcattgtgggagctgttcgttccccaattaccatgcaacttatttcccaccgagccagtccgaaactcactttgtacaggacaaactttctgaattttcaggccacccattttatagtggtcatctggttggtaatcccaacggctcttgcgttttcttctgatggatttccaatccatagtgttggctgaagttggaaaagatccaccagctgttgaaatgacatgaatatcgtgtgcagatatggatgcacgtgaatattctgttggctcatttcttgaaatatttcgaggggcccattggatccatctatcacgaaagttccgagcaatctgttgaacctgttaaaatcattatatgaatcaaacaggtcatatcctcacatcagagaatcactaagcctataaatgcaggtaataacaaacaatattcttattgcaaaacctatattaaagaccaacagatatcaagccagctaagagagaatataaattgtactccctccgtttcaggttataagactttttgactttggtcaaagtcaaactgctttaaatttaaccaagtttgtagaaaaaagtagtaacatttccaatccaagacaaatttattatgaaaatatattcaattattgatttgatgaaactaatttagtattataaatattactatatttgtctataaacttagttcaatttgaaacagtttgactttgccgaaagtcaaaacgtcttataacctgaaacggagggagtatttaactaagttccagcagtttccgggaaggctcaaagaatacagctgttcataagtaaacatgatgatgctaatgcataatccgtttacagcgaagtactcacactaatacatttgctaacttatttacaaacaaaaaaactatatgaattttcaaactatattggaaatttggattggttatccattaacgaaaataaagaaaacttgattttggttccattttttgctctaagcaaaaagacttgtcctatgtccatggataaactaagcatttacaatacagaaacaatcaatatcaaaccatgtatatgcatgacaagttcagaaacatgcactagtattaccaattatgttgtattgctttcttttaaagtgacatttccctcccaaaataattaatttgctgattgcatttgcaaacttgcaatctttctatactatgttcatggcctgaattgtatactatctaaacaaagagtcaatgcacaaacaaatacctaaaaaacaagataaaaatcatacacgttgggattagtatatttattacctgcatatcattatgccttaacaagcccaacatcgactccctgaagctgcaatgcgaatttcagagaataaaaggtaaggaaaaattgtagaattgatgcttcaaaatgaaaacttcaacagcaaaagaagctatatttagagcattaaaatactgtccatagcatgttatttgcacggctaaagcttagtaatacaattaatggtaaacctgcaactgcaattagatatacataaaacaagtgtcttgaattcaaaattgtcacctccaaatatactgttcactcagggcagcattaggaaatattctttaatatgggacttgtaatataataaattgcaatgctacaaacacatttcacaagtggttgcttgatggattacaaaaggccatacagaagatgtactagcaaaatttgaaaatttgaaagcttgaaatatcaaacatacaaaaataacaagcaagaattgcatttatttcctcggaagaccatgttttggcataaaaaatatgttgctacacaaagcaaatatacagaaaactataatgaaacctaagaatgaaaaataccaaatgaataaataacaagtttgaataatcaaacctttctgtcccagcacatcgaggaccaccatttatatgttcagatgtcagaatgcccttggaagctagaaactcaagtacctgaagaaagattactcataaggaaaaaatagggtcccataatgatataattctgtgatagaaatattattctcttttttgttatacagaaaataagaacagtggtgcaggcattgcactcattacaaattaaaagcatgtccatccctatctgttaagaaggtactagaggacgggtatgtagttagcacctgtgctatgggccatgggtttaggtgttacagcaaaaatgcttcgcccatgctaaacgtggtaagtggctcatgctaaatctctccctcgtacatttcacaaatgtttaatgataaaatctccaaaatattataacgttagcaccaaaaaataggtggcatataataattaatggtaccaaaggtctagggaaaaaaaacacccctacaattccaaatgcaatacgttttagcctactcaactctttcctaaatgtaagttgctttggaatttctatgcatttttacatcttttctttcttgtttgcccttgccaaataaatgccaccatctcacaaaatacattatcatcttttccagtgcagcataaatgaaggacaatagtcattttgagtttttttttcttgatttttgtgcacaagtcataaaagaatcagagggagtagataacaaggatcttgtgggggttgatatgtccactgtagcacctagatcagttgttaagggatgtacttgctctaatgtgatatattaattggaaactaatgtaataagacataacataaaaaagaaatgcaaaccttcacaagctttcttattataggtatcctatggaaatcgcttttattctgctttaatatattgtgaagcatttgcagtcctgtcagaaaatagtacaaatagtttattagtcagtaattctagatgattgtatttcacgtaaaaagctgcagaatgcaagaaaatgtaccattcttattgatgatatccaacaggacagaattggatcttgttttcagaagtgcatcaagaattaacgaaagatcccttacactgaaagatataacagaagcatatttagactgggcaaatgtaacttgctggatgttattaggtaatcaaaccttttagacgtgcccccagcattgtcaccttccgctgcagtcacaaggagaagcttcaagtatccatttgttgcgtccttttggaaaaaaaaattatcagtagttagaataatatccaatgacagaaaaggtagaatggagagatatttggactgcttgacgcccaattgatgcaacacagaacacatgcaaatattgcctagcctttcaagttcaaaccacaccgtgtaccaaaaaggatgaccaagaaacaatttaaacctaaagaagtctaataaaggtagaagttcaatcaatcgaaagtcgttcatacactatgttcttgagattgatactaataaatgtgagaaatactaatccatatttcatacactgtcttttagcatttgcgctcaagaaatgtggaataccactatataagtttccctaatccccaacgcggtgcaaactccgtaagagaatgcctcataaaaaaactgggttgatttttagccatttagcatatgacaacatatcctaattaagagttgatgccaaaaaatcagtaaaatatattcagtcctagtctataattgaagtatatatataatgcaaaggacaagaggatacatacttttcgtttgctaatacctccatttacatcaagcaagctgttcaatcttccttcaactgtgcatgtcaggtagcgatcattaacagtcatatgtaaccctagacagaaagagagatacacttggaagaacagtattacctcccaaaatgtgctcactgtcaataggagctgatgatggattcagaatcaaatgatgttttacattggttttcttattagcgtggaaacctggtacccagtggctccccaaatcggaactaggcggaattccatttgttgtgcttggaacctttggtccatccagtgtgcatggagccctttgcaaaatttctgatgaccgagtaccatattctggaaactgccgcgacgtactctcaactgtccgggacacatggacaggtgtgcggacgacatcttcatcatcctgtgggctcaatgcttctaaggaattttctggctcacttgtgtcaaataaggttcctgaagtttgttgctcagattctaactctggtgggttcacagatgggcaatcatttgaatcttctgttttagtggaagcttcatggtcgacaatatctagatgtgtgccatgagaggacaaaccatttgcaccaagtacttcctcagcatcctcctgaacagccataggttcgaaagtccctgcttcagcatcatcttgagtaatcatatcagcacctgatatgtcaccaccgatgtaaccccggcatttgccagtaccgcaaaagcatttttgaggagcagcaccagatacacgaacatagttgtaatcaaacgtcaattcttcaccctgtgaggaaataaatatccattaagtgcagcacatataatacagatataggttatactgaaggatacgtttcatttgcacaaattatctctacaataagaaaggtggtggtggtagtcagtgtatcagataaccacttgaattggggtcttttgcatgtggctaggctattttatatgacttttttttgcaaattaatatgtttttcccaaaaaaatatacaacattttaagttggtatttaaatttagctagtataaagcaaactctcagtttctcaggacctgcatcatgttcattgatgatttcaagtttctagccttaccttcttgatgttcctcatagcaaatattccaatgcagacttcaccattgaccatccactgctcacaaggaaaaagtaatttaatggactcaaaataagaatataactaattacacaattttatgcaccaatcattatttatttatttatttgtaaatataacatatgacttgtattggacattatcaggatattttaagtaacaaaggcaagggatctggtcagctattcaaatataaagatcaaataaaacggttttaccttctctgtacggcaattaggactgcagctatgattgatgaaccggcccaagtttcctttagtacaagcatctatcacctagaagagttcaaagcaaaatgccaaaagtggtattaactattaactgatttaattttaagtgttagcatcatgaaggttgacataagaaaaacagataccacactgggttgtttgtatcatctattgatattataggaaatgatataaatgaactaatctgataatttctaatcgaaggcatatctaagaagtggcagggattgagaaagacgtgaagttagaaatgagggagtacatctatgcaatatgactggttaagaataaataaagacatacctcaccaccattaagtgccatgaaatagaaatgcttctggcctttagaggcataatacctttggcgggattcataagccgttatatcaaggacctgaaacaacaatgaagtaagcaaatcaacaaactcattagacatgaggtcattcataatagtagaagagaaattgagttagagagcagattgcataaatacacagaatttctgtaccagagggttgtacagttttggataaaaatggaatttgtatatactagtatatttttaatacataagtcggaaacacgacgaagtaatatcagagttacagttgtttaaaaatatatctatataaaatagatgcatggaatgaaggatgctactaatggaatcattatctcttcattctttttgcttttttaccaatatccatgtgaaaagaatgagataagtatcctggctatgtcagaacaaggtattcattacaacgaatgtgaaaccaacataatcaacatttaaacagagcatgtttccctgcaaaaaaaaaaaaagaaaacagagcatgttggcaacacatgcatgcatgcacaaatggctcagtgcaatcaacagatacaaggtattatttagtgacatgccaacataaaacattgctcccatgggcaagttgcactaacagaaatataacgccaccacaaacccggaataaacagaggaggggggacgataggcagcatgaagcactacctctccaacatattcaatgaggaatcgtccttcagatacatcttccttcaattgcaatccatagccctttttaccagtatggaacttaccaagttttgcataggtgcgcctttggaactgttccaagaactttataagttcaaacccagcatagtaaggaaacaagaacaaggatatgaaagaatctaacctgctgattggaacagtgctccccacatggacatgtacgtttggtgcattcaatgttgagtatcctgttcaagcaaccatctctacaacccattcggtcatcgtgaggcggcttacaattgcataccatgctcttgcattattgaataaaaaaaatagaaatatcaggtttgtctgctggaatttcaacccccaaaagaaccaagaacaaagaaataataagttgtctacaacagttcaagacagtttagcctgtactccatccaggcacataaacatgttctttcggacatgttgtcaaactttcaaaaaattgaatatcgataaatttttaaataattagattggaggcatgaaaaaatataatcatgtgtgtagatttgtctcgaaaattacttaaaaatatatcacaatagaaattagtggtcaaaattgtattttgaagactggatatgtccaaaatgattttcagggctgtagggagtactgatagaaaataaaaaggagataatataaattcaagaggttgagggagcagaaacataaataatatgagagagagagagagagagagagagagaggccatggggagcattttacttgtcctgaacaacagtttccaccttccactaatcatgctgtagcagaagggagaaatggaaatgtgcgcaagtgaaactgactgtgaatttttgctgtaactgaaaacttgtgaaccatggccatccttgatttggagtggctatgatacaactgtctgcctttacataggcacttcagtaacagttttttccagcttatcctacacgcggcatgggaagtgaaactatgaggtaagtggagaaactaaagctctgtttggtattgcggtgccttatgataatctcgttttcagaaagaacttttgaattttggtgttgagcaaactgcctttattttgatcttggtattgcggtgccttatgataatctcgttttcagatagagcttttgaattttggtgttgagcaaactgcctttattttgatccatgtggcaaacgataatattataatgtaaaatatgaaaattgggaaaacatgacagatggataacatattttatctaactgtgattcgatttgtagaataagctacaataattataagttcatttccacgggaacttaaaaaacaagtgcgcgcagcacagcaaccacaaactgagcctaacaatgtgtagcatgctcaccccccataagatttattgcaataccatgttctgagtacaatacacataaactacaaaactctatatgaatcttaactgctccttgcacataaaaagcaatatggtcggaaaaaaataatgctaggtaaatttaacaaacagaaaacaaaagaatgtcaattaagaaataaaaagtgagtagatcaacccatacctcatcaatggattgtgtcctgcggttacgatgtagaaacaagtttgacctgagaagtgcaaagtttggttctccagaagctgcaacacagcaatatgaaaaagtttgtcacaaatcagatatgatagagagcaacaaaagaaaattttgcattttctgaccagaatgtatagagtcaaaaattcaaacctttcgagtttgatccatcgccattagcttcatcagcagaagcatctgaaagcccaagctctgcattgatctcatcatctgtcttctcttgtggtatagagcaattggcaaatgtcttatcttcgttttccttacaagtcctttgtataaacaagaaaggaaaatgagttgtaatttattaaccattcaacagataaagaaaaaattcaaaatgagtaggcaaacacatctgaaatgacatctacatcaaaaagatcaataatattaaaccaaatggaagaattaaaatatatattttcaatgtagcggagccacatgttggtaataaggttaatctttgccctctcaaacttcacaaacacaggtcatttttcacttttcagtctccaatgcaatattgcccatgtttttcattacaatatagtacatggaaactgtctgttatgaaagtattatgcaagacaaatcccatgacatcacctctcaagtcaaacgatatgcttctacatatatacattaatagtctacatgaatcccgtggaaagtatgagcataaatgaaaaaggcccatgaaatacgaatattttaaggaatggaatgcaatagatatctgtagttacactgtagaattgaacagcctctgtttgcacaggaaatactaatatgaaatattgaacatgggcacatctaacatgcaagaagcacctttcttcctctgggtaactggctggctgctagccaactgccaaaatgatagagcacaaacaaatgcaaaatgtaagatttactctacagattatctaaatatagtgtcagaagtctttcttcctttagaaagaaatatgttttccattttaccaaacttttctatttcacataggtgattgtggactagcatagcaaaacaaaaggaaatccaaacaaaaaggatttcaaatgagttattttccagtggaacaatgcagtaatagatttcagcgtatgattactcaattaggttagaggactggtgcaaccaagaaaattgatcaaatagggatggcaggatggaaatcaataccatctgagattttcttttgagattttatctgccagttcagttggtatgcagcgccatttttcgcaatcatcacaacaaacccaagcaggtgctggtggtacagatgcaccatcagttttgcaagcaacaactgcaggtaattcaacagatacggcagaagagttcttgaatacaagttcagcagcaggaataagatcacctgtataaataagatagttagcaccaacagaagctacttgataaatgatagtaaaggaggatcaaatgatagaagtcaaagatgaaaatatatactctgtttattcatgcgaggttctgacaggtcagttaactgagccggcaaaccgtaggtgttatcagctatatttttcttcttgcttctgcccttcccatgtggatcccgcaccttacccttctttcctccatgactatcctttttcttgcgccttagtgatttcacattgtcaaatgcactcccttcgtcatcattgtcaattccaaaaggacgcatattgtcatatccatgcataccaacatcatgtatggcagaagttacgaccttagaacaagaaccaaactttggaggtctcgtatgaagcagcaactcagatggatcaagtgaaggtgaatcattagaaaaggacacgagttttgaagcttcactagatgaaattttggtggaacttctatttttgtttatgttttttcccttctttccatctttctttcggcattcctgctttcccacatttctacctttcctcatcgtattggacttcgctaaagtttgctttccttcaccaatatcattgtacatcatggcatgtgatggaatgacatcttcctctcccatgtcgttctccctcacagttttgacctgctgctccaaatccatcaatgatgaagcatgatgattttcacagtgagaagtagataaagcagatgcacgaagaccacctccaatcaatccaccaggacaagatgggttttcatgcactataacatcaagggttgcagaagtgttgctttcacatgtaacagaagctatatccaaaacagagtctggtgaaaacccaactatattatttagagaacgttcagaagttgaagtaccacactctccatggatgtacccagggcatgtttcttgagtaacattctccaagccaaactgttgtgtgtcagtcaggctagatgttaattttagagtatgattaccttcaacacactgtgcagctttgtgagcaccattcggagaattgaacaatgcatcagaagaaacattagtatcaatcctcactgaacaggtcggttggccattcaattcacctgctaaatatccaatatcagaaagtgatgtgtttttatattttgaacatcttgaagttcgaattttccgaatagatagctgttttttctcgctagatcctctatttgatatttcttttcccaaacaagtttgatgagaacgagaagttgaaggaccacagttctgattgaaaccatccattagcttttgtaggctgccccaagcagaagagttcaatggcctattgatgccacttcttccctttgtggttttgtttgggaacttaatcatggtgcttttaagtaatgagcttacactgtcaaccttcttagatttgcgtgtactattacctgatttgtttatctggtcacacttctcaaaattagaatttcttgaagaggcagctcttactggattcctccgcctgaagaaaatcaccggcacttccttttggttatgagaaccattaccattctcaacaaaatcaacagagcaagctttgtcatcagtggaagtacacgtattgagctcttgtaccaaacagtctgaagattccagtccaagaccagcagaatcttgatggcctaggcagaaggcgggtgtttccctgccactataacaaggttcattttcacaaggtaggttatgggacgaactagtcagatctctctctgggggggattcagagatcacatgcttttcacgactttgttggagtggaaactctatttcagcacagggatcacaagatcttctagtgcctgtattttctacttcacaaacagatgcagttgaaccctttggaacatccatccagaagtgttgattctcatctccagaagcctcagtctgaggcctgctgtcaaatgaaagcataacttctccgagcaaatcatgagccaatttctccacaccaattctattttcagatatctcaccaactaaaccatcctctttgtataaaagaacatcaatggggctattatagttagagggaatcgatgcctcatccactggacaggagaccactacatcactttttggatgaaaatcatcctttaccagctcatggttagcaccagtcatcgatctcagaccgtcaccaccacgtggtaatatgtcggtgccatacttccctgaatccgacaaagctacgatgctgtggcatggttccacttgacctgtctgtaagccctcttcacatgtcttagcctccaatgtggaactctgattctcatctgcatgagactcctttaaagacctactctcacaggaaagtacacctcctcgctgtgaaccatgcgacactttctccatgattgctctatgctcagatgttttaccaatctgaccagcattgccatcaaaagtaaaatcaacagagctcacagaaattgaaggaactgaatcctcatggatagaactagagaactctcctctagtatttgtcaacaattcatccttttccagctgatggttaggatctgtcttcgaacatatgacattcatgccatatgatggctgctggacaccaaattctgtcaaatatggaaagcccttgttatcacattgtggttccttggaacacatctgtaaatcatctagacttttctctacatctaccccacctcgcaaaacaattccatcacacgccaaatcaccctgcccgcattgactcccctgtgtcaccttgttccccatgactgctatgtgtcgagcatccttggactggcatccttcactaagaggggcatataaaacattgcaccacaaatcaccattggccatatgagacatccccatatcattgagagtttcacacgcacaacctgccttgcgtaaagaatcatcaataccaccagaaaaagaagggattgaatcatcctccaccgacctagagacttcagcttcaatttttggtatcaaatcaacttgtttcagctcattattaccctttatcgtaaatcccaccccatcaaccacttgtggccatcgctcactgtcattatgcaaatccgacaaaccctcgctatcacaatgtggtttcgtgcaaaccatctgtaaatcttctgtgtttgtctttacgtccgttgcgccacccaaatcatctttactgtccgccaaatcaccatgctcacaaatgctcccctctgtcgctttgtccagcaagtaacgcatatggctgttatcactggagaaaacttcgctgaagggagcaaataatgtcttattcgataccccgccattgggcgcatgacacgtctgcaaattgctgggttcagcagattccacatgataactgccatgcttctctcccgccatgttcatagacccctcctgcatactagactccttctcaccaccaatctgaccccttccttcaaaaggggtagaaacattcacagcagattccaccaattctgcagcggagccacctccattatctcggactccatcttcctctgtgggcaggcgcctctcctgaccaccgcagaccttcccaccatcaccgagctcaccgccaatctcaggaacagcgagcaaagccaggccaccgccgccaacagcaccctcctctcctcccaaccgcccaaccgcagcatgatcctcccgcccacgcgcttccccgtcaggctcctccatcgaagcagcgtgtcagcggggagccgcacggatcgagaccatccaatgcacgcccccccacctcccctccccccgggtcctagccgcttctccccacctccgatcacacccaaaaaaaaaccctagaattcgcgagcccctgcaacctccaccgcaaacgaacgcccaatcagaattccgcccaaaccctaccgagaccaaaaataaaaaacaacgagagagagagaacaccaacctcaaacgaagccacactacggcggcggcggcgaatgcctgcggaccccggcgcccggcgaggaggggcccgccgcccgtccgtacgcgcgccgcggcggcggggggcgaggaggcggcgagtcgggtcgtcgtagtccccgcgtcgttgcggggaggaggcggcggagaagaaggcggatagggaggaagagagagagaaggggggaagaggaggaggaggagtataatatgaggaagcgaaagaaaaaaataaataaataaagcggaaaaaatagaaaaaaaagagggtggaggtgtgttgtgcttgtgcgtctctgtgggtcggtttttgttcttctttgcggtgcgcgtgtttttttccgtgcggccgttgggatgtggagttgtagggaacaggcgaattttgtgggtgttttgttgttagattttcttttttttttactgcagcatgtgtgtttcaagtacagtaatagttttgttgggagtaaaagggtggcacatggtggtgattggtgaatatatttgcttcgtttgcttctttttaagatgtactttattatatatttggtttcgtaaaaattactgttgtgtatattttaactatctatacttgcgcagcacggcaatttgtttgtttatctggtcgtttcaaatattactaaacttcaaatgtttaaaattacgaatatatctctataagcatggatatgaaacagcatgccgagtatagtgcgggcacttgctggctttatttcttttttgaaaaataacttattacatctatagctatgtagaaaaaaaactatttgtagcatgcagttaactgtgtatgagataataaattatttccttgcccgataacttacaacataggcaatatcaaagtgtccaaaaaatattagaggcgatagctttatatgcatgaaatagtttccttcatagaagtaccgtcaacatgcacaaccctacatagacacgtgtgtgtatcatttaaacataatatgagaaattatatagtcttaagctcttgtaaggaaacacacaatttcaccaaaacgtgtgcatacgtttattactgagatggtgtgatttagtataaattaaccctagagcacgggtttattcctcactgtgagatctaattggtgtgaaatttaagtaatgcttatggaacacggcaatgtgttttcttatcggatcattttgaacatagggaatatttaagagtctaaaaattgtaaccaccgatacagctccataagcataaattagaaacaagaggctggtacatgacgcaacacatatgcttaccttaaaaaaaattacacctatagctacgtaaaatagacaattgtagcatgcatttaaccatgaatggttatgcaagatagcattttatttcctcatatgttaaactataatatagaagttttcaaaatcgttatcgaggctacaactccataaacacgattttgtttcttaataaaagaccaccaacgtgcacaaatgcacgattctgatttaaacgaatcccgagatacactcatgctcttataagaaaacacacaaagttaataaatgtatgtatccattggaacccatagtataatgctatgatttatcaaccctagaaaaaatggaactcctttgatatgaaatatagttggtgtgaaaaagaagttggaaaggagtgcacacccgtggcagttggtggctggtgccaaagactttcaccgccctgtgaggttttgacttcaacccatgactgtaggagtgaactcagctccatggcagaatctttttcacaggggcctaaatgcttaacgtggcgccagaaggaaaaatatccaggatcaacaggaaaaaggggctgaaaaggtcaactaactaatcatagggacgccactatactcgcatcacatcggtcgacgtgcacaaaaaaaaataattgagcaggagatgattatataattccactccaaccacagtactagtgtactactactactcctaactttaacttggggaggccatatcgcaaatatgtggataaccggaggggccaaaccgcaaaagagccagccaagccgcgcaggcatcctgatccgctcgctctgctacgcgcacaagtcacgcagcgcgcgatcccgatgacacgtggggcccacatgtcgagtggggtcggggagtcaggcacggccaagctgcgggggggggaagggaaacgctgggatggcgtaagcctcgtggggcggtccacccggtggtgggggcccacctgacagcctgcgtgaggggcggcccgtgcgggccccacctcggtgcgtgcgtggctgcgtacccccgcttcttgtgatcttttgtccgtcgcgtggcgtggcgtgggcgtgccgtggctgcgtgtgtttcggtgcgtctcgccgtttttttttgtttttttgacgtgggattttgtgttttttttttctcttttcgtttcataaacgaggagcggtggggggtaaaccggtaaatgaaccccaacccaagctgcggagctgggacgctggttctgaaatcattgaattttgtagccttgtagtagtagacaacgtcgcaacgatccaacgacggtgagagctgaggagcccagatcagttatcagatgtatagccaattattggttctaaatcatctgtaatcaattcatataatagttatttataatcatatactttctctgtcccataaaaaataaatctagaatcagatgtgacatattctcgtacaataaatctggacggatgtatatccagattcgtagtactaggatatatgtgtcacatccagtactaggttagttttttatgggacggagggattactacacaattaatacacagtcccatctatcatatacacatgcatcttgtagtccatgctacagctggctataaatctgtagtccgttactcttctctctcatcttttatctccttgaaatgttgcagtgacctgagtagcactcgaaggtcctgagttcaaatctccattggagcaaattttagattgggttatttgagagctaagttccctgttcgataggctaagttcctaattttaaaaaagctgcatatatccacttggatgcaaaggccgggtaaaaaaatacccttctctaaaaaaacttcttgaaatgtgtttatagctgatttatagtctgctattgtacctgctcttagtgaccaaaacaacgatggtttattcgaaggtttgggcttatattttgtctcgaaatttgattgtattattagagacggtcaccgagtcatgagtacaatgagatgtggtacttttttttgaaaaaaaaaaaacagagctatggtggctagtaacaaggattgcgacggaactctctaagggcaagtataatagactacaagacagttattagcttgggtacgtcatgcaggggatagtaattaggagagagaatggagccaattcgaccacatagtcaacggtcatgcacggggcaccgaagctcatgcatcctgcactttggatcatcattggacccatcgaaaatatagcgaatcgaatataaaagttgaactcagattgatagataaaataatagtattttagagtataaatgattattataaatgttgcctgcagtgcttgctatagttgagttgctaatgtttagagcccgcaacgggctgtgttattgcccttgctctaagggttcgaggttggtgtatcatgatcctctctaattttgcatttttattctcacccgtctaaactttcttgcgttttgcatgatgacacgttttccttcaaatgaactaacgtttcttctcttttaagaaaatggattataaccccaatacagtctctatatctaaacctacattgtcaataactaacatttcttgagatagataatgggcaatcatcccactttttttttcatacaataattaacccaaaaaaagaacaaaatcaaccatgaactctgccaacatacacagtagatacaaaaataaaattggtgcaccggagtatattgtgctatatatattatgcatttacattataaccctaatattttgcttggcggtttgttaacccacaaaccatataaccatatttaaaatctaaggcattgtttagcatgtttccagatactcaatccacgttagttttggacttttatccaattaaattggttgcaaatatttcttttaaaatagaaaaaaatacactcatatgttatcaatatgatcatatattaacctagaattaatcatcatttatttttagtcttagcttctaaaccacaaaattaaagtaggaatataaacctataatttaaattgcttcgatcatgtgtcgctgcttataagccctactgctctgtccctcccctccccccccccaaaaaaaaaaaactggatttgaatgtggatacatatatgtccagattcatactcggtaaaaaaaaattaaacctcgggtttgaatctgaacacattgtgtgtccaggttcaacccaaggttttttttttacggaagggggtagaaaataaaactcagcaaaataggttctaatttttcagctcaataaaatccagagacatgggctgtgctctttggacaactttcctaacatcattctcgtttttcgcacacaagcttttcaaactattaaacaatgcttttttttaaaaaaaattccatagaaaaattgttttaaaaatcatatcaatccatttttatgtttttttgctaatacgcaattaatcctatgctaataaggtatcttgttttccgtgtgaaaggaattactccatccattctaaaatataggacacaactactttttaaaggtgtttcataatataatgtgtgcatgcatgcatggtaattaattagcatatcttctcttctaaattattattttttaaatcatacactcacatgatgtttaattctattgggtgcatgtattgtattaattggattgattcaaacaaagagatgataataattgtttcttggttattagattataggtggttatgccttatattttggaatggagggagtagttcccaatacaaggaaacgaacacagcctaagtggagtaggcaagcaagttttttttttatgtccgcttatcatcattcctgttaacttttttttataattttgtagtaatatttactaatcagatttattatccacttacatgagtattcatacggccaaaaaagagcaactgaaaactaagtccttgtttagttcccaaataattttgcccaaaaaggttacatcgaatctttggacacatgtatggagtattaaatatagataaaaaaaactaattgcacagtttgcatggaaatcgcgagacgaatattttgagcctaattagtttatgattagtcataagtactacagtaacccacatgcgctaataatagattaattatgctcaaaagattcatctcgcggttcacaggcgagttatgaaattagttttttcgttcgtgtccgaaaacctcttccgatatctggttaaacatccgatgtaacacctaaaaattttcatttcgtgaactaaacaggcccttagtgcgatgcgcttatctgagacagagggaatattacaattttacgtactccctccgtcccataatatagcaacctagtaccagacgagacacttcatactacaataaatccggacatacttcctgtccagattcattgtaatataaaatgttccatccagttctaggttactataatatgagacacagagggagtacttgcttacagtaacatatcaagagccatactactccacagtttacactcgctgtcatgcgatgaagggggttccacctaagcctgccaatgggtctaaatccaatccaaaaccaatccaacccaacacctgccgaggcagcccaccaaaccaatccacaccattttcccatttataagatccaacccaaaccaacccccaagcacttccaggccaaactaacccaaaccattccagcctaatgggttcaacccattttatatccatgggttcagtccacgtacagtccaatcttcatcaatcgtcaccactcaccatcgggaggaaaggtccaggacgccgccgcgttcgtaaagatcgagcagctcgttcccctttccctccctctcccttcgctttctctcttccttcctagggcttcccctcctcggcggcgcttcaatcgaggaggagttggtcgtccacgacgtggtggtcggtgtcgggctgagcggcagcagcagcggcggcggtgacgggacggcggcggggaggcggcggaggcgcggcttggcctcgtcgtcgtcgtcaacaacggcgacggcggcgtggtggtgtagcggcattgggcagttctagaaggttttagaagggggagggcgctgctacgactacgagctctgatatgaatctgcgtctcttaagtgtgctttctagcttgtgtgtgtgtgtctaagcttgctttgggcttaagctttggttaagcctcacacacacttcgctggttgctgctgctgggtttggctttgtactgatcactatattcagaggccattagtgcaatccactcgtatccatgggttgaatccatggttacaatccattttggacccgaaagaattttaaccacatccaaaccaacccacaccgtttttcaatgaatccaaaccgctccagtccattatgagtattgccccatttgaatccaaccaaagccagtccatttagaaatccaacccattccacccatttacatccagtccattagcaggcttagttccacccccagtcaaaaccaggtgggccagcccagtcaaaaccaggtgggccagccagcgaagtcaccctcattgtagatcgttgacccaagtgtcagtcagtcaattcacccgacgggtgaaagaacacttcctcttttcccccccgggatgtgacgtgcactcctcctcctactagtagtagaagtggtactagcagtaggttctgaaatggtcaaagcgaaggaccgagtaataaaagagaaaagcgaacaggaatcatcccccggttgaccacgccacccacggcgccacgcacggccagcatgaaagccccagtcaggggtcaagtccccaccaacctcacctcattttccattttccattttcctttgtgtttggacggttttttgtttattaagggaaaactactcctaacatgggcatttgtgattctaatattttctgctaaactagtacggagtagtacgcatatgcatttcaatggacctttgattcatgggttcatgggcttatacgactgggaatgggcttcaagtttgacagtggggaattatattttggaataagttcactggaggtccctcaacttaacaacgagattttttgtggtcccttaaccacaaaaccaagaatgtgtacccataaactatacaaaaccgtttaaaagaggtcccaaggcagtataacagcatggtttcgctgacgtggcattctagtcagcaaaaataactaaaataaatatgtggggcccacatgtaagcgataaaatgacgtgggtcccgctttttgtctcttcttctctcgcgcgggaggaggcaggcggagcggcggtgtcggtgagtgagcgaggctgtggcggcaagcggtaggcgagcgacagctccaggcgtgggcgaagcaggggacgcggaggggcgagcggcggtgggcgagcatatgggggagagaaggccggtggcgggagagggggagagaggccaccgacgcgacggtggcgacgggagaggaggcggttggcactatggcgagctccgccggcgcgacggggcgagtggcgacgggggagggggaga

SEQ ID NO: 83220 - DNA, 23655 bp, Oryza sativa
  unsure (1)..(23655): unsure at all n locations
ttgtcgacgatctgctcgactgctcgtcttgctacctcgctttcgtctccgttagacctggccctgtgatggtactaggctggtagcaacacagtcaacacgtcgggcaatgtcgaagtaacgcaggctatgctgctgttaagtcatggtctcatggagcagtggagtgctgaaccagctgatccacgagctgatgtatttgggccgtacagtccgtgatagcccaagcagaaaacaacggcctgcctgcctctaaagatgggtctttctctatccaaaaacggaggcccagctattgtccgtctggcaggccggatgtaaccggcctcctttgcagccccgctttggatggatgccacgtggaaaccccagccatcgaacggatcgctcgtctcggcccaaagcgcagcactaggagagcgtaggctcggctcgagggcacacgctgattctcctttcaggctccctatcggctcgatcgattcgagacgcggagaattttcgacatagcctggcgactctaatcctccgatccggcgccgacggcgtccctgagactgacgtatccataatccatgggagcacctcagaaccacagcggacgtgccgagctccgcagctgccaggtgaccaacacgcggcgaggaataagaatttgttggtgttcctaattaatttggatccagatggaattcttgaagatttgtttctggagcttgaaacgttctgattccagcagctggtggtggtgcatagccgacggccacttcatcacgatccgagaacaatcgatatgatgcgtagcaaacaagatagatcgattgattcataaattggagaagaaccggaatccggcgtcatcgccggaatcagccgtagtcgccgatgtctcggggttcgtccgcgacggccgccaccccgatcggcacaggcgccggttcgtcggcgtcggccacgaaaacgagaagacggctgcgcggagccgacgatgaacctaaaagccgcgtcggactctgagccgagcctacgccctggccgtgctagggcctgggggtggagctgagtcgagcgatccgttcgatcgttggggtttgcacgtggcatacatccagagaggggctgcaaaggaggccggttacatccggtctccaccaaatttttttccgtggaacattcgtcaagcacaagttaaactaaaactgaataggagtagtacatgatttccacagaaaaccataagagaacgaattaatgattcaaacagtaataacgtctaattttgttgttcttgctaatctgctctacatacaaaaccaaagctcccactctggttttctttaatttacagtctactagccagttgtctgcttcaagtatagtcattccatcgccacttttcacgctgtgcttcccggtgttgataaccttgatctgctcgacaaaaacgcatatcgatcttcgtcagcgattgatcatatggaattcagcgttatcagaaaaaaaaaaaacagagtgatcagcaactgatcaacacgacactgaccgctgcgtgaaatccgaggcagaggaggggtagctcgacggccgcgacggggacgacgagttcgagtggtacggccgcggcggcatggcgagctcgtggacgcttctctccagcatctccagcaccttgcccatcgacggcctgttcgccggcacggtctgtatgcaccacagcccgatcagcgccatcttcctcgcgatctcctcgcctcccggtgatccggcgccgccgccggccgtggcggcggcggcggcggcgacgctctgcagcacgccgccgtcctcgagcaggtggtcgtagacccagagcgggaagaacgtgccgctggcgcccttctcggcgtaggccttgacgttgctcccgccgccgaccatctccagcagcagcatcccgtagctgtacacgtcggacttggtcgagatgtcgccgaacccgcgggagaacacctccggcgcgatgaaccctatcgtccccctcgtgtccgccatcgacaggatgctctcctttgggttgcacagcttcgccatcccgaagtcggcgatcttgggccggaatccctcgtcgaggagcacgttgtgcggcttgatgtcgaagtggatgatccgcgtgttgcacccgtcgtgcaggtactccagcccccgcgccacgccgacggcgatctcctgcagcaccttccaccccagaacatccctgtcagggctcgccgtcgccttcgncttcttcgncttcgnncgcgncgncgncgacgtngagtagatgtacttgtccagcgagccattgggcatgtactcgtagacgagggctcgtttggagccctcgaggcagaaaccgagcaggaagacgatgttgacatggctcgtcccgccaatgctgaccacctcgttgaggaactcctcgccgttgggcttgaagtggtgaaggaacttgacggcgacggcgcggcggtcggcgagcgtaccgctgaacaccgtgccgtagccgccctcgccgagccgctggctgaaggacttcgttatcttcttcagctccgagtacctgaacctccggggagctagggatccgtaactctgcagcagcttctccacctttgcagtatccgttctgcttgcaccgtccatggcgttcagaaaactgaaacgattttgcatacgtcggcgacacttgtagacgatggcgatgcatgccaatagcaccaacccagtcgcacagatcgacagtgacactgaaagcgacgaagcaaacaattagtatagattagtaattactaccaagtggtaaatttatctagataattgatcatgacatcattattgaagaaacaattgatcatcatgacatatacgaagaataaaaacaagttgaattatattattttgttggattagttaagcaagaattgaagactgaagcggatgcatacctatcaggatgaccttgttcccggacttctttgcatctgaaagggaagaatcatttcattttagtcaacatatgtacaaaatatcgccagtctattccaaccaattgaaatacattgaacgagcattaatttatttccgagattaatcaaagaaacagttcctgatcaaagactaattgttccacacacagttgcgtcattgatttcctgatgactaattgaaactggttggaccaattaaggtgtctgaactattacttaggaacaattcagacaacagatatcatcgtaaatttgtacatatgtacgacgttgctttattcgaagtatttgtacagtggacagagaccaacatgtatctgacctaaccagctacaggagagtgcagcaacagccgccgcgagcagcaacatatctcgtttgattcagacatgatgaacaaaatgatcaaaataatcagatgaaatcaaacaaaatcgtctcttttcggacacaaaagttagttttagttgaccattttgctcctatcattgtgatttcaaagtcaaagtcgataagtaagcactaacaactaaccaaccacacgtgctggctgtatacgtattctacatgtaaacgttgctgagatcggagaacgtgaaattccggctacttgtagctaaagtatagcttcacagatcacactggggcttatgtggagtccattattggttctcggcaaaagattgtttcatacgatgagatcgtgacagccaccatatgttgattcagtaatttaattagtccaagcccgtgcaaaaagtcattccagttctattgtacttccactattgctagtcctatcaagagccttgtcctgaaagtacacttcacctaattaaaacatgcataaagagatcacctttttttcagttccagaatcacaatctacacttttttttcttattaaaaaagagcaattttacggtccttgagaaggtaccatgaggtaccactttttgtattgtaaatttagtacctcttggtacctagatactatgaggtgccaaattttacactaaattttcggtacctcatggtacctcttcaagaaccataaaattgctcatcagaaaaagggagcatcattaggaaattttaaagaattttggataacgtgaacggtcaccgattgacaaccattgttagattgttaccctccatataaatcacgttcaaaagtcaaaatagcttaatctacttacttccttttgtcagttctaaccaccctggtttttggcacgaccacgcaaatacgaactactactacatgttcgttgatcctaactactgcttgtgctgatcaatcaataaatagttaatttgaattttaatactctcaagtctctaactaatttaatttgagtaatagttatgtatttcccaataatcaaattcagggaaaaaaactgaacgaatttagcacaaagaacagatagatttacacttaccacatatccccgggcgcgatgagccgtcggagcagatgcaggcgaacgcctccgtgtcggcgtcgtagccacactggccgccgctggcattgcacgccatgcagtcgccggcgggcgccctccactccagcatgtagcctccccggagcagctgcgggtagtccgtcgggctcgcccccggcacgccgaccaccggaacggccgcgtagtcgcagcctccggcgaccactctggcggcggtgttgttgtagctcgtgtcgagccggaccacggccttcgctcccgggcacgtgacgttgacgaaccctgccggcggcggcctgctgctgctggtgcagttgaagaggaagacgagctggctgttggccgggctggcggtgaacggcgcgagggtgaggctggcggagacgtcgatcttgggcaccgggcagccgctggcgtcggtctggacgttgtcgttggcgacgacgacggtgcggttggcgtacgacacgccgaggatcttgtacccgctgcggaaggagcgggccagcgacgcgcggctgccgttgtcgcagttcacctggaacgccgcggggccgcacggcgcggacgacgacgacggcggcggcgatgagtccggcagccagaacgggtaggcgatggtcacgttcccgcacctcctcggcgcgcagctcgtgacggccgcctccgccgcgtgccgcggcgcgagcagacatgccgccaggaagggaagcagcagcagcaatggcgtgtccatcgcgacgacggttggtggcgcgatgcggcgaggaagaggcgttgtattataggcgaagcgatcgatggatggatcgaggagacgaggaattttacatgtgtgtagttgacttggtttcgtgcaccacttgcgtcatttgcttggtcactttcttggaccattctctcttcttctggagtagtacggagtatgaaacgaaacgaagatcggtaaggagagttcgttggggttggcagttgccactgctcatattaatctgcatgcgagttaaagttaaaccgcgattggtgcatattatagtacgtgctgattacgtcagcacgcagtgtttggtgagtgtgcaccttcgttgataccagcgtacggaacttcaaaatatttcaaatgcaagttggataaagaaaagcgcagaggaatgcaggtacttgtctcactgggccgttagctgaagagggccagaataggctttacagcccaaactatgggcctaaattctgacccatcacatagtacgggccagaattttgtgatgcgtccgtgcagcccttgttcggttgttcccttctccccggcgccgccgcggcgtcgccgtcggcggcggtgcaaccgtgcaggattgcggccgctgccgtctcgcttcgtgagccgcagcagtaaacgccagctgctcggccgtaggcattgagggagtcgccgaacaacgctagtgttctcctccgctgcgttggtggcggtggtgactggttagggcggcggattggggatggattacaaacacaagcaacggggagccggggagatgggcatcctgtcctgtactttctgcgttgggcgaggcatagatcgagcagatgaactcatcaaaagttcgaaggctgagtagaggtgcccgctgcttcttcgtttcttcagaggaaccgtggaggaatccagtaagtaacttgctctttgctcttttgcgtactacttttccgtgaaaattttggcactatgatgatgctagtttttgagcccatagatcaaactagggaagtgggaaaatgtgataattattggcacggaatcgtaaatcgtagcttctggtagatcaaattgttgaattaaattatgaaacaagttagggggatggacagaattcagaaatatcttcgattcagctaccttaaacacactagtcaatgccatgacccatgaatgtgtgatgatactatgccaaaatttgactgcagatcatctttttgcatagttggtagtcactgtaggatcctttgaattaacgaggcttgtctcctcaacccttagcacttcacttagagcttgtgcagctttggtatttatagtagaactcgtactttctgtgttaatctcctgagctggatgttctctgaaaaacagaaatagcatagatgaaattcactgaaaatattaccagtccaaatcataatgtgtagagaaagtatcttacagtaattcactgaaattttgttttggtggcatttccagttcatccaaacttctctcgaacatatctaaaacctgggttattgtcggccgatgcataggcaatacttgtacacaccacaaaccaattaaagtcatctttttggctatttgctcaacctcacttgtgacttcacaagcttgtaatccatcatccagagcaaagtggtcataaatccaatctggaaaatacttttcacttgaattttcaaccattgacttagcattcttccggcctccgaccatctctagcaacatcattccgtaactataaacatctgactttgttgaaacaattccaaaggatcgatagatcacttcaggagcgataaatccaattgttcctctagcacctgtcattgaaagcttgctctccttggtgcggcacagtttggctaaaccaaaatcagcaatctttgggcaaaaatcctggtctagaaggatattctgaggctttatatcgaaatggatgattcgtgtgttacaactatggtgcaagtattctagcccacgagcaatcccgattgcgattccgtaaagtttttcccaccctagaatttctttgggattttctgaatagatataatcgtctagtgaaccattgggcatgtactcgtaaagaagagctcgttttgacccctccaaacaaaacccaaataagctaacaatattaatatgagaggtcctgccaatgctcataacctcattcacaaattcctctccatttccttttgagtcatgtaagaatttcaccgcaaccagacgaccatcttgtaaccttcctttgaatacaacaccataacctccttctccaagcttataattaagaaatgatgttatctttgttacttctgaatacttgtatcttgttggagctattgatccataagatattatgagggcctcaatgttcctttcactggtgctgctagtctttgtgtaaaggaaataccgtagttgtttccccttcccatgccatattagcacatatatacatggcaagagcaagcctgcagctgctgctgtcaaaactgagattaaaacacatgttatttccttttacaaaatcataatggtatactacgaccatttattttgcgatatcattggcttttcctattaaggatattatttccttaagtttttattttgttattatggtttatgattcaatggtattgtggtaaatgtttttgacatacctattaatatggttctcctgccagttttcttgctgcctgaaacaacagattttatcagcaaaagtaatgtcaagagtagaatatttgatgttgtctcaaaacaaatgaagcatcacgtttgaagttcaatattctttagatgatgcctgatttgttgattgtgttggctggagaataatcacagttacggttagctagaataccaagtattttttttccttcaaatctatatgataaagatagttaattagaagaaaggtatgtgccatgatcccagccgtagaagtaaaagaacggctcagattcggccaaatccactcggtggagttggccccagcttcaggggatctgaacccttctggccagatgattcttgtaatttcgtatctcaccttgttggtactgactctatagctgagtaatatacctctcttttcccacaaaaaaaaagtagtatattagtatattttcctcagcaacagtggggtgcgtttccttggtgttgattgccacttcaagatttctggcctaatttgccggctggcatctgtaaaatattgacttatgtgtagatttgcgcgatttctggctacggagaaggacaaacttctatgactgggtcgtctacgtgactacgttcaaagtcctctcgcactttgcagtcgtctctatgtagattatagcatatattgaccgggacgtgatatgtttctctagaaaaattctatagcaaaattgttttaaaatcgtattaatttattttttaaacttaaaataattcatattgaattaactatacgctaatagcatatcgttttatgtattttctcaatctttttttctctcatctcaaacatactcgattgagagactttaaacacatgtgtatttgaaatgggaggaaaagagaagattgagaaaatattatgccattagcatatatatgagtaaatttatagtcattgataagttaccgggaggtatcgtattttctattgtaaaatttggtatctctatgtacctgtagtactagaagatatcaattaggagataccaaaaattgcgctaaaattattattcgtactacgaattaggaggtagaagtatcaaaattaggagacactgtaaaattactcctctcaatatcatacttgggtactacgaattactccattcgtcccaaaaaaaaaaacctaatcttatgtgtccaggttcaaactcaggattgcgtttttttttgggacggagggagtaagccatatggacgaacgtgtaacaatgtttaaagatcattttatgttttcgaaagtagtggaaactggaataggagctcaccggcgcatatcgtccctcgcagctctccgtcggagcagaggcacgcgaacgccgccgcggaatcgttgttgtaccggcactgcccgccgctcgcgttacaggcgtcgcagtcgccgaacccattcttctgccactccaacacgaaccccttcttgaagagcgggctgtagttggtccccgccgtcaagttcaccggcgactccggccacagcaccggcaggtacgagtacgtgcagttcccggctttgatcgccggtggcttgtcacggtcgtagctcccgccgaggtacgcgtagataggcttactgcagttggagatggtggcgttcacaaggccgtcgatctccggtggctccgtgccgttgcagctgtagaggaagcagatggcccggttgctgctgctaatcgtgaacgggctgagagctagactggacgatatgttgaagtcggtgcggcacacgccgtcgccgccgtcggcgacccttttgtgtccagcaacgaatgaactgttggtgtagtcgatgccgaggacgaggatttgcgagcccctcaacgacgccacgccatcgcggctacaccacaactcgaaggacgggtggccacaggcggcaatggccaacgacgaccggttgaggtcgggaccgcttagccagaatgggtacttgatggtgaggtcgccgcatgttgccggctcgcagacggcgtgtgcgtggtggcacaggaggagcaacgtagccaagagcgggaagaacagcaacttcgggttcatctagccactcaaatggtggagctagcagctgcctgcaggctactacacatggaggagtggagaaaagcagaaaactggaaggggaggaaaaggtctagcttgagaaataacattgccattgccttgttttgcttgacctttttccgatcagttagacgtcattttaatcaacacaagtggaaaagtcgccgtcgcctcttttttttttttttttttgagggaacaccggtggggactccacacctgaattaaattaaataaaaccacaatccaaactgtacaagtacaagaacagcaagaggagatacagagttacagcagttggaggggggaggagaggatcgaaagccagataggcagaacaaagtggtcacatgggttgaaacgattaacccagagcctagcatcctgaatgcagttgtggaaaagtcaccatcgcctcttaacttctgaggaggggggaaatgacaatttcaatcttctaagggcattaatagtgcgccacccattttactcagcttggggctaccacataggatgaagacacaagaagaataatacttgccacaagtctcacagtgctatgtagtctcaaagagtagccacacaaataaaaaaaatcgtttctctctcccttatcctcagtccgctcccaaccatctccgcccacgcgcctcgccccttctcctctcgccgcgcctcccctttctcctccggcgcggcggcggcgtcgagccacccaactgcggcgtggagcggcgcggcggacgacggcggtggcgtggagcggcgcggcggacgggtggcagcacgaacggcccgagcggtgacgtcgatgctggtcagcagggcggctcgagcgcctcccctccttcttctcttccggccaccctagatcgaggggcggctcggccgacggcggggctgttcgagcgcttctccatctccgcccgcgcgccttccctttctcctccggcgcggcggcggtgccgcgccaccgagttgtggcgtcgagcggcggcagcggcggcggggtggtcgagcggcggcctgagctacgcggcaccgggcggcggtctaggagcccctggtggcacggcggcgcggcgcagatcgagccgccgcccaccacaaccactccctccatccccgctccggccacctccctgggctccctcccctccccgtcccctccggcggcgctgggcacgggcgtcaccctctcctctccccggcggacgacgatggcggcgccgtcgagctcgccagatccgccctcggacagtgacggcaccgagctcgccagatccgtcctcggtcggcagcgacgacgacgatggtagtggtccatctttccttcctcccttctctctggcgagctcgggtggtggcctcgccggcgacgaccgccgcccccttgcacggggccatgccctctccggcgatgctctcctctccccggcggcatcgggcggtggaagcgaggcagggttgggggcggcaggacgacgcggcccacgagtgtgggccccacctgcgaaacaaaggaggaatggagagccaaagttggcttcgcggtcttgggcaagccacgcggattgccgacgtggggacgaatattcggtttctaggggtgaggctgaatgccacatgggagcattgtgaatggcctaatcgcgatgcctgattaatttatggtacatgccgtaatcagttactagcaaactattttcttctctagtgtagtctgtaggccgatagaaccgccctcaaccaatcatctcttattataacccactaaattctaaatcttaacaggtaaaatgtcacatcattatccattaacaattattatttaagcatcatacaaacatgctatattatctataattttataatttattaaattttagagatataaaatacaagcatgttaaatcatcccacataattcacataatatttcagtatatatctccatcattttttaatgtttatattgtttaaggtatcttacacattatttttttgacttattatcatcatagtaaactcccacagcaatgcgcagggtttcacctagtcaatatggaaattgttggcgcctccgaaagtgcaagttattctcatgactcgtcattcaaaatacagtgtggacgacggacagattggaacgaagagggtggcaaaatcagaaggtttgcccgttatgctatatggccgacgagtatgcggatcatctactggcgaaatatagggccacactgacatacaattggataagtgggatgaccgttactcagtcaaacactggtggaacctagtgcttgagtcccctaataaccccgtctaccatttcgaactccggtgatcctagtatcttgggaagtatggtgcaagcgtaatgcaacaatcttccgccacaaagcctcaacgccggcctcaatcctagccaagagattaaggaggaagctggagcataggcgaaagtagaagcaactagactctaagagtttggaattttaggagatatcatctaaggtttctttttctgggtctatcattctttacaagctctgtatatatctttgtatatttttctcctactctatattgataggaggcaaagcttttgccactattggagaaaccatctttgctgggttggccaaaaactacaatggccccggtttgaatagaaaccgggactaaagatgattttttgtcccggttttaaactttataggccctagatgatctttagtctcggttcattttttgtccgaggctatacagtatataatccctatgacttatcctcccaaactcctcatcttcatattccttcttatcctcccaaactcctctctcttatccttatcctctttctcagagtgagcgagcgaggtcggcggagctgggagggtaggcggccggccgggggtgggggcggcgagatggaggccggccggcggcggctcggcgcggggcggcgggatgggagaccggccggcaacggccagatgtgggacggtgggatagaggccggccgtcggcaaccgggcgtggggcctcgcccggcctaaggggaggcgacgggatgggtggccggccggcggcgggatgggaggccggcccggtttgatttgtttgagtttctcttgattttttgatgatttgtggatgttgttgatttgtgaatatatatgtgaatgtgtttgtgaatgtttatgtgaataaatttgtgatgatgtgttgtgaatgaatttgtgatgttgtgaatgaacttgtcatgatctgtgtgaatgaatttgtgatgttgtggatgaatttgtgatatgtgttgtgaatcaatatgaaaggaggaaaaaaaacggaggaaaaaaaaatagttccggttggtatcaatcgggactaaggatgcatctttactccgggtattttaaccggaactgatagcgatctttagttccagattcgtagtccagatttgctactcgggactatagagggttgcaaaccgggacttaaaaaaaggtttgtgcagcagtgtgccctcctttcaatttttttgtctcctccaggctaagcgaaaagtcggtgatggttctgagcaggagcgcgtggtagatggaattatcttggcaccgacttgcaaattttcatagaaaacaaataagtacagattaactttggtataaccagctttacacacacagttcagatattagccatctctcggcaaatcatcacaactgtttcaggccttccaactgctcttaaaccgattaaacttcaattttttttaatgactcacacaagacagtgcaaagttcatattgatagagcagaaaaaaaaattcaagattacaaccctagaagaccgtaaccaggaaaagaaaaaagtataccgtctcccacacaccgacagcaccaaacacaaacccaggaaaaaaccagcaccggactggccgccgctaagcgtgatcaatcgccgcaaggccaacaaaggagctacaaaagggatcgcccaaaacccaatccttacaaccgacacaaaacctcactctatccacatctcagggattcagggagagagggtgagagagaagaatggaaccgctctccccgtaggccctccgatgtgaccaacttgtacaaactaggacgtcgataaaagaggaagagactctagaacgagcttgcaacaattgtttgggtggtttcggcaagggcgttgcctagacgacgtctccagggagagaaacgacgaaagtaccgccgccgccgaccgtcgaggttagaagaatcttgactgggctttcgcccgacaaccccactagaggaggtgagacggcacgacaacgcccttaggagggtagtgacgctcgagcgccatcgttgccggcctggctgggtttgcacccaccatccacacctacctatccaccgttgacgccccgatgctccaccgccatcaaatcctctgccggcgcgcacgcatcactgcatcgacgcccctcgccggccagtcgccgcatgccgccatcagcagcacccgctgccatcaacctgccgggacgcgccggcctccctctccctgccgccgggcgtgccggcctcttgcgggacgtgacgacctccctgtcatctcccacaacgccctcctcctccgccagccgctcccgcgcctactcccacgtggttgccgcgcctggcaccacacgcacagctcctgcacctaccaccgcagcacgcatcctcctgtcgtgggctgtcgtgactgccagtcgcccacggtccacgatcgccggtcgtcgtcgtcctcctcctcccgtccacggtcgccgtccggcccgtcgcccgtgcatgccgaagccgtggacaccacctccagctactatcggcgccggcctccctcagtcgcgccaaacgacgacgcatccggcccgtcgcccgccactgctcgcgccgtctcccgctacagcctcccgtcgcccttcgtcgcgtcagctgtgtgcccccgactgaatccgtcgaggcggcgctagatccggtcgtggggacgccggatccggtcgcggcggcaccagatttgcatctccaagccggagactcgccggcgccgccgccgtcttcacggagctcctccttctcacgcaagaggcggagcgtcgctggggcttagccccgctgccaccatcacgactcgccgcccggctttccgggcgacgtgctccggcggcggtgaggcaaaggagagggggaagaggggcggcgtcggatggctagggtttcgccccgagccgcccacgtgaggacaacgcggagctctaatgtgctcccttaaacttcaatttgaaacagatgagcaacgctaaagacctttgctgcaaaatactgtatttgcacctaagatattctgttatttgagtttgaacacgcaaaggaattgccacgggatgaagtcattcaaaccagagaaggggaggaaagattagcaggtgggttaaatattgatcattccttttccttgattttgacttttacatggagtaaaaaggcaatgtcggtaaatgattctgattaacggatatcggttgcgatcaatggtccagcctggtggagtcacctactcacctctcaccattctgtcatcttgtgtttctggttcttctgccctacaagtatcaagcgatcttaccactaaaaactactagaggaatattatctgaatccatcactaacacgtccattatttttaagttccttttgaacgcagtataatgaatttgtatgtagttgatggacccttttagagatgacacttggtattgtgtgagtactatcggcactcaccagttgacaatgctggttaaactgattcgcgaataccgatcggtatgttttatctacggttcagcccaaatgagtacgaaatggtcaaactgatagtatattcatttcggctgcttatgcgcggtaaaagaaatacagaggtttcaacgagtcgcgggacaaattactcaccgcatgtcgccggctgcaggcggccaccggggcagaagcacccgaacgccatggcgccggcgtcgtagcgtcactccccgccgctgccgttgcacgccgcgcagtcgcccggcacccccggccactcgagcagaaacccgcgcctcacgaaccccgcgtagtctcccgccgatctcagctccgaccatggcagcacgggcaccaccgagtacaggcaacccaccgtgtccaccgcccgcttggggccaccgggatcatacatccggttcagggacatgaaccactcgccgccgccgctgaaaccggtgcagttcaccggaagcgaccccgtcggcggcgtccgcgagcagttcgcggagaagaggagctccgagttggcgcggctgacggcgagcagcgagagcacgaggatgctggacatgttgaaccgggtggcggcgcatgctgagctgtcgaccaggttggcatggaaggccattacggagctgttgccgtagtggatggcgaggacgcggaggtaggagccgttcaggctgggcggcgtcgcggtcgcgccggtggggtcgtcgtcgcaggtgacggcgaaggtagggtggccacagtatgcaggctgccggccgcgcagccagaacgggtacttgatggtcaggccgccgcatgccgccggcgcgcagctctcgccgaccaccggctgcgcgcgcgtcgcggtggcaagcaaagtgaagagcgctaccaccactagtagcatatcttaggaaaaaatttgaaaatatactttattttttttatattttgcgtttatatacctggctgtgattaatttgcaaaaatatacccaatccgcggaacggttgcgcgggagcgaggataaaccagccggtcccgctggccggggacgcggtaccgcgccggtcccgcgggctgggtgagcgctgcaacgctcccgcatgccggatgtgcgggaccggcgctcccacatgccgccagccatctcggttcccgaattggatccaatctcctatgcacggaaaacggagcaagccattagcacataattaattaagtattaggtaaattttttttcaaaaatggattaatatgatttttttaaacaacttttatatagaaactttttacaaaaagtacaccgtttaggagtttgaaaagcgtgcgcgcggatgagttggaaaaattaggggaagaatacatctccaacaacacgcggcctgttcggttccgcgcgttggaacctcgggacagcctcggtcccgcgccgctgttctgcggcaccgactcgctatcccgtgggctccatcgctcccgcgcaatggcgtcgcggtaccgactcggtcccgcagtccagtagtgcgggaccggctcggtcgcgcatcccggttccgcgtgaccggctcgggttccgctcccgcatcctcagtctgcggttcgtcctcgctcccgcgcatccgttccgcggattaggtatatttttgcaaattaatcacagccaggtatataaacgcaaaatatgaaaaaataaagtatattttcaattttgtttcgcatatcttattgctccgtagttcgtatgagattggagcaaataccaaaagcttgagtagactatatattttcatggagagtgtactgtgtacaaatacaatccggagggatagggcttctacgaccgtattttttcaatctacattagcgttgaccgacgaaaaatatagcatccgcagcagtaccagctggctgcgactgctgcgtcgccggaacgcctgaaagtctcaaatcgccaattcacgttgaattgtatgctttgctgccggcctgaccaaaccaccgatcgaacaacagggcctaatacgtgcattttcgattttgcctgttaatttccctccttttcttttattatctctactactataaattctccttacattctcttatcccaccacgcgcaacacatttgtatcttcagtgtgtaaccaccagatccaatatattattctctgtaatacttttagttcatctctaataatacggccttcatccgttacaatatactagcatattacactactggaaaaagcattttcgctggtgggggaaacgtgtcttcccatacagacggccggtcttttaaagaaagaggtagtagtagataccagcatacttgatttcttttttaaaggaaaaaaaaggccttgtttgtcacgtgatgagtgatgactacatccagcaagagattcggctcctaccagtgcattgaacttccattgcaatttgggccgttgatcaactaggccttttccgcgtcgttttcttttggaacaagttcacttcgtgaccttcaaaaagtgatcgaaatctaatccacggccctaaaccacaaaaccggatatctcgaccccctaacttttaaaatcagtgcaatttgactccctaggcggttttggagggcggtttcgctgacgtggcgcctatgtgacagtattgactcggtcttctttccatgtggcgttgacgtggcgcttacgtgacgttagaaataaaaaatgtgtgtgggaactatttgttattctcgcacaaaaatatattgtgggacccattgacatgtggggcccacatgtcatactctaactctttctcttcccttcacaagtgttctcttcccttcacaagcggtggcggtcgagggaggccggcacattagagcaggcggcggtggcggcagtggtcggtggggccagatcttcctcctccctttctccctccctcatctctttctcccctgtttctcttcacgggagctaggggtagattcacaatgggggcgggagggggggtcttgagactccagtaccgcccctaggacagtggagacccccctaaggccccactaattttttttccatagatccataggatgtggggactggaggttcgatttatgctgatgtactttattcagtccccactactattttttttctagatccgcccctgacgggagcagcagcgacagacgggggtcgggtttggcggcggcggcaaatgagggccggagcggcggcgatggcagccgcgacagcagcgtggcggcggacgttgcccgccgtcgccgccttccttccgccgccgcgcccgccgtcgccgtcgtgctctacacggcctggttgtggcggtggtgatggagcccctcatcaccgtcgcctgccgcgccgcccatcttcgcctccgtcgctccggctccccgcacgaacatggcaccgcccttgagctcgagaaaggcataggagcccttcccctgcgtaggccggcaccgggtagtggggcgaggacgtcctcgaggggaacggcggcggggggaaactggcggcgtgtcactgcggcgcgcgagaggggaaggatgagtggttctagctgtggctgaacgacgcggtggcgagcgaccccgaccaagccccctgcctcgccgagcagatgagcctcgtctactaccccgtcgcgacgactagcgcaacgccgacggtgtcatcaccagggtcccctcctgcgcctccacctgcccttgcttgcccgccctcttgccgccgccggctcccgcgtgtcgctgccgccgccactggcccccgtcagccgtcacacagccgccgctcgccgaagggaagagaaagagagagggggaggatgaagagagcatgatttatgtggtccccacatgtcgggtggatcccacccacacttttggtggatgacaaatgggtcccacacatatttttttatttctaacgccaactaagcgccacgttaacgtcacgtggaaagaagactggtcaatactgccacgtaggagccatgtcagcgaaaccgccctccaaaaccatcgagggagtcaaattgctccagttttaagagttggggggggtttcaaaatatccggttttgtagtttagggccacggattaaattttgatcagttttgagggtcacaaagtgaacttattccttttcttttcggtctcttttgtcaaggcgtaaattctggcccactctatcttatgggcctcaatttctatgatggggtcgcaccctattttctggagatttggaccgagccgtgctgcctagtgcccttggtcaccacggcggcgcggcgtgtcgctaggattgcggctgctgcagtcctgccgtctcgcctcgtgagcggcagcagtaaacgccggccgcccgtaggaacggagggagtcggtgaacaaagccagcttccgccccaagccgcgatggtggcggtggttactggttactggttaggatggcggattggggatggtgtcgctgaagagaggtagtgagcgatagaggagatcttgatttggccagaagcttatcaagagttcgaagattgaagaggggctcccgctactttgtttcttcagagaatcagagaagaccttaaggtaaaagtaaataaattgctctttgattgtgcactattttccctggaaaagtttggtgctgtgagcctgtgacgatggtagttgtcgagctccaagatcaatcgaggaaaatgtgataattttggcacttagctctaaatcgtagccatggattgatcaaattgttgaattgcttatgaagcaattagggggggataaacggaattcagaaatatcttcgattcagctcccttaaagacactactacactaggcaatgccatgaatgtgtgatgatacaataccaaaatttgacttgtgtcttactttctgtatactgcagatcatcttgttgcatagttggtagtcactgtagggtcttttgaattcacgaggcttgtctcctcaacctttagcactccactaagcttgtgcagctttggtatttccagtagaactcttactttctgtattcagctcatgaactgaatggtctctgaaaaacagaaatagcatagatgaacttcactgaaaatattaccagtccacataaaaatgtgtagagaaagtgtcttacagtaattcactgaaattttgttttggtggcatttccagttcatccaaacctctctcgaacatatctaaaacctgggttattgttggtcgatgcataggtaatacttgtacacaccacaaaccaattaaagtcatctttttggcaatttgctcaacctcacttgtgacttgacaagcttgtaatccgtcatccagagcaaagtgatcataaatccaatctggaaaatacttttcacttgaattttcaaccatttgtttcgcatttttccggcctccgaccatctctagcagcatcattccataactgtaaacatctgactttgttgaaacaactccaaaggttcgatagataccttcaggagcgatgaatccaattgttcctctagcacctgtcattgaaagcttgctctccttggtacggcacagtttggctaaaccaaaatcagcaatctttgggcaaaaatcctggtctagaaggatgttttgaggctttatatcgaaatggatgattcgtgtgttacaactatggtgcaagtattctagcccacggccaaccctgattgcaattccgtaaagtttttcccaccctagaatttctttgggattttctgaataaatatagttgtccaaagaaccattgggcatgtactcataaacaagagctcgttttgagccctccaaacaaaacccaaataagctaacgatattaatatgagaggtcctgccaatgctcataacctcattcacaaactcctctccatttccttttgagtcatgcaagaatttcacagcaaccatacgaccatcttgtaaccttcctttgaatacgacaccataacctccttctccaagcttataattaagaaatgatgttatctttgttacctctgaatacttgtatcttgttggagctatggatccataagattctatgagggcctcaatgttcctttcactggtgctgctagtctttgtgcaaaggagatgccgtagttttttccccttcctatgccatatcagcacatatagacatggtaagagcaagcctgctgctgctgctgtcaaaactgagattaaaactcatgttatttccttttacaagatcataatggtatatcatggccatttaatttgcatgaacatcattagcttttcctattaatctaaaaaaagtgcaaggtgacaaaagctacaaacaaggtaaaagggcttctatattttatccaaatcaaccagtcatttataagattacacaaattaaggatatgtgtttgcgtaatattttaggttattatggcttctgattcaatggtaaatgtttttaacatacctattagtatgatcttcctgccagttttcttggttcctgcaataaccacgaacttaattaacaaaagtaatatagtagaacatttgatattgtcccaaaacaaatgaagtatcacgttggaagttcacattctttagatgatctatacatatcttcaagttagtgaactaatcctttgaacgataaatcctaggtttgatacaagggataattaacaattacgtaggtcatcttgtctggatgaacattctatgtggagaacaactcctctatttcattgcgttccttgtgaaacttaacatgatggacagaagtaataccctgttttgaaattcaactagctgggtggcccgcgcaattgcgcggctagcacccaaataaaatcatatattttttagcatgattttacttaaaatttattaaatagctatctcatgtcttaagagtttgaaagattaaaccttatcatccccgtgtttctaattatatatatttttttaatagtcacaccagttgctaccccttatgacatctccttctttatttgcttgttcgatctaccactatttctattcattctccttgaaacctttaaaaattgtatcttatagtttttagagtttattatcatgttgggtttcgtttttataattttcagacgtctcgtcaaacgttgccattatacttctctatggctcgtccactgtctcttttcttaattgtcattgagattttaaaaatcgaacataattatcgtttcggttcatttttgctttctagaaatcccgccaaaccgtcagcggctttgccattgtacttctctacggctcgcccgctgcgtcccttctttattgtcattgagattttaaaatcgaacatgattatcattgtttttttttactttttagaagttcggaacctttaaaaattgaaccttgtagtttttagagtttattgtctcgttgggtttcattttttataattttttagaagtctcgtcaaacgatgccactatgctcctctatggttcgtccgccgcctactctttctttattatcattgtgattctaaaaattgagcataactatcggtggaattcattttttattttctagaagtcacgtcaaacatcagcggctctgaaactatactactatacaccccgcccactgcttctcatttttattgccattgagatttaaaaattgaatatgattatcaatggggtttattttttattttttactttctagtagtcc

SEQ ID NO: 83221 - DNA, 36799 bp, Oryza sativa
ttgtcactatagttgcagttttctgaaatttgctcaccaaaaaaaatgcaatatgactagcaattttgagcaatattttgggtggatatgaagtaaagaagtagcattgatttacgtgccagtttcactgacagaagggattacctctagctgggtgaggatttcaatagtatggttgaagtcacatccattagcatagtacagctctgcaaggctctctgatgaaaaatcaggaaactgtgaagctaaatacgctagggggtcaagaacatcgtctgttgctgcagcataatcgctagcaaaactgtcagaaaagcctgcagcactttcagaatcataatgaaggccctgatttccattcgtaaaatggagatcccctacaaaattttgctcccaattgcttgaacccatagttggaaacgatgcttgtgaattatcttcataaagtaaactggtaagccccagttccaggctcttgttagcttgagaagataaatcatgctctcttgaaaagcggctagctgttgttccatagaaagggggtgcattcaaggataatccagcaagagacaattcttcaggttcttgttcaattttctcaaaactgaagtctggaataatgtcatcaggaagctgcttacgccaaaactggtgtgcctcatcatccgagttatttgactttgatgactcggacctatctaggatagttttcccagaagccctaagatctgccttacttacatctgagacagcgctactctcaaaagatggtctaatacatgaaggtacaaattctgctgcgttgggattcaatgctgtgactttatttggcaacattgaccttgtatctccattggaaacaactttattgagtgaagtcatttttaatagaaattacatgtgatgttacatgtacaaggggaaatttgcaataagattttatccaagccctgcaaagatatcaacaaggattagcatgaacatggctgagcacttgatgtaccacaatcacgtcaacctttaccaaaagattatatatgaacaaataggtgtaatttaacagaaaatataacttccataatattaataaactagtatttgtcaactcaaaaaaagaaactagtatttttgttaataagcaagacaatatgctaacctacaggtaaggctcactagagctagtaatctttgtcagactcaataaaattgatagtgttgtgggaaatttcatttcaaccctattataaaataccaaaaacaaataaaccaactacaagaacaacagctagttcttgctattagggcaataaatatttagaacaaaacaatttaattacttcatagtatgtccataaattaaagccagcaagccgctgcatcatacaaagattgaagataacacaataggatatataaggctggacaaatggacaaggattcagttatacaagttcttaaaaagtaaaaatctacaagccgtttactttccgttaggattcataaaatattttgtttgtttgttttcactgccagggagaaataccacaatcaatgcgactgatactgataatagaaatttccacattcacagaagacccaaaatcagtagctctgtcaaccaaaaaaagaagagaacttctaatgatttgctcccagtttccacaaaattggcgcgactcttcttagtaactcatatagctgccgtcgcaaaagaagcaagttttctgacacattatctcaatatctcctccataaattcatcaattaaataggctcaatatctcctccttccgtccttcgttctcacataccgacacgctgttctctcacccaaacgtatatagaaaccatcaaatcagtaagaaaggaaccataacaaaagaaacagaagcttattgctgtttttttggaaaggaaagagaagatatcctcaaaagtccacgcaactccatctctaacacagaaaagggaagattgtacaatcaaaagaggcaaaagagcaacggaaagacgagcaaacagtacccccttgcttttcctctccgtccagcacacgcacgctaaacaccccacgccctcctccccgtctccccggccggtggcgagatgcctcaatcaaaaaaaaatcacgccttttccgggttttccctaacccggacaatcaacggaacaaaaaaaaaaatcctaacgccgggcgagatctacacccccagatctacccggaacccggggggagccagcgccagatctggagaggagaaaaggccgggagggtgttaattaattacctttccgccggtcgatgagctgatagtgatatatcgctggcgaccggcccatggggcggcgtcccccccaacgccgacggtagatgagaaacggacgccgccgcccgcagggggattcgggtttcaccgcccaatcgcgcaacgggagtccggccccccgctccgggagaatcgggggcggaatagggttcgccttcttgggaggcggaggcggaggcggaggcgaggagaggggagggaggagggagaggttggtgcggatggggtgggggtggataggtgagggatggtggagtttgacccgtcggggcggggggtgggggtgggggcccaccgtggcgtggaggagaagcgggtgggtggtggtggcggcctcgggatcgggggcgccgctgcgaggctgaggtggcttggcttgggttggttggctggctggttgcgttgttgcgcggcgctgcggggtgcggggggaatatgcgggcgggtgatgcgagcgagcgtgccaggaaatctctcgaactatgggtggctccgtccctgactggctcagttggctcgcctgctccggctttgcttccggcgctggaccacaccagctgatgatgatagcttgggtgcgttcggcgatttttcgcgcacacactctcgcctgtcacatatcccatccttaaaatttttcaccgtgtcacattaaatatttaaatacctacataaaatattaaatatatgctaaaaaataactaattatacatattgcgactaattagcgagacaaatcttttaaacctaattattccataatttgacaatatgatgttacggtaaacatttgttgatgatggattaacgaggcttaataaattcatgtcgcggtttactgacggattctgtaattagttttttatcttatgtaacacgccaaaactttacacccctaatctaaaccctctctaaattattagatgacgtattttttatagaatagttattttaaaagattatattaatccaacttttaaattcctctaaaaaaaactattaaacttatttcaactaatatatcactccgttgtgcttgtagggaggtggagtttctaaagctgtgtttggcagcctgtgttggaaataaatctcctgaacacagaaaacagagtggtccattagcgaatgattaattaagtattagctattttttaaaaaaatggatcaatatgtttttttagcaactttcgtatagaaacttttaaaaaaaacacatcgtttagttgtttgaaaaacgtgtgcacggaacacgagtgagaggaattgggaacaaatgctgccgaatatagcttaagatcatcccaacccaaaaactatattagttttcatacttgtcatgttgtcatggttacagataaggcatacctcctatcctaccacttatagaatatacggatacggcatacattcgtatgtacgatatatttccgtatacattaagaaaattaacaatagatcatggaaattagcctcatgggcaagtgaacaacagagtcctacttggaaaggattaggtttatactatatcgtgcgggggcctataatctctgatttttacttggagactaaggtgattcacggtttaggggatcgaatcataacaccaacacaaccaccatagcctacaatccgaaggacgtgaagcctactcgccaggagatctcgtcgaaaccatctcgatagggatctcgccggtaatctcagaatcattggttctggttctctattgcaatatgtggtctttccatatcaatctcatataaactggattagggctattaccttacgagggacttgaaccagtataattcttgtattcttgtttgcttgatgtcgtaccaacataccccaataccctgttcatccgatctatggatatcccctgtcgacacatgtcgtatatacactatgtatagaaactacttcatccgtcctaaaaaagtgcagctgtgcgtttccgcatccaacgtttgaccgtctttcttatttgaaaaagaattatgattaatatttttgttctcattacacaatagaacatgaatagtactttgagtgtgactaattttatttatttatttcataatttttaaataagacaaacgagcaaactatggacacgaaaaaccacaattgcacttatattgggatggaggtagtatatatctaatagaaatcatctatcttctctatccttttatctacatatcttgttttcattctagtttttatatggggatgatttcttgcatgagaaatgatttatttatctttttatctctcttctcattaactcttttaccacatcagatttttccatatgtgacaatatatttaatgctatggacactgaatgataaggagagttggggatggcctaacctctaccttcgaatgaagcctaagctagcttggttctatttgctacttcggccttgtttagattctaacttttttcttcaaaatttcaactttttcgtcacatcgaactttcctacacacacaaactttcaacttttccgttacatcgttccaattttttcaaacttttaattttaacgtggaactaaagccttcctgttcttttattcttgattaagatatagattttatctcaatttttgttgctaggctttttaatttgttaaacggtgaaagagtgtgtttcgtgtgaaaggcttttcacaatttgaacgggccactagctactacggcatttaaaagaaacagcaaaaaagtattagtactgtttttatgctagttagataatctgatgacttgccccttcgcaattgggagtacggaaaatgtcatcctggagttggagtgtggattgaaaaggtaaacaaacaagaggtcgccagatcaaataaagttgttaaatatggggaagaatattggatgcctacaccaataatttcacctcccttatctgaacttgtccaacaaccaatctatctttatcctttattagacattgtacactcaactattgtgtccctggcctttttttttctcaataattaacctatgtttgtttacatgaataaatgtaaagtttgttacacacaagtgatttgcttacttattacacacaactctattttttctcgcggttgtatatacttgtatgcaacatttggggttaatgctaatcatattaataaggatgttcgctggcaataacaacatatggctatatagcaagccagcaggaaggcagcagccaaccatgaatcacataatcacacttcagatgggttgcaattgaagtttcaaacggctgggcttgatttgtaactccagcccaaaatattgcagctaccggtactgaatggcctcatttacgatcgagttctttgtactcaaacggcaagaagaatgatcgtaagattttcttacggtatcattagttgacccgtctgagaaggcattttttagttggagaatctaattggcgcaacatttgcgactttttttagtacaattataatagtaattgaatttgcacgagattagtcgtgttttgtttacaaaacggcaggagctctgcctaatttaatttaaggaaggggtgaaagatacaaggttcgaacgtacagcaaagggaaaaaaagagaggcaaaaacgactagagattacaagagcagagccactaaagaagctctaaatatcgtcgtagttttcctgaaaagaaatatcgtcatagtaagtagccaacgcgagcaagccaagattatgtgaaaccaggaaaagaaatatgagtctcatcctgattattttgctggaaatcctcctattacgctccagcaagatgttccaccacgccgtcatcaaagtcattgcaatcacttatcttatactccctccatctacttttgatagtcatatttcatcttaacacacagaccaatgataagtgattctacttatcatccatttaaacatgctactagtcattcctcgtaaacaaacgattcattaacatttacatttctcgatgtccatgcaaccaatcttgtgtggaagaatggagagtcatgcattaaatctgagaaaatcattaagatgatagattattggattgaaatatacctatcaaaaatagatttttcagatttggaaatatgactatcaaaagtagatggatggagtaatgaacaacaaattaagttacccacacaatgagttcatttcagaggaattatagcacaagcgaagagagtacataaacatggatttttgaatagctaacattacaaaccccatgtacaaacatggtacaacgaaacttacagctctaatacaatgttttcaactactactaatttacaaggtggccacaattaatatccaattgaacggtgtccaaaacaactggacacagttacaaattgcaatgctacacacacaacttcatgctcgatcacacggagcttaatcatgctcctctctcgagcaatcatcaatcagatcacatattattattattctttgagagccaatctacacatgctcccaagtttattcttaatttattattaattgattcaataataaactcgccattgacgagctcaacatcccaatcattgtggcaagcttcgccgccggccgggaaagcaagcaatgaatcagtcgtcgtctccgccgccggggcatccggaccccgcggcgaccttcctcccctgcggcggcggcggtggcgcggccggggacgccggtggcgagtcgaggcagcggcggagcagcctcgagacggcggcgacgaggtcgtcctccgccgcggcgccccccgcgcgcggcgcggcggagcgcgcgaacgcaacgtgccggtcgagcgcctccgccgtggtgatggtggccttcccggcgccggcgcggcggatctcgtcgcccacggcctccgcgcagaggccgcacacccaccgccccatgtactcctcccgcaccgccgcgatgtaccgcggcgtgcactcctccgtgaagccgcagcactcgcacctggctgcctccacctccatgtcgacgacgacgacgacggctactcctctctccttaccgctccttctcccagacggcgtaggcggggacggtggcggcgctcggcgccgtgtggcgctctccctcctcgctccggacggtggctacggctgcggctgcggcggcgatgacggtgtcggcggcgggtgaggccggtgtcatcgcaggcgacgtctcgctctctcctcttctcttgcaccgccgctaatctttcactgcttcctctccaccgaaacgtgtggtctccatgtggtatttatccgcaaaacggcgtggagcgggtggggcccaccacgaaacggtcggggttcctcccccttagacgcggacacgtggggccatcccttggagggcccacatgtcagtgagtacgagtggtgtatgtggcggtgagagttggagagtggaagagggacggggacgcgaaagggaggcccacgtcagggggctgatgagctggaagggtccccaccctttttaatgtgtggaccttgacagctggcgacggcaccgaggaagagaggaggggagggagtggcggccgccgcgccaccaccacttgactagtcgactactctttctctgagctcctgctaggtggaattggtgcaagttcggataccgtgtcgttgtcgttgggccctctcgtcattttcgtgtgcgctatttatcgtttttttttgtttcaattgataaaaatgatttgtcgcgattgctctttttttttatgtagatgcctacaaccataagattcataatgaaacgcatctcaaccaaacaaggaaaaaggttttgtgcccactctagaaaattgaatgacataggagtatcaaagcaacctacattattatcttgccaccaaacataagctatcgtccggttctataccttaattgttttacaaagttaatctcaactacccataaagatcacaccaaatacaatgaggttattcggtaattttgttatgtagctgttcaggctacacgggatagcgcagccactcggctactcggctacaggtctagactacatcctagccattcatctgttgtagctactgatttatccgctgagctactgttgtctgtcgcaggctcgcagcaggcagcgctgcagtagctaactctttcgaacagatttaatatgaaagttcaatctatatataaagattgaactacatttggactacatatataaaggcaaaaaaaagataaataaaaaaacgagtcccatctctatacattacatgcattaatccttcccgcttaccatagaaacaaagtggcctaggtcatgtgctgcacggtgcttatcattgatgcagaaaacctgtgagcaaatgtacatgaaacatggcacgtactcaccgaaagaacagaaaagaatcgcatatccatgggaaaagaaatggagagcatcctgtgataaagccatgatgcattaagacgacgtacattgataggatcctgtgaagaaagagagagaaaagacgatcgtcacatactggtgttcgagtggtgacccaaaaaaaaaaaaaaacaaccaccagatgatcagtccgtgcatgcagggacgccccggacagtccagccatgtgacacggacagattggtcatgattcatcctactacacgttagtacgtactcatccgtaaaaaaaaaactcaaatttgttatactacatgacatatttctagattcatttttttttactgagggagcaggaataccagtactaaccagggttaatattaccatcggtaaacgcgcggttaccgggcttaccgcggggtacgataatataaataccacggtaacctccttaaattcaaataatttttaaaaataatttgaattttttgataaattttgcacggtttttcacggtaaccgtccttaccgccggggccggggttaccacgccccggcggtttggaaaaccctggtactaaccatgtgattgagcaatgcacgtacattgcgcgtgcgcatatatatatatatatatatatatatatatatatatatatatatatatatatatatatatatatatatatatacagagagagagagagagaacgaacaaacaaaacatacacgaaatatattcaatgatagaccagatcatatacggtaattcaggtgaggtgatatcgtagtttcgtataagcttgtggtgagactctgacgtttgttctcatttttgcaaggaatttcgaggaatggatatataaatggacttacggaaatgaatcccgaggtatactaatcaaaactacgtgattttgtaagagtattatatatatatatatatatatatatgagtttatgagatattactattttaaaactgcttttagctttataaaagttaatttatttatggagtatttatattctcgaataattattacaaatattttattcttgtttttttcctttttaggctacaatagtgagctcttaagaggcaacatgatctgttcttgttatctttttattttctttaaggctatgtgcatcttgatgcagagatcggtcgtaattttactgtttaatgaaatataaccattctctatagaaatttatatatttaaccatcacgtagaaaaggaaccaatacagtcaattcgtacagctatgtgtatactctctctgtcgaaaaaaaacttaacctaggagtagggctgtcaatgagccgagctcgagcgagtttggctatgtaggcttgagcttgacatgaactcaagccgagcctggatattgatcgagcttgggagtgagctcgagttcgagctccagcaaacttcgagcctactcgagcttgacagcttgacttggtgaaactccaaagaacttactcttgtataagagatattaatgcaaattatcagtagtaaaaaataatgggtgctacttgtctttaatgaagcctctgcagcttttctcatgaattcatggctttgaaacgttgcaattaacaaaagctagctgctacatctaataggaatagtagtactattattagcaaccggataattgctttattgagaagcattaatgagatcttgaaacttgagcaggtcatgcacgatgacaaatatacattgacccatcaaaaatatattcatacatgcaatgcatcttacgctaatcaaaccctgtcgagctattcgagctcgagcttgctaggcttgcgagtctcagtctaggcttgagcttggtttgtttagtattcgagccgagctcgaatcaagctcgagcagcttgcgagctccgagcttttttaacagccctacctagaagcgaggggatgtaccatctcctagtacaacaaatctcgataaaggatagtccagatatattgtagtagaaggtgtcaggttgagttttttataggatggagaaagtatgcgtgttcaatggaattaacaataggccatccagagttctctagatgtatggaccaaatgtggggcgtacatccatgtgtactcttgcacgtacttcacaaaatccttaaaaaaatgtttttttgcaaccgcgcggacgcgtcgaatcgactgagcgatcgatccaccgcaccgtaggagcggcgcgtttcgctgtacgtttggaaggtatcgcgtgcaagaggacacagagcgggcggggtcacatactcacatgacgatgacgagatcgatcgacgatccggctgggatccgatcgatcgatcgcctcatcgccggttgacgtatgctaaaagttggtggagatcgaccaagtgatccacctacatcggaacgtacctgtacgttaatttttacctggctaagcaaatgcatgcatgaatgtaccgtgggatagcgtcattgtgtccgtgcacaagcttaggacatgtacagcggtttatattagtggtatctttattgccatgcaattaaatttgatgacatggaagaaaaagaaaggagcatggttgttatgcatgataatgctcagagtcgactcttagcatttattagagcaaattttgttgcatggtgatgaaagaaaggaaagaagagtaagaaaaaaatattttgatacattatgattaaagaccatattgtctctaactattgtagggtgctagtctctagataatatagagctcatatctgactttaactttgtacatgtccttagctatatatattccgattcttactaaggttaaattgattttatgtaaaaagaatccctaaaaagattatgtgaaattctcgccttagaaaagataatatagcaaatgaaccaaaacgtttgtactgtaaatagaaacatatatataccctggttcatgtcggatcaataaaagcataaaaggagtaacaaaacacaagcaacgctaaaaaaactctaaaagataaaacttgtacgatagacgattaaataaaaagcggtccattaatcattaagaatggagtcttaccttcatgaacgaatgataattgtaacccgtatcatattatcgaactttcgatttcaaactcagtaattaagacgtgaaaatgctagtcgtcagtattaagcgataccgatggtatgtttatgatggattttctttctccaatttgaaatactgatggtttatgatagtgggtttcccatagaaaatactccgtatttaggatcatcactctgctttgcccttgctcgaacattcgttatgtctatctgggacactaccgactaccgtgcattccaacttgcaaattaaggaccgtgagaggtcgtaagaaccgagaacgacgtgacgacgataagcaaatgcgatctgccttttcaaaatcgtgatctccgaatcggcccaccatagattatacagtaattaaccgtgacccgtcgtgacatgacctgtgtagtgatcgatcaaacggaaagcaattgctactggtacagtggtactaatcaagtactgatagctacagtatctatacagtagactagcatagtacgccgagtacaggagaccagggtacctcatgcacgactagcctgtccttataagagcaggtacaatagcaggctataaatcagctacaaacagatttgtagctaattatagcacggacttcaagacacagcgtgtgtatgacaagtaggaccaggtattaatagtatagtatgcaactattgtatgaataaattattagattggctatagataaattggagctagtagttagctatactattaaacttgctctaagagcacccgcaatggttatctatatgctctctacaagagatccatgtcatcatattttcctacttggaagagattaaatgaagagagagagtaaaactatctactaacttagagatagtctatagagaaaaacgaggcaatggatgagagacctatagatacccatgtagacatactattgaggtgatttactattaatctaatctattgctgagatgtacatattttatagagagcaccttactttaccattgcgggtgctctaatgcggttgctatcgacttcgttttaactacaggcaggctctgcctgctccccgttgttatctgtatatatcgccacggattaattgcttgatgtctagtacatgatgcggtgcagcattgcgatcgatcacatgcatgactgacggtaggggacaagccaacacacctagtatactccatccacttcataaaaaatcaacttctaagctatgtctatatatatataatcagaaattcatttttatgagacggaggggagggagtagctcggcctgatgttaaatccgttcatactgtgcttttcgttgagtgtaggcacctgatatagagttgaaaaccatatttttagattatcatagattatgcgtggattaccatggctgaaccgtacactttacatcataagaaattaaaataaagtttaaaccatatttttagattatcgtggatagattatgcatggattaccatcattgaaccgtacactttacaacctaagaaattaaaataaagttattctcattataaatatttaggttatattatttgtcatcatttttacctgacttcaaaactttcttttccctcgtttgatgacttgaggttgaaaaagagacaaaagtccacccacctgaagtggtggtgggtggtggcatattcaccacttaccattattattggggcttttaaaaaagtatagatacatagatgtttctaaaattatgatttattcgaaagttccttttccaacatagtatagatacatgtgcccatacaaatgcgcacacactcacctcttatgaatgcatatacgcacattaaaactaagcacatctgaagagtgaagactgagtcggcatatcttatatttacaaagtcaccatatttacctcactggcgatgtcatctaatatttgaactcgggtaatcagccttcacgacaaaaaatctaaccagttgagctacacttgctttgctattcaaaagttttttacatcaacattgtttagatattagctatataatatataactagcagggtggcccgagcagattgcgcggctagtatcattatatttttttctcatataatagcgtatatgttttctcattatattattcaaatatattaaaatgacaatataattttaaattttgcaataattttataaaactactaatgtgtaatattcatattatattttatatacgtgttagttattaattatttttaatatcaaattttagttatttgtaaattatatatattcatatatggactctatactcgtcttttaatatttctttttttaaaattccgaattttctgtaaattgtatttctatatagactctatactcttcttccaatattatttatttttatttctgaatttttattatttctaattgtatttctatgtggactctaaactcatctttcaatattctttaatttttaatttcgaatttcagttacttctaaattgtattcctatatttatattcctatactgaccttaaacttttcttcctatgtttttcttaatttcgaattttagttatttataaattgtatttttatacggactctaaactctacttttaattttattatgtttattccaaattttagtaagttttaaattcctaatggactctatactctacttctaatattccttattttttaattccgaatttatatttttttcttaattatatttctatatggattctatactctacttctaatattccttatttttaatttaaaatttatattattttctaattgtatttctatatggactctatactctacttctaatattccttatttttaattccgaatttcagttatttcctaattgtatttttatatggactctatactctacttctaatattccttatttttaataccgaatttcagttatttcctaattgtatttttatatagactctagtctcctcttctaatattccttattttttaattccgaattttaactatttctaaattgtatttctatatggactctgctttttctttttcctcgattaatgtgagaatttctagaccatgagagcgaacgtggaggctcctttttctattcctttaattatataatagatattttattcgtctctataagcaactgtccatctaagttattatctaaccatccgtttcaaacacataaacccacttggctgagctgattttaaatttctagacttggttttagaattaattaagatatttcttcatcatgtcctttgcccattctttttacaaggtcagtaagaaagaaattaaataaaatctatctctaattatatattctaaaaacttactttaaaagtcaaagcattttgaattatattctgcagcaaagccaagttcagccaaataatgtagctttatcaaccgactagccgtcgcttgataacacacacaaaattttctgtgtggattgagctttagaatactcaaacatagcttttttaaaaaaattcccctgaagttgacactcagacgcttcacactgctatggattctacaattcaaattgctcttgagttcttccaaggtccgcttctttttgtgtggtcagagagctgaaaccaatgggggaattacggtgtgagcttcttagaccttgcatatacttgtcttaatcaaatcatcctcaacgaaataaattaatataacacatgtgtagtgaaacaaatcaagtcgttttagctgcgcgagacagagaaatggtgatttgaccccctttttcaatcccaacataatctcagaaaagttgtgaccggccatgtttattagtttgaggccatgaaagcgccaacgcagtgcgctttcacgatcttaaagatgacaagcgtaggggaattttatggtttttcttgttatactttcaatttttttaggctggaaagaacgtagaccagttcagaatcaactgatcaagatgtaccatgcagttcaacttcaacaccactgtgttactatttcaacatacaccatggccaaccatatgcagttcaacttcaagttcagtcatgctgattgataaatatatgcatggcattttttgtgttactcctctagttgagctttatcatgcataccatataggcagaattatccaaaagagtcgatgttgaacggtcataatctttccaattgatcggtaaaccattcctcaccatatccttgtggggtgcagatgatgactaaacttgaaacgccaccttcacccagcttgttgcaatcccctaccaaatgcttatctgaacttggcattatcttcttgcttagtcaccattttcttttttgcattcacagggcttgcctgccacatgtcattctcagtttgttcctgcaccagcttcaagtgatccatgcgacaaatcaccagtcatcaacgagagggaagcgtagatcgaaacaaaggattcaggtaagccgtcatgtccaagctttagcggctgcgtatccaagcaggaaagtgcagcatttgcacaccagacaagttcaccttccaatatacgcatgctgcacaaaaagaaaaggatgaaagaacaacctgctacattttgattccatcacgagtctttgcaaacatttgcagaaaaaaatagtgctacaacatgaacatattcatcagcaccttagcattatgtcacaagaaatttggaaaagcaacattaaagtgctgggacaatagcctttctccaatctccacgtcctaccatatcactaatagtagtacaacaactggccaataaaggtgctatgttggccgacatagacatcacttaacatttcattttgtgacacgaagtactctttaccatagaaaactaggtccagagtttaatcttgaacagaatagttgccgcatcagctagatgggaggtttctgccggcaggaaccacaggtgaactatttgtattaagtggctgtctcttgcaagcaagcctgacggtggaatcgatcacagaaggctcagccattgcaccattaccataatcaccacaggccagccttttggtaatgggagggaccaaagatatacctagcaggttgattgtctcaagatgacgactggtgaacgggttgttccacatgaaggtgttcatagctggggcaacaaagagtggtttgctgtagtcccatgctctcactatgcatgtcaagaggttgtcacataaaccaccagcaatctgaacaaaactaatccagtgtcacttttttgtaggcagcgaaaacaagttgacattgtcaaacaaatccaggattcaacataaaaaatatatggttcacaccagaaaaagaaaagaaaatcacataccttagctagggtattagctgataatggcgcaatcaccatgatatctgcccattttcgcagttcaatgtgcaaaacttcatcccctatcttcttccaggtagaccattcatcatcatcagtgtaaagaataatattgctaggcagagacgttctatcaataaaatgtaatgaagccttggtggcgacggctctgacttctgcccattccgagaagctacggcaaaggctctcaaattttatagcagcgacgcttccagaggcagcaaggaggacccgaggtttgctaggatgagggaaatccaatcccaaggtttcttgtactgactctgatgtagtcatcacctcagtacttcacctgtaccgctccactacattagaattacatgaattcagaagatctttatgctgctatacgaaaactctattcacaatgaatttctggaatgaaatgaaagtgaaacagaaaggggaaatgccatttcattcacggattccatatctaagctaaagattagttcaaaaacaaaggtaattgcatcatgataaatacattagcaaactggtcactagtttctgttcctaccttgcaagcttggattgatgtagcggtctaactaaaactaaactcagattggaggtggaaataacctcacctagtacaaattaatactccgtagtgtcattgtgctaagatggccagaaactaacgccggccatggttctcagctgagccccccaattcctctaggaaacaaacgctaccattcgaaccaagatggaggaaggtcgcacccctggctccaacgctgctccccggccgcgcaagcgaggatccggcagtggggagaagagaaggctacgttgggggtgggacaacgataggaggccggccgcacacagcgcctctgggtgttcgccggccgtgcgcttgaggaggcggggcgcgggggagcaaggaggaggacgggaagaggcggagactcaccgagagattatgggaaggagcgggggactcaccggcggtgaagatccgggggaggagggggtggccggcgccgtactccggtggagatccggcggcggaggagggtgccgcgacgggggcctcgaagttttggtgtgggaggacttcggttcagaatagcctttggactttggttactagaagatttgggccttgggcccagtaatgtattgggctgtgaggttgcagacttaggaatttttttaatttttaattttttattaaaatatttaaaaaaatagttttctatttgaaaaatttacaaaactagtcgcctttaagcgatgggcgactagttttgcaatattttcaaaacgaaaattattttttaaatattttaataaataaaattaaaaactaaaaaaaatcgcagagttagaggctcatatattaggcccatattacaaaaatcaaacttgtttttaaacaagtttgattttgtaatgtggtctaatgcataaatgtattttgcatagcataaacacagttttgttcagtatccacacttaaaacatttctttagataatgattcagacttaaatatgtcttgttcttcatctctaaaaaaaaagaatctcctgttcttattgcaaacaagagcctaaaaaaaactaaagataaaatcatcctgcataattgcaatttgcaacgatcaaaccatcaacagctaatttgtgacaagatttactacttattactacgtccaaaacgaggaaagtctgtacaaaatacgattcaaacaaagacagaattcacataaaaaagacgccatgatttccatgtgggttaaacatgctatgcacgcacacaaacacagggcacagaggctcactgagctcctatgctcgcaccgacacggccacggtgtgcggcggcggtcaccggcggacggatgtccgcgcgccgtccgtacgtctcggtctcagaacccgacggtggcggcggggccgaacgcggcggcgtgggagtactcgatgccgacgggcgcgcgcagggcgccggcgagcgcggcgccgtcgatgaggtcgcggacggcgttggcgtagcacacccgcagccgccgcagcgcgcgccggtacatcgccgccagccaccgcacccgcagccgccgcagcgccccaaacagcctcctcttcgtccctcctcctcctcctccgccgccgccgagcctcaccaccgccaccttcttcctcctcatccgcccagccgtcgccgtcgccgtcgccgtcgccgtcgacgccgacgccgacgccgacgccgacgccgaagccgccctcctcctcggcatccggaacagaatggctcgcctggcgacctggaccacgtcgtccaccatttcttggctttctcctatatacctcactagctagctcagcttgatctctaatctctctcgcttttcttcttaccaagagaagaagctaagctaagccagcttagctagcttgcttgcagagtgttctaattatactccttttctgtgaccttttctgggtgtcaagctaatttaatcactagatgaattaacttaactattcttcaataagtccaaacgactgatcggtgacgatgatgtagtagcagttaagtatcaggtcatctcgagaatggtcttttctttttctggaggggtactggtacatgctgatgtgttgtcttatggaggccggaaaagttagccggtgtgctacgttgacctcaacgacgagcggttagatctcgatcaaaaattaaatgtgacgtattggttagttaccgctttctccgttttagaatataaaaaagttttacaattggataatattatacaaaaattagataaactaaatagaaagatgttgtgattgattgataaggaaatattgatgaaaacattattatattttgagaaaaattcaaagtgttaaaagttgttatattttagtacgtagagagtacatactctatataattgatctctgtgaagaaacaaatagtatcttccaaaacaaattaaagcaaagcgtatataatcagcaagggaggttatgattaattcgatcaaggaatgtagcataaggtgcgatcgaagggccgtttgactaatggaattattattttttggatgcattaaactcgataatgcatccgagctaagaaaaatattactgctgtactggtagcccacaagttaattaaattaactaggccataaggttatggctcacatgggtgcatataaatttggacactgtatctgtacaaaattgtgtgaaatctgtctgttgaagtacacgcctcacagtcacagtcgttgcatattcaccccttaatccttatgtatacagcactagtagtattttagtccttggatcaaacctaaaaaatgtagtattttgccatcgagaacgagcggtgtagtaaaggaaatcgcgactttgaccatgttcaagaaaacaaaatcatgatattttaaagagtgaattgcatcttgaactatgttttcttacccatgtttcacaatgaactaggtgttatcaaacattttcactttcaaccaactatagttacttgagcatgcaatttggacaagaggcccacatgtcagccagaccatgtgtgtctctccctcttccccttctctcttcctcctcaagaccagtccatccctatccccactatcgctccctccacttctctttccagtttgcctatagcagtctagctgtccatctgttgtttcccttgagcttgagcatctagattaggagcttatgactagatcaagcactagatcagatcatgctgcctctactgttgcaagagcaatgagcacaatacatggaagaaaaaagagtagctacggagcagggctgttgaggcgccacgacggtgcaagtggagctcgagcatggggcatggaaggcggaggttaagctcaagcacgcagctagcaaaggtggccacagatggagcttgagctcaagctcaggggcaacgtagacagagctcctctcttcaacgccattccccgcggctctcaataccttaggctagtggtgttgtgctcctctgctagcttgacccaatgtcagtgccaaagttagagacgattggcaacagtcagcagcttgatgtagaagcaagcagtggctgagtggaaacatggaatgtgaaaatggatagagtggtctaatgtgcaacccaaggtaaaagactcttgtataaactaaaaatgttggatgtgccatagtccaaagtgaaactttagtcataataactagcccaatatacaattcactctattttgaaactaacccactttatagagaagcatcatatactatttacggaggggagtatatactttatttatagttttagaagcacaaactaatatacatacatcctataaaaaaggaaatcgatagagcatacacgttctaaaaaatcttacaaaaatgatcccaaccttttggttaaataaaatctagatacgatctaagcatgacccatcagtgtcagtaataaaaattcattaagaaaaaaaccttttccaaatcagtaatcttaggttgcattcttttctccccttttctaatttatactatctcgtttctcgcacacatgtatggtgtgtttttcttaaaaaaaattctatatcaaagttgtttaaaaattcatataaatgtaaattttaaatttattttatctaatacttaattagttatgtgctaatgagtcactccattttggtgttaaggaaaagttctcaactggagctaccaaaggcagacttataccgagttcatccatggatgggcccatacacacagaaggcccaaaaagcaatacgtctgtacgctggctcggcccattagactaaccaccagacagaccaagtaaaccacagccttcgctacgaaggcaggcaaatccggtccaaaacccaaacccaacccaacgaccaaaccaccgaccggccgttccactgcgccattccttccttccccccacctcctcgtcgacgcggagatcgctcgctcgccggcgacggcgatggcggcatcggcggcggctgcggcggcggtgagccaggcgctgagggaccgcgacgtcctcgacgccgtcggcacctccgccgccgcgctttcgctcgcgggctcttccttcatcgtgctctgctacctcctcttccgcgagctccgcaagttctccttcaagctcgtctacttcctcgcggtctcggtgagcggctcagatctggaactacttggttttggggggttctgggttcgggaggctagcctcgtgatctgcgtaactgcgttgggttgcgatttggaattggggagcgcaaagtggggatctgagggcagtgcggtgttcatttcgcctccgattgagaaatattgggggttcacgccgtcagtttaaccaacggatgctctgtttttgctgcttatgcgtgcgagctgaagcagttctcgacaattttttttttgtaagatgtttgctatctgatcggcacttgaagtagcatagggcatgctccattttttttttagtgaaccgtgtgaggatgtttatgtcatagacccttacttcaatgtggcaagtgatgtccctataagtatccatgtaggcaattgctgggagatcacatttcgtgctactgtcttcttggattggaagtacagttggtttgttatctaattatcatgttggtttgttaatattattaattgctgcaagacaagctgatgtctctaatctcaatttcttcaagacatttggaaatttgtttgagagaaatgatatcacatttctattcaaggtgtttttctgacagcttctgtctaaattgcaggatatgttttgcagcttattcactattatggggtatgcttctgactgtgttattcaaattgtatttgataatgcacgtagttacttcctgacttaaataactgcaactaatgtaggagaaagtgtattactgtgaaggaaaaaacatattgttctttattttgttatttttggaactgttactcatgattacccctttttttgctgactttctattatgcgctagtgaaatattcttacacacatgcttttcatattgcaggggcccatcaaatgcattctactgttttgctcatgactacagtgcacacttcttctgtgtggcttcttttctatggacaaccactatagcgttcactcttcatcgcaccgttgtcaaacataaaacggatgttgaggagtttggatcaattttccacctgtatgtgtggggtatgcaattcttttgaccacttctctgcctttcttggagcttgtgcgtgccaaattagctggtgcaatattattaagaagttagaaatgcttgttgatttggtatagtgcttctttttcatttgaagtattgacaattttatagctgtttcatctatttgaagtgtatgtgattgataagagggaacaagcgggagcattttgatttcttatatctaagcattatgtagatttgatgcacatacttttgtttctccttttctgttattgttgtctgcattgtttgtcatctaagaaccaagtatgcaagttccagtttctcatgcatttttcattcctgtctgctaatgtatatactgaatggtagacaacttaagacatttgttgacttgacataattgcgaacatgtgttgtaactcatcctattaatcttgttgccctgcttgaatttacagttcttgtgacaataattttccttttatatgtttctcaggaacttcactagctacaactgtattacgttcaattggaagtgattatggaaggccaggcacctggtgttggatccaacaaggaagcatgggaaaggcatgtgaccttttgtgttttgtcatgaatcagttaacttggttctaacactgctaacacctatctacagcttacatttgaaccttatccatggtagtcagagtggcccaaattggtgctaatgacgttcctatatgtttttgctttcatttagtatttgagctgttatcaaatgatccaaaacaaactccactcaacagaataagtactacctttgtctcaaaaagacttcatttctagctatgaacctaggcaagtattgtctatattcatagtcagaaatgaagtctttgtgggatggaggtagtaacatttatttatttggaattgcttacgtaccttgcacaagacagatggtatcataaagtttagtgagtctctgagagtatacgcatgctttctcttagtttgtatgtttgactttttgtgcattggcttctttcttttccatatctttactgcaatctatgtcttctgttaatttgccatcttgatcctagctagaccactcattcaaaataaaaatattgtcactttgtcagaattttagcaattgttcattatatgtcttttatatgcaggtcttgcacttggtaaccttttatcttccattgtggggtgccattctctacaatgggtatacatactttcaggttaatcgcatgataaacaacgcgacaagggtatgcatacagttttctattttatattgatgataaataaggcttgtattgaatccttgtaaattctgctctttttgcttatatgttctgattttcataagataatggatgaatttgtagatggctgttggcataagtgatcgatcaattcaatctgacgtgagggcagacaagaaggtataaatttcctacacatctcttctcattatgtgtactgaaatattttcccctaatgtgctactgtattcttcctactatcatgaattcagagagtaactcatttgatcctattattttttttatacctccagtcttgagatgaactggagtataataccttatgttatcatgtttggagcaaaaatgatgtgtaaattctaggagtacttatattatcatgttacctggatgtctggatcagcctcgcaccactgtctactgtctggtagcagataggaatgtttatttgagcagatacagcttattgacttgttttcttttgcaggcgtttaatcggtggggttattaccctctcattctaataggttcatgggctttcgcaacaatcaatcgtgtgcatgactttgctaatccaggccacaagatattttggctctctattcttgatgttgggtttgccggacttatggtgagtattttcatcctagatgctagttacccagttctgaagagttttcataacatattgaaactactttgataatgtgggttgagccaaccttttaagtttagggctagagaaagaggcttagaggactccacgtatcttgttgtcagtcctgttgataattttttataaatgggagcgctggagttccaaccctactctttcttgaaacaggcctatgaaattggttgtatttcatacttagccttcagtatccaaagaattggctctatataatgcatagatgagtcatggtctcgtggagtcctcttgaagttctgtttgtagaagtgtattgttgttttgtttccttgtgaggcttacctcagcttgagcttatctcacaaaacttctctggcgttacatcatctgtgaacacattttccatggattctaatgcttcatggtatctttaggggctttttaattccatcgcttatgggctcaactcgtcagtgcgcagagcgattgctgaaagacttgacatgtgagttattttctagactttacaatcatctgttcctcctgtatcacctcatttccgtttatcatttactatattggtttatgcactatataacattttgtttcctgaattgtccaggtatctacctgagagatttaaaaggagcctccctactctgacacgatttaaaagtcagcaagaaaatgaacttacttctcttattgtcgatgcgagtaacacataggaatttttctagcacactaagtttgttcatatcttgtgggttcttcaatccagaaagggtgtatgacattactgtagagccagatgtttagcattaaccatttgttagcatgtggaatagttcccctgcggtcctttgttgattgccttgaacacgagcagtgtaatatattgaagttgcattgtccggagtacataagagattaggagatagccagagttgtagatactactatgacgttgatctgtatccctttttttgtggatgtatcagtgtaccaccctctccatgttttgctttcatatgtttgtctcaaaatactggccacaggccacatacggtacgacttactaatgtttcggttctcctgagtcctaacagttgacagtgtcaaaacagtttttcccattgatgattattttcaccttagtgaaagcgtagttcttgtaaactgcctcgtggccttgtccatgggaaaggaaaagcactaggctattgctttgagatggtgttggctcgagctctcgtccatagtggaaaaggagaagcggcaaaaggtgaatacatggggaaaggaaggaggctggcaattgctttgagatggtgttggggataggattcaacatgtttgaaggaagaattgaatagggcttgccttgcttaggagttacggtgttggggataggattcaacatattcgaaggaagaattgaatagggcttggcttgttcaggagttactcgaatatttctcggtcttgcacactctcgtcaacagcgacaatcgatttgtcctctattttaaatttaaacgtacattcaaatgaacatccagtaaaactctaatataaaatatgatgcatggtgcatgaacatattcagcgtatatagggtgatttaatataaatttaggagaaataattgcctaaatctgatgtatgtgcaatttatcgcgtttctaagatttaaattacagtaaatactaaggttgctattcaaatttaaattaatgaaattttacagtatggtggtgctaagtttgagtgtacaataccaaagagaaaattattataatctaacaaaatttggttaacctcaatcggagttaaaatgttttttatataatttttttcaaaagtttcagaatttctcagtacaaaaataattaacagaaaccttttctcagatttaataatttgtttacaaaagaaactaaagcgcactatatagagtacgttttcctacagggaaaacgttttctaattgtgtgcatcgatttaaaacagtgggtccacatgtcagtgaaaggcactcctctaatcattcggccaatcattaaagtttccagaaattacatatagatcctatgcctacctatcagtgtcttgcatttcttaaaaagacactgggcctcttcactttacatcattttcaaccatatcattttttttaaagttattaaaaaatatatatatttagtttgttgttaagtttgataaatacataagaaattctgctaaaattttaacaatattatcatcttatcaaaattttaaaataataaaatttagtaaggtttatttaaaataacaaaatctgaacagccccctatcttttcctccttcaacctacaggcagctcgatgggcagagaggcgcggcgactcgggaagggctcgccggcgacgagcggccgcggggatggctcggccgaaggccgtggaagctataggaggtccttgcgcacatcctagaggcggtggcgcagccgggggtggctggaggcggcgagcgccatggccggcagtgcaggcggttcgggacggcggcgggcagtgtgctacggcgaacagtggctcgattaatggataggggagggcctagggactacgaggaggcttactccttgcttgattcggggcggaggtggtgcgtgacggcgcggcgacgggttcacgaggcggcggacggcggcaatggcggcggcggcgctccggcgagggggggggtctaaaattagttgatgaaatgggttcaaggggctcccggggtcatgctggcgcaaggaaaaggaagggggctcaccgacgcgacggctcgatggtgtaggtgatggcggtggctctgttcggccggctcgggggtgcggtgatggcgcggccgttcccgtcgaaacagagaggttagggcttcgtctagggatgttggagaacgagtgtggtgtggggagtcagccggcgcgaggtctcgatttataggcgagggaggagcgagaagcaggcgcgcgcggttgtctcgccgttggtgcgcacgggcgaggccgacgggagacatggcgtgggcggcctcggcgggaatcgcggcggaaggctggggacgcagccttcccagaggctttttgcagagggatggcagcggcggtcggggtcgtcgtgtcgcgtcgtcgccttgggcagagagggcggcgtcgattggccgcggcagagcggagattggcttggtcggcatcgggcagaggtagggcagagggcggcggcattggattggccacggcggctgcggtgcaaggcgcctgggcgcggcaggggcggcgtcggctttgtgcagccttggcacagcgggaatcgcggacagagggtggcttggtcgtcttggaggcgctgacttcgggttggcactccaaatgttcgacgaaatgacctcaagggggagaggtgaagaggagagggaaaactgagagtctgggaattttttttttcaggattgttacagagctcaaaagcttgtgccaaaattactggaagttagtgtagtcatgaacttcatttggtgaatttctgggatttttctcatgtgtagtttatattgttttgaaaattcatacaagttcactgtttttatttcaatttgaatcaaattttggatgttttcgtctttttgattgagatgaaaaacttgtgagacttaaggaaggttatttcaagtgtgtaccacttatttcaattctttttatccctttttgatttaatacttcaacatttttttgtttatatctattgcttgcaaatacattataagatgcatgaaaaatccaagaacgccaaaaataagttcaaaagacaaagaaaaaaaatcaaaatcaaaatcaaaattttgctaagtttttctttattttcctttttttctgacttcaaagaattccgggtacgttacaaaaagttcatttttattaaatagggtgacgacatgtcaatactttttatcatatgattaggaattcataaaagtataagagataaaataagtaaacacatatctacactgttctgttttcaatacaacttatctgttgcacttcttatacgagctatttcaatcgtcaattaaaaaccttattagaaacatcaaaatgacatcctcatttgcttgtagtactagttctccaagtagcagtgcttctagtttttctctggctgtggccgctagcttgttcgttgtcacccttcctgctgacattcttctcgtctgtcctcccaccagctgctactttgtgctcggctagtctcactctcacatagtcacctcaaggcggcggcggcggcggcggcgatggcttcactcccggaggtggcgattgtggccctctgcgccgccgagggctgcgcgaggctgctgaagcctatcctcgacttcctggcgaacgggatgagccccagcagcgccgccgccgacgcggccatcgtcgccgccctcctcgccctcgtcttcgcctacctcgtctgcgtcttcctcgtctacctctccgtcactaccccatcggcggtcgcggctgccgtgaagctgtccattgtcaccgcattcacgctggtcttcgccaggccagccattgcctccgtcgtcgtcgtcgtcgccggcggtggcctctagtgacagtgagcgaggtaatatttgctgaggattttggttgagcctgaactaaatcccagctaaatccccaaatccaaacatacaagtggtggggaaaaatatttactactactacagatagttcagtacaataaagtgatagtatcagatacaacgaattggagtagcatgtaacgccatggatttacaattgaagcactctacaatctactccctccgtcccacagtataagggattttgagtttttttttttgcttgtaacgtttgaccattcgtcttattcaactttttttttgcaaatataaaaaacaaaaagttgtgcttaaagtacgatagataataaagtaagtcacaaataaaataaataataatttcaaatttttttttaaataagacaagtggtcaaacactacaaacaaaaactcaaaatcccttatattatggttcggagggagtagatttaaggggaccatgcgtgcagccatggacagtggctgctatagctatgctatcccctagtttcctaacgaggcattttcctgcttggccttgggggcgaaaagacaccaccctgatgagtatgattagtcaataatgtattggacaaaagttccatggatatgcaatgtgaaatttctcctttctgaaagttagttattgtcactccacatcgtgttgtacgttggattggatggtttcatttgcattcagttgaagcacgtactggcaattcgttctggagaataaattggatacccaagccatcttctttgggagaccgatgctcaaaggtctgagaaatgcactgttggaagatggaacggacagtggcgtgaatgtttagagatctttttttgaatggaaaatgtgttgggagtgctaaggacaaactaacatccattatttaatagagaagaaaatggttaaaaaaaacctacgctgcctgccagctgaataatggattgcaagtaccgttctcgtttagagattgtttcaaggagtaaaaaaatccgtaggaaaagcgagaagtaaatatgaatgtaataggcatggatattctccctcgcaggtactaccaccaaatgatgctcctccctagcagatactattaccaacaaaaggaagtacttacaaattctctctggaaaaaaatgcaagtgtgtagaagcaatacttttccctgccaatgtgggggagacaggtgttcagtgatgctctgaactgaagcagattggtctcggatggttgtaacttgtaaacgcgcacatggttgtgtatttgcgcgttgcgtggtcgtctacgacgcaacttgctaggaaagcgctcaccatttggtccggcagcccctgaccacgccgtaagctatcagcatattaagttcattggtagtattagcaagcagcttaagtttctacaggggattagctgtcaaaagtaagatttttggggagagacgcttcaaaaactttcaacagggagagttcaatctgggtgacaacccaagtcctctcaagtagaaatttaagtgggtaattcctctgtcagtataaaaattcgcttgctaattaatttctcacatgttaatataaaattaaaaataagaaaaactcaaagtgagataaacgggcagaataatcccgcttgactgttatgcttgcattcctactctcaagccatctaagcatccaatggtgcaccgtgcacctttcacttatctctaaattttttaattatgtgtttgatgatactctctctcttaaaagagtgttgataacttgatacgctcttttttttaaaatttacaaccccatgtctatctcgtattttcctcgattgaaaatgttaccatagtgtctccattctgagatgatttacgtgcgaggtcaacacggagctactagcaaaaaattcaaaggaccgtactctactctcttgctagtagtactccctcccttacaatttaatctattagtttattcctaaatggtctacgtatttatatttatttattaggtctattcattatttatgcattagagtaaatggacattgatgcatgcatccatacacaccagtatttatataacacatgcaatatctttatttgctattggctaagaaatatttgggatggtgtatgcattgagtttgttgctagagtaaatatagtatgagagagttattagtttttttcttgatgtacctacgaaatatgtatatcaatttggaatggagagagtatttgttaatgctgatgaagagaaataaatgatatttctaagggcctatctaggtcctgtttggttccatgggctaatgtttagccctcatcttttagcctcaaattagccctcaaggatccaaatatgtgggctaattttgagctaatgtgaattagcccccctcaaaatattagcccctccaaggggtgctaatggggctaattttgtgtagggacaaaaaaaaaagcagctctctctcttctctttctactctctctccactttttagccttgaattaggctatagatccaaacataccaccctaggctaatgtttagcctaccaatttagctaaatattagctcttaaaattaaccgtgggctaatcttccaaacagtgccatagtaaaacaaatacctttcccctgtaaataagccctccggatgactcgaggttctacctcattccagaaggagaagcaggagagaaatcgaaggcggccggagaggagggagcggaggagaggaggaggaggaagaggagaagaaggcggccggaggaggagcaggaggcgtccgcggaagaggaggagaagaaggcagccggaggaggaggaggcggcggcggcggcgtcggcggaggaggagtagaaggcggcggcatcgtcggaggagaagaagaagaaggcggcgtcggcggaggaggaggattagaagtcggcggcgtcgtcggcggaggagaagaagaaggcggcggtcggacgaggagtagaaggcgacgtcggcggaggaggaggtggagtagaaggcggcggcggcgttgtcggaggaggagaagaagaaggcggcgccggaagaggattagaaggctgcgtcggcggagtcggaggaggtggaggagaagtcggcggctacgtcgtcggcggaggagaagaagacggcggcggcggctggcggaggagggggacgaggaggaggattaaaaaaaaaaaaactttgcttactgtcgcggtagcattttctgcatcgctgcacgcaccttgtccaatttcttcccggtcttagctcgatctccagattgtgcccatacctaacacaaatggcgtcccacctcgacgcggccgcgcttcttcttctctgcctcgcggtcggctgcgccggcttcctgggaccgattatcgaggccctcgagaacggctccttcacgggcaaccgtgccgttgacgccgccgccggcgacctcctccgcctcgccctccccgccgcctatttcaccggcataatccttgtctaccgccgagtggctctctgagtcgccggtgatcgtgagctcggccttgcttctgcttgtgtctctcaattgtcatagcctcgttatttggggattctttgagatttctgttcaggtttgagaaggatttgggtcttaaatcttaatcccctgtggcactatccgaattcatacggggcaattcatcagagggaaaagccaagaaagaaattagagcacggctgaataaaagatttgacctttcaggatgtcctttcttggattcacaagagagtgctccatcacggcagatctcgaactttgtatatttcatcaagtcgtcagcatgatccaggaaagaatctgttgtacctatcactaccaagctggtccgtccatgacagtatgctgatatgctctgccagtgactaggaatcttgggcaaccagtatgctccggcgaggcataaggtggcacatggtgacatggaacattccggtccttgcattgaaatcaaccagcgacctccagtgtgcttgatgggcctgaaggagaagaagaatcatgcaccatagagttttctgtaaatttatcatgtacagcaatttacaatcagctgagtgattggttttcttttctcgcaaatttcagtcctgcaaggtatacatttgttttcaatcagttgtgccttttcaagtcgtgctacaaagcagttatgtgctcagttgcagaagatgagtgaattgataaagagatagaaaagaagataaaattaacactgtttttctcctctttcttccaagttaagtagtaaataatcttgacctttgcaagtacagaaggaaccttactgatgacttttcccacaagtgggaactgaacaaatgatatgttcgacaacaaaccatggacttttcaaaaccgcatccacatcagcttggacccattcttccggccctgtatgtatgtttcttgacaaatgacaagtttactgtatgtttcttggcattaacttagtatgaatagttctcaaaatgaaaaaaaaaaaacttggtatgaatcatgtaatattcccggtatgtatcctgtaagaatcttaactgctttaccctgtgatatttctggtaggtcttcctgaaagaattgtaaccatgcgccgatgcgcgctattccagtagtctggtgcccaatctccatgccagcatgatcacaaaactcctctctgcatgtcattcatttgcacttggacatctaatctctgactcaaagctctcttctgttgagccttgctccttccatgtcgtagttctgtccaacggctgccactgaaaacccggccacccattgatgaagatacacagctcccatcttgaacctgatttccttcttgtagtctagctagagcacatgtaactcaactggcttgcttgccaaagctaatagggctacattggaacgaatgaattttacaggaatctgttaaaattcccgcaaaaatcctataaaattcctccgttccaaagtaggcctaactttgatcttaaagggagcaaatgaaaagccgcggccatcgaaaacggcgaagcgcaggagctatcttctacagtgggcaagctatctcagcgaaggcacaagtttgcaaagcagtaagcaccagcatcaggccagcaacacatattaatcgatggagcagcatacatatgatcgcacgatttatatatgcgtgtgaacggaaagccagcgattccttttcggtaaggaaaaacatggcgcggcaatggcgacatctacgccgaaatcgttgaaagataagcactaaatacaagtttaaaaaggattataagcactaaatacaagtttcgtggaagttgcgttcgttgaaaattggacgccgactccactggcgaagtttcgcggaaagccctggtggtggaatttctgtggaggctggccggccggcgacggggacgaagttggtgacaagatttcagtttggagttcggacgaggagaacgaaccggacgtgaggggcgagaaactaggcacatcggatcggaggctcagaatggtcctttgcgattctataatttgactaaacttttttttttcggggaattataatttgactaaactattccttcgtttaccgggatcacgttctaaactgcacagttttttccaaatattttatatgtaaaagtttgttttaaaatttaaataagcttattttataaatttataataatcaatacttcacatgttgctcaaaattttaggcaagcagccttagtgaaagggtgtactagttgtgtttttccccttttttttttttggtaatgtatgcttagggcccctttgaatcgtaggaatgaaaaaacagaggaataggaaaaacacaggattctgacaggaatacaattgtaaaacagaggattgcaaaacacaggaaaaacacaggaatggctgtttgattggaccacaggaaaaacgcaggaatcagatgagagagatagactcagagaaaatgttccaagaggttagacctcttgctaactttcctccaaaacccattccataggaattttaaaggattggataggattcaatcctttgtctcaaaggctttcataggatttttttccataggattgaaatcctccaaaattcctacatttttcctacaaatcaaaggggcccttaatgtgtatgcaacaattgatcataagggtgggacctagtacaggtaacattagttaatgccaactctacaatggctatggttgtgaaatagaatttaggtagacctcacaaggtcccactaaatcttaaaaatattgcttctcatctgctcctagtgaactagtatgaacaatgaatcaataaaaaaagtatattttattctcttatgtgcaggcatcctattttaatgttttgtaaaagatatgagagtaaagttaatattcaattttgaatgggttatagttgagataatattttttattctattttaaacttcagagatctctcaaaaaattatttgagattgctttcaacattggttatgatttcattgcaattaccgtaggaacacatagattgtaaactaaaattactatgaaactgtgaaatctttaccactattttacatgttgtgaac

SEQ ID NO: 83222 - DNA, 48217 bp, Oryza sativa
  unsure (1)..(48217): unsure at all n locations
tatatatatatatatatatcaaacgggctaggacttaaagccgtttgaggtgagtaaacctcacctctgacgggccatccgactgtgacccgtcataggtaactagtcacctgtgacgggttaggacttaaacccgtttgaggtggggtaacctcatctatgacgggtttcattttcaacccgtcacaggtgactagttacctgtgacgggtcgcagccggatggctcaccgatgaaagcatcctgtaggacccgtcaaaagtgacatttatcactgaccaacacttatgcccatcacagatatgctgttaaagctatgaggatctggcgtagtgcctcttgaaaaatttcctataattctatctctctcatcctattcctatgtttttcctatgatccaataaaatgtttattcatgtgtttttacaatcctctattttgcactttcattcctgttaaaattttttgttttttctaatcctacgtttttttcattcatactattcaggtccttagggtgtgtttagttcacgttaaaattagaagtttgattgaaattgtaacgatgtgacggaaaagttgaaagtttgtgtctaggaaagttttgatttgatgtgatgaaaaagttaaaagtttgaaaaaaagttttacaactaaactcggccttagactgcgaacatttcagcagcataaataatttggatagttggaatactgcatgcgttggagcgaccgggagggacggacgcgtacgagaggagtataatccaatagaaaaggtaatggtcatcacgacgccggccggactcgtactgtcgcacgcccatctctcgctcgcccaatcctccatccgccacggtccggtccagtcccactccggcgcggcgcattggtacttgcacatactcccatcgccgagctatcgcagatagaccacgcacgcacagggataagtcaactcatcacagggctttgtggcgcagcagtagccggagtagtatcacagattcacaggaccatctcgtctcgtctccctcctgtttgatccgccgcacgtcgcgtcacggcggaaagcagattggattggcgtcgctgcccaatcctgccgaaaccgcatgccaccacctggcaaaaaggatgtcgctgccaccaccccacctctaaatttttacatgcatatggacttttactcctacgcgagaaaatactcctactgcttcgggtgtgtttagttaacgttaaaattagaagtttagttaaaactgaaactatcagggttatgtataacacatatctaataggagttgattaaatctctacaggacccaccacatgccatatcctatgcggaaacaacctgtgaatataggaggagttccggataaggaaagacaaccataattctacatggaaacgacaaggacaactcggattgtatccatattggtttccctagttttacttggacaagaggacacctatgggtataaatacaagaccccctaggaggagaggacacaatcaacatacacggaataatagatcaagacacaagatcaatatacaagccaacatacaccaagataagccgccggatatcgacatcagagatatgcctggatcgaccctgtccggtacctacagaggtcggccgtagggatctagcgtcgtctctaatctcgccgggcacaaactcgaagaggaagactaccttgttgtcgactacgagtcagaccttcagaccgccatgtcaacaacagttagataggctaccccaaatattgtactggtgtgattatggtgaataagagcaatacctgcttcggccaacaggatgtagggttattacctgacaattcaggggcccgaacctgtataaaaatccctgtctccatctcttttacctcaatctcgcatatactctagtaccaacgatctccatactatgcaaataccggaatcgcgacatcaaactgtgactaggaacnntgacggaaaaattgaaaatttatgtatgtaggaaagttttgatgtgatagaaaagttggaagttcaaataaaaattttggacctaagggcttgttcacttcactaccatttttaaccttacattttttatggcaaaattaaaaaaatggctacatttagtttgttatcaaattttagtaagtacatatggaatcttgccaaaatttgataaacttgtcaaaattttagtaatcttatatcaaaacttgataagattgaaaataatagcaaagtgaataagcccctgaactccgtcgaaaaaggaatttctcttcgtgtttcactacacatgttttgcccgtgacacccgtggttaattgtggtcaaatcggcgaccaaaatctgctctatccaaatgtggcgcgacgtacgtacaataattaaagacaactccatcgtactggcgtactgtagatgcgatgatatgcgagacgccccctatacgatccagtagctattgctggtgggcggtacactctcagacgttcctcgtgccggacgttaattcaattgggtaatttattagtagtattacttctaccagtatacggagtagtgtttcaggcagcagctaggttgcccgtgcgaacgcataatggcacgtctcataaatgcaccactgtctcgtcgtccgtccttcgctttgctttgcagattgcaggcatgcgctttctgatacggtacacgcatgtactccaaatgtgtataaacgtagcgatacgtacgtgttggtgttaagggcaggtgacaatgtacgtttctggacagattacgatcccatctgatctcgcatgcacttggacgtatgtataccaccataacgatacagtatatgtgtgtactcatgtactgtagtagacatggagtacgtgcgtatcgccggcacgagcagctgcaccctgcacggcgggatgggctcgggatggatggatggatggatggagacgtcgggagacgcgaaaaccggcgcgttttacaggcgattcccctgcgatccagcggcagagagacgtacgccacggaggagcgacgagaccggtggggagcggcgcgtgacggcgtgaggccgccgggtcggtggatcatccgttccgtgacgcgccgcgacgagttgtggacgacggaaaccgcgcgcgatgggcgccgcgccgggacccgggagggtaccggagcggacacggtggcccgcgggtggccgtgtgtgtagccgtaccggtaagtcgggcactggcgttgggccctttttttccttaggcctggttagtttctaattttttttctaaaaacgtcacattgaatatttggatataaacatgaagcattagctatagattaaaaaagctaattatatagtttgtatagaaatcgtaagatgaatattttgagactaattagtccatgattagccataagtgctgcagtaatccacatgtgctaatgatggattaattaagcttaataaattcgtctcgcggtttccaggcgagttaagaaattagtttttttcattcgtgtccaaaaaccccttccgacatccatcaaacttccgatatgacacccaaaaattttcttttcacgaactaaacacacccttgctcgatatattgcaggacggtatcttgttcggacaatgtattaaaaagaaaaatagaagacaatgtattgtgtacttcagatacctatgagatatcacctgatatacctggtaggtttattgtcccatagaagtcccctaaaatttaaaagaaaataggtgacattgtattgtgtacttcagaaattttagccaatcttttccatgatcccgagtttttcttcttcccttatatatcctaaattttggtttttgatatcttccatacttttttcggttagtcaactgttttaatgatgtaaaaaaagaagtcaattttgccattggacaatgcataaatttataaaaatcttttattgtgtgactatcatattcataagtttgttgaacgagaaaatattatacgcagaaaatttagtatatatttaaaaaaatgtcatttttttaaaaatggaaacaacaattagtcattgtagcatttcttttgggataatacttatgacatgcaacaaatttgttgtgctactattttacaaaaatatgctacatatactattgttaataaataataaatgttatgttttgctatgaaatctaaaaataaccttctgacaataatatctcacacaacaaactcataaatatataagtcctatgtacaaacttctagacttcaacaatatagtactccataatttctttcttccatgactaacagcaaaatatatatttttatagaaattagacagttaactaacaaaaatgtatggatagaatccgaatcaaaatttggaggtataaaagggagtgagcacaactcataggtacaaaaggaattggtcgaaattctagggcatacaagaaattttctaaaaaaagagacattgcctttggcagtgaaccataaaacgtggtcccacatgtcggtcgtggtagctcgggcatcgggtatcttgtttggctccgtggatggctgggcggctatatggcacgacaaaaatatagaaaaatatagagttactcctagttactacctctgtcttctaaaatatagaaaaatatagagttggatataaatattaagaaaaatggtagaattaaatgggaagaattgtgattgatcgagaatataaggttggtagggaattttgcgtgataaaaggttgtgattggtcttaaaaaaagaatgtatgtgttgaagttgatagtatacctctcgtgtttggtgcgactagtttgatccatgtaaatgaaccaaattttggtttcaatttgtgggaaccacatgaagaaaatgccgatctcactagcgtttgcctcctactgccgctgctgcgcaaccggatggagaatatttttattcggttgtggtcgacttcagtttgaaaaccgatttttttttcacttagacacatcgtccgactctcacagtgtgctcagtttgtcttttatttcattctatgagggtccgattttagtcttatattctctttcctaaaatataaaatattttagttaaatgatatatattccactgctacaaatctgaacgtgctaggatatatatcacccaaccaaatttctttatactttgagatgtggagaatattggagttgctcttatattctagataaatttttaagaccaatagttgttatgctttaggacggatggagtacaagtcattacatagctttttagcattgtactgttcatttttttcgttttcttttctttcaccgacatgtcgctgtgacaacgatttatcgggcccaccggttagtggcgttttcgtacatgtgtctttgccttcaatttgatgttaaaattttgaaatgcactgtacaaggggaacacagcggtgtgggaaatgcgtcttccaagatccatgctcgcgatgctagccggcgatggcgaggggaaggaaacacagcggtgtgggagatgtaaaggttggcctttgcgacgcatagtgatatacccagttttctttctgcgtttaaggtgattagccacttattggagaagacaatcaatttacacataattaactaagtattaactattacagatatttgagttacttcaaaatcgcatcgtttatactccctccgtaccaaaataagtgtagtttttacactgtttatgtctaacgtttggctattcgtcttatttaaaaaaatatgtttagtatttttgttgttattagatgataaaacatgaatagtactttatgtgtgactattttttttaattttttcacacatttttcaaataagacggatggtcaaaacattgaacacggatatctatggctgcacttagggtgtgtttgagtagaaggggattgaggagattgggaagatacgcaaaacgaggtaagccattaactcatgattaattgagtattaactattttaaatttcaaaaatggattaatatgattttttaaagcaactttcatatagaaattttttgcaaaaaacacaccgtttagtagtttgggaagcgtgcgtgcggaaaatgatgtgcattctcactccctaccacccaaacgaacgcaaccttattttaggacagaggtagtagcgtgttagattgcccatgataatccagtaattaaagcaaagttaataatacagccgacctgttggttataaggttctttgtagacttctattagcctgcccatataatagttagctctttacaattaatacatggcctacttgtctctcttacatagtttcttggttcttgtgtctaagccggctataagtttatggcccgcttctcctctctctcctctccttcttctccaccttagcatttagccggcttatagcttactattatacttgctcttagtaacttataagaacagcagggcctagtaagagctgtccactgccaagttcatgccagctcgtccagaaaggatatgatcatatgaatatgaatccacggtcgattccgtcgatctcgccggtcgccacagccttgccgtcacctgtcgcgcaagggaaggaagcgtgaactgttgcctcgctgagccacactgggctgtgtatgttcttattcagtttttcttcttcttccacggagccgaagcgaagcccagaagcgaggctgcaactattgcaaatgtcagtctccagcgtctctagccgtcgccgttgtgcatcggtacttgcagagtgagcgctttgccgctggctggcagctcagctcgatcagggacgagtcaactcagagggaagagctgtatgcgtgctttgtggagcaggagcatctcacagattcttcgcaggaaacactactattcccagtcgcccacttctgtttgatccttgtgtcagttcagagaaaaggattactatctgtaatcctgtactccaacacgagttcagaaacgaaacctttggcgaaaaatggacagtatatgatactcggatcgaacagctaaacctgtctctgatcaacactagtatactgctgtagttgtattttttcagacaggattctgaactgaagcagcagtcatccgggcaccggctcttcttaaactgctcctccccttctgctcgtgctgtaattcttcgtgacagtgaagaactgaatcctatcttactctactaacttcttaagcttgacatgtgaagatgccacatcatcatctactaacaaaataccacatcatcatccactaacaaaatgccacatcatcatctattaatccactaattaacaagatgccacattatcatccactaacaatcatcacatttaaacatcatgtaaacatgctatatctttatagctattataatttaagagcttttcaaatataaacatgttaaattatcatccaacataattcatataatgtttcaatgtatatctttattatattttatgatatcctatatacttatatagttcatcctcacttagttagtacttaaatgattaatctatggtccaaattatctttctcctttttttcctttaattaagtcatatcacatcaattgtttttagcctttagatgattattctacggtccaaactatatccctatttttcttcttccataaagtcatactgaatcaccattctacatactatttaaatttaaattatcataaactacattaatttacttaatctgatgttatctagctatcttatacgttatttttttttgttatcatactaaattcccgcaacaatacgcggggtttcacctaattgtgattatagtagatggcttgtgctcgtaaaatgcatagatttggtggcattgactggttctgtctgcttgctcatgctgttggagcttagctgcaatctgtcagtgataattcctgggcagttgcaccattatgctcgtctgagccatggagactggagttcaaccagactttttaaaaaaataacagaaacatacagtaatgtggcgccgaaacaacaggtgacgcattatggtagacatgcaaattaaccagctacaatcatggaacgcttttgtttgctcaaggcacgactccacacttgcaataatagttcatcctcctgtcatctaaatagtacaaaacctatcgattccttaactatggaacccaaaagtacgtcaaaagctgggtgtacaacatgtacatatataggactaaagatatttctgcattacactccaaaagtatccatctgcatcaaacagatcaaacgactgcttgttgtggtgttcaaggggcaggaccccaggatgcacaccgatgagatttggtatggccaaaggcaaaaatatctggaacgaaacaaggtgacagaatgcctcctattgctatgtaagaactcagaacacattcaagcctcttttctagttatcctgtcaaaaaagcaaaaggaaaaaaagaagttgatgagacaggttacttcctaagtataggaagataacaaatagatttacagacctgaagcaatagattccaagagcatccttgatttcatgcacaacagaaacggcaagatgcaggtaaaggcccactgcacaaataaataacacactaagactacgtgttggttgtaaacctataaaagcagcaagcagaaggtaaacctagaagttgacatcaatctataacgtgtatactgttaatagaatactgtggagtatgcatcacacaattgataaaaagaggaccataatgagttttccactgtaacagatgatgcaggatttcttttttaaaaaaagtttttgcgcttgtgagcaaactaggccaacactagccattaacctgaaaccagtccatcaataaaacataggcatatctacatgagactttagattccggactttgcaatacatacaacgatatataatccaagggaacaaacagaagattaatgtcaaccaagccaacaggttcccacaaaaatgagtgatcatacaatgaaactaagaccgagtacttcagcaatctcacaccaaaaataaataattaaggtaaatcagttcacctgtgtatgcgcaatacaggaaaagaaccagcagctcatcaactaaaggaatcctggcaatagtaataatgatatatcgtttaatggatccgcgtaaatggttcacctgaaatattagcagtactaggggcaacaaagataaaagaaattacccagcattgatctttgctgtgagagcatttgcaatagcgaaaggaagaaacaccagagactgaaataagagatatttggtattttacttcaagtgactcatgtacacgtgatgtgcagatagaaacaagacatggaactatggagtatggacataccatgcacattccagttttgagacctttgggttcatcacataaatgagcaagtatcatccttccctgtccatgcatggcaactcaaaatatgagcactaattccaggaaggaaaaacaaggatgatggtagattagtattatgcactatgtttgcaaatctcactctacagaaaaatgctccatcactattcagtaaagaacaaagcgcagtggcacattaggtgaaccaagtggcattaggtgcttcttcagcaacagtatatcagtaccaatatgttgtgcatgttagccataaatgcttttcataaaaatccaggcggataatgggactatcaagtttttaattgtcgcaatataacttggatggttagatataacctaattagtgatttgtgatggttagataaaaattcctagacttataactgctgtgcagatagatcaaagtagatcataagaaagttttgcaaagatgaaaactataatgaaaactataagaaagtaattaaggaactgcaagttgatgaaatgctgatccacatttaatgaacacaagaatatccaatatgatatatcgtccacaaaacaagctaaacagtattcagtttaccaccctttccagatcaaaaggcaaggtcagctgatggcaggcatgttcagttgcgtaactaattgctgccacaagacaacagtgatacaaatgcccaaataccattggcctgatttatctgcatatggaccctttgcaattctgctgcacagttctgtataatttggtcattatttcatatagtttatagtatttttataggttagatgggttgatcaaaacctgattgaagcagcctattgtttttctagtaacctactaacaaagatccatttccaaaatgtaggaagtttttacttgctcttagcagaccacattttgactctaaactcttagcaggccgcattttgactctaaactctaaaactggatacttgacacccctcaggtattgaaacaaggctggtttcaaaaacgatttttgtccttggtgccctctcaggctctcactaactgaagcatgaagaatgctgaaatagtgaagagaactggagcatggagtgcccctggttgctttgaaatttgaactcatagcaggtggctgtttttaaggataggcaaggcctagcaggaaccatgtggttagaactgataagcatgacaacaatgggtatgacagtggctgctccagtgaattggtgattgcgcactgaggaaggaggtagaatcctgtgttaaaccatcgattaaaatccatgctaggggcaaaacaaattaaaaacttaccaccaaatatccaaaagcaaaaccagttccgatcacaagcagatgtggctgattcctcataatatctgaaggagagaggtaagacctgcacaataatatacagaatcctaagtatttcattcagagcattgcatcatataataataaacaacaagattactgatatccataccagacagcaactccagttaacaatgcaatgaaaggaaggagctgcaagccaaataaatatatatataaagtaagaattgctatctgctgagatgatcagatgaaagcaaaagtcatatggtctgttattattggaactgttcatatgttgtacttcagaaaagtaacattctttttaagaacatcaggctctgtaggaattttataaaaaaaaggatgttgttctataaatagatatttcatatatgttgactgaaaaaactttataataacatggttaggacagattaaatcatgccatcatttttctattgaaggcttgagcaagattattatcaggggcatataatgatcgagatgaagatatgctatcatgtgctgtaccaaaaaagagcttacaacagtatttaaagatgcacgaatgctttgccctgttaaacagttgtttcttaaataaaacaagattcactcaacaagctccaaaatatgtactcctaggtcttgtcttattgtttgagaacttgaaaatatgtactactagatcttgtttcattgtctgttgaaaacacactgcccaagcagctacaatcttgccaactatccaacaacacattgttaagaacattgggcgcccgtttaagataaagcttacgatgcaacaaaattgaaattaacagctataaaagatgaatttgacattttacaagaactcagggccgattcgatttgtaatgagaagttgtttattaaattttctgcattcataccacaagataaacagacctaacagggaaaaatatattcatagacataaatgaatggcttagaatttccaaaaacacacaggactatcacggttctacagcttcaaaagtttccaacttctagtcttactacataagaaaaaaaatgcaataagcttaccattgccaatgccaataccatgcttccttttcttgcttcaactactttttggacattgctgacactattcaacaggagaatagatctcattaagtaatgataggtaagaagacactgtagaacagtgctgctttttactcttacatcttatggaaagtgccacaaaaagtcacttaaggcaccgattcatgtaacagaaaatagcaaccattaataagatgaacttgatacttatggaccaaattctacgcaagaatcaattgtttgtaagaaaagatgagtcaaaagatatatggtacatgagtgctatttgttaatcttatttcatgctgtggagctgctgcaaaagttacttcagaaagaataagaaagataatttacactcacttggatccaatggtagggattacggcaaacaggatcataagaatcatcacaataatgtataaggggatatctgatacaatcgaaacaaaaaaatcagaaataattctagtggcaattttgttgtcttttgtgcagttcgttggtaacatgtgccagttgatgtcaaagctgatagtaaatatgtgattatgttcatacagaatggaaataagtattttcttgtgcttgaaaaaacgtacctggaataaatggaaggggtacccaacttaaaaggggtatcgacttccgaaaatcttgtgcccaccattcagcgcctatattgggacacaaaagtttctataacacaagtgcttacactagaacattgcaacaaagatccatagaataaatgtgcacaatgtgttagtttattacagaaattaccagtaagaaaggtaaaagagtgggatagatatatcagcatcaggccctccgtaggtccatttattaaaggaagaataagtgtatttgtaaagaagctggtggcatgagaatagcaaatgtcaataaacaatagtcagaccatctgtgaatcaatgaattaatgaatgtattaatgtaattaaagttgaagaaaaagaacatttgccagacattttagtaattaatactagtaggttttgttacaagctgagccagcaaatatccatgtatgtaatcatcagttaaaaacttttctattgacagaattagaagaaacagaacccaagatgttacacaaactggaaaggtaacatttactacatcatggaaacaggataaagcagataatcatcatatatagtgattgaaaaaaacagacatttggtctgccatttttttttctccaagtatgttctcttgcattttgttatgtcacattatttcaaagcaaaatgagaaaacagcttattaacttaaacattacagagctagcttctcaaaactttaggaaagagtaaagtgtacgggcggtccctaaacttgtgtgggtgtgccaactaggtccctgaactctcaaaatgaatttttgggtccctcaacttgtctcgggtgtcatgtaggtccaaacgggtttcaacctactccgtgtgctgacgtggcatgtcatggtagcgcctatgtgtcagtagaactattatgtcagccacatatagaaaaagttaagaacatattttttctcatgtcttttccatttattttttcaaaattaaaaacatcattttctcctctctttttaaattttatttttttctacatgattgacatgtggatcgcactaacacgtaagcgtcactgtggcatgccacgtcatctcacggagtgggctggagcccgtttggacctatatgacacacatgacaagtttggggacccaaaaatgcattttgagagtttagggacctagatgatatatttgtacaagtttaaggaccgctcgtgcacttcactctttaggaaatattcttgttcgccactgaacctttcagaaaagccatactgcaaatttttacatgataggtccagactccagatccacatgtgtgacatataacacagacttacagaaaagattggtattgtcccactaaattagggcgtgttcagtctattgccaaaatcaaccataccaaattttggtatggaccattgcaaccttctcaatttctaccaacatttggtaaccttagaaacttctactcacgaaactatatcaaaatttggtaaggtgtcaaactaaacaccacattcacatcttgatcttgccaaaattttggtattgtcaaattttggctttaccaacaaatgttaaggtgtttttggcaatgaactgaacaaacctttaatcttcatcagagcaagaagattagtatagactaacagtacgtctaaaggctcagtggttgctacaataagcaacatccttcttggaaagaaaaggatgagagcagtttttgaggaaatatacagtaatcacaggataactgagttccaaagtacttactgttcccatgttgcaagatagaacgggacagcagcaatcacccagaaacagaaagtaaaccttccacacatcaaggtgcttccaagggctaatgcttcaaactaaccagggatcaaatcagtcaatatagaagtatagaacagagtgatttatataggtgagatggcttaggaatccttacagcacaggcaagagcatcacatcctgtaaaatgacaaatttgcatattgtgagtataagatagacatgtgggtgtggaaagagcattaaaccttaacacattaccatgatcaaaaagttctcctagaggacttgatgagctagtgcgccttgcttgtttaccatcaacagcatcaaaagtctaggaaaggtacaatacaataccattaaagcaaatgcaaggcaggagcatagttcataaaatcaagttgatgaacaactgcattatgatttccagtttatttggatatattagaaacacaatgcatacggtaaacatatacagaaaaaaaaatcagaactcttttactacttgcaatctcaagatgtttcacaaacctggtataagaagagaagtaatccatgggcaagatggacccacctagggggagctgtgtcgaggtggggcgaatagatctgcgaaattaatattctatcaagaaaagaatgggtgcaacataacatgaagcatgaaaagaacgggcgttaaataacacgaaacatgtaatgcattagaagatatcaaagttagggcattaggcattagcagctgatatttttaacagctccctcaaattacaaaaaattcaagcaagaaagaaccttacatagccaagaagtgctgatacaactagaaacatgaatccagtgagtgtgatctgaaatttcagaaaacatcataactgttgaccatagacaaggaagaactgagaatatgtagatcatattcttaccatattaggtctgagtgtggatccatacatgcaaatggaaaaaaaaatgaatcagcatccatgtttttgttaaaaaaagagtaatatacatgagtatctttgataattattatgacacaacaggaaagctgcaatcgtagccgcatactactctacttcttttacatacagttagacagtcatggttgttaaactcctacaaagttgaccattggtcaggcacatacaagtgaatcatcaaagcaaaactagctcacagattaagaaaaagaagcaaaactaaacagatcctcaagcagacttgatatagtaaatgccaaatatatgaaaacacatagatgcatcaattgaatttgatttatgagcataatcagtcatgctcactgtggtcctattcatgatgcaaaatgcctctcagagacatttgagtttattccttccctgtctagatgaaatgacatggcatactactaagtactgacttactggaattatgtcaacaaattaaggcaagcaagcaaataaaaaaataactaactttccaacctgtaaaattacagttcaaccagatgctatggttttaaaaccagctcaaccagatgtttcttttgactggtcaattcaaccagatgttacttcccagttaaggccttgtttatggaataatttcgcaccacaataggtgcggaataaatccgaaaacgcttactatcgaacgtccgatacgtggagaaattccggacggtcccacagtcaaaagtcgcaacccatcctttcccaaccttatcctcattcctcctcatccagtcatccctaacctctcgcatcgacttcttctccgtgcagctcggccacggcgtcatcaggtggcgctagcgccgctgtagacggcggggctaccgtcacgggtggccggattctagccgttcagccaacaccgcgagaaagtggtcgacgccggttaggccttgagctcgccggcggcgggggcaccatggttgtccgttgtcaaagaggactcgagctcggcggcggtggtgtcaacgtcacaaggagatacggccagcgacggttagggccctgagctcgccggtggcggcggcactgcgaggaagcgggctggagcttgaggcgccgttgatggagatggccttgaactcgccgacgaaggtgaggatggtgggagcatcgagctagcaaggatttgttccatgctagttgctagtttctttatgttgcacacaagtgtttcttgatgttgcatttggtatttcttgatgttgcaattcatatttctggatgttgcatttggtacttgatgctgcagttgatttctttggatgttgcatatgtttttgctcttgaagtatgcgttttttagtgttcacatccgactgaaacattttcggtaaaataatgaaacattcttccatgaagaatggaacatcaaagaaacaactctgatgaaactttttttttggaacagtgaaacattgcaacaacttatggtgaaacatttatttggaacagtgaaacattgcaacatctcttagtgaaacattgcaacatctctttaatacgttgtggaacaccgtccggagatttgtaaaactgcggccgtctgatgtgtagtcgtccccgaataaatctcgtccaatccctcccacttggggattaaccaaacatgggctaaatggttctttcctaagtgttcaaatgcaatgtcactgcctttttccctcaaaaaaggaaaaaaaaatgtcactacccccatatagtatgaccaaattcaatcccctcgcccatgctactccctacacttccacaactcaagatcaaacacacacaagtccctaccgcacactaacctaacaaatcacgaactagcagactactagagagcagagccagagcaccatcaactactcaaactcgagcgaggagcggggaagggaaggtgggggggggggggggggcgctcacggcatccagagcgggaagagggtgacgcatctgctccagaagggctggagcacgtacttggccaccaccgagtggtcctgcccgctgtacctgtaccgcttcagcgtctccaccccgtgcgccccgatgtaccccatccttcccctcggctcgctcgctcgctcgtcggcggggagctcctggtcgggggaggcgtcggcggggagcagtggggagcttgggggcggcggcggcggcggcgagatcgcggaggcggagaagatggggagcggcggatcagtgatggcggcgatgggtatattcgagtcgaaacggttcccccgtggctggccgtgggcgtgggctggtctttcgctttcgactttcgagtgcacgtcacgactcaggggagcctttttcggttgaaggggtggctgacacctgtcccggagtccaacaaactgtaccacaaaaaggactttgttgcttctttttcttttttttccttccctggaaaaatatccttgagttacaacgagttaatgttattttagtcttattattcttatatggtttgagctaggattaaattcattgtggaaattcgcttaaatatttattttaaaaaatcatgagctgcaattaggattccgactatcatcttaaattaacatgcgagttttttatagccgacttatatacggatctgtatttcgaaaagcaaacgaacttaaaatccaactcatacatggatctgtatttctaaaagcgaacaaacttaaaaaccgattcaaatatggatgacgtaccaaaataccggcaaaaacttttttaatctttataatggtagagatatacgcatagtagtattatatttattattgtatatgtaaaaccatattagccaacaataagcaagtttctcaaaaaaattaatagatttattaagctggtttcaaaagttacacacaataattgatccaaaacttgcaacaagacaagagtaatctctcccaaatcttaaaaaaattagattgttttgagatttgtacggtgccctctcaaccctaactcctctctcctcaacctcgtgccaccattttactaagattgatgtgacaagaacccttctcctcgtggcctgcctcttccctggtaccgtcgcctgaccttacccaagagcgccaatgacgctagtgaggcctctcggccaactttctcccctctctctggcaatggctcttcgtcgctaaatccaccatcgctagtcattgtcacctaattagtcactctgtgtttgccctccgttgttgatgtcagcccatccctgaggctgcatcgacattgccacccgctttgccgcgcctgtccaagtccaccgctcatcgtgggattctccgccacccacaaccatctctctgaccctcgagaaactcccttcttttgtctctcctaccctctttcaccttgatcctaaccaagaactataactggtcgggggtcgatgctgtcttgttggagctaccatgagcccatgacccataggaacatgaggaaaatgaggccaatacgaatatttgcacaggttcgacggttccgaaatttgtgttgcatgaaggtttagtaattccattatctttatttaatcacccactaacatctccatatattgcaagggatcataacagggacacatatcatttgcagaactgcatctatagtagtagttactaaccagatgaactcggtcccatataacaacggcacctattgcagatgcagtactgcaggcaatccatgtgttcatggcaagatagcctgaattgcttatgcgcgcggaagccaaaagacatcaatggcacagcatcatgggccgtcagatcagagacgaacgctcggaatcgtatctggagaaacagatagcgacactcgctgcctttaaaactaaacccacgcaggtttctgaaacttggaggcgggacgggaggacgacgacgcaacggaagcgacgccagcggcggacgcggcggcggctgctgcttccccggcggtggcgcgctctcctccgtctccatttctccggtaaggtagcgccgccatcttcgtcctcaccgatcccaaaccagcgacgttgtgcacgaagtaatcgcgcgccacgacgctctcgcaggtctcaggaaccgcgcgccgcgcagcgccaccgcaggagaggctcaccggcgagcgcaagcgaccttccctcagatcggagctgcagcgcttaccctgctgtgtcccgtcttcgcctccccgagggtcacccaccactgccgctgatttcacaaggtacgtcctcccagtcgccatcacatatccgccagatgttcgacgaaattcctacacggttcggtggttttagttggggtacattttgtcctctggtatgttattttcgagagcactgtatcaacagaagcagccccgcgcccagagcactagattttacagatcacccacatgccatgcttcaggggaagagttgataacgcgcaggagagaaccatccattgaaacatttgatattatctatgaagatgattgattgcattgtcctcgtgctgagaaatagcctagttggtctggtaacctgcaagtgctcaatttttaacatcttgcataattctcgcaggagaattgcaaaagaaaggcagcaatgaattggtttgctctagtgttgagattcataggatctgttcttcgtacgagccgaggctgtagtcgacttcgtgcacttcttgctgctgatactagtgaagggaaatctacaggaaaagagaacaagagcatcaacaccggtagatttgacagagtcaataacattgttgggggactacatgatgtattcagtggattagcggttgccgtggattgtgttgggggaatcggcgctatcactagtcttgttcgtcatgtttatggtgtatttgctgcttctgttcgaagatgggcaaccttggcttttcgctggatttatcatcgttagcagatcttgggacagcaacaaacctcatctttacctatcagtttcactgctgttgatcacacaattatttctactgttgaagatgcccaaatagctgctgcacagtggaatgggaaggaactgatagatgtgccagaagatataactctggagctcgctattgaaatatggcagatcttcttagaacatgcagctggcgatgtcattgacaaggccccaagtctttcagttaaggtggggcaacagattatactgcgagaaaaaatcaaagcagcatcaatgaagttacaatcgaagaaagcggctatagaggtacttgagagccatatcaagtgcacagaaggtgatcgggatgcatgtgatcggcttcttcagaatctgcgtggccagcgacagcacttgtagcttcaaaccatgacccaatgaaatttcaattcatgttcaagaagaggaatacaaggggcaatgacaattttgaagaatcattaacaatcctatactacctctaggagatgtttgtacaggcaacatacctcatagtgttagtagatagtagtactgtcaatatggttacaacttggctttaatagctgttacttagtaatttggctgatgcaatgacttttttttttggtgagaaattgtaaaagccaaaatagggaaagaaagaaaaaactatgagaaggaattttcttttgccaggggtctgggtggccatattccatatgaagcaatgtttgtatggttagttacagttttgcttgatttgtgtggtagtacctggtaatgtggtttgcaatagtttttaaatatcagttgttgccgttttactcgtatctactttgccaaggcttgaaaagatttgttgtagcatttttcttaactctagtacggagtaatagatattgtatggtttggaagatttaattgccagagtgatatgagacgtccataatgtgcttttccatccatatttccgcatcatattcatatgaacatgtgcagaatctgtttggtttgtgtaggtattgctactatttggagtttggaggtcttcacatgaaacgcgagcgtgcattcaatcaatcaggtagtgtagctgacaaagaaattttatttcatctgaggatattcttttctcatccgctcagctcaaccctcgtcggcggcgtggtcagtgtcccatgatccccatccgcgatggacctgcaaatgcaatcctagtagagtttccttctccgtttcgaacaagaacccctgtactttacatcaagctcgattacaaaatctgatccaatacttccaatgccctatgacccagattggccaaagaaaaaaaaatcgaaatcgccagacctgcaccaaaggcatggatgcggcgggccgccgcatcgttcgcgcgctcatccgggccaatgatgcgatggagcctgtgaccgacacaatcgcctccgccgccgcccatgtcggcctcgtctacggcgcgatggaagttgttcgggacattcgcgtcgtcgtcggcggcatgctcagagttgctcggggcagcggagatggcggccagctgaagctgctcctgctgtcgacctcgccggcgcgtgcgggctgggcacttcaaccagcaggtacgcctgatatgctccagtaccttttctatttccaatttgccattaaaactacttccttcaagttgttttgatttttttttccaaacaaacttttttaagtttgaacaaatttataaaaaaatatatatagcagcatttttaacataaaacaaacatattatcaaaatatattcagtacaatatttaatggaagtttttggtgttgtagatgttgctaatttttttaataaacttagtcaaatctaaataagtttaattgtggcaaaaagttaaaacgactcataatatgaaacggagggagtaaaatcttattcaagttgttggatcagatagtctctttgaagtttgaacccatcaagattacatcgtgtaaaaagagatgcccttttttaaatgcccaataaatcaagaactaatgacttacctaatcttcttagcaccaagaattacaaacagccccacattggatcattggatgggcccaagcatgtatagcaactggtagacattgtacgaatatcagcgattgcaattttgaaacaaaatttttgaaatttcagtaattttatccccatcagcaggcgcatatctcggccaaaatttttggagttccttttcctttcaattttttgtgaatttgatcgatatttattcaaaatcattcaaaatttattaacttcgaatattttcgtccaaaaaagttccaaaattccgaatttttgttgaaaaacaaaagtgtaagcgctgtacacgatagtgcagtgcacagttagctctcaatgtggacaaattacagcaccactacacttgggtcacaacagtcggcactaattggccatcggttgtttcggttaatcccatgacgaagcgattgaaataaatcaattccaaatcccacctaatcaaccttaatcaaggccttagagggccagacgtatgccttggagcatccatttggttttctgttgtaactgtaaggcttgtatttttttttacttcagtactggaatggagaatgaactgacctgcagacgaacgacatcagatcattgccatcagaagctaaaccacggaaaggggagaaatgttcaatttgatgatcttccagaggtttgtgaaaacttccttgcaaggtttatacggagtatggaattgaacttgcaagcttgggggtgtgacatttctattctgcaggatgtgatatgcttgatattttcgaagctgcagctgaaagatcttgtaagcaccagtgtcttgtcaagcaaatggaaacatatgtggacaatttgtccaacactaagatttgatagcagtacactgtgtggcagcaacatgtgcagtgcagaacaatttactcagaaattcattgacaacgttaatgcggtattgcagcagcaccgtggcaaactggttgaagcactagagatcaaaattgattttaacagcagactggctaatcatctcaacaactgggttagttttgctgtatcatcaaagacaaagagcctggctttttatttaccacaaaactatacttctaatgtcttttacatatttccctttgaacttttggacgtcaaaaccttatcccgtctgcagcatatccaacttggctttgtatctttaataaagctacctttccagtttagtggttttccaaacctgaaaaagcttgacttgctcctgctgcgtactacaagagaggaccttgaagatatgatagcaaactgtcccaatcttgaatggttgagtttaaatagatatacttgcaagttattcactgccagataacaaaaatagaaatagatgcagttaatcttaaggcttttgtatacaaaggatttaagctgcgtgttgacttaagtgaagcaaaaggactggaaactgtagatattgaattctttggtatagctttagattatcttcttactgcaattcccagtgcacttcccagcgtgcaaaatctgactattgaagctcgcattttacaagaggtttgttctttgaatgcgctatttgcaaagactcctactttctaacctcttacattcattttaatgactttatttccctcatgtcagtcaccctggtttgtggaaacttcatgcaagttttctcagctcaagtgcttaaggatgttgctgcatcaccggtttagtgataaccgcaatactctcggcttggcttcctttttgaaggctgcccctctcattgaacaattggagctcgatgtaagtcttcttgattgttcacttacagctcttgctatgcattggtgccaactcacccagtactatttgttgcgtgtttttagttgtactttttaattaatgttcttgcaactgaactgtatttctttttggggggaacatattgcctgaggcatccttaaaccaatccgataatgttcctccaacgagttcctcgaagttctaaactttattaacatcattttgccaccatccgtaaactgcactcatgttcttggcatatataacaaatctacaagtatatttatctagatatgttggttgcataggccatgttgagctgcttgtgcacattgtggaaaatgcaccggccttggaggccttaacgatagatcgtacacagagaagaggccgtcctttgcatgaatactcggcaagattggctggtatcgcttctagaggataccttgatgggaaaattctgcctactacgaagctcgtaattatctaacatgctatccatcagagaggggcatagttaattagggcattgcatgcgctgagatgggaacttgtgaagtgttaccttgtgtgtatactctcccatcttaaaataaatcaacttttatatatgaatctgttcggattcgtgtacaacagtttaactcattggtatccagattcgtgtaaaaagttaaacttatttttggacagaggacctatatgaaaggcaggctggttgttatgcaatttctacagtccgctttcacatatctggccctagccctactgcatttcttggtgatcttgtgttgcaaaatacttactagtatctgattttaactgaacatacgggcacacgccggtgcctggcacgttaagacatgtgttcagcatcaataccatacacttctactactgttctacacactgcaaacatttaaattttaattaataaaatgtgggttcaggcaaatcgccgacgagcacatcaagcacacaatcgagaaactcatcagtgttacgatggattcagttagagattagatccgatggtttcgaatttaagctgaacaatattttctagaaagtctaaatactcccttgaagtttatctaacacactaaacttcgaaccggacatccaacttctcgaactttaaaattttgttcatacaatccatagtcttttttcctataatttgcaataagttggatgagtctgactatgtgacatatacattggacataagtgttaaaatattcacttgagtacctttttactcagttttcgccatcacttataaataagtatcaatataaattagtatgacattattacagagtataaatcgacgactgacatttgatgatatgttactcaacacagctcacttaagctttccaaatacgcaaaaacaccatccaaaatcatcttaggtgtactatgaatggcatggtaaaatttaaggagttgagtgttcggttttacagtttaggattgtagacggacttctatccaaaatttaagtgggcatatggacttattcaaatttgataatatcttggattcaaatttgttggctatacatcgtcttgaaactaatcaacaaagttcatttaacttcggttaatcaagatgaattatgaacaatgggagatttaatgtacttatattcgactcacaaagatctggttcatgagtcacgatgagatctttgtatattattacctccgtttttggttataagacgtttttactttgaccaaagtcaaactgcttcaaatttaactaagtttgtagaaaaaaataaaaatattttcaacccaagacaaatttattatgaaaatatattcgattattgatttaatgaaactaatttgatattataaatattactatatttatctataaacttagtcaaactaattatttgactttgattaaaatcaaaacgtcttggaatctgaaacggatggagtatattctaccttatcttgttcggttaatatctcgtacaattaatttgaagtggatttgaagatgatttatttcacacttattaaagtgtggaattattttcactcatttctctctcatccttgtcttttttttttagccggataagtccttaaaagatccgatcacttataggactttaaaccttgtgtttgactcataataaaggtataattggttgattaagagtccaagatggagtacttcttgcttggagaggaggttactgtctagcgggtcctaccaaacctccaaatctgagtagtttttttaagaaaataatttttttttcctgatcaaaaagaaaaatcgcaaataaacccaaaattaaccgccgccgccgtcgaggaacacctcgcctgctcggaagccatgctggcgaggctgcgcgcggcgtcggacgcggcgcgcgagctcgacgtctgcgtgcgccacggcgacgacgacgacgactacgtcgtcctccacggctgcgaccgccgccgccagcactacggccacgggcgctcctgcctccacggctgctccggcgtccgcgccgccggcggcctggtccgcatcgtcagcggcgcgcggcacgtccgcagcgcggtgggccgctacctcgccgccgcggacgacgacgaggagcacgacgagctgtccgtgggcgacaaggtcctcatcgccgccgacgtcgtggtcggcctacgacgtggtcgtcggcggcatcgacgtcgtcgtcggcgtctgcgacctcgccgagtacgctcgcggcgctctggcccgcctccgccggatgtgcccgggcgttggcatcccagtcaggttcaggtatacctcaaaccagattgaattccataaggaccgtaactgaatttgatccagtacgtgttcaattgttcgccttgctgctgctcgtttggaagggtacaaataacgctagattttcttgttgttttagtttactttagcagattcttatactttcagatcttaaagagagggtttgagatcagatcatcccaattttgtccagagaaagctttgcttattactttctagtagatagattcagtgttatcttctagacttgtatcacttcagtatttgcattctttttttgttgtctgaatagattagatattgtagatgaaaagtacatacaattgataatgttcattgcaggattggaaagaagaaagaagattgcggtcccaaacgaatccgcaagccagggacaaaagaggttcgatttgaagacctttctgaggtatatcaaatttcccttttcggttgatatgtctacaaatctacaccattaaattgacagccatggtgattaactatggtgttggtgttgattctaggatatgcaaaacatgatattttcaaaattgccgctgaaagagactgtaaggactagcgttctgtcaagtaaatggagacatctgtggaaaatttccccaaaactaagatttgatggcagcacaatgcgtggggaatacatgttggagaaactcgttggcaatgttaatgcgaccttgaaacagcagcgtgggcggatggctgaagctttagaggtcaaacttgaatttcaaagcaggctagttgcttttacaggcgaaaaaagcattctggttgatcatctcaacaattgggtccatcatcttgcacaacgagcttagctcttgatttagcaccaaaggaattcagggatcgccatgaccgctacatgtttccctttgaactcttggatggaaaagccgcatcttgcttgcagcaaattcaactaagttttgtatctctcaagccaccaacccaattcagtggtttcccaaagctgaaaaagcttagcctgcacctagtacaggtcatcgcaaaggatcttcaaggcttactttcaagttgttctaatcttgagtggttgagtattgttagatgcaatcttaatgatgatgaactgaaggttgattgtgcactgtcccgactgctatacttgcgtattgcaaactgtgagatatcaaagatagaaatgtatgctctcaagctcaagactttcatttacgaaggagcacagctgcctgttgatcccatccaagcacaggaactagaagttgcagatatcgttttcaagggtgatataacttttcagtatgctctcactgtgctccctgtggtgtttccaagcgtgcaaaatctgactgtgcatgctaattttgggctacaggtgggtctaagaaaacttcgcaagtcaataatgatgaccatatcatacttgtagattttctgctgacatggttaatgtttttttattttcagtttccttggttattgtcaactaaatcaaagttattcaacttaagtatttgaagttgctattgcctcaatgttctggagatatggacaacattgtctatctagcttcttttctgaaggctgcccctctccttgaagttttggagatccatgtaagtacttttgtgggtttgtcttctctggtagatatgttcatgtgaatgtttggttgtactacttgtaagtagtatttattttcaagtccctaggattccaggtattttcactgacatttgtccctaaattaagttgctattgcacatccatcagcactacatgttttcttgttttcacatgtttatgctcatgctaacccagaatcaagttttggcatataccaaactatacttaaaaatactgttcttttggaaccattgcagttcaatgtacctggctacgaagatgcagggataccggttctcaggagcctcccaaagtgtccatacaagaacctgaagagcatatacatcacagggttcagaggcctgaaaggccaagctgaatttcttgtccacgcagtggaaaatgccccggctctggaggtgctaaccattgacacagcaacgaaaataggcgtccgttctgctcaacacatcgaaagcgccggtggttacgttgctagaagctgccttgcaagcattgtttcacccaagaccaagtttcagatagttgatacagctaggtagagtagataccgagtactagtactgtgtcaggtactacgtatgcagttattgcctgttgtgtttgtgaatttttgatacgtactacgctctttcgtctgggcccctggggtgcttgcatcacatctgaacatgcgtacgcgaagattggcacacagatggatgcagcatgggaaattttgcgtgctcggtttgcatctcttgcaggtcacgaactcttctactactccactatacgctgtgctatttgttccttgtgcaacgccagtgtctcaccatggttactgccacacgacttgatagttgatgcactcagcagtatccagttactgacaaagcgaaaacttggtctgtttggtttgtggccaatgcaaacctcaccaaaaatctggcaatggtaagattttgagtgctgacagatttttggtaacgctgctcatttggtttattgcatttttttcctttgtaaaatgcatgttttgttgcgaaaatgttggtaataccacggtactatctttcttccagaatctaaaaaactgccgcaagttttttaaaggaaaaactttcaaatctagctatagtagtataattgtaatataattttattataactatactataacttgtatataatcattaaaataatatatgcaactttatatttaacttgtatagagattacaatgtatagttacaatgtaaatatagtctaattatattgtagttacactacgtctatactatactccctccgtcccagaatataataagttttagaattagacgcgattattaagaaaataggtagaaatgaatggtggagaatataagaagttttaaattagacgcggttattaagaaagtaggtagaagtgaatggtggagagttgtgattggatgagtatgggaaaagtgaatggttgagggttgcgattggttgggaagagaatattgatagataagttgttatattttaggacaaatcctgagagctaaaaattgttatattttgggacggagggagtagtacatttgaaagttttttttgccaaaaaaaacttgcgacagttttttagcagctctgttttatcagggtaaacacgattactgagataaagtaggtaaaaataaatggagtagtttgtgattggatgaggagtaggggtaggcaaaaaattgaatagtgaaaggctataatctgttggtgaagaaactatcactatattttaggtcaaattttacaggtcgaaagttcttatttttaagatggagtaagtaactcctttggcaacaaacaaacggaggcatcatctctatctccttgatttttttttgacatggctaaattaggcatggtttagtttccaaagtttttttctccaaaacatcacgtcgaatctttggacacatacattggagcattaaatatagattttaaaactaattgcacagttagagaggaaatcgtgagatgaatcttttaagcctaattagtctatgattagccataagtgttatattaacccacatatgctaatggcagattaattaggctaaaagagattcatctcaaggtttttaggcgagttataaaattttattcgtgtcccaaaaccattttcaacatcccatcaaacatctaatacgacttttaaaaagttctcttttagcgaactaaacaggcacatattatccgtgagtagtaatgcaaagaccctcactcaacaaacaatctctctgttaaaccaggacgtgccaacgtttaacatggcgctgtactcctaatccactggctcgcccgtcacgtcgatcagcacttcagctgagcgagcacgcacgcacgcgaccacgggcactcgcacacgatgacagagagcgcgagagtgcaggttgcaggagagtgatttctcttctgggcgcgcacccacccacgcgcgagagagagaggcagaggcggtcaggatcagggctggctggcacctgcgacgtcgctgcagactctgcactctgcactcctcctgcactgtctgcacgcacctggccctccccctgaacactggccgaagtgacccatcctctgcacctgcaccaccagctcattatcctgccatctgattccccctcctgacacctccacactgcctgcattcatcatctccccacccctgtactgtactcccttcaaaaaaaacaaaacctggttttcatatccaacgtttgaacttccgtcttatttaaaaaaattatgaaaaaaatataaagacaagttacacataaaatattactaatcatattttatcatctaacaataatgaaaatacgaattataaaaaaattttatataacatggacagttgaagttggacacgaaaaattaggttttgccttttttttttttttacggaccgagtatacgtagtgtaccactccgtataatattactactcctccacactggacagaacgaacaggttgtggttgtagtgtgcttgtgctgggtgaggagacagacgtcgacgatgatggccggcggcggatcggggaggtgcctgttcacggcgacgcagtggcaggagctcgagcaccaggcgctcatctacaagtacatggccgccggcgcgccggtgccacccgacctcctcctccacctccgccaccgcgccgccgccgccgccgccgccgacgtcgacaccgtcccctccctcgccttccctccccatcaccgtacgtacattgtcctctcgttccgatcgatgcgtacgtgtctttctttaatttacttatggcgttgcgcgcgtacgtgcagtggggtgggggtgctatggcgcggcggcggcgcagtacgggaggagggtggaggacccggagccggggcggtgccggcgtacggacggcaagaagtggcggtgctcgagggaggcgtacggcgagtccaagtactgcgagaagcacatgcaccgcggcaagaaccgttcaagaaagcctgtggaaatgccgccccccgccgccgccgccgtctaccgcccgtccgcgctctccatctcgccgccgccgcagacgccgacgcgcccagctacggcgccggcgccggcgctcctctccagctccacctcgactccttccacgcctcgacgtcgccgccgccgtcctaccacaggtacgcgcacaccagcagcgcgccgctcttcccgtcgtccgccgccggctacggcggcggctggtcgttgtccaaggagcactgcctcaccctcggcggcgccgccgccgacctgagcctcgacaagccggcggatcaccaccacgacgccacgtcggcgacgacggagaagcccctgcggcgattcttcgacgagtggccgcgcagcgacgacgggaggacgccgtgggacggcacgcagctctccatctccatccccaccgccgccgccgcgtcccccgacctcgccatcgccggcgccgcctcgcgctaccacagcaacggtacgtgcgttgcattgcacgaccgatgctttcactcaccactgaggcactgatcgatcgattcttgcgtgttttttttttgttttttgttgcatgatcgatcgatcgaccgaccaggcgaccatctgcggacgagcgagtgatgatccggcgagtttggttgctgcaatcctcagacgcaacggcacaagcagacgagtagcagcatcgatcaatgtcattggcttgataacaattgtattagcatgcatcatgtctttaatctaattaatcttgagtggtttgttcgtcagtgacatcttttgtttcactgctcgtttttacttgagtctgtgagcacatttctctcgtgttatactctatttgttcgtcagctctagtctacatcaggttgatgctaacgccgtacttctgctaggctccacagctcccatgatccatctgggacagcaggtcaagcgtgtcaggttaattaacacgcctgacctgatctgagctctcgcatgcacgggcgcaatgatgatgcaactttctctgcgactgacgttgtctttggacgatccatctgctgcaaaatcaaaatacggattatcaaaaccgggcgtaacaaattcttcgactgtttagattatactaagtgccctatcgtttcgtttttttataataagctaaaacggtttattagaagataaaaataaatttgtaggtaaaaatcaatgctgaaaaagaaactacgttgaaaatatcttaaaatcaatatcaaaattaagtttgaaaattttaaattttcaaacttaatgggccatccgatgggagcctaactttttttctttaaacttataactttttcgtcacattgaacttttctacacaaactttcaacttttccatcgtatcgttttaattttaacgtgtaactaaacacagccgaacttccttgcgaatatcacaaattcgtgttacaatagaaacaaactgcagatgaacagacgggggccgtagctgtgagcaaaagagaaaaaaaacggataaccaaatctcgccggcaaactgacgttcaaaacccgcacggaatctgacggaatgcacgtgaggagtatggtcaagccgcggtatgcttcgccgttgtcggggcgtggggtgcggcgtctccgttggtagacagagcttgagagatagtactgctactagtagactagtagtactatcttctgtaaaagaaattcaaatacttctttcatctatttttgatagtaatatttttaaatgtaaaaattttatttttgatagatatatttcaatccaacaacttatcatcttaatgactttcttggatttaatacatgactctttattcttctacacatgattggctacatgggcattgagaaatataaatattaataaatcgcttgtttacgaggaataactagtagcatatttaaatggatgataagtagaattacttatccttggtctgtgtgacaagatgaaatatgactatcaaaagtagatagagggagtactagttacaaaaatattttaaaatttttgataggttaatatactctctccattctaaattgatctatatattttataggtataataagacaaaaaaaataataactctctcagaggtatactctataatatatcacaagttaaaatttagtttttataagtgtaataaaatagaaaatataactatgaatgtacaacaattattttcagtttagtttattttttttttgacttatagaagttgaatttggttcaatatatttttggagtgttatattttaaattaattcattttaaacctgtgataactactactagatgggatgaaaatcatatccgagagagagagagagagagagagagatttgcttgctgggttgccgtgcacaggtgaggcattattctactgccactggcagtctgtctgcttgactgacacacccattaccctgcctgcttgcttgcctgttcggactcgttacgtcctcgctttttggcttggtaaaacagaaaatttttcaagttaaggggaaaaaaatctgagtactaggccctttcaactttcagtcacgttaaacctttcatacacacaacttttctactgcatcctatcaatttcaaccaaacttccaaactttagtgtgaactaaacacaacctagtatcatatttcctccattctaaaaatatactagtaagagattttactagtaggaaacttttagaaaacacgattatggatagattctttgtctggatttatagttttagaaattatctcatttatttaaaatctcgtatattttagatagagagaataataaacgaaacatgagtacttttaatatattgtgctattggacttcgtttttaccaggcatgtgaaaatgcggggcaggaatttgcccacttcaatcctaatcgttccttggagagttgcagtgaaactgaccacttcggtccattccttgcagcgaagctgttcaaatggagggtgtgtttagtgcacattaaaagttcaattgaaattagaatgatgtgacaaaaaattaaaagtttttatgtgtagaaaaattttgatgtgatgaaaaaattgaaagtttgaagaaaaaaattggaaactaaaccagtttggagtagtatgttacaatcgagttcgattatgttgagcattaggattgattgttaaatttttcaaaagtttgccctaagttttattgacagaaagcacatggtcgtgtattgacatgtgttttctccgtatcatattaaattcatttttatcttccactaaaaaaaagaagttcatttctagctcttttcgtttatccaaattaagcgtatttttaagtaattattgcatcgaagtttgtgaaagtaaaaaataattgtattcgtagaaaataaagtgaggaatagttacattgagatttgataaaataaaagtgtttttttatgtattggtatgtgctccctccgtccaaaaaaacttaatctagtactggaagtgagatagagagagtatgaaaaggataaaattaacttattttgggatagatgtaggggcctgtttagttggcaatttttttttgcctgtgtatatcacatcgaatatatgaacatacatttgaagtattaaacatagtttaataacaaaacaaattacagatttcaccagggaactgcgagatgaatttattaagcctaattaatccatcattactaaatatttactgtagcaccacattatcaaatcacggtgcaattaggcttaaaagattcgtctcgcaattgcctggcgaattatataattggttttttctctatatttttcatactttatacatgtgtctaaacatttgacgtgacagcgtaaaaaattttgtttgggaactaagcatgccctataagtgctagttaggtaaaaaagaaaagaagagctgcaatgcctaagactattccagccaacaaagaacattaattaattcacatgttttcagcttttactggctcgttttcatgctcacgttttcttgaactgctaatatttttacgatttttacaaaactttctataggaaagttatttttaaaaaaattcatattgatcttttccaaaagttctcttaaggctaatgttcaataaatcatgcgataatttgccatccattttgcgtgtgggggcctctccgaacgcagccttaaaaagtcttggaaaaagtacaccgaaggtccctcaacttgtcatcgggataaaaaacgtcctcgaaccgcaaaaccagatatgcggggtccttcaactatataaaactggtcaactgaggtccctcggaggttttcaacccggttttatccgacgtggctgctgagtccatgtggaacccacgtgggccccacatgtcagccggccacgtcataccctcttccttcctctccctttgtcctctctctctctcactcttctcgtttgggcagacactaggcagctggggaggatgtcggcggctactgccttcggcgggtgaggtgggagaggacgagggcgtcggcagccggtgacgggcgacacgatggcggcggctagcggctagcgacnggnnnngngnnncngcggccgctccgccaccgctctcgcctgccgttgcagaggccgtaggcgcggaggcgggccgccgtcgagggaggaggtagggcaagtaagggggcggggaggccggcggcgacctcctcaccgggcagagacaccgatggcgcggaggttggcggcggagaggacgagcaccacggcggagttgaccaccgcggcatcgggatcgcgcgcgaggaatcgatcgtagatggcggcagatcatagatggcggcggcggcggagggagcgagctgctggtggaggatggagtgcgcgagggagtggaaggcggggcgggaaagggaccagatgaaggccggggcgtcggtggaggcgatgacctcggagaggagcgggtcggcggtgtggaggctagctagcttgccatttcatgcgtgcatgcgccatgcaaatatagaaatgcacactgtgcccagtatatatatgcgcgcgtatacagattacagagaatcaagagcaagctatgttatttggccggtgaagcaactacgtgcatgcatgcatgcatactaatgcacaaacatatatggtgctcgattaggggtgaggtgattagcgggcttaattaagaaatggatgcgcctgccctggacttatcccatatccgtaaatgacgcgatcacggcgtattatgtatatccgcggttttgatttatcggctagataagcttgcttatcgatcaaattaaaaagataagatggggttttgatttatctgaatgacttctgttggcgcgagcgctagcgatgcgcttgtcctagcgctcgtcaccggaatatggcccagcagcagagaaacaaaacgaacaaacaaatcaagtttatctctatcgattgcttcttatctgcaggaaaatcggaggaggtcgctccggcaacgacgcgacgtcgttggtgagcgagaagacgtgcgtgcgcttcggcgctgccgcccaggttcgccatggctgtagatcgatagtgttttttcattcagaacggaagcaggagggaggaagagagggatgtctggggttaccttttggcgagccgagggagcgtcggctccttcggtgtcgtcgccgccaccgccgctctggagaagggggagaaggggggttggatttggaggaaaaggaaaaggcggcgatgggaggaagtcggaacgaatcgaggctgccgccgtgctccccttctcccgtgtcgccgtgtttcccagctgcagctgccgccgccgggcgccggccgccgtcgtgttgctggccaccgtcgcggcgccgccgctctcctctctcccgcctcgcctgccggcctcccgccgcttgcctcgcccagaaagagagacgaggagaaagaggagggtgatgacgtagattacgctgacatgtggggtctacgtgggtcccacgctaactcagctgccacgtaggctaaatccggatcaaaaccgccgagggaccttttgtgaccggttttgattagttaagggacgcgggatatctggttttacgatttgaggacgattttgtatctcgatgacaagttgagggaccttgggtatactttttccaaaagtcttcccttgcaaacagtgccacggcccactagcccatcagcccggatgtgcgtaggaataagttcaccggccatccctcaactttacaccgagattttttgaggtttcttaaccacaaaaccagaaatctccacccctaaactatacaaaaccgttcactcaaggtccctaggcagtatatacgagtggttttgctgacgtggcatcctagtcagcaaaaaaaaaattaaaattaatatgtgtggcccatatgtaagtgagacaatggtgtgggtcccatatttctctattttttttctttttctcttctcttctctccgaaatctctcgagtctcgagcaggcgtggcgaccgagggggagagaggtggccgacggcggagcggggacggcggcgacgtgagagggagagagaggcggtcgacgcgacggcggcagcgggaaaggaggagagctggcggctggcgcgacggcgagctcggcgtcggagatgttcgaacgtgccgggtgctcgacctcgggccccgccgccgcccgccgggcgagcggcgcgctctccccatcgaccctctctccctccccaaggcgatggggctgctccgctgccgaaagagctgctgcctccattggatgaactacctcagccccgacctcaagtgcagcaacttcaccgacaacgacgacgacgagctcaccatcaagctccacacccttctcggcaacaagtaagcaaaacaaatttcaacgtgttgtcatctgctccggttagctcttcttgtgttcatggtgctgattgattggttctgcaggtggaacacgcacatcaagcgcaagcccatgagccagggcatcgatccgcagacgcattagccggttagcgctgggaccagcgttgccgcggcaagcgagctgaccacgacggccagcactgtcggcttcccatccctgcaggcgccggcgccggcgtgagggagctcgaggaggaaggagggaaggctgggaggggtcttcctcgtagtcgtcgttggcggcggaggtgtctccggcggaggccgagtcagcggcggaggtgagcttgagctccgcgtcaaggagcaccgcgaagtcatcgctgccgctcgacgacgacggggaggacggcgacgacgacttggcggcggggcttatggccaagggcaaggggcgtgctttggtcggttggggtgggctggatgcgcctccgcgctcgcccacctccgctccgctgccacgctcgccctccgccactccacccgccgccacgctcgccctatgcttttctgcccgcgaccgtgctcgcgctccactgctcggcccgctgtgcttgcgccagccgccgctccgctgccgcgcttgccctctgctgcgccacccgcatccgcgcgcgctgctccgcctgccgccggcctccctcactgaagaagagaaatagagaagagagaaaagaggagagaacggagaaaggagggagaaagaaaaaaaattgtgcagctaacatgtgggccccacgtattttttaaattttttttggtgactaggatgccacgtcagcgaaaccacccatatatactgcctagggaccttgagtgaacggttttgtatagtttaggggtgaagatttctggttttgtgattaagggatctcaaaaaatctcgctgttaagttgagggacctccggtgaacttattccgatgtgcgtaccgatcgcatctgcgcaagtgagctgggccctatcctcgtccacctttcagcccggcccatttatatccagcaattgcccgtcacgcctcgtcttcctcgtcgtcttgcaagtctgcttccacctctcttccatctccgaattccttccccccgccgctcgccggagcggggaacgtggtgtttccgccggcggtttaccccaatcgggagtcctcccccaatccgggtggacttcgagtttcgagtcggaatctcgcaagaacagtccgtcccggactcctcccccccatcggatcggccagaaaaatccatcggagtcagttccttccccccgtgcgaatctgacgggggcgcaactcgtcgcggatttctccctgttccccccccacctccggcgatggccgcggtcgccgccgagcagaagaaaggttcgtcccttcctctttcctcgtccttcagcgttcgtttcttctgcttaaccccatctcgtggttgcgcaatcgcagtcgtggtgcacttccggtcgacgggcaacgcgccgcagctgaagcagtccaagttcaaggtgcggggcttctcttgtcctcttcttgttgaatctttgctccctgcttgcacgattcccacatgttgtatcgtctgatgccgattattgttactgtaatttcgcaatgatcttgcgttaaagcgaatgtgtagcgcgctagttcagcctaggccgattaaaccagcagattaaaaatgtagttaatcgagccacgaaatatcagtttgcttttgtgtagagatggaagaactcgtatttggggggactatgttgtaataccctagaaaaatgttgttaggtgaggcatcctgcagcaacgtggccttcattgtatccatcaggagacaggattttgaaaaagggggggggggggaaggtgattgattggctcgttgaatttttgatgatttttataatgtctatttcatagtattaatagtagtatgcacaagaaataaacgtgctgattcagtcaaagatttttttagaaaatagtatacctggagtaacttcacgatgtcgcctcatgatatattggatctagcgatggcaatggagccccgttgccaccccggatttgatcaggttattttcggtggtgtcatatggtgtttcatctttttttttttagtctagtatggaagatatgtacatggcttgtagagggtggcaccatgtagttttgatgccctagtcaagtatcagatgcattagtattttgtggttctacggacataattttctgttcaatttgtatgagactatgagttccttgtttaatgagcgagtaaataaattgccctggaactcatagtgaaatgatggtaacttgttatggttcatccgttcatgcaattggaagctggaattacacataggcttttgcttttgcattttcagattggtggaaacgagaaatttctgaagatcattgactttcttcgccgacaaattcaccaggatacagtggtacaaatatagcttgtaggttcatctgagttgaatcaacatgcttagaaatttgttgatttttttttgttttacctgcagtttctctatgtgaacagtgcattttcaccaaatccagatgagttgataatcgacctatacaatgtaagctttgatgtccgtgctatccgttcttacatatcaatgtactgccaaataaccttcagcagagtgcattatcatttttttaagagaacttcaaaaccattttgacatcaaggcttgaaagttaattgtaggtgtagcatactgacttggtttctaaactaattactgatgaatgatactacagtatgagtaattacataacctagtgatattattctggtatcgatgtcacatttggtgaatgattaaaggactaacactaaacatttatgttttgcatcaaagaactttggaatcgacgggcaactggtggttaactatgcatcatcgatggcatggggctgaaaggctgtacctgctggagagaggaaacttcaatcaacatggaaaaacctgtgtacaaaatttacttgccgaaacactcatcatgtaaattgctgagaatttaacttcaaagcgaagctctttcgaattattattcggtacacgttgatgtcagtagcagcagctgcaattttcacggggctttcagccccactgtaaaactgagacatccttcattaaacgccccagtgcttcagacatcgaagagcatctttcagttgtgttatgtactagagtactttctgtatgttcatcaactgctgctaatatactctccttctacagcgagatgcttgctttgaattcctcttggtaccatggcccccttcagattgtcattaagctcatgctattaagtgagccaacgatcagtgtcactgaaatgtttcgtgccacttgctaattagcttgtaaatcaaggagcacatgttgcggcagattagtcctccacgatgatgccgttgtgtccattaacacatgagcaagagcgacatgtattgtcagtgccacagtgccacttttggtattatggagcaacgtcatgctgtggaaaacggaatgcatgtcgctatgtaaagtggaaaacgaatacatgtcgctatgtaaacttaggggtatatacgtacacacgccactgcacctccacagtccacgccatactcttccactcacctttacgtgatagctgcactagtgatgaactgataatggttgtgattagtttcacgttaaaattaaaagtttgaagaaattggaacgatatgacggaaaagttggaagtttacgtgtgtagaaaattttgatgtgacggaaaagttgaaagttttttaaaagaagtttaaaactaaaaacggccaatatgcatgattttttcgttttgttttctctctctttctgtgttggatttgaacttgtcacatgagtatcgattgagtggcgcctagacctgatgcagctagctgcacgataaatagccatcactcaaacgaaaaaaagaagatgcagtactactacgagctaaccatatagtactacgtaggagtactactgacacagttccacacatgccaatacctttaaagcatttaagcacctgtctcagtgagtagctagctcgatcacgatggcaatatggtcacaattttgaatgtagaggctgtgtttagtgctcttcaaaccttcataaattccttcacctcaagtgtttggacatgcatgtagtattaaatgtagaaaaaaaaactaattggacagtttgtatgtaaattgcgagacgaatcttttgagcctaattataccatgatttgataatgtggtgctacagtaaacatttgctaacgacggattaattagacttaataaattcgtctcgcagtttacatgtggtatctataatttgttttgttattagtctatgtttaatactttaaatgtgtgtccgtatacgttaaattttttttttgacgaactaaacacggccttaattttgcactccagttcagggtttatgattccgacgaaatccggtcagaaatccgtctgagattttgaggagttttatccaaattcaaatttgaatcgataaaaaaagaaaaaaaatcaaaaaaaatcttataaatactatgatattaatagaacctattgggatataaattttcgaaaaaaataatgtattgtatgtatttactgaaacttacgccaggaaagaaaagaataaagaattaaaaaaggaaacaaattaccgatcgaaatttcgatgattttgatcggaatttcgccaaaaccgaccggttttcgagaacttatcagcaaactcagggatttgtattcaaattttggtttataaaatttattcaaaatttaccggttttccaccgaatttcgtgaaattccgaattccgccggtgcccgaaacggaagggctgtcggaatcggaaacctgctccagttagcatttcgcaattcaaagctgtagcagatgacgaaacggcggtgatgttgagtacttctcttctgtgtgtatatgcagagtaccacattggacaccacaagaatatataccggctgaacagtgtgtacatctaacatgtcggcatttgtactcctatttgctactatgtgctttaattatctcccctccctcgtgcaaaatggctcatttgtccctattagggactgcctttttatgaatgactgaatataaagctgaatcattttgtgatcactatttaggatacgtacatacgaataaactaactattataaatttgaaaaaaataatatttttaagaaattcgatcatatatagaaagtttttcttttaaaaaaaacaagtcataacgtttaggaattgtagaagcatgtctcattaaggcgctatttgattcaaaggcaattcataggagtattttatttctataggaaattttcctatatgaccctttgaatcaaaggaatgaatcctataaaatcctatgaaattcctatggaatacatcttctcatgtaagttttggagaaaatttaacatgaggtaaaaccttatataaaaaaaatcctttgagtctttatctcttctcaaattcatgtatttttcctgcggtccaatcgaacggtcattcatacgtttttcatgtgttttgaaatcatttctgtcagaatcctatattttttctattcatctgtttttttttcttccaatgattcaaagtggtcttaatccaattctcccatttctcaaaaaggaacaagcccaagtatgagagacagtatccaactatccatattaattcgtggctcaaaattaagggctcttttggaacatatgaatccacaaacacaggttatatgaaaaacgcaagattaaaatatcgtggcttgttgaatcctacagggaacaaaatcgcaggaaatgtttcaaagtggttatttggatgtctcatggataaagcataggaaagtccaatactacctcattttttaatagataacgccgttgactttttgtcacacgtttgatcattcgtcttattcaaaaaatatatataattagggatgaaaacggagcggatagtttccgtccgctccggataaaaacgaatacgaatacctctcggatcggataattctcggatagttcggatacggatacgaatacagatattttctctcggatacgaatacgaatatggtatcagggtttccgtcggatacggataataattcggatatccggtgaacagtgctattcgaatatccgcagaagccacaagacataccccatttctttataactctatgaccttcaatatacctttttagattttaatagtagttcatctcttaacactagtccacattattaatattatttaaaattttaaaaatatttataaattatactacattttatataaaatgagctaattatatatgttgatatttgtttctattagaagttgaattggttttcgtgttccgagaaaaaattgtttccgtatttgtgtccgatcatattcgattcttattcgtattcgagatagtccgtatttgtttccgtattcgagctatccgtattcgtttccgtatccggcaaaaaatataaaaacgaatatatataaaaacgaatatgatatgagcattatccgtccgtatccgctccgttttcatccctatatgtaattataatttattttgttatgagttattttatcactcaaagcacttgaaatttttgaataagacaaatgttcaaacatatgtttaaaagtcaacgatatcatctattaaaaaacggagggagtattaatatgttgatttgttggtgagagaatggagagagagtgcattgaaactttcaaaggagttgtaaacatgaggttatcctcttagtagaaatactccaaatatacatagaaattattatttcctatgaaattcctttgaaccaagactagcattcaaagactctcaaaggatttttccccctatggattctattactccatatatatttcatacaaatttcgtccaatctaaaaggactcctaagcactgattttttttctttaaaaaaaaagaacccaaagttaacatgcgaaaagacaggggcctataattaatactccctccgtcccaaaatataagcatttttagaatagtgtcaagtcaaactttttaaattttgagtattagtagcaaaaattttagaaagattaatcatgtaaatttgatcttactatatttatcattaaacgaactatcataacatgcaactctttttatttaaaacattctacttttatagatattgttggtcaaaatagtatctcgaaaaccgtgtcaagaccaaaaatacttatattttgggacggaggggtagtattcattgattctctccatccgtagcagccaagtcccatggatggttgcatgtgaccacatcgtacggggctacaaggtggtgtgtattcatgcccacaccgttgcatgtataagtacagcgcaaaagtggtagaacgagaggctctgatgcgcaccagatcgctcagtctcacaccgcacagagacagagaagagctctagagagaacgagagagagagacagagagagagagagagagggagaatggggaggagagcttgctgcgcaaaggaagggatgaagagaggggcatggacgagcaaggaggacgacgtgcttgcctcctacatcaagtcccatggcgaaggcaagtggcgcgaggtcccccaacgagctggtgagctagctattacctaatcgatcgatggtcatcgatcatgagatgatgatgatgagatttgtacttaattgtgatctgtatggatgctgttgttgatcaagttcttgcgatcgatcgatctgaattttcaggtttgaggcggtgcggcaagagctgcaggctccggtggctcaactatctccggcctaacatcaagcgcggcaacatcgacgacgacgaggagctcatcgtcaggctccacaccctcctcggcaacaggtaatctcatcacttcatgatcactccgagttccgtatcaatttcgttgagttcacagcttaaatttggagctatttggtactgtcggtgtgtggatagtgatatacttttttcttttcctggttacggctttttagggttgtaatataaacttcgcaacttcttatacgagtcattcgaaaaaaatttgaagctggctaacgctagacaataataagctgatttaacttctgttttatttttatttatttttatctttatcttttttaacaaatttgtaatttgagctgtgaaatcatagcttactgccgttttgatcgatcgtgtatatatgttgtcaggtggtctctcattgcaggcaggctgccgggccgaacagacaatgaaatcaagaactactggaacagcacgctcagccgcaagatcggcaccgccgccaccgccgccgccggcagccgcggtggcagcacgccggacaccgccagagcgacggacgcggcgtcgtccagctccgtcgtgccgccgggccagcagcagcagccagcctcccgcgccgacaccgacacagcaacggcagcggcggcggcggcggcgacgacgaccaccgtgtgggcgcccaaggccgtgcggtgcacgcgcgggttcttcttccacgaccgtgaaacggcgccgctcgccgcggcggcgccggcgccggcaggggaattaggagacggcgatgacgtcgactgcgactactactgcagcggcagcagctcggcggcgacgacgacgtcgtcgagctcattaccggcggtcgtcgagccgtgcttctccgccggcgacgactggatggacgacgtgagagccttggcgtcgtttcttgacaccgacgacgcctggaacttgtgtgcgtgacattagttcgtcgtccgtacgtacctacgtatatgcatgtgtgcgtctcatagaatgaatataaaataatattttctccatctattttaagtgcagttgcgggtttccgtatataaaattaacgattttgctatatatttgtcgacaaattttctcctaaaaatttgacagatgtaattacagtacaatcgtagtataattacactgtaactttcatg

SEQ ID NO: 83223 - DNA, 6406 bp, Oryza sativa
cacaagttttagttatttataaattgtattcctaattgaaatcttatttttctttttctaatttcagaacttattttttttcaaattttaattaatatcgtattgtgttcttttagtatttttatttgtattttttattttcaatttcagttgtttcaaaattgtattcctacttgaactctcttttaatttttctaattttgaatattattttattttttattctgaattttatctaatctcgtattgggttcttatatggattcttatttgaatattgcttatttttaattccaaatttcagctaattttaaattgtattcctacttgaactcttcttttttttctaattttggattttatttttttattcccaattttaattaatctcgtaattgggttcttatatggactctttttttaatattccttattttaattccgattttcagctattttataattgtattcctaattggactatccttttcttttctaatttttattttattttatttttattttaaattttgattaatctagtattaggttcttatatggaaacttctttcaatattgcttatttttaattccgaatttcagctattttaaaattgtatttctacttgggtctctttttttctttctaattttggattttattttatttttatttcgaattttgattaatctcgtattgggttcttatatggaaacttctttcaatattgcttatttttaatttcgaatttcagctatttttagattgtatttctacttggactctccttttctttttttttctccgattaatgtgggaatttctagcccccacagcgaacgtggtgccttctttcaaagctgtattttattataaattaaattttagttgttaaaaataatatcattggatattcatttaaatttaattttatatgattatgattttgttgctacaatgaaaaatttaaagttaaagtttagtttttaagaccgtactaaatttgaacacgccttagcgagttggacggagagatgtatctctaccgatgcataagttttctggtctatttactctttttttcatccataggtaaaaaaaaatatcacattttaattctaattataccggctccaaaatatatatgcacgcactgtgtttgaatcctaatcacctgatctgttgattgatccttagtatccatctaggataaggaaagaatcaaagtaggagtacgtccacctatttggacttgtattctagaacttgatcagtgttgtccgtttgatctagcagttgttttctattcagacttctattatcaaagttaatctacaccatcaaagtctagtcccagtataatctaacagtctagatttttcttttttctctgattaacgtgggaatttctagcccccacagcgaacgtggtgactcctttcaaagctgttttaataatataactagctgagtggcccgcgcaattgcgcggctagcacccatataaaatttatatttttaatacctttactcaaagtttattaaatagttatctcgttgtcttaagactttgaaagaccaaaccttatcatcatcgtgtttctaattttatagtttttaaaagccacatcagttgctaccccttacttctgtcatatccttctttatttgcttgctcggtctaccactgtttctattcaatctctttggaacctttaaaaattggatcttatagtttttagagtttattgtcctgttgggttttatttttataatttctagaagtcccgtaaaacgctgccgccattatactcctctacggccatccactgcatcttctttttattgtcattgttattttaaaaatcgaacataattatcgttttgattcatttatttttactttctataagttccagcaaaacgtcggcgacgttgttgcagtactcctctacggcttgccagctaccgcctttctttattgtcattgagattttaagatcaaacataattatcattggggtttatttattttactttttagaagcccgaacctttaaaaattggaccttatattttttgagtttattgtctcattgggttttatttttttataatttttagaaatcccgtcaaaccctgccactattctcccttacaacctgtccgccacctaatttttattgtcattaggattataaaaatcgaagataactataattggaatttattttttttactttctagaaatctcaccaaccatcggtggctttgccattgtactcttgtacgacccacctgttgcctctcatttttattgtcattgaaattttaaaaatcaaatataattatcattggggtttatcttttttactttctagaagtcctgccaaacgccttaactgattgcttcacgacttgcccatcgtccttccttttaatcatcattaggattctatttgatgttttattaatagcttttacatgtcccatcaactgccaccacttttctcctttataggtccgtaacttaattaatctcgtaatgtgtttgagatggtcttttcttttaatagtttttatttttatcactaattttagttatttataaattgtattccaagttgaaatcttatttttcttgttctaatttcagattttttttgaatttcaaataatattgtattgtgttcttttaatattttcattttttattttcaatatcagttgttttaaaattgtattactacttgaactctctttttaatttgtccaatttcagaatttattttattttttattccgaattttaattaatctactattgggttcttatatgtactcttatttcaatattgcttatatttaattccgacttttagttgattttaaattgtattcctacctgaactcttcattccttttctttttttcaaatttcaattttttttattttttattccgaattttaataatctcgtattgggtttttatatggactcttctttcaatattgtttaattttaattccgaattttagttattttaaaattatatttctactcgaactcttcttttccttttctttgctattttcacattttattttatttttattctgaattttaattaatctcgtattgggttcttatatggactcttctttcaatagtgcttatttttaattccgaatttcagctatttttaaattatatttctacttggactctccttttctttttcttagattaatgtgggaatttctaacccccgcagcgaacgtggtgcctcctttcaaggttgttttaataatataatagatatatagatagatagataagtaggagagattgtcgccgaaataaacgataaaccttgaagagtttcgatgatgagcctcctgcggcggttcgtgtttaaaaattgaatataactattgttggaattcatttttttattttctagaagtctcgccaaccgtcggcggctatgcaactgtactcctcctatacaccccgcacgctacttctcctttttattgtcattgagattttaaaaatcgaataggattatcaatggggtttttttcttttacattctaaaagtcccggcaaccgccttacccgtttgcttcacggcctgcctgtcgtccctccttttaatcatcattaggattctgtttggtgttttactaaaaattttatatgtcgtattaaccaccgcactttactcttttataggcctgttaattaatttatctcgtcgtgtgttttagatggtcttttttcaatagtctttattttttatcatcaatttttgttatttataaattgtattcctaattgatttatttctttttctaatttcagaatttattttttccaaattttaattaataccatatagtgttcttttaatatttttattttttatttttttgaatttaagttgtttcaaaattgtattcctacttgaactctcttttagtttttctaattttggatattattttatttttttattctgaattttaattaatctcgtattgggtttttatatggattcttgtttcaatattgcttatttttaattctgaatttcagttaattttaaattgtaatcctacttgaactcttattttctttttttgctaattttggatttaatatttattttattccaaatattaactaatatcgtattgggttcttatatggactctcctctcaatattccttatttttaattactaatttcagttatttttaaattgtattcctatttggactctccttttattttcaaatttccaattttattttatttttattattaattttgattaatctcatattgggttattatatggactcttctttccatattgctttttttaatcccgaattcagctatttttgaattgtatttctacttggactctccttttcttttctccaattaatgtgggaatttctagccccacagcgaacgtggtgtctcctttcaaagctcggcctagacctcgtcggcgggagggccgacgccaaggacagtgtaggggtgctccaggtcagcgcgcgcacggggaacccaaggcgactgcgagtaggtgaaggtgcgacggtgccgcttcccagaaagctccggtgaacttaggggctttaagtccgttaagtaacccaaacctttaggttaattgatttggattttaactcttagggttctaacctgaaattagggttcttcgaattttgggaattttgtcgggaaatttcaatctattttattccctcttttcgagttaggggagttttaatattgtttatcctcttttaattttaggaacttcaatctagtttatccctttgctcaattttggtttttcctttttttgctttggcaagcgtttcatcgtgcgggtggggacggaaggcgccgctcggtcccctcggaaagatttagattaagattaagataagataaaattttcaaggacgacggaagtaaattgaatcggattattttttttgttttaatgttttttcgcctttttttcgttattacttgttacggacaacggaaacgctttcaattttgtaagtagaggaaacgctttcaattttgtaagtaagtagaggaaacgctttcaattttgtaagtaagtagatatagagatagagaagatagagatatatagtatcgtgtcacatataatatgataggattcgatttttttccgcgtcacatataatttctttattttggaatcagacagatttgttttttattttttcgtcccttttttaccgcgtccacagaattcgattcatttttttgcccggttttttcacccgatttttccccggttttttttttgcccggttcctttttttaatcggaacgattcttttttttatttttttcgccttttttatttggaatcagacgcctgattttttttcgtccaattcctttttttataataggactgattcttttattttttttttgcccttttttacacagaatcggattttttttcgcccgttttttttctcggtcagatttacggacgacggaaacacctcttgttttttaaggactatatagatagagataacgtgataatttctttagagcgaatatagtacaatttaagtgcataaatattttattatacatgcatgtataattagatttagtgtataactcttatcttctgttttatagataaaattgtagcattgtaatttagtcctaccataatctattggaatagattttaatctacctttgagcgcttaataattaacataatatttgcttgttctttcgtggatgaacgtgcatgactctaattacttccacgccatatgaatatccgattccaattgcaaatctcactaaagatttacaggctcaaaaggccatacgcatgcatgcaaatacatgcatgtccgactcctagtcaaattagtccaaatacatgcgtgtccgattcctagtcaatctctctatatgtttttcttttggactcacgtattttgctggttgatctggaccatcaaaatctacacaaatacaatccaacgacacatatatttctcttttttttttccaattaacgtggaaatttttaacctccacagcgaacgtggtgccttctttcaaggctgttttaataatataactagcatggtagcccgcgcagattgcgcggctagcatcattatattttatctcatataatagcatatatgttttctcattatattattcaaatatattaaaatgacaacaaaattttgaattttacaataactttacgaaactactaatgtgtaatattcatattgtattttatatacgtgttagttattaattatttttaatatctaattttag

SEQ ID NO: 83224 - DNA, 597 bp, Oryza sativa
tttttttttcttatctggttttataatcccatatgttcaccgccgttatatcgatcgtgcgttttctcccccaatttgatttcaaaaatcaattccccactcctctctcatcattttctctatgattttcccttcgattcggctttaattgccggatttaatctctgttttatagttaccgatgatgacggtgatcttccccggtcatttttatcccgagttttatgctctgattcagggaaaacggaaggagtagctcaagtggataaaaaccctcgactaattttggctgaccaagaaagatttagccaaatttgatggggatattttctctggcaaacgtacgggcgcggacacgggattatcttcgggagattgaagatggtagtcatagtcgggaagttgaaggtagttgggtcgaagagaagacaccaaatgaaggaaggtagcggactagcgtagggctgacaaggaagaaaggctttcggctgaaaacccaggaaatattttcattaccttttcttaattataatttatagcgatcccaatattaagatttttattaaccttttcaattatagtgtatactgaatatcc

SEQ ID NO: 83225 - DNA, 15387 bp, Oryza sativa
  unsure (1)..(15387): unsure at all n locations
tgattctgtggataacaagtaccagcaaaaaagtactaggcccgggctggcttttttgcatgggggccccttgccgccctagggtttccgtgctccctctcccgtctgccgtcaccgcccgtccctcccccgtttgccacgtcagcttgccgccctagtggagggcggcatggtctatttttgtaattttttttgtgccgatggattatttctgtaaatattaaaagaaaaaaaaattaaaaatgaaaaaaaattcgaacctgcgtcgcctctccctgcgaaagcccaaactgttcacccgctgaacaacacgggccgtctctacagttcattcatccacactgcaacgcaagcacagccgtcgcgaaaacgccggaaagtacacgagtacgttacccccctccccctctctctcgccgcgacgccacacgacacgacacgcgacgacgcgacgcccaactcctcacgcttcccttcccttcccttcccccatccatcctctcctccgactccgacctcccgcaaccgcagcgccgcccgatccgccgccaccgccaccgccaccgccggcagctcgatcccccgcactcggtaagctccccgccgatccttccccgccactcgtgctagggcttcccggatggatcgccgtttcggttttggtcggacgaatcgaatccctaacttggtgccgtttctgctgctaccagggggggttttggaattggcgaatggtggcgaacgaggtggttgcggcggcggcggtggtggaagaaccggcgcccgcgtcggcgggggcggttgacccgatgaggctggcgtcgcggtggcggtcgccggcggagtggggggccgcggcggccgagatggaggcggagccggcgccgtccgagctcaacaccaccaacagctcgggcctcttcgccgtcgtctctaccgaccggatgtccgtcaggtacctcggcgtcaaccagcacggccacgacgtcggcgtcgtgcaggccaaccgccccgcccccacgcgccgcgccgtctactacttcgagatgggcgtcaagaacgccggccagaaggggcagacctccatcggcttcaccaccgagaatttcaagatgcgccgccagcccgggttagcatcccctctgcccttgctgtcgcttggttccgctgttagttcgtctacgatgttgttggcaatcagaaatgtgtatatcctcgttttgagaaaatgccacagttttatggtagcaaccgagttttagctggttgagtttcctgcctaagaacctaagataatgtgtggggatcacaaattcatttaaaattactacgaggaaacctaagtacatgtagtgcactggttgaattggactatttgttgcataggctaggtttatcatgctaaagaggtaggatgccatttcagtttgtttcaatgcatcgaagtttctaatattggccctattgaggaagatttcctggctaacttgtggtaatgttggctgaagttatcttaatttctataaattagccggataccctgacatttccacgggtaaatttacttcagtctaccttagtttttattctgaatcgtagttttgtagggatttacattgaaacttgtatggaatcaaatcgccagtttgattttatgttttaattgagatttaggtttttatatattgtattacacgtggactctttatcttatatctgtcactccaaatttcagttgtttcaaaatggtgtttttctgtagactcttttcttttagtccatgcctttaaaacccaaacccacaatataatcaacagtgtaaatatttttctttgtctcaaataccctgacacttgcacaggtacatttgcttcaggcaactttagttttattccgagttgtagttatatagggatttgacatttaacattggaatttgtatggaatcaaactatcagtttgattttatgtttcaatggagattcagtttttctagattgtatttcatatggactctttatcttatatttttcaatccaaatttcagttgtttctaaatggtgttttggtgtaggctcattattttagaccatgcctttataaaccaaacccatatagaatcaatggtgcagatctttttctttgtctgggaccaacgtggcactttctaggtttttggcaaacatggagactccttttcacctaattttaataatttaatagacagacattcagagaaatagttagcaaatagtatggcccaccatttctttctttgagtggacttcaaattttaccactaaagtatattattttttttccttttgatgacatttttaaatttatcatgtttgttctatattcattccagctgggagtctaacagctgtggatatcatggcgatgatggctatctttaccgtggtcctgggaaaagtgagtcatttggtcccaaattcacttctggtgacacaattggtgctggcatcaactatttctcacaagaatttttcttcacgtaagttctgtcattctttctaaattggcatggcagcgtctgcttctccgattagctattctatattagccttttagtcgtcatattttagactttcttaaagttcatagctttcatcctttgtcttgtgagtttttttcttgacttgagatgaatgctgtgctttgttgctgctttcattaatattttgaaattcgcaagagttgtcttcactacagctgttggctgttaaatattgaatttggaaatcagttgcatttgcatctgccactacgcctctggtactggcttaactttccatgtgcttgtttctttttctccttcagaagccttgaccatgcttattcatctcaggatatcattctgcactttaatctaattacatgtaccattttgcaggaaaaatggatctctagttggatcctttcaaaaagaaattaaaggcccactatatcctaccattgcagtccatagtcaagatgaagagtaagatacccgttcctaagacttagttcttttcttcaactccaaacttcaacttcctggttttccatttgcacgcttttcaaactgtcaaatgatgtatcttttacaaaaaaaaaattctatatagaagctgtttaaaaaattcaaatgaattcatttttcaagtttacaataattaatacttaattaatccatgctaatgagctttctcgttttgcgtgcgctgaaaaactctctccaacctaacagcaagaatgctgcctaagtgattatttcaatgaaaatagacattccaaatatggaaaattgcattttaaccaagacagttaaacctaagttgctgaaaaatggtgttaagtgaaattatttgcttgtgttaatatattatttaggcttggaattgcatgcgttatgtgccataactcataaattattatattaattttcagcttttcaatggatctgattgttcatttttgcaaatcagggtgacagtaaactttggaaaagaaccattctgttttgacattgaggtgagccaatagatctagatattcctattcacctattaaggacctcacacaaaaatgtaatattgtcatgatttccttatggagtattatttcaaattccatgttttccattccacagtttgctgcatcaattaaacatatatcataatgtcttatagattatccatcttagttttccaaattcagatgcattgcatcttaagcgcagctcctttcatataattgaaagaacttttggttgcatgcatccttttaggtagtaatcaggccaccaaaatatggtgtatggtgccataagaaccaattggttttcattatggaattatagcctacaattatcactcagctcattcttttcatgtatatttacctatttggtgtttagttcatgcacacatgatataacactaagtatgattcttattggcagggctatatttttgaagagaaaatgaagcaacaatctgtcagcgacaaattggatttgcaaccagacatcagtcattggtatgctttctcatgttaagaatccatcactgtttcatcttgagatcattctgtatcttgtgagataggttagcgagttatgtttgataatcactgacttgtgctgtcaattatttgtctgctcctgttatgtttatgtgaaatttaccatattacgtaatctacatttgataccatattcactccgcccttcattcctaccttgtctcaatctttaattgtacctatattgacattaaatcttttatactttgccgccttatgtacatgtactgtgcacttgtaacaggattgttcgttcatatctcctacattacggctaccaagatacattaaattcttttgatatggcaagtgaaactgatcctccatccaatcatcaaaatggttatggggaacctcctgaaatgtatggtcttagccacagaaaattgctgcgtcaggtgagctaaggaaaacttatttgaaactgaattgttattgctgttgaaccatttttctaatctactaataagcaacactggggagtcaattgttagtatttataagatttttacaagatcatacatattctcttgaaaccagggctttacagtagttaatcagttaaataccagttactacccactgatgattagagcatctttgtgccaagtatccatattgatttttgttgtggtcaccacctgtagactgtagtgttgtgagtggactaacctgacatttgttttcagtcttaaaggctccagctcacgtccactattttttagtgtttatgtttttttttagatttcattaaccttttgagatgttacgatttattaatgcaagcttcataggcagatatctttttccctgaagtaaaacaaggttttatcacagctcggctgtatttggactgcactgcacttaatctcttccatatttttggttgcacaccgttgtgtgcagctattccatttgtctgctatactgtgcagatactacataattcatagaattggcccctttcgattttccccccttttggtgtggtttctgccttctgaaaacagtttgtttgatttcgtgaagcttatcatgagtggagatattgattctgcattcaaaaaacttggagaatggtatccacaggtgataaaggtacagtcttctatctgataattaattattcatttactcattgcagtttccacaaacttctaatgtgaattgataggtgcagactccaatttcgtccctgaacttgcattttactttgtaatacaagtttatgaggtggctccactttcatccctgaacttgcattttactttgtaacacaagttttgggaggaaagttgtacgctttgcaagtttaataacctgcttgcattacgattagtcaaatactatgtttatcctagcattttcagttgccatgatgtactttccgcaaagagttagttcaccactaagaaatcatttcttttttgcaggatgaaacatcaattatttgcttcttactccattcccaaagattcattgaatttatcggggtaattatctgaactcctaacattcagctatttggttaaatatgtatattatactctagagatcgaagctacaaaattgcatgcaaataagcatatcatcaactgacaaactacttatacacacatgaaaaataatacactacgtactttaataaaataaaatacaacacacatgtaagattatgataaattgtccaatctaaaaaaaacagtagtaaatggagtttggctgatgcaccccaaaacacacatttgtttttgactggagggagcatatgtgagatcaacttattttgacatctggtcaaattggcatgtggttctgtttgatgttgcccacctagggctttcgtttgcatgctcactggtggtgatgggcacttggacatgttgcattattacactatatcctgtttcataatgatataatctcagtttctcttgcattaggctggacaactggaggatgctgtaaaatatgctcgctctaacctggccaacttcttgacacataaagcttttgatgggttgctaaaggtaatgcaatggctttttagatgttgatgggtcatttgtaatgcgtccaattttacttgcaatagcaaagtgttttaaggcttcacatctatataagctttgcaatttctgagctaaaaagtgaacaaatctacttgcaggagagcgtggccctgcttgcatatgaaaagcctgccgaatcgtgcattggatatctgctagactctccacagcgggaatttgtagcggatgcagtgaatgcagctgtcctgtcaacgaacccgaacatgaaggaccctgagagttgcctttactcatgtctcgagaaactactgaggcagctcacagtatgcagcttcgagcgacgtgcattcagcggagaccaaggggatgcattcttactacataaagaagtgcagtcctgcgatagatccaggtgttcctaggcatcaaagcattcaagttgcacctgcatctgagcagtgaactcagagatgagactttgtgcccctcttggaaggaaagggattcacctcggagcggagatgtagaccatgatccatgcgcaatcacagatactttgattcttgaagtttcgcagtatactctccacaaggtgaacgcctaactgctgggaaatttggcagcagctccttccctgtaatctgaaaacttacattcacacatggccttaaacatctctgtttccataaactcggaagctttgagctggtagacattctgaatgtgaaatgagaagagaaaaacaataagatttgtgtaaatgaaatcgagttgccctttaaccttgtggttcattctaattcattgatacattcaattgcaatgtcttggttgcgctcgagtatatgtttacttgaaatgataaaccatttgcaagaaccagtccatctctggagttaatggcactctgccctttctttgttttgaaatctcgtcctctgcttctgcctattggtgaattttcactcatggatcattcatgtattcctagtcaatctgtctgttttcggtcttaattgcttcattgtagttttagtaaatagtgaaaagaagctgctggagaataatgaatttattctaaaaaagaaaaaaaatcaaagcagcttcttttgaattttagatcattagagaagttaaccggctaagaaaaaaaggggtacgctagtgctactataactgtacgagaaattcacctgtatttttagggtctgtttggtctgaatggtttgaagtcaaattttaccttaccaattacttatttggtaacttcaatagtatacactagctatttggattgataccaatttttatcaaagtcaatagagttgatactactctttcctataaaaaggaaaaatgatagtactcaaacttgctcaaggtttgacactacaaatattttggtagtgctttcaaccaaacatgcccttagaaagggctactccgtactagctataggcttatagcaaatgcaatcctacatggcctgcaatttgcgtgggaaatactgctagaacgttttaaaccacatctatttcaccgcacctctttatggaactcttcatgaaaacaaaacaactaaaggggatgtagctcaaatggtagagcgctcgctttgcatgcgagaggcacggggttcgatcccccgcatctccacatatataatttgtgaattagttttggttctttcacaaacagtattttaaattccacttgaagtatttttggttctttcacaaacagtacttttaaattcaaggagatcactgcattccttttggaagaggagaggcagggagcattttcacaatcaaggcccagcccattcacaatcaagcccatacattcgatgggccccacatgtcggccactgtccctcgggcggtttaagtaggttttcattttcttcgcagcttcgattccctcctctcccctcctctccgcccgctcgccgccgccgccgcccgcgtcgactcgccggagctgagcccggtagggccacacgccgagccgacaggatgtggtacctctgcgtcttctaccacaggctcctcgactaccggcggcccgaggtgcagtccctcgccgagctcttcggcgggcctggcgccggggacgccgtcgagtggcgcatgccggagaaccaccacgtcgactcccccttccacctcgtccgcctcccgggcgacgagcgcctcgccgcgcagatcgccaaccgcagtaaaagcgcctcgcctgatcgattgattcaccaccattcgctggctaagcttcttcttgcgggttaatcttggggggcgccgcgacgccatgtgtgtgtttgtaggcttgctggtgaaggggatctacgagctgtgggggcaaggcaccacctacgaggagctggagagggtggtcatggcgtaccccgaggagaggaagctgccgtacctgacgccggagagcaccttcaagatcgtcgtcgacagcttcggcaaggtcatcagcttccaggagcagaacgacatcatgaagagcctcacctacatccccttcaaggtaaattcatttttgagccataataagttcaattttagcctccccagtttgtcccaaaataagttcatttttgagtaaccactgcatcggagtttatgaaaatagaagataaatatgttaggagtagataaagtgaggaataattgcgttgggatttgataaagtaggtattatagtcttttttatgttgtattggtattggattggtgaaaaatgaacttattttgggacgaagggagttcatggagtagttcggatcacgaatttgtggatgtcagatgcatttattttctcttgtgtgtaattggtgctgttcctcatttccagggccgtgttaatttgaagaagcccgatcataagttctttgtcatggagactgatgactatggctgcaacaatggcctcccgccggttgctcagaggacggtattctttggccgcgaggttggagcggcggataggcatctcctgccgacatatcagctgaagagcaggaagtatattggcccgaccgcaatggatgctgaaatggcatttcttatggcgaatcaagggctggcgcgccccgggaagctcgtatatgacccttttgttgggactgggagtattttggttgcagccgcgcattttggagccatgacaatggtttgtgcttattgcacggataacgaataattttcattctgcttgtgagtatgtcttactgataaaggcctttcagggtgcagatattgatataagggttgtgcgggacggtcgtggtccagattgcaatatttggagcaactttgagcaggtgattgattgaagttagctattattttttgcttagattcttccatcctgttgtgatctgcttgattctgtgtgagctgcaattctcttatgacagttagttcttaaacgctgttcttgcctagtttttgacttggtatcatatagcttatgcagattatgtgtactaactatagtgacatttcggcatttatcacttgttagtaaaacacccgaggttcgtgtgaagtactaattatattgtcttcttcagtacaaattgccggaaccattatgtatactaagagcggataacaacgtcccaccttggcgtccaggattgaaggaggtaatactctgttgtgcggtttatacattgttgtatttttttgaattttacagttttgacagtgtaagcttgtactatatgcgcgactaaaaactgaaacaaatgtgaggaacgcataaagtgattcctgtacattcatgcaatattttagttgtgcttgaaatcttggatttgttatttacattcttgcattgctttatttggttgacattgcttgagaaaatggttgatgctgaagtaattgaattctcacgtagctttttaactgatgaaatatttcctacaactgaatttccatatgaagctattgtagcctacaagcgcatgggccttaatttccatagcttttttttttaataaaactttccataaccattggcttgatatatcttctgcttgtatgctacaagatactctggaaagttactgatttactccgttgtttcaattttttcgacaagatatgataaacacactattgatgcttgcgatcaatcaggttttcgatgccatcatctgtgatccaccatacggagtccgggctggaggccgcaagtccggtggccggaagctcataaagggcaccgtcgctccgtacacggttccggacgagaagagggacagccacatcccatccaccgcgccgtacagcctcgcggagtgcgtccacgacctcctccacctcgccgcgaggatgctggtcatgggtggccggctggtcttcttcttccccgtcgtccgcgaggacggcgtcgccaacccggccaagtacccggagcacccctgcttcaggctgcttgcctcctgcgagcagatcctgagcatgaggtacagccgggtcctgctgaccatggtgaaggtcgggccctacaccgaggaggtcgagaaggcggcggaggagcggcgccgcgagttcagggagaaccaccataagtggatggaggaggggaacctccactccgccgtgttcagccccgccgatcaggccgccgccgccgccgacgggaagccggccatagacagggactccaagcctaagtacagaggcaagtatgtgtaggtgtaggcaggtgagagacgctgaactttttgtctgaaaatttttctgacgctgtaacgaacaattttgtcgatgtcatgtggtcgtgtatccttcagcttaagagagcccggaggctttggatcagccgatttttagagcataaattagtgcaggtgctgctgtactatgatgtaccatttctgagatgatacgaggctgctaattcatttggtcgatgatgaggatttgccctattgaattatctatctatttgtactagtagtgttttggtttatcagaactgagaatcgtgctaattgaactaaaattatatttttatatgatggtattgtagtagtcgttaaaaattatattttttatatgatggttggaaaaggatatataaactttacgataccactcacatcctaaggttgtttaagatagtggttttgcatatttgaaagcttaaatcagcaattttgaatggctaatatagcatgtttacatatcgtcgatcattgatcattaaattttaaattatactctagtgatgtcatattagtattataatattgtcaactgtttgtaaatgagagcaaaaatatgttgttaaaacgaaagatttaggtggagattttaacttatctaatgcatatgtcacctagcaaaacttattcaacatagataaaaaccactttgtaaaactatattaaggtgttatataaaaggtatgtttgggggttggatgtctgggcttcaaagttcagaggtgctagatgaactttcaatcaaagttttgggggtataccttttattgctatattataaaagaaattaacgatcaaagataacatgaagaccgtgtaaaagtctaatactctccatatcattctactccaggtaacacaaccatcagtttttaaaagcctggagtttagaaacatgtaaattatatgtaaattatatattataaaagtagtgctcatggtaaatctaaaaataaaatataaatcgtacgatgttaaattattgtaaaattataggaatcgatggtcaaagattaaaatgtttaacttggaacaaactagcaatttaaaacggactgagtatgttttatattttataatttagaagggatatcttagaactgatggatgctttaaaatgtagccacttaaaaaacttcagatgcaacatggacgagagcagatcattgactgcaatcaaacatggtgagcatgatacgatttatttactatatacatcttcaccactgattgacatggatcagttaaataaggttcccctactaactgtaaaaatctatgaaaacgaaacaagcgcaaaagtctaacgtgccagccacatctgcttattcattcggagatagaatttgtatgatccggtgtaatatttattacttctacttctggtcactgtatcgcatgatgccgtacacatcaacaatacccggaggaaacactggatcagttgctgctcttacagcgaccttcgccacggaggcaacactcactggaggggtcaacagtgggccaaccagcggcaatctcgtcaacggcttcgcactttggagaacctgcagtgcacagggagatcttcaaattaagtcttaaaaacaactttacatttggaataagagcaaaaataactgtgttgcaaggcttgcaaaaacagaatgaagagacttttaccatttgcataggagaaccaacaagtccaagaggtatttttacgctaccgacacggcgagttccatgaataaaaccaggcctcaaaatcactcctgaaaaatatgtaaaaaattgatataaaacttgggctagaaatacttattgagaggataattgtgtccaaagtcatctcaagtgccattgaattaaaatccaaattgaaatgataaataaacttctcacaaagtcacaattcttctggttatgccttctctttagtttttctactcttattacatgataataataatggaatagttggaatcagcagaattctcaaactacagaaccagccgctttcacacagggggaacaagattggagcaagggccctaagaatttagaagacaactcgagaaaaaggttttagaacccagtccctcatatatgtactccagttatccaaagtattccagcaatgtaagaccaacaaatacttgctccgtcccataatataaggaattttgggtggatgtgacacatgaatctggatagaccgtctgtccagattcattgtactaggatgtgtcacatccacctaaaatcccttatattacgggacggacataagtggctcacgagtaatggagtggtagctatgaacttgctcacactaatatagtgatttcaatacatgctgattcaaggctatcatcgcacatagcatcagaaataattttagcaaaatcaaattggtttttactggttactccaagtttggctatttgaagccaatattctaacacatttccattgatgtcctagtatggacatataatatgtacacataaccgattagcactggaaaccttctcaaaaacagtatagagaaaattaggtatattccatttcttatagacaagcaaactggaacaacccatggcttcaagcaatatatatgagagaaacactaaggcatgagacagttgcaatatatatgagagaaacactaaggcatgagacagttgcccattgcggtgtgcacagccaagttatctagcttacgccttgatattatggtcctgtcctttccactagaagggctgtaatggtgcttcctaatgtgcttgagggcgatgcatcacctgagtgtttaaagttaattagctgcaacaatcattggccattgttctcttgttgcgaagaaatttggtgatttgtcctctttatcgtggaatcgtgttgtcagctatgctgcaacaagaaccatggaatactggcaaccacttgaaatgatggagtataaaattgattgcagagatggagtatcaatggcaccatcaagaactatccacacaattggcagcctatatgcacctcatggcatagggtgcttgagcagcaatcaataagaatccaataaaaacaattaggagttgaggacaaggaaacacaggccccgcacgagcaggggccattgccagagcctctgaactggtatttctttgttaagtacagccatattgccgcttactccatggtatatgtggtgttatatcaggtccgatactggttactgatcacgaatttttgaaacttaagtttaagataaacctctacacctcccatttccaaatctgaatgtatttggctatttgcaattccgttatagctggtgctacagggcaatactgtcatgttgggaagagatcatggcgttgcaaagatttggccacgccactcgcaatgatgtggagcatggcagcaccaaatttctactcaaaaagggtacatagagaacattgtgtaaatgaagtgtgaagctattattcaattctaatggatgttctccaattgcttcaacttcagcctcaactccatttgccactctaatgcatctttctcctcttgttagcatcctcctcgtatggaatctctgtaatgaatttgcaacatgaatgatcgcacctgaatcaacccaccaagtggattttaaataacttatgtacagggattcatcttcaaatgtaataatgtcctcacccttctttatgagatgctttaggaaatcagggcaatctttctgatagtgccccttcttcttgcaccacttgcaagtgtccttgtccacttctacattgcttggtcgtgatgtggatcactttgtggtgccttaggagaggcagcattctggttgtagttgttcctcttcttgttgtgcttcacatagttggcggaatcaccacgagccttgggtctatcctcttcttgcacacatatggcaatgagcttctcaatgtcccagttttctagctgtgagttgtagttgacaacaaaagcctcaaaatctgaaagcaaggaggcaaaaataaggtgaactagaaacttatcagggagtaccaagtccatcttcttgagctttgaagtgatatcactcatcttcaaaatgtgctctctaacccctctgccagtgtatttaatggttactaagctcttaatgagggtgctggcataggcctttgaagaaccagtaaattgattctccactctctgaaggtactcagtgggtggtacaagctgagattgctccccttattgcctccacaatggagctcttaatcaccatcaagcacttgcggtttgatgactcccacttcgcacgacttcaatcttattgccgcatggtctagcattctctgtttgaagtcaccttcactctcaccttctgccctcactggagtaacaagctcagtgggacgaagctcggtgagagctacagcgcaagtgctatctctatcttctctcggcatgagccatagttgggtaccgagctcgnnttcgcctgtatatgaagtccaccctttgcag

SEQ ID NO: 83226 - DNA, 19109 bp, Oryza sativa
  unsure (1)..(19109): unsure at all n locations
tatcctcattaatgattaattaataacataattaatcaccaattaggataattaattactaaattattattagttaattgttaattaagtatttaatcactaatcaaattgagcctttggaccgtgtcgctatttgattccgaacggtctcgctcttctgttccgcgagaccgcgcggtctcgcgctttccccgcgcgataccgtccgcaacgtcacgcctatgtcattttcgtgtaatggttgtgcgagatcgacggtatatttctgtaaaaagttttgcatcccgaatatttctaagaaaaaattgaatgaatagtatatttttaaatttaattccatggtacaacaggtgtgtgtgtggtggggactggggagtgattggctgtctctctctgtgtccatttgctttactaaaatctaaatttgggaggaggagacttcacttctttcaggtcaaccccctgtcgcctcaagtgagcttccccttcgtccatttcagatttgcaggggagcagccgaagcagccggcttccatggccggaactgagctgagcgtgcgtgcgctgctgccgtacgtgtgcagccatgtcagccaggttagtcaatccactgtcaatttctcttggttctgaatttcagttctctcttttcctctgcatctcctgctcctttttgttttgagaccgatttgccctgccttttctgaacaaacgagtcagcttaggcaacggaaaaactgtttgccttactagatctggccatttgctttgacaaagatgtgctgtcgacgcggcccatagcctgatttgggaggaacaaattttcttacccatgtccttcttttcctgataaaagggcagcttgtgttgtcttccggtgcttcttccataatacaaaaacagtgtgtttctgcaacagtagtgttctgttcatgggcaacccaagaagggatacatgaaactttcttctgatacgagacatccgaatttgggcgtgtcctggtctcctggacacggcaaaaaaaatctgccacaccgtatctgaactctgaacagcacacgctctctcaactgctagtcctgcacatctgaacatgcctagagaaacaactgcttgaatggaaccaatccaaagtttagatgggccccaaatccggcctgcctatatgtgcaagcccaaaatttggactacaatcctataagaaatatactacacaaatctaccaaaaaaaacaccaatgagaaacttccgttaaatttgtatgcgaaaactttcgtagaaactctgacctacggcacaaaaagttcagccattctttttgcaccaatcaccattcccctccatttttcagataattcagcagtaggtttggtttctttcgtgcaactcttgcttcggcctcgtgccgacccttcaccctccccggattccaccctcccttcctctcctcttttgctgtagcctgtagtagcttcgtcccaagaaaccaaaccaaaccaaactgaagccgaaaccaccctccttcgtctcctcctctctcgagaaaccaaatcgatcgaatccgaccgaaaccatccatggcgagcgcccctacggccgccgcctgcttcgggttgctggtggcgatgtgggccatcggattggtctcctacctcgaccagttcttgggtgccctgatgagctccgctcgagctctgccgccgctcgacgttgctgtggaggtggtgatggcggtggcggcgatcggctccctcaacaccgccatggcgtccatctacttccgtgtctacaacggccgcgccgcagctgcgaacaggcggatgctggatggtgcgtgcttcgccgtgtgggcgtcggccagcgtcctcctccacctcatcttcttcctccagccgggcgccatggacggcgctgatcaagatctgctacctctcgccgccgccgtcgtccgcgccctccttccagcttctgcggcggtgacgttcttcgcctccatcatcctcatctacgcgtatctccgtagcggcggcgccggcgccggcaccggtacctccgtgaagctcctcaccaaggtgaccaactcggctgcgcttgtcacgattgttcttagcctcgtcgtcgctgccatcgttgtcttctactccgagtaaatttgcccaaagcttgtcgaaccaaccatcgatccaatcctataccgctgcagttcgttcgggtaagcgactttaatgtctcgagtgtgtgttcatgctttgtggtgtaataagaacatatttcgctgtcaatcgtatgcatccgagtactactcttttacgcataatctgattgtggatttgacgcaaaaacatgatctattacgggaactcaactcatccggttggagtcttggagatggcgcgacggtttggtcactttggtgcatgcagtgcagcagccgaggttttgagcgcccgcctgtcgaggcgggattaaggtggccgtgccatgccagtgccggcgcctacggcggctgtcgcggttggagaggtggtctagctcgcggcggcgcccgcgatgtcgctcggcggccggcggcggcatccactggtttccgtccatgtggggcctgccgggtgacggcctgaggctgattttggggttggttgggccgtacgtcgaggcgatggcctatgttcttagccacgaaataggtgggcacggacgcacgacggggggcacggcagccggcggcggcggcggctgcggcgagcttgccggaagaagcatcagctccgtccagtttcggtggaggattagcggcccaccgtcgccgacacatgtccttgtctggttcgcagcttctggtgtggattgtggagttgtgtcgctagtgcttaacctcgaggtctggttgctcattcgtcactttttgtctggggctttgacctttgttatgccgttgcgtttgaatattttcatttttgacgcgcactcacgtagatatatactgctcgcggcagaatgtttttgttatagcagtttggtttgcctctaattagcaaccgaaaaatggaagcaggggatcgatcgtgtggtctgaaaaaaaacagtacacaagcacctaccagtgaataataacgccagctggattttaacgccgttgatgagcaagtgtgttcatttttaacgtgatcatcagcctcaccgtttcgcttatgattatctgcacaatttaatactatctccattttttaatagatgacgccgttaactttttctcacatgtttgactattcgtcttattcaaaaaatttacgtaattataatttattttgttatgagttgttttatcactcatagtactttaagtgttttaagtgtgatttatatcttatacaattgcataaaatttttgaataagacgaatggtcaaacatgtgagaaaaagtcaacggcgtcatctattaaaaaacagagggagtagcaaataaaatataatacatggataaaacttttatatacatgtcattatcttgacgatgcaaacccttgatcccttgttcgttgtcttcttttttgccaccctatctatttagcacgagggattttgtggtacttgagaaaatacctataaatatcaaaatgttactcaagataagtagtaataggaagtattaatttttacaatagaaaatataaaatcttctaattctttctcaaagatagtaaagttacccatccgttctagtgaaagatggaaggggccaattctgcatgtttttttgttgattcacgcgccatgtcctcaactccccctccgctattctgagttgccgccaccgctgtccccacctgctgcctccctcgtccctgcccgttgttaccatcctcggctccccctctgctgtcctcgcccgccgtcacccactccaccgtcctcggctacccctccgccggctgctcgatgatggagagaaatgaagatgatgtgagggagaagagagaagaggattgagtagagagagagaggtgagggaaggagatggagagatgagactgacaggtggggcctgatgattaaaaaaagaagaagaattgctgatttgactgccacgtagaaccaaaaccactccggtttaagtcgagaggagggaggttaattaatttagccggtattaatagttgaggggtgaaggatgtctggtttttggatccgagggagtaattcgtactcacctaatacttaaggggtgtaattcggactgttctcttaaagcaatacgcaaggttgagagtttccattcctgaaatgactttttcctaagaaaaatatagcggggacgataaaataaatttaccctagctgcttgtccagttgtcttgttggaggataatttctgaactcattagttttcccacatgtacaagaaaaaaaatgcacagctcaacccatgtactccctcaattctgttatactgatttctgaagtactaaatttgtcacaaaatgtattgatttctagccgtatctatcattatttcataactcaagaagtttatctttttaataccccttatttaccacctaacaacactattctactatgaatgaaaggtacttcggtcttttttttactctactaaattttcttacgattctaacattatttagttcaactaaataataataataacattttcgacataaagcaaatatatcataataagaaaaataaattacaatggtgatttaataaaactaatcttgtgttatatatagaagttgctacatttttaaataaacctggtcaaattttaagagtagaaatttaacttatttggacagagggaatatttatttgagtaaaacatgcagccctgttactttaaaaacgaatactccctccgtcaaaaaaaaaaagacaaactctaggtttccgtgtccaactttgactattcgtcttatatgatttttttttataattcgtatttttattgttgttagatgataaaacatgattaatattttatgcgtgacttgtctttttaattttttttataatttttttaaataagacggacggtcaaacgttgggcacgaaaatcagagtttgtctttttttgacggaggaagtaggtcaaagaggataaatatggggatttgacatgttctgggcacggtacaaacttcctcacaagccacgccaagccacgcccttgcatgccaatgattactcgaaaacatctttagcagatctctataatagtaggatgtggattatttttataactatttaggtgacatgcacgaaatgaggggatattccttcgagtgatgaattctcctttatagtactccaatagtagtatatgacccatagtataaaaacctaatatgggatgggagattttatattactataaatttggacatactatctgtcaatattcgtagtattagaaaatatctaacccggttctagttttttatattttgagactgacggagtattaagccttcaattaactaattaatatcctgaagctgttggtccaagcacatgcgaaccttttcagaactggttaggaatgggcgctactatcccagtccggatccagccaactgcccccatccaacagagaacataccaacaatatgaacttggagaatttaatatggatatggatttgcttgcataaaaaaatcttattatttctccgcgataaaacagcaaagcaaagtgcgtggaaactcccgttaaatgatcctgcagaagcgccctcctcctcctcctccttcctcttcctccaatttccaaaccctaccaccgaccaccgataaaagtccccaaactctccactcgctcaaccgcacccctccagtttccccacacgcctctttcctatcccaagaaaccaaatctctcagtggtaccatggcaagccgcccttcggccgctgcctccctcgggctagcggcggctgtcgccgccgctgccgctgccggattcctcacccacgtcgaccggttcggtgaaaacaccttggttggagctcctccgtcgcgagacgccgctgtccagctgatgctcctgcggctgcttgtggcggcggcggcgatgggtgccttcaacaccgccgtcgcgctcatctacgcccgcctgtacaacgccggcggcggcggcgtgaacgggaggattacacggggcgtttacctcgtcctgtttgcgtcttccggcgtgctacatgtcttcttggttcctcagctagagccaggcgtcatcgtcgatggcgctcaagaacttctgcctcctctcgccgtcgccgttgcacatgtgcttcttccaactgctgcggcggcgacgttcttcctctccatgatgctcatctacgcgcatgtcggtgccggcggcggcgccgttggggacatgatggcgatcccgacgaccaccgtgaagctcctcaccaagctggtactcgctgctgcacttgtcactgtcgttcttaccctcaccgcgaccgcccttgcctcctacgccgactgatcagcatcagcatacgcatccatcgacgacgacatagacacggtctactggtaaggaatttgagcattttaatttaatttcgtgagacaggtgccggttatgcattggtaaatgtaagatggtgctcgccttgtgctgtaacaagatgatcaggctatgcatgctgtgactgtgagtgctgcttaatggttgtggatttgatgagagagctttagcagcacggccggttgtctcagcttgacgattgcactgcatgttttgggggatggttgggagttgggacgcgatggtctcggtaattaggcaatgtggtgcccttttatcggtttcttgcttcgctgtagcgcggcgacgacgacgagctggccaacttgatcgaggaagcagctggccgggaagatcctttgtagggatactttagattgaggggctacacctaggagtttcgaagagttttttctgttgtctaacaataacaacaactcaacagaaactagaattagcttgagtttgttggaatctttggtttactaggaataatatgcatggttttcagaagtaaattggtgtactctccactaacattacctttccaaaatgtttcaaattttatgcagtggaggaagctttttcggccggaagaggagagcaagctgaaaacaaaaggtggaacagatgaagcaaatgatgacaagattaagacctccaagagcaggagtgggatagttgtgatgtttgctttccctgtttatagttgctgtaggagttctactggttgtgtttagagcttgtgactgttgtcattggggtccttttgccgtttagagttatttagctaagtgtggtccctgtaattgaatataagtgcaatataactacaagttggatatacaataacacgaatcttaatgcaagattttatggatgaaaaagtgaaagataggtgccaaagatcttgtgaatgaaaagtgaaatggagtacaagaaaatacacgcgatttagaggtacacacaacaaatcgaaatgattagagctcaagatttccatgaaatatgccattttagagacccaattccatatgaattctagagacccaattatttattattgggttaattggatctataccaatacaaatatgacatttagataaatgacactactattcatgatatcgtctacgtgccgctagaatttggagaaattggaaccccgccgctccctccatatcattttttttttgctaatctaacaaatcatgacacgtttaacattcgacgtagcaacatgtggaccaaccgaagatgcaattgctcttttaccagtagtactccctccgtttctaaatatttgacaccgttaactttttagcacatgtttgaccgttcgtcttgttcaaaaacttttgtgagatatgtaaaactatatgtatacatacaagtatatttaacattgaatcaaatgataggaaaagaattaataattactcaaattttttgaataagacgaacgatcaaacatatttaaaaaagtcaacggcgtcaaatatttagaaacggggggagtatatgctaagactgtgttcggcagccagttttcccaaatcctctctctcatgtttcacatgcatgcttttcaaactgctaaatagtgtatttttttaaaacgtttctatgtgaaaactgcttaatattgatccatttttgaaaaaaatactagtacttaattaatcacgcgctaatgaattgctccggtttccatacacaagatattagttcctaactagtcctaacgaactcaacatgagtaaaaaacttactccctccatcccattttaagcacaaccatgagttttcatttccaactttaatcatccgttttatttgaattttttttatgctccactaatttcatcgttagaatgttaggaatagtcttcttgtttaaagaaggtggaagtatttgttttctttattgatctgctctcgaattaacgaacggcacatcatattcttgacttcttggcacaccctagctatcggccaccgtacacactgcatacacaagatcggtgcagtgcacgcgtgtaacaccctaaaaattcccgataataaaaatcactaaaattttaaactttttaaaacttttacatcatactggatgttatggttgttattgcttgccaaactgtaaatcgtctcaatagaaaaatcaaattaaaagatgcacatctaagtaataactaaagtttacgacaatatattgttaaccctataagtatttatgcacaagaacgcaaagccaaataaagcacaagccaattattagtttctataatgtagattacaaattgaatgttaaatacttgaaccatgttgacaagtgtcatgacatctaagtaactaggaaaatagtcgccactacaacgaccctatatataaaggagtgtttcactagaataattaaattaatatttatatgttcatcaagtctctcatgggatggattcactcatgtaaaataatttgtcatgcaaataaattgagctttatatataaaatgcgttctagattaatattgcaccaagtctcaatttaattttatggaataatagattaaacatgtccatgtaaaatacattgttatacaaataaacttgaccaatgtgctattgtattattaaaggtcacattagaatatttaattagtttttttaagaaatatcaaagcctatatgttatattggataatttaatggaaagcaaattcatttgggaactaatgaataaccaaataaatatttaaataaaacatttgaattctcaaaacccaaaatgtatagatgacatttcaattcaaacccaatcacattcacttttacagtttagccccaccctctccctctattccccttttctttcttttggcgcactattcattgtccgccaaccgttcgatctcggcccaacctcgcgcctctctcccgtgcgccgcgccgcccctccggtcgctgctatgccgcgtgcctgccttccctattcgtgcgccacattatgcgtgcccgtgcgccgcatcgcgtcacgccacgccgcgcgggcccgccgccgaccgagccgccgaaatcccgcgcaaaagctgcggctccacgcgcgcgcgtcatcgccgtcgccatcgcgcgtcgcctcggagcagatggataacggccactgcgccatcccgcgtcacccctagccctagccaactacctttggacaggagaaccgccctcaccaagccgccactctgccacagctcccatgtgcgcgcatcgccatggccacgtccgtcaccaatgatgtcccggcgcccttctttgtatccggtgggtaaaacgaagtccccttccccagctagggctaaaactcgcagactataggatatagggtgatgatggagccacaaaacctcaatgcccttatccgattgccattagggctctagctcagctattgtgtgttggcatccttatcctccatagttttcttacatcctaagccaagccaggccatcaaaaccccatccccctctgcctttctctagtcatgcatttcatcgaacaccttgctatcactctctcaccaccgctagagatcaccattgtgaggctccccggccagagctggaggttggagggagtgggggaggttccgtgctgccgccatcgccattgggggagcagaggaccgctggacaccgggaaccacgcgtcgaacactttcgggcgtcaccaacagctagccgcctctgcttcgtccgcaccgcaccacgcgtcaccgcccttcgccgtctctccatcccggggtaaaacctcgagcctatagcatcctctacacctctaatatctagcgtcggctccagtttgtaggattaatgcctatggctgtgctgccccagccgccgttccgccgccgacgagctcaccgtggacaggccatccccggtgctcttcctcccatctttctggagaaatagaacgcccgtacgccgtatatgctcacgcactcatcaatttggtcggaaacccttcctgtcgtcctagccacttgtagccgagctcggctatggcgcagccatggcggccatgcgccccgtccctccaagcgccgccgcagccggtgggtggtcgccggagcttctccgcacctcccctggccgccgccgggtcgccctcggccggccttccgtgcgcgccgtgttcccctgctgctcccgctcggtcgagaggaagaagacgaaggttaaagacgaccttcagccgagccactgacaagctgtcccccactcctcctatttcctttagaaacttaatcctgtgaaaaagaaaatcaaagctttgaccccacatgtcagcagcggttagggataaggatatattttagattaaaaataaatgaattatgaacagtagcttttcacaatttctcggattaattcgaaattgaatctttaaactagtataacttgctcattttaactcggatttgagtgaaacttgaacctaatttcatctaaattcataagctttccaatggtatataactcactatttaataaaatatatttataattattaaataattaatatcaaatgattagattatggtcaacttaaaattatgctaataaataaaattggtattatacagtagagtagatgtaataatatttgtttctagcatgttttgtcacagtagcaaccatgtaaattaagtacagtgatgtctcaaatgaacggatgtatagcaagacactagcactatttacactatttaatgttcaattaaatccatgacttataaattatttacataaaagtttagcctcacattttgtaactaaaatataaacacatatggatgaatatctttagcttgattaggaggaatataacagagctagtgtgactagttatgttgtcggttgcctatattcagtaaatggttcaatattaatatactgttgcatacacataaccttttagataacctactagttgcatatattaaactaggtaataaatgaagaaccagtatattagctaaatactagtgctagttataaatcttgaccacacataattttaattttagttcaaccacacctgaggattgttcattattaatttataaagttatacaataacataatcagtaactataatattattaaaccataaatctaaagtacagagcgcataattgtcaaccttttatgaaaacggataaaatccatatatatacatcatgtggataattcgaataatagcttcattgataaaataataatgtaggtgaatcatggtgatgatatggtttatccttaatctccccatcgacatagccatgctataaccttagggacctgaccattttaccttcataacagatctcttccataagccaatagctagactaaaccacagattagcaaaatgtgtatgtattgtgctagttagtaccaatagagccatcgggacaatataaaatactaagaaaccttggctcttagcttgattagaatccattagcaaacacgagtagtataagcagccctaggttcgacctcaacaattatattttgcttgtgcatatttgcttgttgttgaatattggtttttctcatgtattatagaaactgtatatcggttagtcgtgagggagcgtatacagcttccaggaggtgaaggttgatcaagattatatcaagaataagaactaccctgagcaggcaagtcatcaccccatcccttgagcatgttgatcccaatcgtgaaattgttttgtttacaaataaaattgcatgcagtgatgaatatcctacttgttattatgccatgcctttgattattgcttatctcattattcccgtgtacccataattacgtatgagtccctagtcacttatgacaaatgcttagtaatgctaatttagattcatgcattctcatatttatcaaatgctttatgcttgggcaactaccttggggaaggtagttgaggtactgcatgtggagacatgagcgccacattgccatgacattgatgagatgatttgtgaaagaaaattaaaactaaacaaatgttttcgactggggcggctggaggacttgggtggtgtccggaaaaggctagtggcgtccctagtcagttaaggaccgagccatgaagttaagcatgaaacgacccccgtacaaccgtacttctcgtgtgggtatagacctagcggagtaaatagccgagcggaggcggtacccaagccgtagtggttttcttgttgtgtgtgaggcagggcctacggtggggcagccattggtaggaccgcgaggggcgggtgcctacagtggtgtcgccattggtaggattgccatgtgcaaacctaaacttaactataacttaatgaatgtgtgagtctttccccctcaggagcgccagaactcctctcactgctagaaaccttggacgcctagagtgcatgaggactaaagttcatggagcgggtactgccaaagtgaggttattgaaaggctttgtcgtggcaagtctcattcgttgggacgtaggcttatgtgttgggcaagtcgcggagtatgggtaaagtgtacatccactacagtatgagtaaaccaatctattcgaatagccgtgctcgcggatattgagcaccgagatatgtattacacttggctagactctaatttcttaatctgattgggatgggatatgcatgatgattttgtattggtgaatcaacttttctcgagaggcgagaaggggtagaccccagaaaaccatgacgaccagtggcgggaagctatccttgggaacacaatggatggtggacagaaccgtcgctgtttaatgaataatggagataaaacttgatcggtttatgttaggtcttaggtttgtgaaatgatatttgaaaactcagctttatgcaaagtaaccatagccactccttgtattgtcctgtacattactgcattttgtgtggtggcttgctgagtacttttgtactcattgttactctatatatatcttttagtagagtgttgaagagaagcccttgtttgtacgcttgcgtacctaacaagatgatcggagtgcggttctaatctaggtctcgttccccagtcgactgcttgtggcatgtcaaccgggcccttgtattattttgtcttctgctgttgtcctctgatagttgttggcctgcctggctctaatgtaagcatttaactctcttagcctgaattcattcgtgatatgtttctcttagcctgaatttattcgtgatatttgtgattcggctatatatatgtaccgactactgatgggattggtactgataaacattaaaaattttcgatttctaaaatcggggtcgacaacgctgcacatgtacttcgtgcattgtaccgcgggagagtggggagaggaattctgcttgccagccagagtcaatcagcactctatagaatctgttgatctgttccttccaccccgtgctgaaaaacacgccgtccacatctgcctttgctaccttcgcccagaaggcacgggacgggacacatgatattatcaccagaagggaaaattcactcgactttttgccaatcgttatatatttgcagcgcattcataaaactaaattatcagcaatattaacaagtagtattataaacacacttagtacgctgtattatcaaatacatggatctggttaagatgcagtggctagtgtgcctacaaggtaagcaataacacgagtatcactggattcaaaatagatgacttaggtacattagtaaaatattatagcaatttactgtagcaaacaatttgaaccattagatcaataaaatagagggctcaaattgtgtacagtaacttattctgtagccatagtagcaaatgtactgcatctcaatcccaaaatacatgaacggtgtaggtgttaattgttcatcaagcactccatcttaatcaatgtgttgttagtttgtgactgcaccaagagaggaaaacaacaaaaatagcactagttaaagatggcacggaaatttttctacaatctgcaccgctagccctgacaagtaacggtggtatactggtatggaagatagctggtttgttacttcccccgttcataaatataagtattgttagagtttttaacaaaatttaaggatgagttacaattactttgatgcttacgagagtttacttaattagaaaaggtcccgagtattgatgcaactagtgaacatttatgaaaaataatactcctaaaatacttatacttgtgaataaatatcaaattctagaaatgtgtatatttgtgaatggagagagtagttgttcatgaggattaaggataaatgtgaaactaaaaggagatagttataattggttaagattaaagaatacggagaaattaagtagatatgattatgattggtttatatctcataaaaaaagtatgtgaatgagtatactttagaaacaaatttgaacgtcaccatctatctctctattttctacttcctccatcaaaaagtaacttcatttttcatcagttccacattaaacgaatacaaatacaaggatatagaaaaagactacaatgtccatcacttcaacaagcctcagtataattggccccatttttacaaacctcaatgtctgtgtccctcgtttccaaaaacttccatgaaatgattactcaaaatattaaattattttggaccaaatatgataatgaaaaataaagttattttgacatgaagagaatattttaagatgaaccattccaaaatatagcaacctaacaaaaaatactcaatgtgtagatttgttttactatattgtgtctaattaaatactctatccgtttcaaaataaatttatttttggctcttacggtttgtcctcaaataactttatttttagtaattattatatcagattttgtgaaattagaaaataattgtaactgggagtagataaagtaagcaataattatattagcatttgataaaagtgaggataatatagtatttttattttgtattgatatgtgtgggttggatgcaaaatgatattattttaggatagagagagagagcaacatgttgttatattttggccttgtttagttgggaaaattttttaaatttggttgtcacatcggatatacggatatacatttgaagtattaaacgtagcctaataacaaaacaaattacagattccaccagaaaactgtgagacaaatttattaagcctaattaattcatcgttagcaaatgcttactgtagcaccatattgtcaaatcatggcgtaattagacttaaaagattcgcctcataatttacacgtaatatgtgtaattattttttttacatttaatactctatacatatgttcaaatattcgatgggataagttgaaaatgtttggtttgcgaaccctttgtaattgtagtattgacgtttgagtgacgcggatgatattgagtcatctgtcactgcagcagtgacgtgtgacagcataatggggtcgaagttttttcttttttttgccccctcttttcaatcatggaatcattagcgcagatcctaggcagccaatggagacctcatctgatgatgtgacgagcacgaaccggatacaggatgacggccagctcccttcacattcatcttgtcgatttcacaaattaaatactccatccatccttaaaaaaaaaaagacaaatcttgagtttccaaccgtccgtcttatttaaaaaattataaaaaaaaatttaaaaagacaagtcacgtataaaatattaattatattttatcatctaacaacaataaaaatagtaattataaaaaaatttcatataagacagacagtcaaacgttggacatggaaactcagtgtttgtctttttttggacggagggagtacggtgtatgctactcccccgtttcgtaatacaaatggaggaaaatatatagagactcaaatactccgtatatatgtaaggccggggacactcttgtctgcaccatgtggattaaattcagtcttctgatcaccagaagtcgagaacacgattcaacaaagctgatcccgccggggttactaacaactactccctctatctcataatataagggattttgagtttttttattgtttgatcactcgtcttatttaaaaaatttatgtaaatataaaaaataaaaagttgtgcttaaagtactttggataataaagtaagtcacacaaaaataaaataataattccaaatattttttgaataagacgagtggtcaaacagtgtaagtaaaagcttaaaatctcttatattatgagatagagagagtatgatatgatgcgggtgtctcagctaaggcgtcgcattgtgacttgtgagtccctaatcgctgctaagaaattcttgtgaaaatgagatgttgtcggcagattacacacatccggccggtccaagcgtaaacagtagtacatcaagtgaacacaagtaggcaaataagggacagtactatatagacggtaagcagcgatatggacgggctccagtgcaaaagagaatatagcctagagattgcagtgaccaaaatagtatcctaaggttgtgaatttaaatcttcataggaacaaatttattatttgagggctaagttctaaatttaaaaaggtcacatatatccggttggatataaagaccaggtaaaaaaaaccttctctggaaaaaaatagcctggctctaatacatgacaaaacaatattagtttttgccatctcttgggttgttacatcatactcggtaacacggatatcattttcgaccggtggaagatgtacagctggtcatcctttgtcccataaatttagtaatacagctccttctcgaaatatatgacgttggttaatacatttttaactaaccaacaattatatttgaacctttcactagtggagaaaggactagtagagaaagggtttttacttccggttcgtaatcagaaatcctaacgcgcgggtgatcgcccccgcgctgccctagcgatcaccccacgcctccccctatgctcctctctcttcttcccctttctcctcctcttcttctcttcctattatagtacatcacaaaaaaaaattaaaaaaacaaaaagttagaaatatttatgtatagaaatactatatataaaaaatatttgaattcaaattcaaatttgaatcgggtacgtaaacttttgacttataaactttacgtctataaactttgggtgtatagaaatactatatatagaaaatatttgaattcaatttgaatcacatataattcaaattcaaatttgaaacgggtatataaactttaggtttataaacttttgacttataaactttatgtctgtaaacttttgacttataaactttaggtatataaactttaggtgtataaactttatatgtatagaaatactatatatgaaaaatatttgaattcaaattcaaatttgaatcggatatataaacttttaacttctaaactttgggtctctaaactttagatgtgtaaacttgaggtgtataaattttaggtgcataaatttactaaaataggaaagtaatgcggtgacaaaaaaggaaatcaggtagagggaggaagggagagggaggggggcgaattgatcgctacccccatctccaggcgagcgatcgcccattagggtcccccgttcgtaattccccttagttccgattttctaaccgggactacgaatccagaaactaaagatcgttatctttagtctcgggtgaaaaaaccgaaagtaaaaatccatttttagtcccggttggtaacactaacctggactaaagataaagcatttttagtcccggttagtgttatcaatcggaactaaagaggctagatccggttgctctttattcttttcttttcttcattgtttttaaatatattgatttcaccccatcctgtccccaaaatcccaaatcaaacatcctcaaattgcctccaaatccacaaatcgatcatctcaaatactcaagttcatcacaaaatcttaaaaaaaattacatcacaacttctacaaaattcatcacatattcacatcacacataagtcaaatacatcacacaacaatctcatatccaatcaaatacatcacacaccaatctcagattcttcaaaaaagaaataggaaaaaaccgaagccggttgctttcaataaagccgtcgaaccgtggggccggacggccggtcaaccgtgcacgtttgcctgggccggacggacactttaagccctggcttgccttaccagggtcttgtagttcaaaatatggagaggcaattgagatttcggggaatagtggtctaagtttggggggagggagttaaaaagcttgggaggagattaaggttaacgaaatgtcccaaaggtataacttataagggaaggtaggaatttcnctcaatccgaaaggcgccatcgccctacgaaatgggg

SEQ ID NO: 83227 - DNA, 701 bp, Oryza sativa
  unsure (1)..(701): unsure at all n locations
tagaatactcaagcttgcgtgcctgtctggctgattctatatgagccgcgtaggcttcacctggctgaccatttacctgaagaggccatcttcacaggtccatcacacatacagtgatggttgttcgcaatacaagctatgtaatcaacattgtccccgtaggccaggaacttgttcatgcccgactgattcgttgccacaacttattctactcataattgctatcactattcatctttatatacggaatggatgaccttcattactcactcacatattgcacagtccaattcatatatactgtcgctcctactcatctatgacgcccttnnnncctctttgtatacggacgtcatgaactacactatcttacacacgaagaccaccttcgctaactggctggtcgttttctacacatccttcagttggaggaacatgcacaccttgacaatgatctccttggtacgacaataccacagcattgggtatatcctcattgtcattatgagccacactccactagtgtctatgagataatttatgaacaactcgacatttcggatgacacttggtgtctaacacataaaatacctttgttgcttgtggtgctagaataaatggatcatctttgtaccacatgctgccatggattatgcttctgaagaacccatcttacttcatacggaacttcttttcatgag

SEQ ID NO: 83228 - DNA, 714 bp, Oryza sativa
cagtagtccatcaatgaactatctaagttggctattcaatttcacaatgaaactggagcatttcccatttggtaagtcgacatgttcttgttcgctgtaatattgggttgtcaactgaagattcatattcatattttgagaaatctgagtgtttgtctaatttcagttgtcattactgcacataaatttgaaaatcaagacaacctcaaagtcaacatacaaatggaaatgtctccgcaattgttgaaagtcttgcaatagttttttgtgttgtgtttagactggcgtagctacttaaattgcatcaaaagcatcctgacaattaaatcgatgtgctattatggtcttttatcgcataatgttagtgcgctggattgtgttttcatgttttgttggaaattttgtctataacatggcaagggttttctgttgcaacataatcatttcagtatcgtgcagctgacaatggaaaacaatttgcaattgtacccaaaattcaacaatcttgtcagcctgactcttggtcaatggtgtttggatgcgaacttctatggattggttgtcttccttcagaacgcaccaaaactggagaagctaactctggaacttgaaaaggtaaatcgtttcatccatatgtatactgacccttctcgagagatctttcacaaacacacatgtcaatcagggatgtagcttatttgttttctttctata

SEQ ID NO: 83229 - DNA, 1784 bp, Oryza sativa
cgtgttccggcggcgcatgacgtgttcatgggagaaatactactgccggtgatgacagagtggatgagagttccatggatacgtaggtatccatttgtgccgcctccgccgccggagtcgccggaggaggaggagacggtcgtacctcgtcggaggaggaggcggagagcaatgccaagggacgccggccatggccgtgcggcgccgggacatggcggcgacaagaagcagtggcgtggcgccggcgcggttcattcgccgtcttccgggttccgatggaaacaccggtgaccgcccgccggcgatgaactttgcttaatttcgccgttacagattttacttagtttatttattttctgtggatgtttttctttgtttgctatggacattttctgagtgtttttgagattatcatctgaaactaaaaatggttagtactaaccacaaatatgtacgaacaatcgagaagtagatatgaggttaaatacttaataattaattagaaatttaatcgtgaaaaattagagatctaataaactgaacatgtctttaaccaaccagaaggcccgtgaaagaacataggagtattgtttaagctagtgccgataagacttctctaatttatcaaatttgtagaaagacatcgcaacattctaaagcatactatcaaaaatatattcaatatattcaatgtttatatttaatgaaactaatttaatttaatgttatacgagttactatatttctccataaacttgcttatataagtttatcttagaaaaaatcaaaacgatttatgaagtatgtattataagtagattaaaaatcaatgtttaaaataatagactatgataaaacggttttaaaattaatattttggctatggccgataaggcagtgagctgtgagcagatgatcatgttggtctttttcttctctttttcgatgacttcaaccagatgtgtctaaccatgcatcgaaaagcttacgacgataaattcaagatgatgcagctcgcaatctgattcgatccattactatttttttcaaaaaaaatatttgacgaaacaacctaagcaatttgttcttacatggcattctccagattgctttgacattatggctgtcatattaaatctccataccggtcgaaacttagtggtcacacgtcaatcgactatatcttcctctgtctagttcgtgatgcctatctaatactacctatgttttttaatacttcaccgtcccaaaatataaatatttttaaccctgacacggtcatcgagatgctattttgaccaacaatatttataaaagtaagatgttttaaataaaaagagttgcatacatgatagtttgtttaataataaatctagtaaacttcaattttacatgattgattttttttattttttctgctattaatggtcaacgtaaacaatgtttgacttgtcattatgctaaaaatgcttatatttaagacggagggagtatatgatggcattgattttttaacaaacatttatcactcgtcttattcaaaatttttatgtaaatataaaaatatttaagtcatatttaaagaacatttgatgataaatcaagtcatgataaaataaataataattaaatatttttttaataaaataaatggttaaacgtatttttaaaaattaacgatgtcatatattaaaaagctgagggaataccttttttgggaaatcgatcgatggcgtgttgttctagagtgccgaggttttttagttattattgttgttggaggt

SEQ ID NO: 83230 - DNA, 761 bp, Oryza sativa
agtccgcgtacatccattgccgatccatctacatgaaatgcaaaaaaaccgtaaaaatattcaacgaaagtgaaacccactaaacagtcatacaataatgacatatcattatacatacaataattataaaataatcccacaaattattctttttgtaattatttttgaagtttttaaactaatatttaatgtgttgtacttcttttaattttcaatttagtttgttttctattattttagattaattttcaatatattttcattctcaactattttataaaaactttttataaattgtaaataaacaaaatttctatacattcttcttccctacacaaattttctctctcatcaacttccaacaaagttttagagacaataatgtgtaccaaacatagcttcaaatgtaatatgacaacaaaaaaaatattggaggatgaagttgctaaccttttagacacctccaatttgtatatgatcaccaaaataaattcacaataaaatttggcaagacctcccctctgaagaattttgaagcttggctcggactggaggaagaagaagacatatataaagatcactactggccctcaccgtcgccgtcgtcgaaggtggagaacaatgccaagggacgccggccatggctatgcggctgtgggacatggcggcgacaagaagccacggaatggcgccagcgcggttcactcgttgtcttcccggttccgatggaagcaccggtgaccgccaacaacgtacttttg

SEQ ID NO: 83231 - DNA, 52819 bp, Oryza sativa
  unsure (1)..(52819): unsure at all n locations
aattcctgcagccctgaagtctcctcctcccaaatttagattttagtaaagcaaatggacacagagagagacagccaatcactccccagtccccaccacacacacacctgttgtaccatggaattaaatttaaaaatatactattcattcaattttttcttagaaatattcgggatgcaaaactttttacagaaatataccgtcgatctcgcacaaccattacacgaaaatgacataggcgtgacgttgcggacggtatcgcgcggggaaagcgcgagaccgcgcggtctcgcggaacagaagagcgagaccgttcggaatcaaatagcgacacggtccaaaggctcaatttgattagtgattaaatacttaattaacaattaactaataataatttagtaattaattatcctaattggtgattaattatttattaattaatcattaatgaggataattaaccgctaattaaattgtcattgaacggtatcgctcatgcaatgagcgacagcgctcggtctcctttttcaatccgtgagaccacgcggtctcgcccttcccacacgcgatatcgtccgcgacgtcattgtcacgtcactttcgcgtaacgtttgtgcgagaccgatggtatatttatgtaaaaaattttacatccgaaatatttctgagaaaaaattgaatgaatagtatattttcaaatttaattcttgtaccatggcaccaccacaaaacatgacaacgcatgtgttacgaagtatagtaagtttggaaccttaatccgccctcaattgggtgaaacatgtcactggatttctacaggcaaacatgtcgtgctaggatgctagctaggagcagcagaaattggctttgggcacggtaaaaacatggtcaatggagacggttacccacaactccacaagagctatttttccttttcggtttcaaaagagaactatatttatttgctcgtctcacgcgacagtcacgcagtgacacagtggtgaattggtgatccttgctgatctgatcagcatgttgttcagttgttccaaatcctcacacacgatcccaaaaggaggaaatctgtcagttgtaatgactaatgacaggggaaagaaaacaagtactccctccgtcttaaaataagtgcagttttagcactgttcatgttcaacgtttgaccgttcgttctatttgaaaaaatattatgattagtatttttattgttattagatgataaaacatgaatagtactttatgtgtgactaatttttttaatattttttataaattttacaaataagacggatggtcaaaatgctaaacacgaatatctatggctacacttattttgggacggaggtagtaacaaaaagcattcgaaaggaagcacctttcacgagttgcaaacgtggtcaggaaacgcctttctgaattccgtcggcagatcaccgccgagttgcaaccagggcggcatctcatctccagaacctcgccgatgtattacggacatgctggtgctggtggaagagtaaaatctcaggccaacatgcagcaacaacaggcacgaataacacttgttcagaatgccactacgacagattctactccaacttcagtaggtacttattttcgtcggcaatagaccttcagaaagagcggcacgaggacatggcctgactagccttgttcatcaccagccatcatcaataataacatgggatacaaaaaaattatggagaaaatattcacttcacttgtgcctgtcgcttttcggctgcaccatcaatcatctgtgcactgtgctacatgcatactcctactacatgaaacaaaatgttgcaatcagggtttacaaaactggtagaaaccatccagttttgtgaaatctggaggttctaagatcacaatccactcggtaaatttacatttcaaaaaagaaaaaaacaatagagcacattttaaactggttaagttagaaaaaaatcaaactgaatatttaaattttgacataacttggttacatttgaacagtttttttttctgaaaaaggattgtcatctgtttcgtcaaccctaactacacgcttacactcatatgtagaggttgtttagatccagggggtgtaaagttttggcgtgtcatatcggatatacggacacacatttgaagtgttaaacatagactaataacaaaacaaattacagattccgcctataaattgcgagatgaatttattatgcctaattaatccgtcattaacacatatttattggagcaccattgttaaatcatggtctaattaggcttaaaaaatgagtctcgtaatttacatgcaaactgtgtaattagtttttttttgtctatgtttaatactccatacatgtgtctaaacgttcaatgtgacagggtgtaaaatgtttgcatggaactaaacaccggacatgttgttctgagcctgtgctggctgccactttccaacaatcaccacaattttggcaagctgaactgtgatagacgttaaaccacaatgaagctagtgatccaaactcccagagccttcaaatgtaagacacaaatttagtcctttgatgagatatctagcaaagaacaatggacaaaacgagtgcccaaagaaaaggctcgtggcctttccagtttccaactttccatcacagggggaaggttcgaaaggaaccgcacagagcagaagtagacgaaagactcacaccactccactgggcactagcagtagtagcgcaatgatagcaaagtacgaagatttcccaaagaaaaggttcccattccttcaacgagaagatgaccagttcagcccactgaccgagacactgctccaaagagagatgcgaacacgaacccaaatcacatttcacatatcgggttgtgtttagttcagcgcaaagtttatattttgattaaaattggagatgatatgactgaaaaattatgtgtgtatgacaggttgatgtgatagaaaagaactgaagtttggatccaaactttgaatctaaacacaacctcggttctcccagcacacgattaaaaatgcaaaggatgaaacgcacaccacttcacaactcagttactacgccctcaaagagaacagaaaaaaaaaaaaggaaaagaaagtactccgtagcactagtgtcaccagtgggcagtggtctgcacacgatgcactgcagcaggtggtaccgggtacacgggacacagggccccgggcatggtatgtgaggtcccgttcatttctccaccaagagttggatgaagataaaaaattttgtggtacgttttttaaactgttaaatggtgttttgtgcgaaaactttctatatgaaatttgctctaaatatcatattaattttaatttttttaaggttataataattaaaactcaatcaatcatacgttaatatcacctcgttttacgtaaaaaacttaatctccatcttcaggagaaaagaacgccaccgaatcttcatagtcaacaggcgcaggcgaaggcacaacgcagacacatcaggcagcggggggtgggacgacgaggaagaaagcaaaccgccgaggacgcaagggcctgtttagttcgcgaacgaaaatttttagcgtgtctcatcggacatatggacacacatttaaatgttaaacatagactaataacaaaacaaattacatattccgcctggaaactgcgagacgaatttattaagcctaattaatttgtcattagcaaatgtctactgtagcaccacattgttaaatcatggtacaattaggcttaaaagattcgtctcacaatttacacgtaatatgtgtagttttttttatctatatttaatactccatacacgtgtctaaacattagatgtgacaggttgaaaaaattttgttcgggaacaacacacaggctcaataatcacaaccatcctgtggaagcggtccgtggccgccctcggcagcgtccggccggtgccgcgccctgcggaagaaaaggcgagaagcgtggtgccgaccaccgtggcggcggcggcgacatccggtacgtacgtgctcatcatatcatcacaagaggtctccattggctgccgcagctaggatctgcgcctgcgctaacgactccatgattgaaaagagggaggaaagaaaaaccttcaacccgtttggctaccacacgtcactgctgcactggccgatgacgcaatacaaactgcgtcactccaaacgtcactactgcactactccctctgtttgaggaattttttatagggacacgattattaagaaattggataaaattaaatagggaaaatttatgattggacaaaaagtgaaggtgggtgaaaaaattaaatggtggagaattgtgattgggaaaagaacattggtgaaaaatttgtcatattacttgttggagcaggttgcagattgtagaaaaattatgtgccctcttaagtcttatttttgttgttgtcctctgtttagtgaagtcacaaacttgcaaatcacaatatagtaagatctctacttaaaaaataattttactgtacgggaacttcaaaatcgaccttcatttttgcatgtagctacttaagagatccgcatgcaaaaatttatttttactgtcgagtctcttaaggggccacatgcaaaaataagtatattttcacatgcaggcctcttacttagtccgcatgtgaaagtatcctgctcttcttcatagttttttcccctcctctctctttccctcaccacttcaatttttttccacctcgcatcctctctctccccctccgtctactgatgtctctctctctcctctcctctcctccgagtgggagcgggcggcagtgggcagcggctgggcagctcggcggcctcaggtggcgccgtcccgcgtggatccgacggcggggtggcccatcccagcgtggttctagtgccggcgacgatgacgggcggttgggatggagaatgcgatgttggtgacgagcgggcggtgggggtggcagatccagcgctttgatggagacgacaacagcaggcggcgggctagggtttggggttttttatttttatctttttttttgccgaatttattttcgcatgcggccggtataggtgacaacataagatgcgttgctcgcgtgcaaaagtccgattttcattggccgtatgtaaaattcacttttggtcgcatgtaaaaatgatttctgtagcagtggatggagtgattgatgagcaattaagacctccacaaatatgatttataactcagtaatagctgtgttttttaatatttgttgctgatactgtgtatctttacatttaataacgctcttcaataatcctcccttcgtgttaggttataagacgttttgactttggtcaaagtcaaactatttcaagtttgacaaatatggtaatatttataatactatgttagtttatcaactcaataattgaatatattttcataataaatttatcttgggttgaaaatgttattacttttttctataaatttagtcaaaattaaagcagtttaatttcgactaaagtcaaaacgtcttataacatgaacggataaagtataatatatattgattggtaaagtcgagtgatttttcccctctcgtgataataccctctgcctcgtgccttctgggcgaaggtatgccatgcaaatgtggacggctaaagagtcatcaaaattttagaacggcgttttttcagcacgggtggaacgggcttttcgcctgattctccagctcgcagtgctgagtgctgattggctctggttcctttcgattggggcaaccagaattcctctcccggtacaatgcacaaagtacaggtggctcgtgcactgcaccgatcttgtgtacgcagtgtgtacgtaactttgtggccgacaaggagtgccaagaagtcaagaatctgccgttcgttaactcgagagcggatatatataatccttatatcccaaaataaattaatcccatacagatatatcttatccacatacgagataaacttattctgaaacgaaaaaagtatataggaacaaaaaaataattttccatgtaaaaaaaagataagtattttactagcatactaaaaaaaggtaagggtaagggtatgtttggttcatccacatattgccacgtcgaaggttaaatatgttgcagtttattaagataggcatttagttgattattttagctgtgataagccctactttactcatcactagtatatcccgattcgtactactactccctccatcccaaaatataacaacttcttcactaatattctctttcttaccaatcacaaccctctaccattcacttttcccatctatctccactactcatccaatcacaaccctccaccattcacttctacctatttttttaataaccgtgtccaagcctaaaattttttatattctcggacggagaaagtatattactatattttagaataaatagtgtatttaaatttgtaccacacttatgaccatactttatgggctttgttacatctataataggttgaattagataaagttaggcatcaaccaaaaaaatcaacctaaaaccaacctgtagccagcatgcagcagaagacgaacaacacaggtcgagaaaacatgaacagaagatcaggactagcttttaggatccgacacatcttctgttgcgcactatatatatgtatttttaccactactgctactttcactcaagacggtatattttccgaggacggctgtccgttgctcatgactactccctccgtccccagaaaaaagggtaaaccttgatttccgtgtccaactttgactgtccgtcttatatgaaatttttttataattcgtattttcattattgttagatgataaaatatgattaatattttatacgtgacttgtctttttaatttttttcataattttttcaaataaaacgaacaattaaacattggacacggaaatcagggtttgtctttttttaggacggagggagtagtcttgttcatccccagtcaccgtaaagaaaatttcacttcactttgcacgttgccttttgggttaaaatcaaccgtgagaatgtgatgataacaggaaaaagaaaatgctgtgcggcaatcatatggcagtcaaaccggccgtgtgctgctatgagccagaatgtcttttgcaatgctgcccaaggccccaccaccatagactgtttttcattttaacttttaactagtgaccagtcgactgttatttttaatttttcacccggtgatgattataccacaatcaagctgatgatccaaactcaaagaggcccaaacgatagtggagtatctgtcaaagaatattagacaaaacgggcgccacaagaaaaggtaatggccaaagcttcggaagggaaataaaggtacacgtacacagaggttggaccgagatgcaaagagcagctcccacttttggctaaaatcgaacctttgcacaaaaagagagcacatcgttagagttgaatgatgtgtcacctagaaaatcgactttcaaatagaaatcgaacgcaagcaaataaaaatattttttttgtcaggttgcacgagggggaggcagacatggataagactgagcgaatcccacaaatcaatttctacactgtagcgattgaattgaaattttgttcgcttgaggcctggtttagttcccaacttttttaaaaaaacttttaacttttccatcacatcaaaatttttctacacacaaaaacttccaacttttccgttacatcgtttcaatttcaatcaaatttttaattttagtgcgaactaaagagtcaaccgaactaatcccaccaacactacaggtgtcctgaagagtgtcgtactccattccaccagtagatgtacttctccttccctccattccactgggggttgaagattgcttgtccaaatttataaccaggatttaagttttttttgactgagggagtattgatatacaataacagcatatgtcttactccctctgtaaaaaaaagataacctagtattaggatgtaacatacaacgaatatagacatctacatctactactacatatatttccgttcatgtgtgatgtcctttcccttaaaacgcttacaagaggttaccggaaaagtttatgaaacggcaatcgcagaaaaaaaatgtatattagaaaacctatacaataacgcagatcatcgtcgcaagacctctatgtagagttcgagtgaacggttactctgcaatgtccacaattagacattgtactagaatagttgcttccaagctcaccattacacatttaaccttcaaattcgggatcctaatatttacaccgagaaatgttggacatgtcataataccactttgtaaccatgacaaagcaaaaacaagtatactactctataaaaaaaaagactaatcctaacaacgaatctggacgcgcgcatggattggtcttattccaacttcaccgcacatcaaacacagaaacaagtacattgaacaattaagacacatatactttggtctttgtatttaaaagaaaaaacagagtccatttggagttccgtcgctccaagataggccaggacagttctatgagaggagaggacctgcggaagaagagagcgaaaaagctcataggagcagtacttgaccccctttttctccgtgaggaggattcgccgtttcgggctggctttcggcagtgtttcgctatcttggatgcggacggttggattggatagcgagtgggggtggatagatctgcgaggaagaacaacagatgctgttcgcggacaacaatggaggacagcatccgttgttgtttctcctcacggatgatcacatgaatatacaagagccatgtcaaacagtttccctgcaagaaaatgatgtcacacggtcgttttctgtaccctttctctgcacctgaatggcgcacacaactttgcgctatcaatctactatagccgtgattagttcctccttcaaattttttttaacgtatacggatgcacatttgaagtattaaatatagactaataacaaaacaaattatagatttcgcctgtaaattgcgagatgtatttattaagcctaattaatctgttattagcaaatgtttactgtagcaccacattgtcaaatcatgatgtaattagactcaaaagatccgtctcacaattttacatgcaaactgtgtaattggttttttatcaacattttaatgctttatgcatgtgtctaaatatttaatgtaacggaatttttgaaagtttgaagaaaagtaaacagaacttataatgtacttccacatgcagctagacgaaccatttccgacagacggttacattgcatttccctcacatttccacacgttcaaactggaccagacagctagacaaggattgggccttttttttttcttttctgagaacggattgggcgattgcccataacctctacgagataatccaaaaaataccattgacaaatatccaaatacaagaaatatcattgacaagcacccaaatacaagaaatgctatcgtacaagtgtgaggaatacaagaaatcccaagaaataccatcgtacaaacgatttttgtcctaaaaatactatcgttgttagggttccatccattttgcactgttaaatacattgtttatcctatagcacttaacgacgcggaatggacggaaccctgacggcgatggtatttttgggacaaaatcgtttgtacgattgtatttcttggagctcatatttgtcgatgatattttttggatttggatgcttgtcaatgacatattttagattatctctaactttatttgattgtcatcccgctgtctataacatgtgggccctcatgtgtctatgacatgtgggtccagtggtaaataatttagcactatttataagagtggcaaatagttaattattcgatggtagctaggtactagtaccgtactagcaatccggtgtgaacggcggcagggcacgagtatgagtatgagtatgagtacatgtttgaacggcatattttccgaatatgccacacgggttcctttcgcttgcgtggcccccgcccttcaaccggtgggctctgttgggcttttcgccgtgcccgagttgtccagccatgacccaatgccgcaaccgcaatgcgtgcactttgancnccatgagcaanganctntgtatgccttgagggtgtgtgtgcaaggagaatcccctctgctgtgcgacatggcgcttaaagtgcacgcattacgacgttccccagtgcacacaagatggataaaatacgagtaatgcatggttgtaacacgtgacatttgcttctctcttttttttttttttgaaactctagtgggacaaagattgtgatctccaaactatagtactgcaatacgaggccaacatgcagcaccagaaaagcaaaactgtatagtattgtagaaacggcatgggcacatgacaagaaactgtggctagccttgttcacaccaggcatcgtgataagaaaggacaaaactttcgttgagaaaatttcacttcacttcgcttttggcagaaaccatcctccatccaggaaacaagttgcaaaaatcatatggcaatcgaaccggccgtgttgctccgggcgagactctggtggctgtaactatagggtcttttttcttcgcgaaaagaaaatttttaggtgtcatatcggatgtttaacaaatgtcggaaggggttttcggacacgaatgaaaaaaattaattttataacttgtctaaaaaccacgagacgaatctgttaagtttaattaatccgtcattagcacatgagggttactgtagcacttatagctaatcatggactaattaggcccaaaagattcgtctcgcgatttctcccctaactgtacaattagtttttttaatctatatttattgctctatacatgtgtccaaaaatttgatacgatgtttttggaaaaaatttttagggaactaaaccatgcctatcaaacaatcactacaactttcgctaggctatgcctcttacgataacgagcccgaggagatgacagttgctgaaatgctgatggacggcaaaccacaatcaaggccctgtttatagcccaccccaaaattttacatcctattacatcgaacgtttaaacacatgtataaagtaataaatatagcttaaaaaataactaattgcacagattacgactagtctgcgagacgaatcttttaagcctaatttctccataatttgataatatggtgctacagtaaatatttactaatgatagattaagtaggcttaataaattcgtctcgcggtttactaacagattctgtaattagttattttattagtgcccgaacactttatagccctagatctaaacacccccaaagctgtgcgatccaaactcccagacccctcaaatatggtactgcaagtctgcaactaaagacaggaaaaaaaaataactcgaacattggataataacgagtgccaagacaaaaggctcgtggcctttccatcacaggcgaatgttggaaaggggaagagcgaagcagaaaaaagagtactcaacagccccaccccacttagtagaagtaccccatgatagcaaagtattccctccatctacttttgatagtcatattttatcttgtcacacagactaaggataagtaattctaattatcatccatttaaacatgctactagtcattcctcgtaaacaagcgattcattaatatttatatttctcaatacccatgtagccaatcgtgtgtggaagaatggatagttatgcattaaatccgagaaagtcattaagatgatagtttattgtattgaaatatgcctatcaaaaatatttttttcagatttggaaatatgactatcaacaatagatggagggagtactacgatagattttctgttatctgtgtgggccctttccaaaaggttgctttccaaaacatggctggagactgccctagcaattcacttcaacgagatgatgttcaagttcaacaaaagctttgtatttctcgatcacataaatttggcaaatgggatgaggcaaacacgacgaaccaaaaaggcatttatctagtgatagacactaaaccacaatcaagctagtgatccaaactcccagagccttcaaatgtaatatacaaattagtcctttgatgaggtatctagcaaagaacaatggacaaaacgagtgccaaaagaaaaggctcgtggcctttctagtttccaactttccatcacaggcgaaggttcgaaagggaccggacagagcagaagcagacgaaactccgggttgagtacttcctccgtctcattaaaaaccaatcagtatcagacgtgacacattatagtactacgaatctgaacatacatatgtccagattcatcgtacatgtcactttcggttctagattcgttttttatgggacggagggagtaggcactagcagtagtagcgcaatgatagcgaagaaaggtttcctttacgaaacatgggtgcatgcagaattcacgaatggtactggtctactagtactagcagtaaggccatcacagtgagtcatcaagttttgatgttccacaagaccacatacaagtagcttgtagtgggtcccaccaatactactttcccctcccccctctctctcccccactcttcctttccccaccgcaggagtcgggcggagacagaggtcgcggaggtcgggcggtccggccgggcggcggatcgtgggatcaaccttggacggcagcggcatgcgcggcggcgggcggcggcgtcggtcagcaccctcctcccctggccagctcgccgacgagtcctaccgcgccatcatccccggtcgccaaggtggtcggactcgctgtcacggctgccgcgggagtcggcgcctccgctgccgccgttctcaagagccctgccacgggagtcggcgcctccggcgccgtccttccctccccggtcgacgccctcctcccccggccgacgccttcctcccctggccggcgcgccgaggacgctgcctgccatagtcgacaccaaggcggcgagctcgatgaggccggcgacgtcctcaacttcttcagtcccctcccctccccctcgcttccggcggctgtcgagctcgcggcggcggggatcgacgtcggtgggcggatcgagcttgccggctccggaggtgtcctcgccgctaatggcgacccgtcgagctcgggtggtggcctcgccggcgacgaccaccaccacctagcatgggatgtgggagcatggcaggggaaccgccgccacggccggtggtgaggtggagtgaggtgtagacgctgctatgcacgatgattgaggaatcactgacaactttgatggaatcgctgacaactttgacgaggaacgtggagctttctttggctccgcgttcttcagtttctagcgtgagaagtgcacgtggctgggaatctctgatgttaaagggggaagccgaatgccatgtcacgcactgtgaacgccctaatatattccatttcttgcccattccttcaacgagatgatatccagttcagcccactgaccgagacactactccaaagagagaagcaaacacgaacccaaagcacattgtgtacatacaccaccgcactaccgagtaccgagtacgttctcccagcgtaaaatgcaaaaggatgaaacgcacaccactttagtattacgccctcaagaaaacagaaaaaaacaagtagcactcgaccactcgtgtcgccagtgcaggactcggtcacggcgatcgggcgatgtgaatcttcagagtcaacaggcgcagccgaagacacgacgcggacatgcgtcgacgacgacgacgagcgggacggcgaggaagaaggcaaccgccaaggccgtaaccatgaccatcttgtgggagcgttccgtggccggcgtcgtggcagcgtccggcgtcgcggccgcatgtttcgccttgcggaagcggaggacgaggatcgtggtgccgaccacggtggcagcggcgacgccgacgacgggcacggtggcgagcggagcaaggaggcgctgcgatggcgcgtcgaggatgccgaccgcgaggcgccaaggggcaacgaggacgaggcagatggcggcgagggacaccgaaagggtcggcttgataccgcgctccgtggcggtcgcggcaggggtggcgccggcgccggctccaccgtgcgcattcggaagaagcacgccgcggacgcgcgaggcgcaggcgcccacgacgagggcgactccggcgaaggcgagcgggacgaggtgcccggactggaacaatggcaggacgagcagggacgcggagacgaggaacgcgacggccagggaaaccaccagcgtcatctgcgcgaacgggtcatcagcgaccgccgcacccgctgcgccgcgcccggcacgggccgcgccgggcacagcgcgcggtttgcggaagaagcgcgcgagaagcatggtgccgagggcgggcgcggtgaccgcggcgatgacgaagacggcgatgaggatgtcgacgagggggctcttcccggcgaaggcaagcaggagacgcagcgcgtctggtccgcccagagcgcccgcgcccatggccacgacgatgatgttccgaataactcgagacattggggctcaccgcctcagaactctgctcttccttgtgctcgttggcctctctctgttttttcttttttttttttggcaccgttggcttctgtttgattcacgattctcgcctacaaccgcaataatatatagtatgtggaagggtatctgcttgtgcgtttcttttttctttctttctttttttttttacatgtgtgcttttgcgtttctggacacactcaccacacatcatcgccgccggcagaggctgggcgggtcgttatcatgccagcgtggtccccttggagatccaaacgattcgaccaatttcatgtatggacacgttgatatacgggtagtacaaagacggtgaggaccggaagtgatcgcgattcgcgagtttcctttgaatcgatccgtaacgtactccacagggccgaaaatgatcgtgattcggaattcgcaacagctcgttgcggtgacaaaccggactacataactgagttgccattgattgcgtattttgcgtcgtagatctctgtttcctcgcaattcgcaagataggtactctactccttacatccaaaaacttcttcatttctcattatctttatcctaaaatagtttcatctttcaaaagtcattccattgttgtttgtaaaggtgaaggataaatataccgaggctagataaaattgcattgagatttcttactttgatgataaacaaaattattttggttttaaaaaaaaataaacaaagctattttgaaatggaggtagtagcattgttgatgataaagcggtgacacaataggcagtaatatgttgctcctccactgtttcccgcgagagtgtgccattgtgcaagttatttaattacggatgacattttggacacgccatttttcttcatttccccccttctccctactgcactttacctgttaattgtaatgataaggagaaaaaggaaaagaaatcacagttatataggctctgtttagttgatggtaaagtttagattttagttgaaattggagatgatgtgactaaaaagttgtatatatatgacatgttaatatgatggaaaaagactgaagtttgaattcaaactttggatctaaacacaggcatagtcgagaatttggggatggcgtgttcacacttcacacgcccaagtaatttattcggtcagtgagctggagaaggaagcaaattacgtttggccatcccatctttccaatttcgatgaccgagaatctgagatgcaatcctgctactttcactcaagacggtatgttttccgaggacggctgtacgttgctgatgactagtcttgttcatcctcagtcgccgtaaaggaaatttcacttcactttgcacgttgctttttgggttaaaatcaaaccatgagaatttgatgataagagcaaggctaatagtgaaaagtagtagtcggcggtagtacatgttcaggtcatttaaagttaatactgtatattgtttatataaaagattggctctagagtctagatgtgctttacggaagcaagaataggtttaaagtcaagtgctatggtagatgtgactatcacctctaaatttatctattttattcaatcatgaactaagaggcaacccatacaatgtatcacctctagtacacaaataccaatatatctaatactctcacatctttcttgaaatttgtgtggaggttacctcttgatttaggggtggctcatcatctctctcctcacttctctcctccacatcatcacttaatccaatgtggcattcttagggataatatatgggtcattatagtacttgccctaattgttacatgtacaggtgatcaaaactaaactccatctctgtagcccatcctgcttcagcatgaaactaaactagtacttaaaatcacacagtatgcatatgcacataagatcaagtaactgaactatagacccaccaagcgaataaaatatttcatcttgcctaatttaccgtgctatcgtccggcgcttgcagaagcgctcgtttcgctctctctcatgctttctccctccacgtatgataatactgatgtggtggttcctagcgccagctgagttcagtactattagagcaagttcaatagtatagccaactactagctccaattcatctataccaatctaatagctcattcatacaatagttacatactacactattaatacctggtcccacctgtcatacacacactatgtcttggagtccgtgctacagctggctacaaatatgtagcccgttgcccttctctctcctcatttatctccttaaaatatgtttgcagctggcttatagcctgctattgtacctgctcttagggtatttacaatgcaagctatgggacccatagccttagcctcaaaacttggtccaaggacacccttcccacagtgcaagcacccatagtcagggtaccaagcctacagccggtgggccccacgaaaaggaatcgtcacattgagtactactcgcgcggaccgattcgtcctcctttcccgaacagccctcgcgcgcctcctcgagtactactcacgctgcctcgcctcctcctccctctccgcgacgccgatgggaagcggtggcgagagtcgtccccggcggaggcggctggcgcggcggtggcgagaggtgtccccggcggcttgcgcggcgttggtgggaggcgtccccggcggagacgactggcgcggtggcggcgggaggcatccccggcggcagcggcttgcgcggcgtcggcaggaggcatccccgacgaaggcggctggctgacgagacgggtaggaggaaggaggcaatggacgccgttcttttttttttgttcgtttttgttctttagattcttgatttgtttgcaccaccttgatttctttgggttctttatttgtttccccaccttgatttcttccggttcttgattaacaggcgtggatttgattggggaaatcttgcgatatcggtggagcggatgaatcggtggtgaatcgggagaggatttttgagggcgaatcggggatttcgcgatgggattcggcgcgagggtacgacacctctgggtcacgtgctccacagcgcacggagcttgctacgcgtggactcgctgcgagaaagttcctcgcgtctttacttggggccaaggggctcaactagggcgcgcgaccttgctccacgcaagcacaaatcctcgttggcgtggtatagcaccggtctatgtcactacactgtgagaggccttatacctgctctaacagggaaagaaaaaacctctgcggcaatcatatgcctgttgcaatgctacccacggccaccccaccatagactgtttttcgttttaaggtccactgttactatttttttttttacccggtgatgattataccacaatcaagctgatggtccaaactgaaagaggccccaacgatagtggagtatctgtcaagaattaatataagacaaaactggcgccacaagaaaagataagagttctcgaaaaaaaaccaagaaaaggtacacgaaaaaaaaaagaaaatataagtctccaaagcttcggaatggaaataaaggtacacgtacacgaaagttggaccgagatgcaaagagcagaagaagaatgatgcgaagtgttccaaataaaatcgacctttgcacaaaaagttccaaccgagcacatcgtagagttgaatgatgtgtcaccgagaaaaaaatcgacttacagatagaagttgagcacaagcaaataaaaaaaattgtcaagttgcacgagggggcggtggacacggatgagactaaggcggaaatgctaacgcccgcgctggccccttccatgtactattgccttcctcttcttccccttcctcctcccctttcactacaggacaccacacaatttttttaaaaaaacaaaagttagaaaaaatttatgtatagaaatactatatacaaaaattttaaattcaaattcaaatttgaattggtatgtaaacttttgacttataaactttgggtctataaactttagatgtataaacttttagatgaatagaaatattatatatagaaaatatttgaattcaaatttgaatcgggtatgtaaatttttgacttataaactttgggtctataaactttaggtgtataaactttagatgtatagaaatactatatgtcagggttatgtacaccacatacctaatagtagttgactaaatctcggcaggacccaccatataccatgtcctatacggaaacaacctgcagatataggaggagttccggataaggaaagacaaccagagttctacatggaaacgacaagaactactcggattgtatccatattggtttccctagttctacttggacaaggggacacctatcggtataaatacaagcccccctaggagtacagggggacaaccatgatgagacgatcaacacgatcaacacccaccatgacgagacaatcaacacccaacacaatcaacatagaagccacaacatacaagccaacatactctaagacaagacgccggatatcgacttcagagataggcatggctattcccctacggtgtctccggataccatcaggagagacgaaaacgctatctctgatctcgccgggcacggattcgaggaggaaggctaccctgttgtcgactacgagtcagatcttcagaccaatatgtcgacaacagttagataggctaccccacatattgtactggtgtgattatggtgaataaaagcaactccggctccggccaacagtatgtagggttattacctgacagctcaagggcccgaacctgtataaaaatcctcgtctccatctcttttacctcagtctcgtgtatatcctagcaccaacgatccccatactgtccaaataccgtagttgagacatcaaacgtcgacagtggcgtgccaggtaaggggattttggtgctctaggatttcaacgagataggttcaaaagacgaattctccgacaacaagctactcgatgacttcgctgtggggagatctaacccgaccaaaatatgtctcccgatgagatcagaaccatcgtcgtcaacaactcgatctctcgagatcgaccaaacttcaagacatcgctgccgcggagaacagtgacttgatattatcaactaggaggtctccgatctccatctcttcggaagcgacatcatcaactgatttttggtaacctcggtaatgccgctgcctgctcagaacaccggccatcgaggaaccaaaatcaacatctcgatctattcactggattcttttgggactcggatcattctcacaccccgattaggatccaaattttggacccctgacgcatactgagaacatccatcccgacatcatgtgttccaaggatcattgatcacggatatctaccaaggtatcgagaaaacaacaagacaaagatccaactaatatgcttgctcctgacatgtacacatgcatatgtatggactcagtacgtgcttaggtatgcatgcattagttggccgacgtgtacatgcaaagaagaccaacatggctgtctaaattgcaatgtgttgattattcagataaatcaacggccgcccgtgatcaggtatttagtagattgattttttaaaaatggtctactattttcgtagatacatccggcatgtatctacaaaggtacgcaatattttatctgcaatttatcgtacctatttttccaatttatacagcattgtcagatcaacaatttattatgtttacctagagcatgcttcttatacaatatccgttgtgcgagtactttcgacgataggccaactatggtctaacgctaggggctcactccgttctctcctgtataaatcatgcttgtttacggtttacataatgcctgatatttaatctgcttgttgtatcctgataatactagaagatctatgcaattttttgagtacatactcgatattatctgctatatattttgccttctagaaaatatttttcaggaacaattgagcactcgagtaggtaatggtcgagtacactccattatcgagaacattctcgacaaatgcggagttatcgcacccaacctgccaacaaagaccgacgacctatctcatagcacaggccatggctggactactcgagaaaaggttgttaacggataattcctcgcgaacgtcgtcggcttgatcactcgacatgattgcgaacggacatccggatatgctataagttgggtacgtgagtcatgctggccacatgagatacacttgcaataaaccaactctaccactttagatggtcaaggtacgactatcgcctggtcctcgaccagcaatgtagcgtttctccggctacttccaccttcagtggtcgagttacgactactgcctggtcctcgaccagcgatgtagcgtctctccgactacttccaccttaagtggtcgagttacgactactgcctggtcctcgaccagtgatgtagcgtctctccgactacttccattttaagtggtcgagttacaactactgcctggttctcgaccagcgatgtagcattactccggctacttcactttcagtggtctcctcgaccagcgatgtagcgtttctcccactatttccacttctagtggtcgagttacgactactgcctggtcctcgactagcggtgtagcgatttctcctactacttctacttcaacaaagttggaagcaggtacacaatatcgccaagtgttttacccagagatcccttaccacgatgacacctagcgttgaaacctatcctactgtccctttacgctgttctgacaaggcctccgaggaacctaagggatcttcggctggggacgcccagagccgataaggccttgtcggatcctatagagacgaaagaccatgtaagatctggtcgtgtaagagttctcgccgtgcgtattaaccaagccgtgtaatcggaaattaactttccaacttcacggctgggggctaggatcagtgcttattcaaccaaggcaggtcaagggtccaagagccttatcctccgagaagaattctccgacgacaaggctgggggctagggagagtgtatgactctacaaactgactgatcaaagttggtaagagagaagacgctcgtaaacaaaacattggttggtaaatttaattcattttcaatttaccatacatattataacatgtcaccctttgagcattcgctcgggggctctttctatctaatattcttttctgagtattgatttcaggaaaattctattcgacattatcgaagactccatgtctctatggttctacaccaaagatcgactaaggcgagtacgacaaatgtcgacaaagctccgtcgcagactctacgccttctcgatcgctcgagaacggttgctggatctcgaaaaggaatacggaatgaagaaattgtgtacccgccgagataaaatttcttgacttcaatccaaattctcgattacagcaagacgggagacttagtcgtacgctctatactttctcggtcgacatcagagattgacttagacaaaccctttcggtgcccgcacgaggctgacaaaggaagtccaacgttctctctaaactcaccgagaacggtcacatgacctcgataatagttactccaatgtctgcgcggttgagaatatgaattcgttcatttgcatcgaagtcgggggctactgtcagggttatgtataccacatacctaatagtagttgactaaatctcggcaagacccaccacataccatgtcctatacggaaacaatctgcggatataggaggagttccggataaggaaagacaaccagagttctacatagaaacgacaagaactactcggattgtatccatattggttttcctagttctacttggacaaggggacacctatcggtataaatacaagcccccctaggaggacagggggacaaccatgatgagacgatcaacacgatcaacacccaccatgacgagacaatcaacacccaacacaatcaacatagaagccacaacatacaagccaacatactccaagacaagacgccggatatcgacttcagggataggtatggctattcccctacagtgtctccggataccgtcaggagagacgaaaacgctatctctgatctcgccgggcacggattcgaggaggaaggctaccctgttgtcgactacgagtcagatcttcagaccgacatgtcgacaacagttagataggctaccccacatattgtactggtgtgattatggtgaaaaaaagcaacttcggctccggccaacaggatgtagggttattacctgactgctcagagacccgaacctgtataaaaatcctcgtctccatctcttttacctcagtctcgtgtatatcctagcaccaacgatccccatactgtccaaataccatagttgagacatcaaacgtcgacactatatataaaaaagatatttgaattcaaattcaaatttgaatcggatatataaacttttgacttataaacttttggtctctaaactttagatgtgtaaacttaaggtgtataaactttgaggtgtataaatttactaaaataggaaagtaatacggtgccaaaaaaggaaaccaggtggagggagggagggggaggggaatcgatcgctccccgatagccttggcgatcgatcgcccgttagaaccacccagactaagggccactttggattgatgccaaaatatgacatgccaattttttggtagtttgaatagtaaatatgatggtttggtttgaagccaaatgaatagtaatgcccatggttaatttggtacaattctagaactttctttaccataatataaaatttggcttccaagtggtattaatccaaacacattacctagtattctaccctaccaaattattaatagtgccaaaacatacctaggttttggcactaccgatgttttggtatgaccctaaaccaaacaagccctgagattttttttacgcgaattcccacaaatcaatttctacactgtagcgattgatttgagattttgttcgctcgagtcaatcgaaataggtcttgtttggaagattagtcccgggctaattttaagagctaatatttagtcttgaattggtaggctaaacattagtctgggacaatatctttggatccatgagctagtttagggctaaaagatggagagagaggagagagagggggggaggaagataggactgttttttttatggtccccacagaaaattagtcccattagcactctttggagaggctaatgttttgaggggggctaattcactttagccccaaattaacccacatgtttggatccttaggggctaattcagggctaaaaggtgggtggctaataattagcccatgaaactaaacagggccctaatcccaccaacactataggtgtcctaaagaatgccgtattcaatttcattagtagacgtagggtggtatttagattaggggtgttaagttttgatgtgtaacatcgggtattatatagtgtgttgtatgaggtgttcaggcactaataaaaacataattacagaatccgccagtaaacagcgagacggatttattaagcctagttaatccaccattagcaaatgtttactgtagcaccacattgtcaaatcatgaagcaattaagcttaaaagattagtctagcaaattagtcgcaatctatgtaattagtttttttagcttatatttaatatttcatacacgtgttcaaacgttcgttgtgacagggtataaaatttttgtgtgggaactaaacatggccgtactacctttgtctaaacaataaatctaatactagatatgatatattataggacaatgaatctgcataaagatatgtctagattcgtagtaataagatatatcacattcactattaggttggttttttatgggacgtgggagtactacagtctacacaatgacggcagatgtactccatctgttcatttatggtgtcgttttgaacctttccaaataaacatctacgtatattagcgttcatgtgtgatgtcctttcgcctgaaacgtttaccagaagtagtagatggcaatcgcagaaaaaaaatgtatattagaaaacctataggatgactcagattaccacaattggacattggactagaatagttttgcttccaagctcactattacacatttaaccttcaaattctggatcctaatatttacacagagaaatattggatgcgtaataataccactcggtaaccatgatatagcaaaaaataagtatactaaataaaaaagagtaccatttaagaatggacctgttccaacttcatatactttggtctttgtatttttttaataaaaaaaacagagtccatttgaagttccgttactccaagatagaacaggataatcttaggagatgacatgcggaagaagagggcgaaaaagctcataggagcagtacgtcttgaccccttttctccgtgaggaggattcgccgttgcgggttttagctttcggcagcgtttcgctatcatatggatgcggacagttggattggattggatagcgagtgtgggtgagtttttttttttttttttgagaaccagtgtgggatggtagatctgcttcgaggaagaacaacggatgctgctcgtggacaacaactgaggacatgatcacatgaattcctcacatgaatatacaagagccaagtcaaacagtttccctagaaggaaatgatgtcacacggtcattttctgttccctttctctccactgagtagcgcacacaactttgcgctatcaatcgactataatgtacttccacatgcagctaaatgaaccacatcactcgccaggggcgcttactctacaatttcgccacatttccgccacgttcaaactggaccagacggctataggcaattgcccataactttatttgcttgccacaacatccgtcggacacacttttttcatgtagagatcaggaggattattgccgtcttatggcagctagatactactctggtgtgaacggcggcaaggcacgagtattcaactgtttgaacggcatattttccgtatatgccacacgggttcctttcgctcgcgtggcctctgcccttcgaccttcggcctgttgggcttttcgccgtgcccggttgtgttgtgtatgccttgatggcgtgtgtgcaacagtgcaaggagaaaaaaaatccctttccgtgtgagacgtggcgctcaaatacgaaggagaaaatacgtttcccagtgcacacatgaaggagaaaatacgagtaatgcatggttgcagcgcgtcacaattggccggcgatccttctgatctcaaaaaaagaaactatagtgggacaaagactctgatctccaaactctagtacaatccgaggccaacataaagcaccaaaagaaactatggaaaatttaaaccatgccacacaaattttcaaaatttgtgatatgtcaccctaacccacatatcattgactcatgtgggtcctacatgtcattgagatacgggtggcatatctcaaattttgcaaaattaaggtggcatggttccaacaaacccaagaaactaactgcaggttcattatgtcactacatattctttttttttcttaaggccgtgtttagtttcaaagtttttcttcaaacttccaactttttcatcgcatcaaaactttcctacacacacaaacttttaatttttccgtcacatcgttacaatttcaaccaaactttcaattttaacatgaattaaacacaacctaagttaagtatagtattttagaaaggataattggcgttcagagaaaacggcatgggcacatgggctggctagccttgttcacaccaggcatcgtgataagaaaggacaaaactttcgttgagaaaatttcacttcacttcgcttttggcagaaaccatcctccatccaggaaacaagttgcaaaaatcatatggcaatcgaaccggccgtgttgctccgggcgagactctggtggctgccacttcctaacaatcaccacaactttcgctaggctgcgcctcgtacgataacgagcccgaggagatgacagttgctgaaatgctgatggacggcaaaccacaatcaaagctgtgcgatccacactcccagatccctcaaatgtggtaactcgtatttatatcaaagaacattggataataacgagtgccaagacaaaaggctcgtggcgtttccatcacaggcgaatgttggaaagggaaagagcaaagcagaaaaaagatgatagcaaagtactcccatggtcccaccccactagttgatgtacccgatgatagcaaagtactacgaaatattttccgttatctgtgcgggcctttctaaaacacggctggagactgcagtagcaattcactaaactagttctgttaatacttcacgtcgattactcacttcaacgagatgatgatattcaagttcaacccgaataaggcaacgaaaactcgtatttctaaatcacataaatatagcaaatgggacgaggcaaacacgaaccaaaaagacatttctcttcccgattacacgaaagataacatatagcatatgtacatacaccaccgtactcatacgagggattacgttttttttcaaccaccggtgcccagcacgctgcaccggcaccgcaccacctatgaacaaaggaagaagatgacgacgaagggcgtaaccatcaccaagatcatcttgtggttgtggaagagcgccatggccatcgccgttggggcggcggcggcggcggcatccgcatttttcgccttgcggaagaacaaggtgacaactgtggcgccgatgatggtggctgtggcgacgcagacggccacggtggcgggtgggttcttgaaggcgaaggcaaggaggcgctgcgcaggcgcgtcgaggatgccgaccgcgatgcaaaggacgaggagggagaagacggcggcgagggacaccatcagggtcgccttggcgaagcgctcggtggcgggggcgccgccgtgggcattcgcaagaagcacgccgcgcgcgcgcgcggcgcaggcgcccacgacgagcgcggctccggcgaaggcgagcgcgccgaggcccccggactggaacagcggcaggaggatcagggtggcggagacgaggacggccacggccagggacaccgccagcgtcatcttggcgaacgggtcatcgaccgccgcacccgttccgccggccccagcgcgcggcttgcggaagaaacgcgcgagaagaatggtgccgagggcgggcgcggtgaccgcggcgatgacgaagacgacgacgaggatgtcgacgagggggctccgcccggcgaacccgagcaagagcctcagcgcgtccggtccgcccagagccccggcgcccatggcgacaacgatggtattccgaagaattgcggccatgggggatggggctcaacagctgagaacactctcaccttccgtgcttactcaggctaagctgccgatcgatctccttcgcggctctgctcttctcgccgtggctgaacccctcgaccggcttaatttataggtgttgattaacggcatattcttggcagcagcaggggcccagggggcattgctgatttgccgagcggccgtgctgatgcatactagcacatcttttccaccctgtggtcccagtatagaagatgtgaagattcggtactggagctggagctacgcgattgcaagtaaaaaaaaatggattgcaagtatccacataatacgctagcctcgtaggtttgcaagtatatatttggcagacccctaccaaaagttgaagatgtagaaatggattgctgatttgggttctcgatgtacacagagtgagagagatacataaggctctgtttctcctggattcatgtagttcgataggttcgaaggatcaaccgaaataatcgcgtaactcgttgccgatcacggagcggatgacaacgaagtccaaggatggatggcacgaattgaagagcgattgattgtgctgcatgtttcagtccaagctaggcgccacagaacggacaaaagtaagaaaatcgctacgtacaactcacgtctgaccagcacttagctgctaattgccctagccacatggagagaagttggtctgcgtgaagcgtaacgattggcagataaagttggattggatgggaatcggacgagggagtcgaacgtatagcaacactccagaagtaaagcagtaaaccgaaaaagttttgctatcacttgtatgaccgtctccacaagtggcgactggcacgacatggccactcgacagaaccgcacaacaaatgctgatcctttgcccctattccatgcgaagttgcgacttgcgagtctttgggcagggcatgcactactgacaagatgaaagaagaaaatcaaccgtaattcgggcgtgcactgctgcagaatagtccttgtgatcatgtccatgtgaccatgttcgttacgttctgaggcgtcgatagcgagcgatgctggtaatcgtgaccaatctcgttcacgtccaccttgttgacgcgcacgtacgtcgctatatatgacaacgtcctgctacatatagccttgctcactttcggactttgacgtatgtgaagagagcacgactaggagccactaatcatatggtttggtacatgagaggatatgcatgtttcactttgcacccaacatgtactgtactcatctagtcatcctactagtattttccatcggtgtccctttctcctgtgatctctcgctttgcacacaaacctcgcaacaaaacggtctcgctgtcgcctttcagcgcttcggcaaaggattggtcggttcatgaggctcgcttgcccatctcctttgctcttcctgtcgcctctctagtctctaatgtgcgattctcgccgaaccagcgacacgttttataggtgtttactcgatcaaggtgatttttttttcacccgatgtaggggcagagtgtgagtgtggttcagtcagcatatctccttttccagcgctttccctgtatttatcaacccaaacaatcgaacaattttcatatgatcgtgtgtacaaagagagacttaaaactctgtttactactctacttgtacttggattcctgtagttcgacttagatctcgatcgaaatgattggctgatcgcttagctcggtgccatattgcagaacggaagacaaaagatggaggccaagaatggcactttggcacgggcaccagttgaactgcgttgcagatttcagatggattgcattgcatcagtcccagctaggcaccacaagactgacatgtaaagcgaaacacaacgacctacccgtacgcaacaggtggctttcagtggatccgagccaagttgagttcggtcgaggtaggatggtgacgtggtgtggatcgatccggcaggacgatcgacagcctctccttttcccgttgaaacttggcaaagctgcgcttggactacgggtactaccagagtactctactctccggcaaagctgaacttgcaggaagaatgtacttagcgccaggagtggtacgtttgtttgcacacacgaaatatgcaagtctgacggcattttcgaccgatcgagtattcgatatttcgagtggctcgctaaatggtgccgcccgttctggtggcgtgcgtcgactcgtctctgaaaatccgttccacccgacttcttccaactcataccgagaaacacatcggcagataaatccaactgaccggttttgtgattattattggtgcaccatctgcgttatattcttgcggcggaccaggtcaatagtcagggcggcgcggcgcggtccttttcgttcttcgctgcctattctttggtgggggtcgcgagcgtgaaagtccgattatctttatcttccgtcgggttgggtggaattttttaggatgggtccagactccagaccatgtgtgattgtgaactgagcgacgaccgctcggactaacttttaaagtttctatatacgcggacagttatgaggattgaggaggacatgattgtagatcaaagtggttaatcacgagaattaggaaaagaaataccgcacgatcgtttctgaaactaggaaaggtagcccgcgcattcgcgcgggcatgtgtattagttttttttaaacagatataacaaattgtgaaagtaagatatactattttttaattcattgtgcattatatcttttttttcttaagaaacttcaagaaatttatatcgccgatgaatgttttatttttaccatcaagtgcttaatttaattggttcacatgcacgcaatttgctatatgcttgcatatgaattaataaatttgttgtatgcatgtattgaagaaatatgcaaatagtggacatggtttttctgaaatatgtgggacccttatggtatttttttaaagaaaaatataggcaatatgagtcttaaaatataaatttaataggaagaaataacttttatcatgatatggaataccacatattttgagctgcttgtatatacaagatgtggagaaacccatgaagctaccacaaagacatgaatgaaatgactttatggatttgttattgaccttcgtctcttgatatgtatcaaaccaaaacataactttatactttacttgtatatataaagagaaacatagaaatgaaaaaaaaagagaaaaatataagtaggacttcaaaaaaaaaattttatagttaaactgattcaatattagcttgtggccggttaaaactctattaaatagatctctaggagcaaaaccattacaaaatctatttccataaagtggccaatgagggtgaggcaaccccgggttcattataaactatcttgttattatttttcatatatatatagatgttagcttaggggagagacggggtcagaggggtcactcctaatctcctgtttatgtacgagagaaaatacatatgtacaatttatccataaaaataaagatatacataagtatgataaaaaagataaatacaaaaaatttacatctgtatgaccgtatgattgaaagaaacaatcacagccaagattaattataaaacaaccagaccggccgaccagccaagattaattccaacgaccatgcaccatctgctcacggctcaagcacgtatatgcaccatggggagggagtttttctggtttttctttttttttttagctgagaagggggaggtagttggtacataagtgggtaccttttattttccttccgaatcgtatatacgttggaatatattggaaggagggcatggctacgtacatgatttgttttcttgagataagaactgatatttaaattaataatttaatggttaaaatattgtgtctacctatttcaatgaaaatagatggtccatttttttctcataatgccacgtggtggcctagtagcatttgtaaaacggaaatgctatataccggtatactgtcgggaagggtatcgacgggatacccttcgtccacctttcccatccaaataggaacgacgctgagcgcctaagctgtgaggaggaggtggccgtcggtgactccggcgcagggaagaagtcccgcttggggagagaaggacgcggccaccggagacgcggccgccggtgacgtggtcgccggatttgccgcctggtgctccatccgcgtggccggctggtgcgccctccgccagcgccccaactccgtcaccggtgacgtggctgtcgatgatgtggtcgccggattgccgccgagagctccagcaccgctgcctgccatccacggcgccgccgttaacgcccaccctcggctccatctgcgtggccggccggtgcgccctccaccggcgccccaactccgtcgcgggccctctccggtcggctccttcgtcgccggccgtcgatcccgctgcgagtccgggccttcatcctatccatctgctactttgggggagcaaagagacaagatggtgtgcaaagaacttgttaacttggtcatggctggctgtggagtgtggtagaatcatcttctacgtggtaagagtcgtatgatacatgataggtatcatattctacgtggtaagaatcgcatgatacctgataagtatcatcttctatgttgtaagaatcgcatgatacttgataggtattatctgattcctctcaagtatcacctgatatatagtagaatcacatgatacctggtaggtatcacctgataccggttagatatcaggacctgaaacatcacaagcatcacccaccacgtggtaagaatcgcatgatacctgataggtatcatttgatacctcgcaagtatcatctgatatgtggtagaaacgcaagtatcacacgatcctactaaagtatcatctttaaaacccataggatcttgttactagacatgatacctaagtagggtcatgtggtactgcataggtaccacacataatgatactttgatgagtatcatgtgatccttctaagatatcatttgtgaaacctgatgataccagacaagatacagataaggatcatgatacctctcaggtatcacatgatcctcccaaagtatcacctatgaaacctggtgaaactggacatgatactaaggaggatcatgctacctcccagatttatgatcctactcgagtatcacttgatacctcgcaactacgcaactatcatcttctatgtggtaagaatcgtatgataccttacaggtatcacctgataagtagctagtatcgggtgatacctatcaggtatcatgcgattctaccatgtatcaggtatcagacgattcctatcacgtatcaggtgatactcgtgaggtatcatgtgatacctatcaggtatcgtgcgatttctacgacgtatcggggtgatacttgtgaggtatcatattcatatgatacctactagataccaggagctaggcgtcgaggtgtcgaggcatcgtcgccggcggccgcgtcctcccccgtccacgctccacactgaacccgaacctcgtcgccggcagccgcatcctcccccgtccatggtccacatcggaactcatcgccgacgaccgcgtcctccgtcgggagctcgtcaccggcagtcacgtccgtcgtccacgcctcagctggcagctgcgtcctccacgctggagctcgtctccggcgccgccgccatcaccacgcaggatcctccgccgtccacgccccacgccggagctcgtcgccggcgtcgtctctgtcaccacgcagatcctccgccgtccatgcgaccatgccccacgccggagctcgccggcggccgcgtcctccatgccggagctcgtcgccggcggccgcgtcctccacgccggaggtcgtcggcgccggccgcggccgcgccaccggcgttagccgcatctgtgctgctcccacggtggcctacactctcgcgtctgagggaagtggacagggagcgatcccgttgggatactatcccaacgcgataccggtatataaagtgtcatgcatgtgtcgacttagaagtatttgtaggaagtttaatgggcttttactatataatagatttatttttaatttatcagatgtgccatgtggtaggttagtagcactgtagaggatgtttaatggagcttattatagattgatctacatgatgtttaatggatctttattacacaatgggtatttgtctatttgatcgattaaatctttagattttgaaacttcaccttaaatatgtagctttgtgaaatttactttttattgtgtatataatgatttgcttgctactcctacaaaatagcgaggagaaagtgagcaagcagagagataagagatcacatatatgttattatattttaataatatttaattgctcattatttgccatgtaaaagataggagtttttttttcaaattatatattcttatatatccaaacatgcccaatatagataaataaaatatattataaaaattacaatcattagttatctaacgtttgattttgtttacatattaaattttgttaggcagaaaattggaagatgaaaggaaggataggagagggagagacgtatctacgtatatgaggggagaggaggtcacgtacgtacacataaggggacaacccaggaggtggtgggtatggtgggaggtgataattaatggattgggctttaggaattctttttaaatagatctaatggtgaaaaataatgggtccactatgttatgtgaaaattaacggtttggtgttttgtttttttctcagaatttcttggatttccctaatttattagaccgtcacatgtcggcttaggagcgtttataggaagtttaatagacttttagtatataatagatagatagtttggtttgttgcccagatatgctagtattaaaattttggtagcaccgacagtaccagccaaccatttgtgttgttgctgaagcactggagtggagtgcagccgttcgtacaatcggaggatgacatgaaggcggtgtgaaacgacggtcgaaacactgtccctttcagttaccacagttcgcgacgcacacgcgctgcaaatccgccacacgggcacgaccatcgtcgttgtgttcttcgtctgcgattagtcagtgctcgtccgacgtggtcacgtggctgacagagcgaggcgactagccgaatgttttcatcaccctatccctgtggcttgtcgacgatggcaaacattttttttgtttggattagtacaagctttcatttgcttattccagcgtttcaccgggcaacacactctatgtgcatatgtttcggagtgcagccgttcgtattggtaaataccattattatagagagttttgcccggtgatttgtttgcctggcgaaaaaaggtagtataatgttttatcttgagagaaaaagttgtactacatggtagtagtatatctctcggctgcagattgacacgaacattacaacattgagtgaaaaaaaaaacccaacatctacagctacttcctctgcatgaggtgcgtgtgcaaggagagcttgattaaccgctaaagttcaccacagggacatgttcaccagacaccaagttcaccactccacagggacatgttccgcaggacgaacagggtcgcgtggcgcgtcaggcagcgccggagccggggtcgcggctggcggagtgggcggaggaggggacgacgaggatgaggcaggcggcgacgacgagggcgacggcgagcgccaccgcaacagtcacccgcgcgaagggatccacggcgggagcatgaggcgcagccgccgcggcggcggcgcctcgaacgacgcggacgtagcgcgcgagaagcatgttcccgaggactggcgcggtgacggcgcccaagacgaagacgcaaatggcgacgtcgtcgacgaggctccggccggagaggccgagcaggacgcggagcacctcggggccgcccaccacggcgcagccgagggagagaacaatcgccatcgcaacatcagaagccatggcgatcaagaagagcacgcacggaaaagatcaaaacaaaaattcgcaagaataccaaaagagaaagcagagtcctctgaaaagcctctcctctctctctctctctgccttgctcaccctgttcactgttaccagtagatcaggcaagaagtagagaagaacagaggaggaagaggttgtgcactggtgtgtgttgctaggtgtagcatttgctccgggtaatataggcgattcggcacctggtttgggcatggttaggtggtgacgcctcgttccagccaagtcggcacggcgcgacgggtcatctcggcagcgaaagaaaaaggtggattggagtgtggaggccattaaggactaatccgatctttgactgatttgatgtgcctgtccgtgtcactgtgttagatctccctatccatgtggttttgccatcatcttggcttaatccctatgctttcgaatactttgttggcaaaattttggcatggagatatgttcagctataagataatggtgagagtaaagttgatcgtagcaacaagctgaatccgtcgtataatgcgtattctgtcgtttgttttcttactcctcccttactttggacgaaaggcattacgccaagcttttactaaaaagaatacgagttcattacagactaagaaacaaaaaaacgacagaaagtaaagaaaggtagcatgctggggaacaccagctaactcctcccctactttgtctcccctaataacaacaaccaaatcaatatgcccagtgccaagaggttaactacttgaggataagacacggagaaaaataacgacaaggttgtggcttctcagctgaaccccatcgatttgttgactaggctgtgagattttcagccgaattacgtgggccaggtaatagctgccaatatgttggtagaggctgatcctgtgacccccagtacgaacacacacacacacacaaaaagaaatacacgaggagggctacgaactaccaattcatagaagatcgtttaatcataacctgcccagcggtagaaatgcttccgctgaaaaatctgaaatcaaaaggacaagttcggtggataagccgaagcatagcgatggagcccgtagggaaaaggaagatcttccatgatcaggtgggaatctatatttttgaaggcagccaattgcttttggagccgtgagccgtcgactaggaaactgatgcctctgacctgcacatcccacatgtgcacgcgcacgatgggtgtggtgacgacgagcaaatgcgacgttcccctccaacctgataaaaccgggatctgatgggcaggcagaccctacatccggacaggagtaatagagtatccatgccggccattttgccagtttgcaggtatctgagcgcgagcaacaacggcaattgaacacaccacatctgcattttttgctgcaaattaacccagctcctgatcgtggtcctagcaggtggccgtcagggagtgcggttgtccattgacatggaaagccaccaagtcgaggagaccttgacgtgtaccgtcggcgatttctctcgacccgacttttgaaattcttctccgtaaattgtgtgatgtaagggatgacgctggggtagccttgtgcactctcggacagtacgtgagacttcctcgtgtacacacaaacatgtccgcgttgctggcttgctgcctcaactgtcacgattcacgaatgcatcaacttgtgctccccttttttttgcacacacaaacattgcacattgcactctttttttgttcgatttcatgttgagacggtgacacggcgacagcgaccgaccgtccaatcacattttctctctcggtgtatggccacgacttctgccctttttctttcgcagctgtcgtcattgacccgtgatgagagcttttaccttttacagtgctcgggaggcatcctgttattacacatcaaccgttgatttgttaaagggtactttagagatagaaaataacatacagggtagtttagtaattgtcaattttttttatcaattatcaactgaaacttctcatggccaactgtttgttgctcgcccttgatgatctatccatagcaatctgccgttagtcctctgcaataaaacgttggtaaaattgtttgtgcctttgggacgtggcacaacccaacgtgtcgagacctcgcagtgcaaacgcctccatcgtgctcctggaacgggaaagagggggaagctctctaggctagaacctgtccaaaacatatgtgtctgtatatcatctcgcagaaagccagaaacacaggcgttagagcttttgcataagcgtgagaagacacgagacacagagatggcttgcccaacaactcttcttttttttgtttacatttgttcctctccctcgatcggcatggacgcacggtggttacctgttgatacgtcactatcaaagtatatccaaatgctgaagcgtacggaaccaaagagagatccaacagagataacattgaacaaaccaaacacgaatacggggcgccttttttcggattcgtcaagaaaaggaaatcatcctaggatgtactatggtgtatcacaagctctgttcgaattggttcgacacattcaaaattcagctctgatctcagaagatcaatcgctttcgccaattaacatcacatagctgcgagataaacagtagaaaaccacacaggtgatggagtaaaagctgtaaacttgtcgagagacgagagctgagcaatcacacacacactgacaaacacccacagggaagtgaagaacagcctcgtatcaagcgcgggcgaacgtggcggagggaacggtggggacggcgaggaggcaggcagcgacgaggagcgcgacggcgacggccaccgtcagagtcacccgcgcgaagcgctccgtggttgggtcaggggcattgcccgcgacgcggatgaagcggaccaggagcatagccccgagcacggtggcggccgtgacggcgcagatgacgccgacgatgacgacgacgccggcgatggggctgctctgcccggcgaggtccagcaagaggcggagcgcctccggggcgcccaccatggcgcagcccagggagagaacagtggccatcgcaagatcacctgccatggcgatcaacaagaacaaatctctcaagaacaccaaaaagacgagctctcgctggcagcaagaacaagaaatccctttcttctcccggtgctctctctctagctcgccttctctcctcttcgctatgtgtagaacagaggggaaggaagtggatggtcatataagcagcggattggatcgatcactgataggggaaattcggacaagaaatattgggacggggacagatgctagtttggtcagaacctgcggcgtccgaggcgctgtgacgctgtctgctgacgtcatcgtggacgaggacggaaagttcgccatttcctaatggaatggaacgtggagggtcaaatgccaatcgaaaagatccgcagagcacttcggttggttagttcgttactgtagtaacgtcgacggtagtgcacagcaaatcagcaatgttcagaacagtagaaaggtaagtccatacagacactggtcactgctctggtactacactgttcatggtgatgacagactaacgttacacggcgagatgggacgacgcgtcgtacatgtttcgttgccgcttgccgcttgccacactgagagcgacgcccgcgtacacggcgtaccacctgcaactgaacagccgaatcaaacgacgtgctattccttagcattatttcccacatagcttcagttcgcgtcgtgatgagtcgtatactcgtatggtcgctatcaccgtgcttccatcagagccgagaagatcgctctcgaataagatcgttgaaaaggtcaggctctcagggcctatccctgtgttatgttatccgatcttattattcagagttctaacttaagggatgtggaagcttttcttcaacatctcctcttttttatttctctttatgcccttgcccacaatgccacttgagctgagtgcgaggcgagtacgaatcatcatcgtagttccgtttctttccctttgtcatatttgtgtcaaaccaaagaaagtgtccctcggtgtggtggaactgcatgtgatagatactccagtcactaatagtagatgtacatgtacccaatgatagtaaagtacgaagatttccattcatctgtgctgccctttccaaaaggttcctttccctaaaaaaaaatggttcccttccaaaacgtggctggagaatgcacaagcaattcacgagtggtagtgtatttccctccgttattgaggccctgtttagatcctgtcaaaaattttataccatgtcacatcaaaaatttaaatatctgcatgaagtattatatatagacaaaaaaataactaattgtacagattgcgactaatttgcaagacgaatcttttaaacctaattgctccatgatttgacaatgtgatactacagtaaacatttgctaataacggattaattaggcttaataaatttatctcatagtttactgacggattctgtaattagtttttttattagtgcccaaacaccctatacaacaccctatataatatccaatgtgacacgccaaaactttacacccctggatctaaacacctccccccccccaatacgaaacgaacacgaaccaaaaaagcaccactcttcctgattacaccaaagatacctatgtacaagtgccaccgtaggaataagttcactagagatccctcagtttaatagcgaggtttttttaggacccttaaccataaaatcagaaaatgtgtacccctaaactcactcaaaggagctcccatgacagtattgacttaatttttacccggttttgctgatgtggcatcctagtcagcaaaaaataaaaataataaatgtgggacccacatgtaagtgaggaaaaatatggggttaacaatcctagtcaacagtttcctctttttctttttctcttctactctttcggttttatctttgctgcagatggggtggcagcggtgcgcggccggaggcaggcggagcggccgcatcggcgggcgagcgaggctgcggagtgtcggcagcggcaagcggcgggcgagcgcgacggcagcgggcgagtggcgcctctgggtcgggaggtgcagaggggcttgggacatggggtcatggggggggcgagcagcggctccgggatcgggaggagcatcagctgcggcaggcggcggctccgggcgcgggaggagtatgtgaaaatggaatattcagattcattgatctaagttatgtcccatacctatgttttttagacgaagagagtactcactcggttaaaaaataataattttaatttattcttagaattggatttgttttactaaaaaaagtactccattctatgaggtaccgaggtgatccactaacttgacgtcgctgctgacatgctgtacaactaggtcccgccgccggcgatatcttgcgtgaaaccgaccctttggaattccgaatttctgatcaatcatccaaaatttcacgtatccaaatgttgtgcgctttcggactttgatgtaccaccagttcccgtacgcgaagagagcaccgctatataagccactaatcacagggtttggtacagcatgtttcactttgaaacggaagcaatataatgtttcactttacacacaacatggtcatgctattctccatcggtatccccttcgccaattcgattgcgatctcgctttgcacacaacttgcaacaaagcaagcagtgatcgacaagggttggtcggtgcacgtccgacgtgggcacattgctgatgcctgacggggcaaagtgaacaagtgggacgtttccggtccatgaggttacgtgcgggcatggtcaatttgggaacccggtccaatagcaaatatatatgtggtcattcgccgtgcttactgttactgaggtttgcctgttcaatctccttcgctcttcctgttgcctcttgtctaatctataaacacagtgacagagctagaaattttctaagcctaaaactcgagtagagctcaactaataagatattagttttctaaagaaaaatatatggtgatttaaaaggattgaggcatatttatggaggcatgtctagggctcaagtccaagctaccctaggtttgtctccgcccctgtataaacgtgtagggtagtgtggttcactcaacacctttctctttccagcatttcccctgtttttagagatcacaaccaatttttatgtgattatgtacaaagagaaacttaaaagtatgtttactacttcaattggattcctgtagctggacttggaacgatcgaaatgattggctgatcgcatagctcggtgccatattgcagaacggaagacagagatggagggcaagaatggcactttggcacacggcacgtgttgaagcgagataggttgcgttgcagatttcagatggattgccattgcatcagtcccaggtccccagccaggcgccacaagactgacatgtaaagcgaagacgcactaacgccacttgtatatacgatcgtctccacgcgcgacctaaacgcaacgactcttcggcacgatcgatcgcgccctgccctggactttctcgcgagctgctgcaaaccgtccttttgtgatggatgtcccgcactctttgaattccctggttggctggtcgtgccagtgggtgatcgtatcctgccgtttgggcgtcgcgagccgcggatcgtcagtaccccgcaccgaagctggctttcagtcggtccgagcaaagttgagttcagtcgaggtaggacgatggtgacattggtgtcatggtgtggatcgatcgatcgacagcctctcctttttcccgttgaaacttggtaggagcacgtcggaaaatacagaacttggttggactagtcgttatttccgtcaaatttgggcttggactacggtagtagtacgtacagtcccagagtaaatctacgtacgttgtcgatctctcagcttgcaggaagaatgtacttagcgccaggtgtagtacttttgcttgcacgcacgaactacgcacttttcacagcatttttcgacccatcgagtatttggtatttcgagtggctcgcgaatggtgtcgcccgttctggtggcgtgaatcgactcgtacgtctctgacaatccgttcacccgacttctcccaactggaatcgagaaactcatcgggagataaatccaactggccagttttcaggcgattactggtgcatctgcattagtatattcttgatgatcaggtcaaggtcaataggcagggcggcgcccgtggggtgggccagggcggcgcggtcccttttgttcttcggtggggatcgcggccacgaaattttaggtcgggttgggtggaattttggaggatgcgtccagcacgtgtgattgtgaactgatcgacgaccggtcggtcaggatggcaatggtaaagttggtaccatatacgcggagaattatgaggattgaggagggttcgttcatcactggaattataggaaaagaaatgccgaacaatcagtttttggtagcaccgatagtaacaggatgaacaatcagtttcagggtttctcaaatagtttggtttattacccagatatgctagtgctactaaatttttggtagcaccgatagtacatgcaggcatccatttgtattgttgctgagtgcagccgttggtatagtcggaggatgccatgatcacaagtatatactcctagaacatacattttttttaaaaaaaaagaatgtctttacgaacaaatgaagtttatccgtttattctccaacgttataactaactcccacgattctaaggggaaaaaagtatgtcaaattgttgagagagcataagtaaactccggtgtgaaatgacggtcgaagcactgtctctttccgctatcacagttcacagatcatcgcacgtcgcacgcgcagcatatccaccacacgggcacgaccatcgtcgttgtgttcttcgtctgcgattagtcagtgctcgtccgacgtggtcacgtggctgacagagcgaggcgactagccgaatgttttcatcaccctatccctaaggattgtgaggattcggatcaggtgcagtcactactgcaactttagcagtatccatcatccaaccatccagcacataagggatggtctagattcgttgcttaatttcccccagcttttcacctactctctgactcgagcaaatgtgttttggagggaaaagtctgagagggaagtaagaattggcgccaattttaccatgggaagcatactttacctcctaccgctgcacatcacacgcaattaatttggatattatctttttttccctagggttctattaatgttgaagatgtcatcttatcttaaaatttcatttgaagaggtcaatagaacttagaaggcatcgtgctgattttggaagcagatgatgatctacttttggatcatgaaaacttttgtaactgggttaatctagcagtagcatagctagttgattttgaaagcttttgtgtcagtggatgcatgacacctaattttagcgaaaatagttagggtatgtttagttcacgaaaagaaaatttttgagtgtcatatcggacgtttgaccagatgtcggaagggttttcggacacgaatgaaaaaactaatttcataactcacctggaaaccgcgagacggatttattaagcctaattaatccgtgattagcatatatgggttactgtagcacttatagctatcatgtactccatccggttccatattatttgacgttttagataaggttgaggccaaacttttataaatttgaccatcaataattttaaaaatatttagtttaaaggacaacatatatagatttgtctttcaaagcaccataataaaagtaaatatatatttatttattttatatattataatagaaaaataaggtcaaaagatatatttttgtataccgtgtcattaaaatgaaaccggagggagtactaattaggctcaaaagattcgtctcgcaatttctatgcaaattgtgcaactactttttttatttatctatatttaatgcgtcatatatgtttccaaagattcgatgtgacatttttggaaaaaatattttgggaactaaacaagggcttaaactcagctcattttgtcaattatgcgtgcaagatattatgaagttcaatataatgaaatgaagtatgtgtctacttttctttaacaatatttgggttttcttaaagttcaagaaaatctattatattattaagacagcttgaaaagaaggcaccacgttcgctgtggaggctagaaattcccacattaatcggagaaaaagaaaaaaaagagtccaagtagaaatacaatctgaaaaataactgaaattcggaattaaaaataaacaatattgaaagaggagaccatataagaacccaatacgtgattaattaaaattcagaataataaataaataaattgctgaaattagaaaaaaagaaaaaaaaagagttcgagtaggaatacaaatttgaaattactaaaagaataatggtctagatttaccgtataaaatataatcatatcaatctaattatagatcatacaatccgcactaggagtccttgtccgtttagaaaaatcaattgcagaactgtatagtatagagttatgattctaaaccaacatacattgccgcacatatatagggtggagataccagtccagcacgcttaggctgcagcaacagaaaaataatatagtgccctcatttcatacaagtccatatattagaacccaatacgagattaattaaaattcaaaataaaaagtaaaataaaatccgaaattagaaataagaaaataaaagaagagttcaacttggaatgcaatttaaaaataacttaaattcgtaataaaaaataaagactatttaaagaatacaccatctggaacccataacgagattaattaaaattccaaataagtaataaaataaattctgaaaatagaataaaacaactaggaatatagtttataaataaaatctatcggaatgaaaaatatgaaaatttcaaaaaaaaatcatctagaacacaacgatgataaatgacaataaatatcgaagaagtaacggggctgtaaaggagtagggtggtgacagccagggtttaccaaaccgccggggccggggttaccgcgccccggcggtaagcacggttaccgcgcggtaactgcggtaaccgtgaaaaccgtacaaaaccatgcaaaattcatcaaaaattcaaattattttttaaatttatttgagtttaaggaggttactgcggtatttatattatcgtacccccgcggtaagcccggtaaccgcgcggttaccggcggtatggtgaaccctggtgacagttgatggaacatctaaaaactattaacaaaaccccaaatagaatcccaatgacaattaaaaggagtgacgacggacatgccgttaagcagcacggtcacgacggttggcgggatttctaaaaaagtaaaaaataaacctcaatgataatcacattcgattttaaaatctcaaatataataaagagtgggaagaagcggggcgagccgtagaggagttcagacggtttggtgggactctataaagtaaaaattgaactcaaatgataattatgttcaatttttaaaatcccaatgacaataaagagaggaagcagcggatgggccgtagagaagtatattgacagcttttaatgggacttctaaaaataaaaaaataaaacccaatgagacaataaactcaaaaaaaactataagatccaatttttaaaggttaaaaggagaattaatataagccatggtagatcgagaaagcaaataaagaaaagggtgacaaaaaaaagcaaggggtagcaactgatgtgatttttataaaagttacaaaattagaaatatggggatgatatggtttggtctttcaaagtcttaaaacaatgaaatatctattgaataaattataaataaaatcatattaaaaatatataattttgtatcggtgctagccgcgcaattgcgcgggccacccagctagttcagatcaaaaggagagaaattgcaggcaaaatctgaactgaagctgttctatgcttgttcaaatagctaaaatgatgcatgacacggttaaatctgggccatccctcgtgtgctggatggctggatgattgggtactgccaaagttatagtcacagtcgtgactgcacctgatccgaatccggattgtggacgatggcaaactatcttattttgtttggattagtacaggctttcatttgcttaaccctgcgtttcaccgggcaacactctggatttgtacatatttcggactgcaccgttcgtattggtaaggaccgttattatcatccggtagtacaagagcaccacgaaacatttacagagttttgcccggtgatctgtttgcctggtgaaaaggtagtcttttatctcgagagaaaaaaaaatacattcatagtatttctctcggctgcagattgacacgaacactacaagtctacaacctatcgacgaatggtaagattgtataggtggaatgacaaaataaaaaaccagcagctgcttcctctgcatgagctgcgtacaaggagagcttgattaaccgctaaaaagaccgcgcaatccagacaccacaaaggcacaaacataacatgtgacctacaccgcgtacgaacgggatagaagccgcggtacgcgcaccggcactacccaccaccgcaccacgtgtcgtcgtgtccacgtcgacggcgcgcggcgcggcgcgtcaggcagcgcagccggggtcgcggccggcggaggggacgacgaggaggcaggcggcgacgatgaagacgacggcgagcgccaccgcgacagtcacccgcgcgaagggatccacggcgggcgcgggggcgcctccaacgccgtccgctttgcccgcggcgcggaagtagcgcgcgagaagcacggtgccgaggactggcgcggtggcggcgcagatgaggaagacgcaaatggcgatgtcggcgacgggactccggccggagaggccgagcagtatgcggagcgcctcggggccgcccgccacggcgcagccaagagagagaacaattgccatcacaagatcagaagccatgggaatcaaaaacggcacgcacggaagggatcaagggaacgggttgagccaaaacaaaaaaaaaatcgcaagaaataccaaagagaaaacagagaaaattctctcctctctctgcctcgctcaccctgttcactgtctagtagaaaaggtagaagtagaagaacagaggaggaggaggaagaaccgaagaacgtttgctccgggtaatatagccgatagatgcgcatttggagctcaggtttcggcacccggtttgggcatggctagttggccgtgcaggacacctcgttccacgtcggcacggtgcgtcggtcatctgggcagcgaaagcgaaaggcgggttggcattcatatttcatttcgtgggtgtggaagcaattacggactacttcgatcttgacggctgattttctctacctgtatgtgttggatctccgtatcggcgtatccatatcccataatattaggccgagtttagttccaaaatttttcttcgaacttctaacttttctatcacatcgaaactttcctacacacataaactttcaacttttccgtcacttcgtttcaattttaaccaaactttcaattttggcgtgaactaaatacacctattagtttactgtatgtttagtttggagaaaagatgaaatgggttagactcatctttattttttatggaattgccccattatctgtttggtcttgctcttttatgatggaggggttgtggcccgcatgtcagtgatagagaggaagtgtgttggattgattcaacagcgactcgtcttggtgttctaggctaagaggggtgacgatcagcagaggctctggggtttagtaggggtgacaattcccctacaggatcgaaagcaggtcgagatttcaacccatataagtgctacagtaacccacatatgctaatgacggattaattaggctcaaaagattcgtcctgcgatttcccggcgagttatgaaattagttttttcattcgtgtccgaaaagcctttccaacatccggtcaaacatccgatgtgatccctaaaaattttcttttcgcgatctaaacaggccgtccatttgtgaagatatcctctgcctttagcttgaaggcagcaggcagcaacatgatgtgaatgcgctgttcaagtctcaacgggggcataaacgctcgtggcatatgccgaaacggcacagcgacacgagctcctttcaatggttacacgagtgatgaatcgcctcgtcacgcctcgccgccgatctgaccgtcctgggacgactaattgtccctttttaaagtagactgatgtgctgattggctagaccagctgcttctcctgttgggtacaagcagaactgccgtcttggtacaatgtacagataccgacgtggcgtgtcttaaattcccctactgtatggcgtggcaataatccacctctggagataaatcacgacgggaaaattatgcggcaaaatgttcagtccaggagagaacaatacttccttcatccttcaaaaaaacaacttagtactataaatttaagcatatctatttccaaattcattgcaatagaatgtattacatctaattccagttagttttaccaaactccgcttttggtgtcccttttttctttgaaggaaggcccttttatttatgcaaacatgcacatggcgacctgaaactattgaaaatgcattttcagttcgcttttactatgagcgagatagcgaccgtctgtccaattgtttctctgggcgtaccgcgtacgccccccactaccaccgttctctgacgcagttggtgagatggatggacccatgctaccagtggtagccgtcctcctctgcaacatggaacaaatcgttgctgaaatcgtgcctttgagacgtgccagtgccaagcttatcgacacctcgctgctcaaacacttccatcctgatctcatctgcacaatcagccaccgcaacgagagagtcagagatcgaggccgagaagctcactaggctagaaccggatactgacctgtccagaacgtacgtgtcggggtacaaaatttttagagtaccatacgatcgatataagtgtttgacggcacgtgcatgagacggtttgtccaacaacccttttgttctagtataacctttgttcctctgatcctctccctcaagctggttaactggtgatacgtcacaatcaaatcggcataactaaatgcgcgaaacatatggaccaaaaagagagaatccgaaactccaaacccaacagagatagtaacataaagatatgtgcatatggcattagggaaagaactaaaacagacgcatcaggagatgaaatcatccagggacattccgtgatgaatatgaatatctccagtttcactgtctccgatatgttcacccaagtccccaaatcggaccggcaagaaagatcacaaaatcctataactctgttccaattgattgagcttattcaagaatcatatcaagtgatctcagaatatcactcacattcgcaaattaacatcacaagactaccacagaaaaacagcaaaaaaaaaaacacacacacacacagatgatggagccgtagtaaaacgtcgagtagtaccactgtaccaggctaccagcaccggggctcgccgcgcacggcgcaccacaggtcggcggcgcgggcagcttctcgacttctcgtagttgcagccgcgcccgaatccgccgggcggccgagcgcgcgccccccgcgcgtcaggcggagctggcgaacttgtcggcggcgggggcggcgaggaggcagccggcgacgaggaagatggcagcgaaggccaccgtcagggtcacccgcgcgaagcgctccgtggcccggtcaggagcgtcgcccgcgacgcggatgaagcgcaccaggagcatggcgccgagcacggcggaggtgacggcgcagatggcgccgacgatgatggcgacgtcggcggcggggttcttcccggcgacgtcctgcaacaggcggagcgcctccgggccgcccagcaccgcggcggccagcgcgaaaacaatggccgtcacaatatcacctgccatgacggggatcaagaaatggcgcggaagagaagaggaatcgcacgtaggtaaggaaggaagaagatgagctctcgctgaagccccccctttcttccccttttcggctttgttttttcgtcgcccacttgccgctttgcacaagattttaaaagcgatggccgtgtaccgcgtactccgcgtaccgctggcacgatcccatgtaggagtagctcctgttgtttttctcccatgtgtgctcctgttcggggtcgtgatgcttcaggttcgctgtgcccgtttttttcatcagaaactgaaaaggtcgtcaggctcttaggggcctaccgaaagttcaaggtgttatgtgggggtagctttcagagtttttattaagggatgtggacgtttagatgaacatgtccaaaacttttatgttttgttatttatctttatttattatgcccttgccacataagctaatcgcgagacgggtatgtataatcatcagtgtttcaccccggccttcaccagccaccgcgtcacaaacacagtcacacgctcgagggaggcgcacaggaccatattgggcttaattgggtcctatcttgcctgttttgggccacactgggttgtgctgggtcgaatagttaattttagggtgaccctcaaatgtgatcgaaatctaaaccatgaccctaaactacaaaaccggatatctcgacccccaaactccaaaaacggtgcaatttgactccctgggcggttttgggaggcggttttgctgacgtggcgccacgtggcgtctacgtggcaatattgaccgagtctttgctacatgtggcgttgacgtggcacctacgtggcagtagaaataaaaaaatatgcgtgggacccgtttgtcattcacacataaaaaaattgtggggcccactgacatgtggatcccacatgtcatccttcttcct

SEQ ID NO: 83232 - DNA, 1652 bp, Oryza sativa
ctggtgagacaaacacgtcatctcacgggtgaatccattcattgatagtgtggttttgtaaaactacactaataaaatatatgtacttatagtgttaaagtgtgtgtggttttctacaacttggaccataaaatgtgtagttttgtgaaatttactctatttttaaattcgaatccacatcaatttaccgtttcctgggcctttaatgtgctgtgtttgtgttgtgtttcatctctagatacatattacacacgatttttccgtctcacggatcgatttgtccatacactggagttgctgtaagtgctatacttggatttatagatggccataatgtccgatgtccgacggcccagcccacggcacgatattttagcccggcccatgaccgccgggccatgcatgggcctccccaccggcacgttgggccggtccggcatgactgggccagcatggcacaatgggtcggcaggccggacccgacacataaacaatagggagtaaaattgacatattatatgtcacggtccaaagaatgagatgaaaaatagatttattttagctatatacgtgtcagcccaaagagaagagagggaaaatagacttattttagctatatatatgtcacagcccaaagaggagatggaaaataggtttattttaagaaggcacgatgggccacacgttccttcgggccggcactgcacggcctgacagctgatgggtcgtgcctaggctggaggtgcagaccatgagctggcacggcctagcacgaagtgccgatcgggccgtgacgacccgattgctggtggaccgtgcctagccgtgtctgggccgggccgtgccaggcgggtcttatagtcatctatactgggattcgatttcacacgcgagggaaacctattcgcgcgcatgagggatgtatatagaaatatcacgttatatatccgatcagttcccattaaaaaaaggtaatatatccgatcagtttccataaaaaaattatatatatccgtaaagaaaaaagtatatacccgtgcagctacatctcgccttctgtttggcatggggaagagaagacgaccacagacaacgtcgacgcatcaccggtactacctccgccgccgccacggcggcgacctgatcagcgagctcaacgacgacgtcctcgcgcacgtcctcggcctcctgcccaacgccaccgacgtggcgcgcgcgtgcgccgtgtcgcggcggtggcgttgcctccgggcgcgcgttcccagcctgcgcttctctctatctcatctaattaacccatcaggcgacgtgaagcggcaggaggatgtcgaacggttcgtcgccttcgtcaaccgcgtccacgccacgcgccgcgccggcgttgagcagctcacgatctccatcgagctgcacgagggctgctgcgcccgggccgtgccggccgtccacggcgcacacgccaacgcgtggattcggtacgccatggaacagcaaggggtgagatcgttcgccctgaaactcgaccagcccaacctgctgccactgcctgaacagcgacggtcctacgacttcgacgaagacgccgacggtttggtcctggacgagctccctagctcgacgatgctggagtccatggcccactgacctaccta

SEQ ID NO: 83233 - DNA, 37562 bp, Oryza sativa
  unsure (1)..(37562): unsure at all n locations
cgccttgctcaatccactactcctcggaattgggtcaacaattcatcccgaggatcacatccaaatccttggtgtctataaggatcagatccgagggaaaaggaattccctggatctctataggtacggccgggctataatactttgctgtcatagctcctccaggggtggtgatgagcagtgagttcctaagcctttctaaccccagctgatttctccccacgaattgcacagatataaacgagtgggaagctccagagtcaaacaaaatggtagcggggatggaatgaatgaagaacgtaccgatgatgacatctggagttgtctgcacatcctctgcagtaacatggttcacacgaccccgagtggcatcctttccaccattgttggggcggggaggcgcttggccttcctaacgcctcggctttgggaatttatccgcgaagtgcccaggctctaaacagttgaagcacaaacgcggctgaccttgaacatccctgcgtccatgactaggctgcacggccggtgcagggggacggggtgcacggttcccttgctgattctgctgttgctgcggctgtggaacgcgtaccacaaattgaggtcatggcactgggcgaggttgttgctgctgttgttgtgaggaggatccccctggatagggattggtgtagcggatcctttggttagccccctgttgattacggaaattcgccaagcgacgtttgtgtgactccagttccttgtgcttggcctccaggcggatgctcttgtccactacgagctggaaatcagggtaatccccggagaccagacgcacagaaagttcagggtccattcctactagaaacttctcctgcttttcttcatcttcacgaacatcctccagggcgtaccaggccaggttattgaactcatgcaaatactccataacagagcggttgccttgcttcaactcccgaaattccctcttcttaagggccatgactccagctggcacatgggtcctttggaaagcggcggtgaagcgggcccaggtgattggctgtccttctggctgcatagcctggaagtggtcccaccatagtgatgcgggcccttgcagctgatgggttgcgaagataactttttcctcatcattgcactggacggtgtccaactttttcccaacggcatgcaaccagtccaaggcatcaacggggttattggagctagagaaggtaggcgggcggatgtggaggaactcggcaagcttggagtgctgtgggggtggtggtggtggtggtggagcattgtgttgcggcggagtctggatgtggtggaggaaagcagccatcatgttggcctgctgagcgaggatttgggtgaggatggggttggtatcgggtggcggtggtggtggcggagggggaggtggaggtgggctgccatggttgttgtggttgctgccttcggggtgactgccctcaccggtagcagcgcttctcctggttgtcaccatctgaagattccacacagaaccagcaaacagaaagagctgacgattaaaactaaccacccacgactaccataattcttgaatttatttctgctattaaattggttcattaaggttgaagttgcttatgcaaataaaataaagacaggctccgacacaattataccacacaccggtataaccatgccccacacgactctgcaagaaaacaaacaaaaagaacacacgcgcgtgcctactagctgctcgtctacttctgcgacgggccagggcggaaggtgagcaacaacacatcctccgtgctgccaacgccagaggctccctcctcctaaggaaccaagggcgcgggctcgacgcaaggagtctccacgaagcaggtccacgccaagaactgacgaacaagctcaggcctagaggtactcttgcgggcggtgatcttctggctgcggcaaacgcggcggcgcttggggcgacagatctccccctgagcaatcttgagctgacacagctgcgcctccacggcgtccaagtccttcagctgcaaattctcctaacgtagctccaggatcttcatgttgtcctcgaccaacccacggcgcaccatatgatggaagttgatgcggcccgtgtcgtacgcctccaccatgcgtgccaggtgcatgatagtagcgtcatcctccgagctagcgttccggccgtcggcgaccgaaacggaggggtggacgaggtcggcgatggtgcggcaaagccggaggagacgacgccgaggtggcatgggaagcggtccggggcgacgacggcggcggatcggagctcggcggcgacgacggagagagagagcgacggcgcgagctcgattctggcggggagaaatggcggcgagtggcggaaacggacgagggaggtgcggtgagggtttatatagggttgggagtgagagagggcggccggcgaggaaggaaaccggcgcgggggtccctatcggcatcaatggcgccggcgagatttgcgggagcaaatccggccgtttgaacatgggagagagatgagaaaatggagggaaagggagagggaatcacggggaacatttccccccacttaatggcacgcgggaacggtcgggggcggcaggatttgcggcggcggcggcgctaggcgcgggcggagggagcggcgggagcagtgggaggagggggatgatgggtgggccccacccgtcagcgagggtggcggacgagcccgcctgtcagcggcgcacacgtagggagggagggaggccgagtgggccgcggggagagaagagagagggagagggagttgggccgaattcagacctagagagaggggagagggttatagggttttctttttataaaatcttttcaactttgtttatttcttcataattattatttgtgctctgaaaattccactaaaatttatttacacattttaggcttttaggaaatataaaaaaatcctcccagccttatttgacttttaactttacacattttaatttttgatagatttgactaggattttaattattctagacataatttataatttaaaggatatattttagggtacttctgggacgtgacatcacttcactggcgtcatccgcgagcaaaaccgtcatcgtcgaccaatagttggacagggccggcgccttgttcttcttccccacgccgccatcgccatgcccttcttccctcctcctctgcgaaccgacatccgccgcctaaaaatagccggcaaagccccttcttttcccccacaactgagcttcgagctcttcttctctctctctcctccccatgccggccatcggctgatctccctcgttggagcattgccgaccaagccctcgcgccaataccttcgcctcgacgaggcaaacccattccctaaccttccccttcctttctccttccgatattagccaccaccgttacctcccataccggccggagctaagtccttgccatcgccgttccggcctcctctctcactccccctgccggccaccaccctccccggatgcgtgacactcgggaacacgttccaccgccgacgtcgtcgcctcccggtcaccggagcaccggcaccctgtctctccccctctctgtgttgctcgcgctggagaagacaagaaacggaggaggaagaagaagaagaagaagaaaaaggagagagaggacacctgacaggtgggccccagtacagtactatttcgcaattttcatatttaattcaaatcctattctctagaagcccatatctcctgaaccgtagatccgattctagtgaaactaggacctaaattcatctaaattcaaaccctacattttgatacccaatttgctattttataattttatttgaatttattcaaatattgtttgaccttatgcttgcattttcaaatactttcttttatcccaaattactctttagccactaaaaagccgtcggctagaactttacgtcttccatgggggtgttcgcggtctactgggcccgatgtcgaaccgttggttgtaaagcccaacagaaccaaacctaaggtcgaagtgctgctcctggcaccctacgcctcgatgcgtataacggtcggagcttcaccattaaatttttgaggaaaatttaaaactttttgaaagctaaagcatttaagagcataatagttgaacttagagtttgaatcctgtatataaaattaaaacataaagatttgttgggattagattagagctaatccaaaattagattttataatatatcgagttaacaaaacacaattcaaataaattggtttaaccatgaaatagaaatttaactcttttggttttgcatttcaacctaagcaaaatatttgagctaaatgaaaacaaatggaaatataagttttaatcataagaaaaaacctaaatggaaataaatatacttggttgtatgtgcattttattattttaggtttgtttttggatgttcttggtgcgtctcataataggtttcatatgcatgtcgtttctaaagaaaattcctaaaaataaattatgcaacaacaaattgcatctatattctcataaatactacacaacatcttgagtctatattaattttagtttcaaattaataaatatcacatcaaatgtttctcaaataattcgaacaactcatctagaaatttggaaaacagcatatcatttagcctactttgcaccttcaccaaaatttaaccataacttatctagctaaaccatttggtcagaatgttaactatagtgtactctaccacctggtgcaatggcttaattaaattcgaaattaaaccacctgaaatgagagccacaagttgcttaaacaatatttagactgcagtcaacatagtaatttagacctctttactaaattaccatagtaactcaaaaagtaatttaatcttggaacttggcacattgaaccatcaaatcattgtctaccttgcagcaaccttgtctccctaaaattctaatttaaaaggaagagaggagtagggaaataaactacatgttctaggcctcttcttctacatctctcttacatatggggccaagccattgtgggacccatgtgtcatcctcaccacggtgttgacagtgaaatttggtaagcccaaagtcatcatcggcttagagtcactattggctacggcatctcggaatcagccgatgggagttatcaagtcgccaatagtcggattcctgctatattcggttaaggaaattgatctactaaaggaaacttatctagaagagaccgagttcaaagagaatacggcatggcaagttatctattaattaagaatagtttgttagtttccttttatctttagaaaagtgtatttagtgtcctataaggactttatcttttccttttatctttaggaaagtttctttcttgtccgacaatgacttgtatcaacccatgggtataaatatgtacacccggggtctatgtaatctatcttcacggtcaatacaattcggcgcatcgccaccctttttacttctacttttgtttttacattccggcggaacttggcactcgacgcggggctgcatcgtcttcgatctccagcgaagggataagtccaatgttccgtcggtctaggcaattgtatcatctacgtcggcgtcgttcaaggctgcatcagtacattcgacctcttagattgctctggtttggatgatatatttgcctacccatttatcatatgtctctgttaatctagtcttagcatatcaatttagctttatcggctgcttctcgttttagggtttctgccggtatcggctaaatcgcgttgctagattagattagcttagacatctactaccctgaaaatcagtcaacggcttgattgtctagatattgtgtttcttttcatacttagtgctgcatcagttaagtttgacctactaagtcatgcttagaaccgtaatctctagcatgctttttgactgccaataagggtttcatcagggtttcagccggtgagttatctggacgttgcatcggctcataaggattgcatatacatataagttggatttagccgatgacaacaaaggtttcactgtttaatctaatctcgtggatttcatgacatcggaccaccagccgatgtgtgctttaaccttcggatcaatgcttattctattatatcaatactagccgattggtttatactggactatattattgttatattttattatcagtagccgattgtctatatatcattatttactaaagtgttagaatctacattggacgtatagccgattgcttaaaccctatcgctatcggctggtatcagcatcggctattatcggctaccggctggaactactccatcggcttgtcagccgatcggtattttatctgttgtttacatatcttgtcagttgcaggatcaaactgactggcacgcccgcatctcatcaagatttggacctgcacaggagctaagcagatctcccaggccgatgtgttcgattttttcgtcaacacagattggcatgaacaattcttcctcatggccgagaaacaaccaccaccactatctccagctagcccaggctctgttaaggaaaagatgctgaaattaggatcgactgacgtcaatgaaggaaacgtcgtgccgatcgatccagaaaaattcacacctgagcagaagaaagagtttgaagcaatgttgcagcaagcatgggatcagttcttgaactcattcatgcagacccgcaaggggacacttgttcagaagtacaaaataaaagtggttgctgatgatcctgggaccagttcttctaaggatggagatgggaaacaagctctagacgactcggctcagccgagtaacaaaggtgctaccgacgtctctctaggaaatcaaggcgacaattctcaaggagtccatggaatgcaaggtgatggtgcccaagggttgcaaggaggaaatcttaatcagaatagtgatgcggcataagattttttcagtaatttccaagaccgggttgactacgctgtgcatcatgctttgatcaatcaatctagggtgttagtcaataccttatcaaacatgatgaagtcaatagccgatggttcaatagctgagcatcaggctgcaggcccagtttatttgcaaggtgtcttcccaaattatcggtctttgatcaccgatgtccagccatctattcaggcggttccctccgttgcaccaacaactcagccaacgacgccgacatcaactcccctacctgctccatcagcgatggcgccaggccagccggtgaaccctcggttgttaatgagagagcatccacagcatagtgggcaggttgcgaatcggctgacccaagattaggttgctgccacgtttctgccacgtcaacctgttgttgatccaatacagcagcagccgattcagcagacacccccaactcagcaggttgtacaaccaatccagcaacaggtcatgcaaccagttcagcaaacaccaccaaggcagcagcctctacagccgattcagcagacgctgttaagacagcaaatcgttcagttgatccagcaccaaggttcaataagcgcatcggccgggtttgcaacgcctggtggtcagcccgtacaacaatttttaaatcaagttgtccaagaacacttggttcaccacgtacagccggatggcacagtaatgcctcaagttgttcctgagcacttggtacgtaatatccagccgaaccttcataattaccaagggggtaacttgaattatcaatatcagcctccttccccgcaagcccaatatcagccagggggattggctcaacctcagtttgcgtctcaatacggtcagttcgagcccatgcagcaacaaggggcagctcagcaacggtcgtgggccgatgtgattgctgacgtaatgagggaacagtttgggcttaaaccaaaagagactagaagcttgtatcggcagccttaccctgagtggtttgagagagttcctcttcccaatcggttcaaagttccggacttctccaaatttttgggacaagatggtgtgtcaacttatgagcacattagccgattcttagctcagtgtggtgaagcatcggctgtagacactctgaaggttaggttattccgattatctttgtctgaatcgacttttacttggttttcctctttgccgtatggatcgatcaatagttgggccgatttggagaagcaattccacagctatttttacagtggggttcatgagatgaaattatctgacttgacagcgtttaagcagcggcatgatgaacctgtgcacgagtatattcagagattcaaggagatgaggaacaaatacttcagcttgagtttaactgatgcccagttagccgatctggcctttcaaggtatgattgctccgattagggagaaattctcgtctgaagactttgatagcttgtcacatctgatacagaaggtgtcacacccagaaattcactagtaatttccgaacttatttgtgcattaaatccttgtccaggaatcagccgaggtacacaaactgacaatttaatatacagattcatcaacgttacatacttacaaaagaaaagagaaaacagcagcggaattacggtctagcgaagctccggctccactcccacaggcagctaaactggggtataagccaaacgtcttctccttcgcaacttgtcttcaactgaggtttgattgtttattgcaaggtgaacatatgacatactcagcaagccacacagcaagtatgcaagtgcacaaggataccaaagaatggcataatatatggctcatttgcaaaagcagcatttatcaaacatttgagaattgtaaaacagtagagtaattaatcatcaatattaatcaacactgaacagcacacccatgctgcacaggcccaaccatcctgaacaaccatacccggctgtacagatctatctccaaaccaggaatgtgccattccaaaccaggagctaatcaaattattaccaattatagcatcatttattacggtgagaagtgtgagactaatcacgaaagacattgttagacccgcccataaccacgggcatggctattcgaatagttttactctagctagaggtgtaccactgtacccacaagacacagccccacaacatgtcaccatgcggctcaatgccaccacggtacctcggaaaggagctgtgacagtacccctcgcataacacaatccaccacagtgcaccgttcctggatcataatcacccccttatagacaaggcatggactccccagcgacccccgtgggcttatctccgccacttttcagtttggtgccccgcaatgaaccatgctatacaaaaggtaaagccgttgcccacgctgacttgtggttggcatggttaatgtttcacaaccgaaactcatgaaccggtccttaattgtcatgagcacgaccatcaaaaccatgtgctcacaacccaccattatcaagttttagttggcacattaattaattaaccaatcacaattagccatcgtgagctacaattaaatatccatcattaagtgatagcggaacattagttatcccaatcatgtgctaatgtttgtaagcatggctaagcaattatatctaatatctagctgaaccaatatataagtccaattagtcaaattgtcacccaaggtatcaaagaatagagtaagcaatgcaaagtggtcataacaaaggaataggttcacaccacccggtgacattcgaaaataaatgcacaattgaaataaatagagaatttaaatataggatcaacatgctcaaagaaattatgtttgggatctgtgtgacttgccttgcaatattcggtcttcaataaatcttctggaatacttccgacgcactcgcgaaccttcgcaacgacggaaacgacaagctaacacgcaaaacgaagaaaaagactaagaaactccaaataaatagtacatataaagtaaagaaacatgtagatcatgattttagatgaattatgagacttgaacggcctcattctaatttcatatgaattagttacaaattttacaagatttaattccaattaaacctattaaagaaaatactattctaaattaattaaacaatttagaaatgatttataactgagataaagattaaaacaacctctggaaaaagattagatcatatttggtagatgacatatattaaaaagaaataatatgccactgaaaagagagaacggatttatattgattttggacggctgagattaatcttgatcgagagttgaccaagatcggatggcttagattgatctggcaagcgggcctcacgagataccgactcaacgagtcaattctacgtgacacgggatcacccaaatgatcaaccgaaactggcgaacggaaccggctgctctgaacggctctaaactaaaggatgactccacacggacgaacgaacgaaacatgggggacacctcgttcgaacgaacgagcgaacgactcaacaacggttgcgactaaaccggtgagctagacacgattcacggtaaagccccggtacggcaaacgataggccggtaggaattaagggatgcaccaacggctaaacaacttggctaccgagcaacggctaaagcggcggctaggttaaagcggcacacagctgcgacatggcggtactagggtgacttggctcagctaggcggcggcgactcggcggaggcacgcggctagggttaggatgacggcacagcgacgacgacacacaacgacggcagactgtggctatggtagtgggacggcagcgacttggcatgcacgagcagcagcagcatggctgtagcagggagcggcacagcgacggctaggtggctagcgcagtggcgacgctagggcagcagctaagcgtggcacggtggcggctactcgatgacaaaaacgagagattaaaaactaaaccgagggaacacggatagaagtctcaccgaaccaaagcgatcggagagagagatgactacggtgatccggcggcaacacatggagacgacgacgatgctagacaaacaacggattagattgaattaagaccctagagataaagtacaccggtgaatggcataggagcggcggttgccggcgaaccacggtacaataatgcaaatggagggcaacgggagaaagaggaggcaacagcgatgcttaccaatacttacgcagcgatgaacggcgaaggagatggccggcgacgactttccggcgatcttcggcggatgacagatggcggacgggcttctcctcgcagctgcgaatcaaatggagacgacggcgaccgaaggtgacgacggacgacgacgaacggcgcggctggaggcacggcggcgacggcggcgctccggttcacgatgacggccaatctccggttggatttggcgcaaaagaaccagcggccgggatagagctcgactttgcggagccgcgggaggtggtggcgctgatcggcgacggccgaggcgacggcgcacggcggctggaacggctatcggcggcggagagagaaggagctcgcggggagggcgattccgacgacggcggaagatgagacatgaggggataggtagaggacgactagggggtcatttatataggcacgggagctcgggtccgagcccaaatcgacgggaaatctcgggaaagtctagggttctcgccggagtaaggaaagattgaaccgcgaaattggaaaggatttccatagaaacttttggggatttcttggggaaaaggaagaggagattgagaggattccattgccgcaactaatttggaaaaaggagcaacgaggtggccggattggtgggaggaggcggcacggctgcacaggcttgggacggctcggtctctgtctggaggttgaagatagagtactgtagcgccagggaagtcaaacagacttctctgcgggctgagaggagagaatggaatgggctgaattcggcccaagactaggaagaggattattattacttttcaaaataaattaaccaatgagatgatctttcaattgttaaaaatacttccaatgctcaaataattccaagaaaaatcttgaacatacttgaacactcagagtatttattaaaattgaaaccagctcatttaatgattaatttaatatgtgaataattactgaaatgttctttgtattattaaaattaggaattgagctccgaaaaatcttagaaaatttcagagagtataattaatcatggagaacttaatacaaattaaatctatccatgctttatatttaggaaattttatttcccacatttaacttcacttgtaaattaatgaacatttaatataaattatattaataatttattaaataatttataaatcctaaaacggaaattcaggctgtgatagaaggtaaccttgcatgagcatagatctgcagaagttaggaaaagctctaagaaggttaatcatgtttgtctgtacatgtatgggtcggatgatgatgaggacgattctgaaatagctgcagccgaatagatgaggagtaaaaaggtcataccatgtcaatgggtaaaaagttctggaaaagaggagaagtatgactttgatatgactaaagctgacaagatctttgatctactactccgagagaagcaaattcaacttcctgctggtcatataatcccatcggctgacaatacctaggcaatcaagccgttgactgattttcagggtggtagatgtccaaaccagagcaatccaagaggtcgaatgtactgatgcagtcttgaacgacgctgacgtagatgagacaattgcctaggccgatggaacattggacttaccccttcgccggagatcgaacatcgatgcagccccgcgtcaggtgccaagtcccgccggatgataaaataaagtagaaaaggtaaaaggtggcaatgcaccgaattgtattgatcgtgaagatagattatatagaccccgggtgtacatatttatacccatgggttgatacaagtccttatcggacaagaaagaaactaacctaaagataaaaggaaaacataaagtccttatcggacactaaacacacttttctaaagataaaaggaaactaacaaactattcctaattaatagataaactgccatgccgcatcctctttaaactcggtcacttagggataagcttcctttagtagattgatttccttaaccgaatatagcaggaatccgactattggcgacttgataactcccatcggctgattccgagatgctgcagccgataatgattctaagccgatgacgcctttgtcgattaccaattttcactgttaacacacggtcaacccatcatcttcacacctctcaattaatttatatttcatttctcaaaaggtgagaggagagttaaaaatacaattctcacctaccttaccacacatataaacctagagtatatctacatgggcccatttgtcacccatgtaccagccatctactcatgtgatcactcatttataatctatatatacttcatcaaagagagagagagtgggggagaaagagagttagagtccaagtttcaccgaagaactcaccatacctcccatttcttctgggaaacatctatatggggccactagacagccactcatactaggttaactgaagtacaagctgaatctcagccctaaactcgatcctctctccaaaaatcgtgtcaaagccatatcatgccacctatctctccattgccagcacaacatccattctttgattaaccacttcaccagataactcatcccactttcctcatcatgttccaaggaagaacttagagaaaactccctcggaatttccgagaacacccacttgttcatccttcccgaaggtgtttgatccgctgtatgtcttctctggtgagcttcgccacaatctaatcataagaacgtgatctatagatcctttccatggatcaaacacattccgtcgagctcgtcggcgtcctcggtgtccagagcgccgccgtcggtcgcttcgccgttcccgatgatccggtgcatctccgacctagccgctgcgccatgagcgtcgccaaggttctaggataaggcctgcgaagggaatcgcgctgaagagcagccaacaaggagatcctctctttcttcctcaagtccggccgccggccaacgtcgtccgttcctcgctctcgggtgagcttcggcgcagttcctcgttcgtgtagcatccttagattgtcgttgagccgttccacttctcttcttggcagtccggagtctggaagggggtcgacgccgttgccatgccgtttcttgccgtcgccggagcatccttcacgccgtcgtcgccattcaagcgttaccggcgcatgtccaacccacagtaagcttccagcaaccccgtagaggcacatgcatacactcattcacaccgagctcgacatgcacatgcatgccgaagctcaccgccgctcgcgctgccaccatcgctgacaccgaccaccgcagccagcgaaaccaccaccattagcttcgccatgttccactctgcattttctattctggtcgcatcgtgaaatctgccaccgttcaccgccggctacgctgtgaagccgctgctgtcgccgctgctctgtcctcctcctctcaggctagctgacatgtgggtccagttggattaggcactaaggactttcattactgaatgtttagatctggtaaggttgtaacttcaaataaccttacaatgacatgtggacccaagaacatgcatgtaaatagattaaaactcaagaactcttaatgaagattcaattaaaacgtgctagggacctcgggacctattactagaacctctaggaatctttctgcaaaatatctctcactgaccagtgggccctatgtgtttaaaatctggaaaaatataaggaaaatgccttagtgaatatctaatcaacagaaaaataggttaaattgtaaattgcatataaaattcattttagctccaatctggatgaaataaatttctgtagaatcaccagttatgaaccttaatatggaaacataaaacttggcacttgcagtagaataaatagctctaataattcacataagaaataatgaacatagagcaatctccaacttagaaaattcatataaaattcatcttaacttaatttggagtgaaccaagctccagtattctcacaaaaccatgttcttaatttacatgaactaaaacttgatactttctgtattaaaataatcaccaactatttaattggtaaaataactagtatagtgtatctagaaactataaaacccataagtgatttattttaactccaaatgagatgaactaaatttgttagtttgataaaagcatatacatttgttctgtagataaatctgtagaagaaaccatatccaanaacatcactcanatttgaataatgaattaaattaaaagatggtatagaaacttctagaattcatataaaatttaataccagtctaaaggaagagatctcaaagtttgttaggttataagaaccatgaccttagtttttataaaataaaatatgacactttcagtacccaaaacttgtctaaaatttaaatagttaacaactactataataaatcacttagcttgtaaaattcatagtaaaatcatcccaactctacaaaaatgtgaaaccaattttgttgaacacctgagaacatccccttcactgcagcaagccaacaattcataaatcatagacctaaaatgcacctaagaactattagagcttaattaatctagtgctagtattacatcttgaaaatttataactctctaatgcaaagtgataaaatataaattctttcatctaaattcatcttagaccagtacctaaccacactagtaaactcatgcattttagagcattttagatttttacatgttttggcatttatcgttaccgttatttcttttagacggtgaattcgttaccggtgaggtgattggtcttatagctgatctcaagaaggtcttatatcaaccaaggcaagtgtgcccttcctttgaacacattgaatcccatgttttcgggctaaatgttttgattgtaaaagttgcatgcgtaattcgaactatcgaaactggattgtagatatgaccaaaaaaaaaaaaaatttgcatgaacccttttgaaaatcactcccttgctgttttgaaccttaggaataattagagtacttttattgtgctcatatagctaagttaagcttttataaaatgctaatgcttagccttgcttagtaataaataaaaacatggctatggaatcacttattatactatttggaaaacctttttatgtgatatgggcagcgatgtgttcgctggatatttgtgaaataaaatgagatgaaatgtgatttttagacttgagcggcatgtggtatgcatatggtggtagttgcatactgatagggggagtattcgcccgagtcgattaaggaccgaacatatcacccattatgtttaccgtacatccacatgtgctagtatgggatggcctaagctgattaatctatttaggactagccttgcattctggtaggccggtgtgtatgagttagtcgataattctgagaattttgtcgataacttagaggaactacccatgagtgtgtgtttgtgatgatcataggatgatacattccctatgtgtgtgtgtgtgttccgtgaggggtgtactgatccacctcacggcatgggcgtctaagtctgtccaatacaacggtattgtgccacgtggtgggttcccgtcgtgtccgccaccacggcattaagtttaaggcgtgggcccgccacttaacggttctagacatatttccaagtatacctaagatggaggaacacgtatcgtgctggtgcaaggctagattctaagtagtgtaaaggcttcgttatgacctctagaccgcactcaacgtatagagtgtggtggtgcatcgcgagcacaaaacaaactagagtgttgttcatatcttgtgggtaaagctgtacaaactctacagagttctaaaaactaatcgattagccgtgctcatggtcatgagcgacatgatgatgtgctatgggtataattttgtgatttctaaatgcttttgaaactaaaggaaaaagtacgaattacccccccgaactattgcggtcgtccgaattacccccctgaaccacaaaaccggacattcttcacccccaactatgcaaaccggacgaattacccccctcgacccaatcagtggtggttttggtctacatggcgtacgcgtggaagtccagtcaacaatttatttattagtaaaataggtgggccccacctgtcagcggcctcctcgcgcgcccgctcccgcgccgcgccgcggatgccttgtcctccagcgcgcgccttacctctttccggtgctcctcctcctcccctcctgccgccgcggccgcggcgccgccgtcggacgccgtgacaatgacgacggcggggccgatggagagctgcagcttcatcgtaatcgcgtgttggcgtgttgctcgtgggaggaggagacggtggtcgtggtggtcgtggagttggacgagaacgcggcggccaacggtgccgtggtggacgccgggaggagctgctgctcaggcggcggcggcggcagatgatgatgatgatgccgcagcgctgcgtgacggatgaccggcagcgtcgtcaccacgggcacggcctgccgcgcacccgtccagagttacacgcatcctgttgctctatgaagctctccaccctgcaaccacacacacacaaccacccccaaaccaaaccaccgccattagcgcacactaaccataccacttaaccatcatctcatcaccaaacacaacaaaaacacggcgatcgattcgaagattgatcgatcatctgtacatgtagatcgatcgaacacgacacacactgaccaatcgtgagagcatgagacaaccagaaaaaacccatgggacaacctcgcctcgtctcctccgccgccgcctcacctcctccaccgccgcctcgcctcgccgctgccaccacaccccgccgccgctcgccaccccccgcctgctgttgtgcgcgtgcgcgtgagagagtgagagaagagagagaggaagagtgagagagaggagagagagagggggaaaagtgcaataggagtatgacaggtgggtcccagtatttttcaataaataaattgctgactggacttccacgcgtacgccacgtagaccaaaaccaccgtggattaggtcgaggggagtaattcgtccggtttgcatagttaggggtgaagaatgtccggttttgtggttcaggggggtaatttggacggccgcgatagtttggggggggcggtaattcgtactttttctgaaactaaatgatttgagttgatgataagattgatatatgtgatatgattgccttacttcccgttgtgttgtaagggaatgatgtctatctatttatgttgatatcatgccatgattaatatgcttcacaatttgctaaaatgttttgcttaaattacgttgcaaatggtttgtgaactaaaatttgctttatgctgaaaattgagactacaaatagcctttcctttgacatagagctttcatgtatgtaggtttgatagtgctctgccatgttttgtctaatttatgttttgcaggaataggcttagtttaatttgagtgatgcgggtttcgactgcttcttctaggatgtgaacttaatggggtaaacccctagtcggtgtgcttgaggattgggtagtcaagcttccgctgttctctgatatagttatatttggccggtcggcctatgtatctatttattagttgtaatctgagttttatttgctttagatgtatcttgctatgtatattcatacttaagatgaaagtgtgaatctagtgcacttcctgggaactagattcacatgagtatgagttaggaatatttgagatgttgtagctctttagccatttttgtcaagtctcctgaatgtgtaacacatatggtcgccgccttcgagtggtttgacgggcacatctcaggctgaagttgactggcaggctaaaggcccagcaatgtctccaatattcctctctcgaggcgtcggatgtttcattatgattgctcgatgacttgaattattcactttatctcccaattataatagaaggtccggagagcctacgacagcatggtatcagagcaaataccgactataggagcccctttaagttggtcgtttagaattgattcttaaaaaaattattttgagggctttgctctcagctacaaattatttgcgaaaatcatatttaaccttatatcttatccctctctggatattatttccctatgtctcatgttttgatttctaaaactccttatcttgttccataggaccgaaaccttttgaaagcttatatttctgtaaaaatgagtttgaaaacgcttattaatcgcaatagatcagtaccaaagtgttttgaaaagttttaaaatctatttgcaaaattctcctatgtattagaacggttttgcaaaaatctcgggttttggaatggcatatagagtgtaggttttgaagttgattaaataaattaaaatttgatagacatgttaggttgtatcacataaacatgttacttctgtaccatggtgaaatttgatgggttttttatgctcttctatcccagcatttcaaaatttcgttatgaccttgaatgggtagatttggggtaggatggaattgttgtgttatgaccactagattgaatgcttagatggaccacccaaaaatcttatagcctctgaatcttgttggtttcatgttatgatggaatggttaatttatcaaacttaaaacatgctatagaaattcaaatgcattagttgcacgtgttctgaaatttatagccagcaactttcacgaaattttgtagcccaaaccataagtgataagcatgccatcttttagcagtagttagtgtactaccatatgaagcatcatgaattttggtagaatttttgaacctctgcatcaaggtgtaaaaattcatatagtctgcatagtcaggttctgaaatctgtaggttgcatacttaacaattttatatctcctaaaccataaatgataaaatgaaaacctttggtcagtaacttgtattcttgtcaggaaagtttcatgatttttcgtgggatttttacacctgtagattaagagataaaaattcaacaaccatagataataacctgttccagaactgcatcatctgtcttcttctttttgaataaaataaagtacttgtccaaaaatcacaattccttcccagaacatagaaaactttgtaagcaacctgaatataaattttatttgaatttacaagccttctaggttggtcattaacttctattttcagcagattgacacctaggacagacctgaaaccacctagcttgttcatcttccataccacaatcctgcttgctaaaacttttaaattttaaggggggtagtatgataggttagcttcaatcatgcaagaatttagagacctcgaaccatctctaatatcaaactcaataaccataacagtcataggaatatctttcaatcttgctgtcctaaaactaaaaatgcatgaacttgatttaggaaagctaaaatttgatccctagtaacttaaatctagagctctatcgcagccgtgttcatttctgtgtatttgaatcattcctcgatgcaccatgtcgaaaatgatacatccaaccaaacatcatcatccttaggcttatttctaaaacttgttacagtttgatccaaaattctaaaaactttgagaaacctttgacatttgttaatgaaatcgaccaaagcaaaataatttttgaacactcccacagattgcactcccatatagcatcatctacacacatagatctgacatatctcatccacacacatagatctgacatatctcaaataactagatccatatatatatttctacagagacactagaaaggataccctcatctcaatcgggcggtaagccccatctcaatcgggcacagcgtccgtcacaggctagaagtcactgatgtgaagagttatctcaatcaggcaaacggccgtcacgaatgaatatatcttaatcggaccctaagtaaagcccgtcaccgatagctttgacccagacgaccagtcaaactatagcccgtcacagatgacctatctctatcgggccacaactagcgcccgtcacagatgactactaacctttatcgggcctaaactagagcccgtcacagatgatactcatctcaatcgagcctaaactatagcccgtcacagatgactgatgacctcaatcgggcctaaaatagagcccgtcacagatgactactgacctcaatcgggcctaaactagagctcgtcacagatgactactgacctcaatcgggcctaaaatagagcccgccacagatgacctcatctcaatcgggcatttagttatggcccgtcacagatgactataatccacaaaaaaaataaattttgttttttggctagcctcaggcctttgctagccatacccgctgcaaaaatgacagaaacaaacacagatatctaatatccccagctccccagcatcacccattcatatacatatgcattcacatacacagacatcaacatatttcacgcaaccacacattcacagccatctcatatttcacatccattcacatatttcacatccattcaaatatttatcatatttcacctgcaaaaccgagttaattagatcaaatatttatttagcaagttttaacataaacatatgaaatatatacataaatataagcatcacagttacatcatcacaattgcataataagtgttcatcattgcctaaacatagaagttcaacattgttcatcattttagtttaagcctaaacattcctttggggttaactatttcatggaggatgaagctggctatctcctcgtgaacctcccaaagctggtaggcagagacttggttattgtgccctacattgtcataattccagattagttgattgatcatatataagtactaaaatgtagttagtctatcataattgagaccaccgacctcaaactcagccaaggtcttcaccttttctctatacagaaggcgcatgttgtggcacacatggaatccgcactggtcacctatttgttgcttcaccgggaagtcttttttgtggatgagggtgtcatgtcctatcttcctgaggcctcctctttgcacgtattgggcccacgcttcatctatcgctagttgaattggggtcaaatcatatgcgttcttatcaattctggagttcaggtagtgacatgtactccacttaggtgttatgaccagaaggatccaatgggcactgcggcattaatatagtgaaagttaattaagtactcaaggaatgtgtcatgactattgattataggtgcacataatgtactccttgtctcggcgggaccataaggtgtcatagatgtagttgaccattccttgacggtcattctggagatttgtgacaatgaccacttgtggatcaaggaaggcaatttccggtgcatgcttctgacaccattgccaacttaacctacacacaggataaacgatcttgtaagaaagttaaaccgattgttattaccagattgagttgggcgacaatacttacaaggagtagcacttaagaggcttgtgtccaccgctcggagcctgtagaggtcgaaaagatccttgaagttgaccatgatataatttgttggaccaaggaatggctttccatcgtgctctccaaggatatcggtggctttattcggcttcctggcgttagatttctccatgtagtataagtgaaggtccttgcaagcggtgcccattgcggcaagcacgtcatctccaaccaatggcatgcctagtcggaactcctgtggagcgacatatttcttcttgacctctttgcccttagtctcttcctggcccttgcccagatctagcttccttggagctagaagcgaggcctgcacctttcctccccttcctctcctctttgcttcgggtttatcgagagtaattctctgaggggaagagtgtgccttcctgctcttcttcatcggtgggggttcatgaattgccttgctgtcggcctccgttcggtcctccccaaaatccgtgtcgtactgcaactgcacatcgtaagattgtgcatgacgatcttgagcaggaggggctgaaggagcaggggtgggtctctttggtagacgaccgcctggtgcagtgtttggcctcgctgtaaccctgatctcaatgaggtccttgggccattggatgaaggtaccacgggcatttcctagtgagaggacctcgtcgttcggtggatacttcagagggaacagctcgtatttgggcttcaccgagtcgacttgaacttttgcacagtcggccctgagttgcgctccatgcactcttgtctttggggtcggcttgtacgcaagtccctcggctgctagaaccgtgaaggtcggcatcaccctaactatgagggtgcagctcgttggttcctgcgatagattaatcaatttttttagaatattacatataatatggattcgttaagtctttcatgtattgagtaagttcacttttaccattatgtggtcgacggtgctgtcgaccgatgttggattttccgccaactcagttgatgcgcaactgctgcgtttttgggtgggacttcctaactcttcgtgcgccgcagcagcggtggcctgggggttctgttgctcttctcggatctcttgcctaatcttggtcctcattgactcgagcttttcgtcgaattcagatgtcagctcagctcttatcgacgcccggatattggcttcaagccatgcatctttctccgccttgttggaagtccgcttcttgtactgccacgcgtagtatggaaatccatacttccagggaacagaagacccaacgcctcgtgtccgtccacggtgttccttgttgcccaacactttcgtgaggaggtcgtcctcgcgtctttgagagcaggcctcttgcgagggttgttgctcggcaaccaactccttctgcattacaatttagtggggttaaataaactgcacgatgggaaacaatgcaaacatctagtttgactagatacttactatagcttcgtacactcgttgatcttctgcatttggcatgaagattgtgccatcatcattcttctggtacctggccctggcccagttcctagcccgagggtgtgggatatcaccaaacacgagtggcgtgttcgattcctccgcttcttcatcctcacgcggccattccttttccttaccggcatatccggcggtgccaagccggtgtggatgctggttcctggtctggagcaagtgatatgcctcgcttctagctctggactcgggggtcgacttcttcgcatggaattccacccagacctgttccatgatccaagaaaatttctctcttggatctggattcgtcgggttgtagacgaactcgccgactagcttagtcttgaagttcttccaagcattgcccataaccttgaaagcagcccgcctaagacggtcctcatgctccgcaggataatcgaagctctccttaaacgttagccaagcaatgtccttctctgcggccggcacgagcttgatgtcatcttgcagaatactgaatttttgcctccctatgaccccgcagatagacctaaatcggctccatattttccttggagatgtcgacaaccctacggcatccaccgctattatgcggaaccgttccttagggattttgtttcctgtcctaggagtacgtgcccttgaggacccactagttgtcgtcgacattggttcgccttgctgagacatcgtctactttttttcaaaataacaaaaatacacaattgagtgctacaatctattacaatgaattgaatgtcacttataaaaataaatgaaacatataaataaacaaaattgcgcatctcacagtaataaaacgaaccacatttcatctatttactaaattcattaatgcaccacgtataaataaacgaaattgcacatctcacagtaataaaattaaccacatttcacaataatttcattaatgcaccacatttcatcccaaacataaataaaccacattttatcccaacataaaaaaaccacatttcatcccaacataaataaaccacatttcatcccaacatgaaccacattgcatataaataaagttaaatgaaatacatttcatcaatcactacaatcatctatcacaaaattcataaatgcaccacatttcatcccaacatcgacatgtctcactcacagttcaatcacatatcatccacatccacatttcaatgacatgtcattcacagttagcagaggacggcgcgatggagtactcacctgaggatggccggtggggctcggtggcggcggagccgggctcggtggacggcgtcgccggtcggtggaggcggcgtcgggctcggtggaggcagcggtctcggtggcggcggcggcgggctcggcaaaggaggagttcgcggcggcggcggtgggctcggtggagggcggcgccggtcggtggagacgccggtcgggtggcgtcgggctcggtgggggtcggcgacgtgcgtcggtgaggacgcgggcggcgacgatgaggaaggccaacaccggtctggtcggtgtagaggctcggtagtggcggcggcgggctcggtgggggtcgtcggtgaggaggcggcggtggtccgaatggagggccgaggaggctcggtggtggcggacgcgggctcagcgagggaggcggcggccttggcctcggcgtcggtggcaacggcggcaggttcggcgagggaggacgacggcggtggcggcgggctcggtggcgacggcggcaggcttggcgagggaggacgacggcggcgctagggttctaagtaggcaggaaagtgtagcgggacttagaaaaattttcgatccgatctgagaaaccctagttatagtagagtgatgagtcatctcaatcgggctttacggtagggcccgtcacagatgactcatcggtgacgggctccatactaatgcccgattgagatgacattcaggcccgtcacggatgactcatctgtgacgggccctaagataatgcccgatagagatagattaatctctatcgggctttaactaaggcccgtcaccgatgactatttttccatttttccattcaagtctttatatttgtgagtacaaaaatatagctgctgtataataattcattttgttagtcataatacatttttggatagtaaatgatttcaaatcgaaatatggtcaacaacaaaattgtagaggttatcaagatctacaacttttattttggtcatttgtctatataactttgtttccaacagcttgaaattgattttgacaatataataaatctaaatagcatttgtaaatactaaatgatttcaaatggaaatatggtcaaaaacaaagttgatcctctcatcaggatctacaacttttattttggtcatttgtctatataactttgtttctaatagcttgaaattgattttgacaatatgacaaatctaaacagcatttgtaaatactacatgatttcaaatggaaatatggtcaacaacaaagttgatcctctcatcaagatctacaacttttattttagtcacttcttcatccgacaaagtgatagttatactattcacaaaaatcacatttctctcatctggtttatagatatcaacacagatatgtcaattttgtaaacattggtactatcactttgtcggatgaagaagtgaccaaaataaaagttgtagatcttgataatctgtacaagttagctgtttatggcttttccatttgaaatcatttaatatttacaaatgctgtttagatttgtcatattatcaaaatcaatttcaagctgttggaaacaaagttatatagacaaatgatcaaaataaaagttgtagatcttgataagagaatcaacttttttgttgaccatatttccatttgaaatcatttagtaaccgaaaatgtattatgactaataaaatgaattattatacaccagctatatttgttgtactcacaaatataaagacttgtctagaaaaatggaaaaatagtcatcggtgacgggccttagttcaagcccgatagagattaatctatctctatcgggcattatcttagggcccgtcacagatgagtcacccgtcaccgatgagtcatctgtgacgggccctaccgcaaagcccgattgaaatagattaatctctatcggctgtaaactaaggcccatcaccgatgactcattttccatcttttatttgttgtgagtgcaaaatatatagctgatgtgtaataattcattttattagctataatacattttcggatagtaaatgatttcaaatggaaatatggtcaacaacaaagttgtagagcctttcaagatctactagttttattttcgtcatttttctatataatttttttccaacagcttgaaattgattttgacaatatgacaaatctaattaacagcatttgtaaatactaaatggtttcaaattgtaatatggtcaacaacaaagttgatcctctaatcaggatctacaccttttattttggtcatttgtaataaaacaaaattagccatattaatgactacacatatcaagtctttgcaataaaacaaaatacttcattcattacaatagataagtacaaatccatcggtcacaaggttatgccttccgtatgatgtgaacgagcatatgccacaggctcttggggatcatcgtcaaggtcaatgtgaggtcttacatgaagattatggttgtattcttcttcatcgacgacgttgtcaactcctacaattcggcgctttccatccctcacgatgtgcatcttcttgtttgaagggtcttttatgtagaatatctgctcgacctgtttcgcaagtacaaacggttcatcggcgtatcccaccttagatagatctactaaagtgaaaccttccttgtcggctttgacaccagtgcgtagattcacccaacggcagcggaacaaaggaaccttgaacttgacgtagtttagctcccagatctcctcaatgcggccgtagtatgtgtttgacccaacttgatcctggaatgcatttatacggatgccgctgttttgcactgtgcttttgtcatcttgtttgacggtgtaaaatgtgtatccatttatatcgtatccttgccatgtgtctacggtccaagacggtcccattcccaacaactgtaatgtctcatttgggacatccgtggacattgtcacacgattcatgaaccattcgttgaaccgagaattatgttctttgttaatccatgcatcagatcgccccaagttctcatctcggattttcgctaagtgctcctcaaagtatgggccaacttctgccatatgttggagcacagcgtaatgaacctgcgcgtacgacgcttcatcgggcctaattcttttccttccgattgtgccaacacctgacaaccttccctcgtgacgaaacacaggaactccgataggatcggcatcggacatgtaattgacacagaactcaatagcctcctcggtcgtgtaaccttcaatgatgctctcctcgggtttagctctgttacgaacgtatgacttcagaactcccatgtacctttcaaacagccacatttcccttagaaaagctgggccacatagttttgtttgcttcaccagatgaacagggagatgaaccattatatcaatgaaagacagtgggaaaaaatatccaggtgacagagggtattcacaatatcaatctgcagcccatcttgatcttctggatctataaccttctatccaattgcattgaagaaggcgcacagacgttggatcgtgtgacgcactttcggtggtagaatgcctctgatagcaactggcaagatttgtgtgattagcacgtggcaatcgtgagacttcattccaacaagttttagatcgtccaatttaacatacttacttatcctcgctgaatagcccaatggaactttaatatccttcaagcatgataacattgcgatcttctcatccttccacagtgtgtggcaggctgagggaggtacactttacctgtctctgcatctcgtatgggctggagttcactgcgaatattcatgtcctatagatcaaggggcgcgttcaacccatcctttgtcttcccgggaatattcaacatcaggctaaccaaactctcacacacattcttttctaaatgcatgagatcaatgcaatgacggacatcaagatctttccagtaaggtagccgccaaaatatggattttttcttccacataccattctcctttgtctgctacgttttcttttcttcccaaactcattgcttttgtccttgaccatattgtggacctcatcaccggacaaatctttgggagcaggctgaagttctctcttaccgttaaaaattttcttctttcttctaaatgcgtgacgtagcgggagccacctccggtgacccatgtataccatctttcgtgatttcttcagccaccggcttcgtgtatgttccttgcaatcggagcatgccttctttccttttatagtttgtccggaaagattaccgagtgcagggtagtcattaatggtgcagaacaatagaactcttagcttgaagttctcctgaccatatgcatcccaagtttccacaccttctttccaaagaatctctagatcgtcgataacaggctccaggaatacatcgatatcattgccgggttgcctcggaccttggattaacaagcacaacataatatatttctgtttaaagcataaccatggcgggaggttatagttcgcaataagaactggccaagtgctgtgagtactactcatgtcaccgaaaggattcatgccatccgtacatagacatatcctcatgtttctagggtcggcagcaaagtctttgtgttttcgatcgatattcctccattcaatcgaatccgctgggtgtctaagcataccgtcattccttctctccgtggcgtgccaacgtactaacttcgcttcgttcgggttggcaaagattctcttgaaacgatcaatgataggtagataccacacaacctttgccggaccacccctctttgacttatttccttcgtcagcacttttctttcgcttgtatcgagaagccttgcagacaggacaagcatccaagtccgcatattgcttgtggtacaatatgcagtcgttgggacaagcgtgaattctacggatctctaaccccagtggacacagaacctgctttgcttcgtatgtcgtctcgggcaatgtgttctcaactggaagcatagccttcaaaattcctaaaagatctgtgaaactcttgtctgtccatccactacttgccttcagcttcattaggtccaaggtaactgacaacttagtgtgttttgctttgcatctagcgtacagaggcgtctcggaatcactgaccaacctgctgaacttcattccatctctctcattctgggctgggtcctcaacgtcacgtaacatgtcttgcagcagatcgtgatccacatcaaccatttcacccccaatggagaaggtataaacatgtcatgctcatcttcatcttcctgattatgcgcaccacttctgtctgctgctgctccacttcctcattcttgctctccatgcttcacccaacatgtatagccctccatgaatcctcgttgtatcagatgaccgtgtacgtcctctccgctatcaaacatattctcttgcaatctgcacatggacaacacctgtaatcactgtttcttcttatccgatcctcctccgcggcgttcataaaatttattatgccctttctgtactccgtagaatgacgtttcaaattttttgcatacatccaacttcgatcaattgctacaaaataaaaaaaaacgaattagaggcacatattataagatcagtattgcaaaagtaagatgtgatgaaattgctcaattaatgattaatattactcacttgattgatccattttgatcacttttgggaatttaatttctgttttccttggaaaaatgacaaaaaatcgccccctacagcctcccaccaaaatagtgaacagtggcatacagttacactaggtggtgagggggtatttatacttgcaacaaatatctgtaatggccctacaacaatcaaccgtgacgggcatacaagtaatctctatcgggccttcataaaagcccgtcaaaaaagagtgtcatctgtaacgggcactaaacttatctcaatcgggcctctagttggagcccgtcacagatgaccctcatctgtgacgggtttcttttagggcccgattgagatatggaacccttatctcaattgggcctcaactatagcccatcacagataagtgtcatccgtgacgggctttagttttatgccgatataccatggttgtgcgaccatatctcaatcgggcgaaacttcagcccgattgagattacttcctctgacggcccgcaaattccagtcttgttatgggccgtcacagatggaaggatctgtcggtataaccgtccctgtcctgtcttcggtgattattctcatgatctcggtttttgtcgttgttgtgtcggtcattatgaggcgactgtctcgatcttcattgggggtattccctcggccgtcgtctctttctcaccgcgagggagagcaatgatggtgttgtcggtgcatagtaccgtcctcacgacgagaaggggagtgatggctgttgatggtcgttatcgatcagtttcgaccgtcaatattaccaaaatagagtagaactagtaatgcttgcaatgcataactatgtaagaataacaatattccactagtattaggtttactaaccttttgcagagaataaccataaagtagaggagaatcgatatcaactcaaacgataaatcagtcggacgatgtcaagaatcagacttatgtatgaatgggccaagaactcagaaatgacacgatcaattgggccaaaattcacaagtttgcagagaagaataatagaggaggccgccagccaaaccatgggatggttgggccagccccaggttcagccgaacctccctcatcgctgctggatgcagggtttcttctggacagtgtggattagctccaaatgatggttggagggtagttccgaccattccaaccgtcacaaccgtcattgggaggctatataaacccctcaccttctcacttcactcacaaacctcaagcaagagctctctcatttctctcaagtttagttcagtagtatctagctggtggaataggaatagagtagaaatcaggagtccggaagtcttcggaagagtttgggtatggctctagtggcttttctcttctcttttgtaagctttgtacttttattagaatactcttctgtatacatttatggtattgaaatactttccgagtatatgaatgcctactttacattatattcatgttatactgaatatacggctagcttaactgggagatgctttggtgcgggtataatgtttgcttatgcaattactctatgtcatgacgatgatattagagtagtatctggtagtttagacgtggtgtctagattacgggatatcattatttggggttatatgctgcggttgagaggtgggccgctgatgatgacagctcagtatggatattcctccaggcctatatagaatcctaagttaattctctagggagggtatggttgtatggtcatgatgggctgtcgtaaggaagtcgtcagtcaggggtggcttctcaaagtaccaggagggcatcggatagagggtattatctagtatatcggttaactagaatatatgtatactatatatattagaagtataggaatagattatctttctcttttctttccacttagcttagataatatattatgagaatgagtggctaatgcttgtgtgtcactctacccttagattatcttaacccctgcttaataatataattatcacaagtagcatataaattattagtcaagttctctctacatgatcttcccacgggataaaataaatacgatacccttggaatactctcgggtgaaatgctacaatggtatatctgtgcgcttgcggataaactctgtagccataatataccaggagtatttctgcgccattgctgggaattatatttctagtaatgtcgttaagaaataccaacaagcatttctggcaccgttgccggggaagattcataatagagattacctgaactaatattttatatttacctctgtataatcattttcctttgcaggctaaccttgattgtttttacttttgttgtgaaaactgggtagtgcatgactggtttcaacttgccggagaacttcaaagaaaatccagaagctttcttccagagcgtcaggccgcgagtcgttgctccacagaaaactctaccgacaaagaaaccagccgtaccagcgcaaccaaccttcaagactatggctgacaagacccttcgcgagttcgctgctctctctgctaacaatatggccattgggccgcaaatcaacatgggagacatggatttcaacttgaagtccaacctcatcacgatggcgcaggctagcccattctatggcaagcctaacgaggatgccaatgctcatctgcagcagttcttggagatctgtagcacgtacaccatcaagggcgtcagtccagacgccgttaggctaaggctgtttcctttctcccttctcgggagagcgaagtagtggttctatggcaaccgtgctgctgccaacacctgggatggacgactgcaggagtatgtggccacctgtcctcatcatgggatggacgactggctgatcctgcagaacttttacaatggactcaccccgatgtcccgcgatcgcctggatgcggcagctagaggagcattcttctctaaaacggttcgaggagccattgatttaatagagaagatggtcttcaatatgggttggagcgaggaacgactccagacccgtcagcgaggcatgcacaccgtcaaggagacggaactgcttgctgccaagctggacctcctaatgaaacgattggacgaccacgacaaacggctacaaggcaccatcaaggctttggactcacacgttacgtgtgaggtctgcagcaacacgggtcactctaggaatgactgctcggaaacccgtgaggaggcgatatacatgggcaacaacaacaacggtactgtccacaaggagatctggggtgaaaacaaccacgcccatattatcaaggaggtaacaacaacggtaacttttctaaccagccctccttgatggatctattctttgtggaagctaaaaccactgatgcactaagcaaaaagcttgcggccaatgacaagatcctagagaacataaatgttaagttagatggcttcgcttctgctttccaaaactagctgagcttcaataaaatgatagaaacctagctagctcagttagcatccttagtccctacaaatgaaactgggaggattccggggcaacctgactcctccgttgagaatgtcaaggcgatcacgacgaggggaggtaagtccactcgtgatccgccgtatcctaaccctgcaggaactaacgggattgcaaaagaagcgccatctagtgactcggctgacaaggaagttcagccagagaagaccatgctgcaggagtactgtgacacacgattgctaccgtttcctcaacggagtaggaaaccgtcagttgacgaacaattcgctcgttttgttgaagtaattcagaaaatccacatcaatgtgctgctgttggacgctatggaagtgccaacatatgcccgttatctcaaggacatactcaacaacaagagaccgctcctaacaacggaggtggttaagctgacagagcaatgcagcaacgtcatactccacaagctcccggagaagaagaaggatccgaggtgtcctacaatcacctgctcgatcggggcacaacagttcgaccaggtcttgcacgatcttggagccagtgtcagcatcataccaaaggacgtctttgacaagctcaacttcacggtgttggcatcgacaccgatgcgcctacaactggctgactcatcagtccgttacccggcagggatagcgaagatgtgccagttaagatacgggatttcttcatcctggttgatttcatggtgttggatatgggcacagcaaaggagacgccactcatcctagggcgcccgttccttagcaccgcgggagccaacattgacgtgggaacagggagtatccgtttccatatcaacgggaaggaggaaaagtttgagtttcaaccgaggacggaacaatgctccatggtcagaataaagtacggggcgaacccacagaaaattcaagtggtcgaagtggagccacccaagacggatagcctggtgaagttcatgcaaaatttcctggataaggaaacaacgatgcccatgaaccgttattggaggacgccggtaaaaccaaccataccggccaagaagcaagagcagccgactcagaggaagacgtcttccgcacctaagacaaggaaggtgtggaaggaaaagccaaagacgcctgctccatcacctccggagacggatggaaaatccacgaactgaatcagaagaaggtacaatcttgcacgtcggactttaaatgacgtgacctttgtcaacaggtacattggtatgtatccgcatatttattttcaacaatttaattcttgcatcaacacatgtttgaatttcaaaattgtatttatgatttttgaattttgaggaaattcttcagatgaatttttcagagaaagccaaaataaagttttcaacgaaaatttactgttccacgatcacattgaccgttggaatccaacggtcgaaagtggggctggttgagcccactaggggtggttcggccgaaccggccaggcaacgattacgtgccacttttggcagggtaactgctagtgggtcccacatgtcatttatgaccgttgtgggtaccctataaaagccagccgaccgagagaggaaattcaaccccatttcaacacattttcatttcctcttcaaaatttgctctcaagttcattgaagctttgatagtttccctcaaattcaaacactaattgcatatatacaagttgctttggtgaaactaaccggcaggtgaaactcttgctattctaacccccatcgagttagtctgttcttgctccattgtgcagaatgaggaggcgattgtctcatctgttcaaggggtccggctcttcatcaagtcatcatgacgagtctagtactcgttcatcagctgatatctcgatggaagacgccgaagctccgcgatgactcatgaatggcaccgacctcggccttgttggtgatcgggaaagacaagcctactacatgccgagcgaccgggagtatgctcacacacgagaatactctccggagctgctgaaaaagataggtatagatgttgaatttcgtgctatttggaaagttgttggttggcagagatttgttgtggtagatgagcctggttctcgtttgcttactttgcaatttctgtgcactttgaaagaaatagaagatgtaatttcctttcgctttttccataaggagtatacacttacatggaaaggcttaagcacacatcttggttttcacgattcctgtaaaatcgatcttcagaaaggaatttctgggttcgagaaaaataggttttgggaagatatttctggtgctctaatttgcaagaaacctaggacgaatgatatccataatgctacacttaggctcatgcataaatggattgctatgactttgttttctagaggtgatcttagacccattaggggggatgaattgattatgatgtttgccatggttagaaagatcaaaattgctcctgtgaaataaacacaataatggcaacaatttgctgatgctcagttcgcaaacttcaacaacataatgcagcaacagcacgatgaccttcaagcgtacttccgcttccaggggttcaatccttaccaaggaccctgagcgaaagct

SEQ ID NO: 83234 - DNA, 47687 bp, Oryza sativa
  unsure (1)..(47687): unsure at all n locations
atgtctagattcattaacatctatatgaatgtgggcaatgctagaaagtcttataatctgaaacggaggaagtaattaagatgagtaacatatatagaccactaacataactttaattgaactttttttgtcaagtgtccccattcacttacatatatattaaacttcatcatgactgtttagttattttaaaaagtaataacatgcatctgaagtgatgagtgggcaaattaacaactccccctcgtacatgcattagtcatatatcatagcatttccaagagtaaacttctcaatttgtcaaaaacttttcagtataaagttactcaataggcactgtcccactattaatgtcctaaagccgtccattaggcaatagatcaatcagggttgaaaactctagcagggtccacctacatgataaccggggctggcaagtttgatgagttcatctgagcgcgatttccacacaagcatgcatgatttccattgacagcatagatggccatatgatcgcgtaagctccacccaccttccttttttctttgtggtgatagaacacaatgtccatacagatgcgaagatagtttgatgtagcaagcaactacacaagcttataaatagttatatttctagatttgtatataccacaagctgcatgaagtgcatgctttgattatattaaaattttgaatgcttcatgagccaaagtagaccaccatatgcgagaaacgagaaaaaaaaactcatctttttagaagcgacttgtgcttcacacatatgccacagttgtctgacacaagcccaacatactcgttgggggataactaattacatggtaattatctaggatggactggattgggttcaatgcctcccagaccatttaattattcataatgcaacagattatgtatagatatcatcaacataacccggccatagctaatcaaatggtttgataggcataggacctactgtcagctctaacgagtactgacttagctaggttctatatttctatttattcggcaaacttacttcatcgtagtcatctagtgacaaaaacacctcatctaagcatgaaagctcggtgccctcaccgtggaagctcacttgtgaaccgcagctcgattcgaacactcggcacagcacccagttgttggactcctgtaatgatcatgcataaattttagtattttgtgctccagttactccttatacgcaatttactgaactgttgactgctgatcgagcagcaagatagagaggatatgcatcacttaccatgcttgagtggcctctcttcctatgagacctcctgttagagctcgagctagtcaagttgctgctaccgccagcgacgcaatccccgtctagcagatggtactcatgcatgatccagttggttctgatgccttcagagggctctccaatggagaatagcagcgttttcttcaagccaacattgcggccgccgcttcttactgtttcatcaactccaatggggctccagtgcccattggatgaggtcctactttgtgttagatggcagaagaagtaccactggttcccagcttgcagtgctttgccttaaaattgcaatttctatcagcactcagcatgacttgtaagagaacaaattagtgaaatcatattgatcaatgcagttgcagacttaccattcagctcccatggattgtaccgatgcggaagcagcgtcgggatgatgtcagggtggcatgggaggagggagaccttgcgacggaggaaatggacgacgagctcttcatccgaggggaagaagtggaaacctggaggtaagtttgtagctcctcccatgctacaactacaagtgcaacttacaaactgcagtcaaatgcaacttggctgggatattgatgaatttgaaatgggaagcttgctgatcttggtgagcgagtgctacttatagggagcatatgtgtgtgattgtgtgaaagagtgagatgtagagagagagagagagagagagagagagagagagagacgtgcaagtcaaggagtgctgagtgctgatccgtaggaggatggcagccaagcgagggcgacattttgcgatgcttatattctatatatttctcttttcttctttggagggaaataatgatactatgaggagacatttgttggatcatggattcatgatgcactgctatgtacccgttggctgcagtagtgtgcagagatatatattagtttttcagaggggggcagaaataataattgaatcattccatagtacatgcatgataaaagtgttcatccagcagcctgtgatataattgatggccttaaggattgttggcttatattagatctcagctggtaggtatcagtacttttttgttgattagtcattacctcattgaattggattttctatcagcaatttctttaagcctgtattaattacttactgtatagattattatatcaagtgtttgaagttttatcaagtgataaggttttcacatgagctgattactacattgtgacaggcactccttaatgtacattccccaaaacctcagaacaaggtaatgtgacaggcaacatctctagtgcagtatttcttttcatgatcattgcgtatactatttgtttcccccctgaccattgcattcttgctcatgtcatgcaggcgtcacccttctcaagccatatgcaccttgaccacagccagccattatatacacgagtgccagcaagcaagttgcacattttttctggacctgtgtggcaaaagtacaagggcatcacttgaagaagaagcaacccagatgttgtcctcctgttgtatacattgctgcgtcagaggggtacactaatcattccaaattattcatgaatcaactggggaaaattcttatctgccttggcaggcacaataattatcaggagaggatcacctcacctgagagtgattaactagaaaaatgcccagttggtgaaaggactccatgccatcaagttgcatcgatctcaagtggtaagagtataagaccccccccccccccccctccatctttcttggtagaaagtttaacaatctcatgatgaccacttgtgaagagatccatcaaaggaaactgtggttcgattcaatcccgattggtttcagatgcaagaagatgcttatctcgataagattaaccaaaatgagatcatgatggccgaatcttccaggaactctcacacaactcctctgtgctgctcccaggaaaagatcatggtggcctcatcattccaatggtgcggaggcagccccccctcgctgtcgctcgcacggtttctcttgagcctctatctttctagctcttggatctctttagtttttttttggctttggctttatcttttgggatcatatgcatgctgtgcttctttgtggcagggcatgtccgccactggaagccggtgctctgctgctgctgctgccggggggaatcaatggaacgccattgccgttgccagcacacgtgaggcaaaacctaacatctcctgagtcctgaggggggtggtgggccccacctgtcatgcagagcgtgggtgacccggccccaccacagcacctggtgctggtggtgatgacgtcgtgctgatgcagttcggtcgaggcgcgcacattggccgatgctgtgggggaggagaatgatggagatcctcattcttgttggcacatgctcaggtgcgcatgcaggcgtagtgtactgcctgcggttggttgtggcatgtatcatttgatcatcccaactctctagccttgtagcctcgaggtgatgttcttgacttcaaaaacccaacccaacctcgttctgctgattagtttcgcagatgtgaacatgatgacgatgatctattgatctagtgtgtgttaaagtaacatttggttggtgttttgcaggacgcagtagttcttctgtctgaatgagcaagattgcactgcactgttcattggtcaatatcagatttgcaattaccatcagattgatcaagtgggagtaaaaaggtggctggcacaccttggatgcttactgctggtggtgaaggatgagaaagaggagggcatacgaggccacattctgccaatggcacctgagctatgcaaaatatgccgctcgtgggcaatgtgaggcacacattttgcatcccgcattcctgcctcatcggatagggcggaacggaagggatagaaatggttggatggatggataataccttgtggcagtcagtgttgctgctgcagcagcagcagccttcctccacttccaccaccggcgccacaagaaaagacgacgacgaccgacgccgacgccgacgcgtgcggcaccagccgacgatcgacgaggtgataccgagcttggtgcggtggtgatggcgaattgggtggagaacgaacgaacgaacgggagagacccaaccacgaggatagtaactactactactgtctttcacctgttgccttgcagggtaaaaaaggggctcttcatccgttggctagtttctccagctactgcgtgtctacatcaccagtgacgcatgccaatgcagtgcactccagtagtctcctacgctgctcttgtgcaaacttatttgctgctgctacgacggaccacatcggtttgcagatttccttgaattgaagtactcgactagcgcatccatcatctcgacgttgtggcgaatcgaatgaatggagttagctcctcttcaactattgctttagccggttgctgtgttcttgtttttcttgtctcttgcgtgcatcggtgcatggtgttcttgcatcatcagatcatctccatagtgtttgctatgctagcttgttccggctgcttcaaatggttccaatactccaatccactggcctcaccaccacccaatggtaaagctgctctgcccactcgctgagttttcttttttttttaaccattttgcaacgcacgcgcaaaatgtaccaagcacattattgttatctgctcaaatggaccatcctcatacggcgcttgacattcagcactctcaggcacattattgttccatcagattttccttttgtcgccttcttcaaatgccttgtgaagctgtgatggacgaagtaaagtagaacgagtactccaaaattcttttgcaaatcctcctaataaaaaaggcattaaatgtaacatgggcgtaatcttcccaagttgcatgccattgatagactgaactagacatatatatatatgccttcatgcttgtcaattgccaattgacgacaacatattcttcaactccgatctgaatcatccactgcaaaattcagtcaaacttcgcacacaaaaattatattatatatgtactctgaacgttcaataacaaagactacaaattacaaagagtggaaagctgaagacttctatcctaccaccttcccaaatccaaatatacgatcatcgtggcaaagattggaaatcaacacctctattgcagaggggggaaaatgagtaaatgactcagtagttgattcttcaaactcacaaattgagctggatcaggcaattgtaaagctctgccgaggcaatggcccaaagttctggactctgaatttgtcctgtcagttgtcatcttcaagtgaaaaattgatccttcaggatgccaagttccaaacgaatcaaaatcgtacgagtttatttgtgattgcaatctcaaagaaacacaataaccacattttggactctgacgctcctttgcagcatccttgaaacacaccaccaatctgccataccaaggatgctgaaggcaaatcagtgggcttcatccctcatgcctgagaccaatggccttgttcttgcaatgctaaagcaattgtttcattccagaggatgtatctttcagcacaaaacaaaattgccatgcttgtcctcaacattaccccgagcacgtgatgaaaaagcttgtccagcatctcatatatttcatttgcgtcacagtgagatgtgttagcagcgacaaacaagtgtttttctctctgcacctctatccaactataagctcctcaacattaccccctataatgaacatgtgatgaaaaagcttgtccagcatctcatatatttcattcgcctcatggtgagatgtgtcatcggcgacgaacatgtgttttgctctctgcacctctatccaactataagcttggtccttcctcaatcctttccccttcatgagagccctgacctggcgggcatcgtcccactgtcctgctgctgagtatatgtttgacaacatgacataccgaccactgttctcaggctccaactggaacagggcctcggcaacttcttccgcgatctcaatattgccatgaacatgacatgcaccaaggagggccccccatgacccagttgtacccagaccgatcttggaggacaagcctttgatgaactcacttgcttcttccagctggcgattccgaccaagagcatcaatgaaagcggcgtagtgttcagctcttggttcaacaccatggtcctgcattgattcaagaatccggcggccatcagagactagaccagcatggctgcaagctgtgaggacagcgagaaaagtgacataggttggttgtacttcatctttaagcatcctctcaaacactgcaagtgactgctttccctggccattgtgcgagaaccctgtcaccatggagttccaagagatgatgtccctctcaagcatcctgtcaaacaccgccatggccgctaccatgtcgccacacttggaatacatgtcaataagggcattgtggatgaaaacgttgaaagggtctgaaccgatgctcctgcgcaagatgaagccatgcacttccttccctcgggcgacaagaccaaccttggcgcacgcacccagacatgacacgagggcaaagggggttggcactaccccctcacctgtcatcctttcaaaaagctcgagagcgatctcctcctccccattctgctcatgcccagagatgagtgctgtccatgctatggcgtcctgcgctggcatcatgtcgaatacttgcacagcatcgtcaagcatgcttgcccggcaataccctgcaatcatcgatgtccaagaaaccgagtcacggatggtcatctggtcgaataccccccgtgcatcctccaccctcccggccttgctgtaggcgtccaccattgcgttggccatgatgacagtcacctccatacccgacaccaccaccgcgccatgcaactcgcggaggtgcctcgcatcccggagccccgcgcacgcgctcgcggcgctgaccaccgtgaaccggtcgatggccacctgctgctgccccaggcccctgtccctggccagctgggcgaacacgcggagcgcctcagactcgcggccgtgacgcgcgagcgacgagatgacggtgttgtaggagacgacgttgcgggaggcgggcggcattccgtcgagcaggcggagggcgtcggggagggtgccgcggccccgggccagcgccgccagaagggagttgtacgagtgcgcgttcttgtgcgggaggtcgtcgaaggcggcgagcgatgccgccggggtggggagcagcgcgtagagcgcgacgaggcggttggagaggagggtgtggtgggtgagcgccgtcttgacgaggagcgcgtgcaccgccgcgccgaggcggcgcacgtcccccgcggagatcgcgcgctccagcagggccagcaccgcctctactgtgacggcggaggcggcggcggcgctggccggagcagccgccgccgccgccggccatggcggagtgagaaggcggcgcatgcgcttgcaacgagcagccgcgacgacccagaaaagagctaaagcccaccactgtgccgttgtccgtgggcctcgagctgtgggctctgggccgtgggccgtcaaagcaatcgaagagtttatattttgtgggccaagtaaagccgtctcgtcttgctgttctagaagatttctcttcgcgtcgccggcgctgacaccgccgccgccaccgccatctccggcgaaaaccctacctgcacccgtccagcgagcgccaggaggtaggctctagccgggcggaggatggtgttcgggcaggtggtgatcgggccgccgggctccggcaagacgacctactgcaacgggatgtcccagttcctctccctcgtcggcaggtgagtagctcgtgcttctgctgctccaaccctcgcaagctactcccttcgtgctcgcggttccggtgctaggtgtttgtttgtttgtttgttccaaatttctggtcggccttgcgttctgttggttgcagaagcgtattgcttacctcctgggcatggactcgctatgcagttcgggtaggaatttgtggaaagcaagaactaggtcgcttgattcagatagtaggtagatttcgaattgagtatgccggctttatgccgatagagagagaaggttgggagagtgaggggagatgggcaattttctcccatggaggcagggagcttgctcatggaaggtttccccaacttgcaaatttgcaattatgctaaatgttttgacttatgtgcttcactgttgcgttgcaggaaagttgcggttatcaatctcgatcctgcgaatgatgtgttgccgtatcctctgcactttgagctctgaaatgctccatttgccatattatcttgtttcacttgttggattgttgttctgcagttaaacctgaaatgtatccttgacagcggtgattaagatatgaatgcgccataaacattgaggacctcataaaactgagtgatgtcatgtctgagcattcgcttggtccaaatggaggtttggcccagagccccagacttcaggaatcaaacctgttatttcttttgtatgttcgcttatggtatgctgttgaaatttgtgtcaggccttgtgtattgcatggattacttggagaagaatatcgactggcttgaggaaaagttgaaacctcttattgaaggtcggtataggctggctttctttattaaaaccatatccatgagctgcagcctggaagatctataaaatggagatcttctatagaagtcatgatctcatcgatattgttcgcacagctgataaaaaaattgttgttatggtgcattcagagaaaaatgtaatatttggtcaatttcaattatttccttttcaaaatggtttactcacaactgtttgtttggtctgaagtcttaactttttgcagttctagaaaagtaggacccaattaaagttatagattttgaacaattagagctcctgggttccattattctgaggattgtgtttcagtttgttcacaagtacaccttttgtttgttgagctagttctgaaagatcatagtaggggttactaaaatacctatacagatactgctttattgtcatgatttcctatgtgatttgctcaatggtggtgatgatttctgcagatcactatctgttatttgatttcccgggtcaagtggaacttttctttctacactcaaatgcgaggagtattatttacaaacttatcaaaaagctaaacttgcgggtacaactgtgttaaatcctatccagagttcattgattatgtaatgaattgcgttgcccacaatatttcttggtattctacagctgactgccgtgcaccttattgatgctcatttgtgctgtgatcctgggaagtatgtgagtgcattgcttctttcactgtcaacaatgctacacatggagctgccacacatcaatgttttgtcaaagattgacctcattgagaactatggaaacttaggtactgctttacctgcagcagaatttagttgattattacatgtttctatttactcatcttttttgttggcagcattcaacctcaacttctacactgatgtcgaggatctgtcttatttgcaacgccatctagatcaagatcctcgttctgccaagtacaggtaaaacataaaaatccaagcagcaaatacataactttactgcctcaaaaagtcatgcatatgcagtccagcatacttgcatagttacattgcacttattgaaaccttgttacttgatcaaattagatgtaattaagcaggcatttccagttctcttgggaatattgtgaaatgtgtgtgcagtagcagtacccttttgtccatttctttgtttattgagaaaccaaaggttgcaactaatatatttgtgcaaaaaatccgatgctcaacctgtttaagattaagaatatgtacttgggtaaagttgaaaaaccaaacacaggagttgtgaatgcatctattgtttttgcttcttggggattgatagacgatcatcctaaatcaatgtctgttaacatagcagtgtgacctgttatgaagtgagatgcagtaaccctgggaatcatttaattattcaaatcaaaatctctgataatgttgctcttatgcttggatttcacctttgtaattatttttattgcttgggttatttataatatttttgttccatctgcttaaggaaacttactaaggagctgtgcgatgtgattgacgattttggcttggtcaattttacaactttggacatccaggtacttacttgaaagattcagttatttcaattaagatccctgtgaacttggtcttacaagttgtttttgcctctaggacaaggaaagcgtcggcaatcttgtgaaattgattgacaaaagcaatggctatatattttcatctatagacagcagtgtcgttgagttcagtaaaattgcagcagcgccacttgactgggattactacagatatcctttactgtctcttctagcacctagcttattcaaacaaatatctttactctcataccttaagttattttcagtgttctagaagcactctattcaaatcacccctctggcacgtacaggcataaattattacaatatggaacaacactagaatggaacagcactagaccaccttacatagcaaatttatggctgtgcaacttgccaattttcacatggagcctgtagtatttgtggcaatgttggtattccagactggtatttggatttactagtgcttacccttgaaggcaattcgcatgcctgctgtatgatccttggatgctgctttactgttttttttttctttctcttgtccatgaaatacatcactattatagcccccttgcacctttccacatttccttttgttccttgacatgtgactacaacagcagaggtgcaggagaagtacatgaaagacgacgaattcgtgcagaagacaagcaagacgcgatgaaactgaatttgtttgtaatgcttgacatgtgaccttgctatgcttgaatgagagctccatttgcccccatgccgctcaggtagggatgtaacatgttgtgacatgcaaactggaactgagaaatgtactctctccattttaaaatgtttgacaccattgactttttagcacatgtttgaccgttcgtcttattcaaaaaattttgtgaaatatgtaaaactatatgtgtacacaaaagtatatttaacaatgaatcaaatgatatgaaaagaataaataattacttaaattttttaaataagatgaatggtcaaacatgtactaaaaagtcaacggtgtcaaacattttgaaacggagggagtattttaccataacaacgatacttgtagtttcaacccatgtatcccagctgtagatgtctcgtgctagctgctagatgtgctatgtgtaggacagtaggagtacaactctgaacatgctatgctaattcgatctaggcctgcctagttcttaattttttcttcaaacttataacttttccatcacattaaaacttttctacacacaaattttcaacttttctgtcacatcgttctaatttcaatcaaactttcaattttagcgtgaactaaacacaccactagtaagtcggatctggtcttgccaccccaccagtttccaccagggtttgtatttcggacgacaaccgatcaaaaaccacgaaagtagatacccagtgaaatttcaagtggtttttgataattcaattttgaaacagtaaattttagctaaattttcgatcaatactgggtgttagagatctcacctggttaccacaaagtatcataaagcacacaagattacaggcagtttttgcaatggtataaacaagagtacaagacaagattacaagcaggcagtttttgcaaggttttttgcaatggtataaacgagacaagattacaagcagtttttgcaaagatttaaacaaggggatcatgatccccaatcttcaaagtcatgtaactttatcattgacatgtggatccgatgaaccattgactcatatgtcaataactttaaatatagaggatcttaatccattggatccacatgtcataacaaaagcatagtaactttaaatgtagaggatctaaattcatcggatccacatgcaaaagcatagtaactttaaacgtagaggatctaaattcatcggatccacatgcagtaacaaaagcgatctaaatccatcggatccacatgtcagtaacaaaagcacagtgactttaaacgtacaggatcttaatccggaacaaagtggcacagctattttgtctgctctgatccggagcttctgacctgtgctcaccaccagagttttaaaatggaaagcttgcatcaggccacgtggcgttgacaaagaaccaatcccaatgtggccacgagccccggccacgccgccgccgccgccatggccatcaaaacctagtgccgcctcgcgcagcgcgctgcgtcgtttggatctcgacgacggccggcgccaaggcacggagggagaagaaaaccacgcgcctcttctgtgttctccggcgatggcgagctccacggcatttgcagcggcatttgcgctgctgctgctagcgtcgtcggcggcggcggagggggaggcggtgctgacgctggacgccggcaacttcacggaggtggtgggggcgcacgacttcatcgtcgtcgagttctacgccccatggtacgtacattgtacaggcaaaccccattcctcgccgccggctcggcgccatggcgccttgctgattttgaccttgagctcagctgaccaaatcctcttcgccgccgccgcaggtgtggccactgcaaccagcttgctccggagtacgaggcggccgccgccgccctgcgctcgcacgacccgccggtcgtcctcgccaaggtcgacgccagcgccgacctgaaccggggcctcgccggcgagcacggcgtgcagggctaccccaccatcaggatcctccgggaccgcggcgccaggtcgcacaactacgccgggccccgggacgccgccggcatcgtcgcctacctcaagaggcaggccggcccggcctccgtcgagatcgctgcctccgcctcgccgccagcggccgactccatcgccaacgacggcgtggtcgtcgtgagtttgacctcctcttctctctgcatcagctgtttatgcttatacttacaagctaaaggctctcattggatggcctaaatagtcaaagaataagtcaaattttaaattttcaaacttaaatttaagattgattttaagatatttttaacgtaatttcttttttaatattggcttttaagtcatcaagaacatatatatatatatgaaagttttatctataaatttatttttatcccctaataagctgttttggcttattagggaaagagccaaacgatgggagactaaaatttaattttacatttgaatttttggttttttattataaatagcatttacttttttaagtacatttgattttttgttttttaattataaatagcatttacttttttatatgtatatataaaagttttactcacaaataatatttttatttacaaataaagtgattcggataaacatacaaataagcgaaacaatgacccgatgcatcagtcaaatactcttgctgatgcaggtcggagttttccccgaacttagcggcagcgagttcgagagtttcatggcggtggcggagaagatgagggccgactacgatttccggcacacgacggacgccggcgtcctcccacggggtgatcggacggtgagggggcctctcgtccgcctcttcaagcccttcgacgagctcttcgttgactcgcaggtacactagctgaaaattaatgctacagagatactctgctctgttttgatccctccaggggaggggtatctctgtattcttgtttgcttaaaatcatccaagtagttatgattcatgaaaatttctgtaaaaagttgacagcgttcgtacaaatacatataccacctctaaaaaaatgtaagatccaaactcaacttacacattgatatataaaaaacataaattcggtatatgaataatagggtagtggtagtgtccatacccgaatttatctttttttttcaaggtgcatgtcaaatttaaacttaatttctggtgaatcgataaatatcattatactttatattgccaattttttcaaaaaaatttacagctatttacaataaatttggaacaaaaatatacacgaggggatatgaatatcctccaagggattagctagtagtagctcacattttggataagaaatggacagaaatttggattgcttcttgtttttatttttcaggattttgatagagatgcgttggagaagtttatcgagtcttctggtttccctacagtggttacctttgacactagtccggcaaaccagaaataccttctgaaatacttcgacaatgccggcaccaaagtaaggacagacaattggttgacttctcactctgtttgcctacactggactgtttagcttgttgtttaggccatgattgcctcttatcatgtgcacacgattttcactgtctctcatgttttatttcaatgtgctgctggaatccataattgagaatgcaactcttgtctcacttggtctgatcatctgttctttctgaacctgattttgagcgtgcaggcgatgcttttcctgagcttcagtgatgacagagcagaggaattcagaactcagttccatgaagctgcaaatcaatacagcgcaaacaacataagctttctgattggtgatgtcactgcctctcagggtgctttccaggtaatcttttgccttcttttttccataacaatctttattagtacattgctttgccccaacatttcgtataaaaacaatgtccaagagttgaaaatgcctgctgtctgaccatttttgaatgcacaatgttccagtattttgggcttaaagagagtgaagtgcccctcgttttcatactagcatcgaagtcgaagtatatcaaaccaactgtggagcctgatcagatcttgccctacctgaaggaatttacagtaagccaatttctgaactgacgctattatcctcttcctcgtttactaattccctgatatatattctgtgggttctttaagtcgcttgcgtgatatttagtctcactattttatactagggactatgaaggttacttattattagtactacctctttttttaatttctgatgctgttaaatttttgggataagtttgaccatcgtcttattcaaaaaatttatgtaattattatttatttttattatgacttgatttatcatcaaatgttctttatgcatgatttaaatgttttcatatttgcataaaaaaatttaaataaaacgaatggtcaaacattgataaaaggttaattacgtcatacattaaaaaccggagaaagtttcgctacgtgcttagtcagtttgccttgattttctttatgcaggaaggaacattggcaccccatgttaaatcagaacccattccggaggttaacgatcagcctgttaagaccgttgttgctgacaatcttcgagaggtggttttcaactccggcaaaaacggtatgttcttggctacttgcttgaagaacttgtattaattaccactcgacctgttacagaatgcaagatgttttggtttttgttacaagcaattttttttcaagtttaaccgagtacatagaaaatgtagcaacatttataacaccacattaatttcattaaatctagcgttgaatatatttttgtaatatatttttttagtgctgaaaatgatgttacgtttttcttaaacctggtcaaactttgacttggataaaatcaaaacaccttatattaaagtggaggaggtagatatttgtttaagttatgccctgcatgcctgatgcctgcttcgtcgtcaacatcttaaccattttgttaatttgtttgctcaagctgtcaaaacataagttcggtctctgttttttttttttcaaattccttttgcagttctgctcgagttctatgctccatggtgtggacattgtcagaagctggccccgatcttggaagaggttgcagtttcattgaaagatgatgaagacgtcgtcatagcaaagatggtaatctaccctacctatgagctctctccattgcttggtccatgctggccttgtcaaagatatgattgaaaaatgccttcatagcatgcatccataaaccatctgatctatttatttcttaaaaaaacaaaacaaaacaatcagactgattcattttattttttttagaaaaaaagcaaccatcaaattcacatgtcatgcctggggaaaaaaaagactcaagtttgacattttttttgcctcaaattcaacaaaccagattattatcagaacacgcgcgtttctcaccgttcacctcttgaccaattcgtttgccctgaattgcaggatggtactgccaacgatgtaccgtcagatttcgcggtggaggggtacccaagcatgtacttctactcgtctggggggaacctcctgccctacgacgggaggacagccgaggagatcatcgatttcatcaccaagaacaagggctccaggcctggggaagcaaccacgactgaatctgtcaaggatgaactgtgatggccacttggtcagtgattcagcgactccaagttttttttttttgtttctttaccaaaagagagctgcattttgcaaaacactgatttattcaggatgaattgcaatctaaaatcatctttgtattattttttgtagggggagtggggagcttcaggttaggaggtgcagtgcagctgacagcttgaggacatagctcagtactgaatttaatcttgtattcgagttccaggtttccaagtacatgtagcattaccaatggtttcatacatacatgtccccccccttttttttttttgcaccgctgaaatctgttattgtaacatcattacactacatcgaataatccccattttagcttgccaaacgagtaactaaaatccctgtgtttctgaaccgaataatcttaccaaactgaaccaaaaaaaaaaaaggacagcatcaaatgtccctgcctttctgaatctctgctgctccagagtggttggcgttagataagctctctcgttacagccatcctgtcctaacaaagtaattaagcatgtaaactttgttcctttcttctttttttttttgtgtgtgtgtgtgtgttgtcaaaagctatcatcctaacataatgtgaggtcccatggatgatgattgtccacaaggttggtggcgatcgatgctgcactgcaatttgcaaagccgtgagagagatgagatgagagaatcaaagccgtacgcgcggctccgctgttgcaatcaggttggtcgttggctgtccctctcctttttctctcctctctctctctgctgatctgctgccttttggacagtgcatctctgcatgcgagctcagcactagcagcagagcagcaaggctttgcacttgcaagctttttttttttttttgggagaacttgcacttgcaagctgctctccctttctatctccactacttctcactttccaaatttccatatcaatgtgaatgatagtaataataactaattgcattgtctggttgagctatctgccacctaatttaatgaccaaatggtccgctttattaatcgactgcgagtacactgttgcactgtcgcactgttacatatatatatccagatttttaacattagtaacttttgttagtggtaaggtactaaggtcttgccttttattattatttttttctttctcttcagttaattcgattttatattcctagtctttagatatgtgatctggtatgtggaaaatgccacttgaaggatgtaaacaaacatgtacatactgctagcgtgcaacttacaaatggggaaacaaaagcaataattttcctcttacccagaaaaaacaaaaccaagaactcctcaacatttataactgaatttaaatcctaatgttgactgtacgatcgattatgcatacatggtgtgcatttaattttgaaaaggaaaaaaaaaacactgagctgagctccagaagatgcttttaattacacacagtaggttaattaattactttgccgcgaatgtatgtgcggcgagagaatagtaattaagagtaagctagcgctaatcatggcacgtagatgctcccgtggcggcgatggtggtggcggcacggcggcgccggcgacggcgacgacttgtcgacggcgaacagcttccggaagagcctcagcagcagctcccaccccgtcgtcgccctgctcccgccgccgccgccacggcggccgccgtagaactggcccacggcgcccgcccgcgacgacgccctcagcatcgtcggcgcgcacccgtacagccctcctcctcctcccggtggggacgacgacggcgtctcctcgtcgtcgtcgtcgtcggccgccgccgcgggtgacggtgacggtgacggcggcgtcccggccgccgcgcgctgctgctggcggcgccggagctgaagcaggagctcgtcgttgaagtcctcccacagcaggtccatcctctcctcgtcgccggcgcgcgcgtcgcggtcgcgctcccacagctggtccatccgctcctcctcctcctcctcgtcgacgcgccgtgctgctgctaccggcgccgtcgccgccaccgcctggccgcccgacgccgcgtcgtcgtcgtccgccgtagccatcgtggatgagaatggccagaggaggccgccctggctgctcggtgccagcgacgacgtcgccgccgccgccaccgccgtcgccgtcgccgtcgccgccggcgcggggaacgtgaagtcgtcgtcgtcgtcctccatggacgaggcgaggcgaggcgatcgagctgctactgttgcgctctgacactagacactgctaagtctcgcgctgggtttgtgtattgaagtgatgataaggttagagagtggaatagtacgtggacgcgattgggtacccttgccttgtgttgttgtggagttgggcaggtgacaggtagctagcgccagtaatgctagatttggattgtagttagggagagaatatatgtatacgtatgggtggtattaattactcccccgtatctaaatatttgcgttgatttttttaaacatatttaatcgttcgttttatttaaaaacttttgtaaaatatgtaaaactatatgtataaataaaagtatattaaacaataaatcaaatgataggaaaggaattgataattacttaaaatttttaaataatatgaacggtcaaacatattttaaaaaaagtcaacgacgtcaaatatttaaggacggagggagtataatacagattttatttcatttttcgtgttttcgttagcaactttaatttttttttcaaacttttaaattgtatgtttcgtatgaaagattttttaataaaaattaatttaaaatatcaaataaatttatttttaaagtttttaataattaaaatttagctttcttgttttatgtgttacaacattattttcatcttactagcaaaaatacttgtgtgcaacacgtgaagacaattttcacgattgataaaaactctatcaatttaaatgacaaatcctaacgagacgaacaaaataatggtaaaacaaaatcagaaatcatatattatagcattgaacccggctgtatttatagcattgaacccggttgttgcgcttgcttcatacgtcatcacacgaataatctcttacgtacagctttccataacctcacaaatcaatcgggtggccattccataaatcgatacctgggtattttactatgcctcatcgaccatatattgaaatttttattatttagttagtgaaagtttttttactgtagattgaaagcatttataaagtaacaaacttgccacatatacaccttaaacaatgataactttaagaaaaatattgatgagaagagaattttgaaagagaaaaggaaaggaaaaaaagagaaaaggatgagaaaacagaagagggggaggagagggagaggttcatgatgatggagaaaagaaaaggagaaaaagaaaaaaaagagagaaaaaaacgtcgatcgaggcaggggtgcacggaacggggtgccggtgggatggtgtgggacggttgggttgggctaggaggaggaggggatgtacaatagttgttctacttatgtcgaattaggtacgggtgatgtacaaccaactcaaaaattaactcaagcacggattacgtaccaaaattctgacaaaaacgtcatcaatttctataatactagaaaaaaaatactcgtgtgttgcaacaggtgaagtctattttaatcttattattgttatatggtttagttaagatgaaattcacgatcttaaaaaccgactcaaatacggatatgtatttccaaaagcaatcaaacttaaaaaccgacccatacacgaatgacgtaccaaaataccggtaaaaacatcttcatttttataatagtagagaagagatatagattaaaaccaaaacataaaattaaaaccgactcaaacacggatgatgaactacggaaatatcttcaatttttataaccggctcaaacacggatgacggaccacgaaaatatacttaatttttataatagtagagatttgaaaagaagaagacgaccatactatagcaccaacagtatatgatatatcgagagggctatttgcgcttgacggagcgtggggctcctcaccgggagaccgcgcaggccccctttgccggttcggccgggggcgctaagtgaggttcttcgccctcgatctgaggaacgtccgcgagagaggaaatgcacaagacacgggcgacgtagacaggttcgggccgctgagaagcgtaacaccctactcctgtgttctggtggatctgtgcgtgaaggaatacagagagccggagagcgagagagagttcaggctctagcaccccttcgccagagtcccaaacctccttcctcttttctctcctctccctttctctcctaggcctgggcctcctttttatctggtcaggggtcaccacaagggcctacagctacctaagaaaggaaacatgctttttacaatgagggctagtctacagccggaagtgacctctgacaagcagagcacacgcctcctgccccgctcgcccgcttttccggtggacgcccatttcaaccttcatttaatggccagcgacttccttgccatacttgcgctgaagcctggaatggatctgaccgggactgacataccaactccaggagttagcacgccggctccggctagggacgagagccaggaagctctcattattccgacgggacggggcgaggcgtgtgacaggccgcctgttgccacctaacccgcgatctgaccggtctgcgaccggtcacacaccgcgaccggtctcggaccggataagcgcgcgctgcgccgcattaaatgcggcgtggcgcgctcgtccaacctgctataaatgcggttaggtgagcccgctgtgctcacctaacccacacacgtggcgccaaaaccacagggggtcggggcgccccagccctcggggccgaaacgggagcggtccgacccctcggggagacagagggaggggtggccacgtcatcctcgggcccgacccccccccccccgagggggtcaggccacgtgggtgaccgcggctacccaagcctctagtcacgatacccccggccccatgtcaccgacagcgctattggcacactcttcccttcctttgtggacgaaatgttttccttttcagatgaaagtttcaagttttatgccaaagcacacaatatataatactgcagcacgacaaccattgttctgccaagattacctatataatacttggttttgcatatcatatactccctccgtcccataatgttgcaaccgaggatgggtactaggtctacgaatctgtccagtccaggacagattcgtagtcctaggatggttgcaacattatgggacggagggagtataaacagaagaagtctagagtggatctcgatctacgcacgtctactcttggccctcgtgtcttctcttggttcgggatttaacgcacggaaggcagttcataccattccgctcccatgatgaaaccaacagcaacagatgcaacggtgacaagtatggtcatcacattctcttttctgatcttgtcgaggtgctccctatcaaaaggatgtttgcgtatactcactccttcctaaatgtttggcgccgttgacttttttaaacacgtttgaccgttcatcttattcaaaaacttttgtgaaatatataaaactatatgtatgcataaaaataaatcaagcgatagaaaaataattaataattacttaaattttttaaataagactaacgggtcaaacatttttaaaaaaagtcaacggcgtcaaacattttgggatggagggagtataatgcatgaatgttaggatcgttttcatttgagtaaaaattaatgaaataaatcgtagcgcctccaaattaattaattacctcgccagcttcatctctaattctagctatcccatcatcaataatactagctatcttgccatctatctccactcccttattttctaattttgccaacagatgatcaacctccttcgtcttcctggcaacatcagctctagctcctttggcggatccaccctgctagtaggattaattagagaaatatatatagttagttgaaatggtaatgcataagctaaaaacagctagccatgcatgttagtggatgctaatgatcagagagcaatggctgcaattggctaacggtggtcctttcagagattgtactactaaacttacaaaagtttgacgaccagcatatgtccgactatatgaaatttatattactatacttgtttttggaaatgctttaataacagtacaatatagaaaataattgatatagaagcactaaaacggataccctcatctcaatcgggcggtaagccccatctcaatcgggcacggcgtccgtcacaggctagaagtcactgatgtgaagagttatctcaatcgggcaaacggccgtcacggatgaacccgccaccgatagctttgacccagacgaccagtcaaactatagcccatcacagatgacctatctcaatcgggccacaactagcgcccgtcacagatgactactaacctcaatcgggcctacactagagcacatcacagatgatactcatctcaatcgggtctaaactagagcccgtcacagatgactacttacctcaatcgggcctaaactagaacccgtcacagatgatactcatctcaatcgggcattaagtacggcccgtcacagatgaccatcatctcaatcgggcatttagttatgtcccgtcacagatgactataatgcacaaaaaaataaattttgttttttggctagcctcaggcctttgctagccatgccagctgcaaaaataacagaaacaaacatagatatacaatatgcagtcgtttggacaagcgtgaattctacggacttctaaccccagtggacacagaacctattttgcttcgtatgtcgtctcgggcaatgtgttctcagcaagaagcatagccttcaaaatttctaaaagatctgtgaaactcttgtctgtctatccattacttgtcttcaacttcattaggtccaaggtaactgacaacttagtgtgctttgctttgcatccagcgtacagaggcgtctcggaatcactgaccaacctactgaacttcatggaatctctctcattctgggctgggtcctcaacgtcatgtaacatgtcttgcagcagatcgtgatccacatcaaacatttcaccgcctaatggagaaggtataaacatgtcatgctcatcttcatcttcctaattatgcgcaccacttctgtctgctgctgctccacttcctgattcttgcttccatgtttcacccaatatgtatagcccttcatgaatcctcgttgtatcagatgaccgtgtacatcctctccgctatcaaacatattctcattcttacaatctgcacatggacaacacatgtaatcgttgtttcttcttttcctatcctcctccgcatcgttcataaaatttattacaccatttctgtactccggaaaatgatgtttcacaatttcgcatacatccaacttcgatcaattgctacaaaataaaaaaaataaattagaggcacatcttataagatcagtattgttaaagtaagacgtgatgaaattgctcaattaatgattaatattactcacttgattgctccattttgatcacttttgggaattttctgttttccttggaaaaaagacaaagaatcgccccctacagcctcctaccaaaatagtgaacagtgggatacagttacactaggtggtggagggtatttatactgtgcaacaaatatctgtaacggtcctaaaacaatcaaccatgacgggcatacaagtaatctctatcgggccttaataaaagcccataaaaaaagagtgtcatctgtgacgggcattaaacttatcttaatcgagtctttagttggagcccgtcacagatgaccctcatatgtgacaggcttcttttagggcccgattgagatatggcaccctcatctcaatcgggcctcaactatggcccgtcacagataagtgtcatccgtgacgggctctagttttatgccgatctaccatggctgtgcgaccatatctcaatcagacgaaactttggactgattgagattacttccttgtgacggcccgcaaattccaatcttgttaggggtcgtcacagatggaaggatctggactagtgaagctatatataaagtagtggcaaagttatgtttcgagaaacacaaaaatcacaaaggccttattcggtttagaagggattgaggaagaataatttcacattataataggtgtggaataaatttcctctaattcctccctcatagggattaaccgaaccaggcttgagaaaaaaaaataaaatatggggatagaatactcttctttgcccccaccatatccacgtgtactcaatgcggactacactacaaattgattaagaaaaaaactgattgtcaccgctttctttcaagcaaaagtaacaagtttagcacatatctttgcatagacctcctctgcaatctggcacttattgtgcatatttaattaattggcaatattcatcattagcggtcaaattacagaactcctctgataacaagggtctgaattgaactaggtaattgcatcaaacccctatatttgttattgtctcggggaagataacaaaaaacagttaatttgatcgtggcctgcaggttaattcgctgatagactcgtcagaaccagggagtcgacagctagctagctatagtaggtagatggatcgaacaagagcggaactagtacctgatcaggggtgggatcaggaagggagttcgccggcggcgaatcatgagagtgcatcgccatgacaccgagacgccggaggaatctggaggaggggggcgcgccggttagggtttgggttctctcaacttaatttgttgcctttgcctgtccgagactgagagatccatgggctaggccatccggcctcttggacctgcgtgacccccaacgacagacgaccaacagcggaataagttcattggaggtcccttaacttgtcgacgaatccgattttcgtaagtccttcaattgaaaaaccagatacaacaggtccctcaactgtcaaaaccgatgcaaaataagctgacgtggctaatttgaatcaatcatcattggatgtggcgcttacgtggcaatttaatttggaaaataataaaaactgtgggcccacatgccagttccacaaaaaaaattaaaaatggtgggggccacgtgggccccacatgtcattatcaccccctcctcttattcctcctctctccctatctcccctctcttcatctctctcccctactcccctctcctctatccaggcatggcagggaagcagccggtgggaaaaggaggggtgcgcggtggccgggagcggcgcacggtggcaggggaggccgctacggcgaaggtgaccatgacgacagtggtgaaggcggctatggtgggggcaaccgcgtctatggcgtctgtggcgtgggaggtggccacaggtgccgtgccgccaccgccgaacctcgtcccttgctgccatggtaggggaggttgaggaggtggtagtggtggtgcctccctctgtcccttgtaggctgttttcgtcgtcatgccaccggagagggagtttgatgctgacataggagcggagagggatgaggagggaaggatgactgttgcgcatcgatgttgaaagtggtgacgacgatgtggttgagcattggggtgcgaccatggccactgtatgtctgccccgtggcagtgaagacgatgaagcgttgctccctactacccatctccgttctcccccgcagcggtgaagacgatgagatgggtgctgctagatccagcaagcagcaggtcggcagagaggagaaggatggtgccggagaggatgaagaggacaccataaactccaaatcaacgcgacagaggcttgttgcgccgatgatccctccgatttcttgaccacagccatcgtcgcttccactcccacaatccgccggtttgcatcgccgtcggggagttggcagcccgccacgctgatctgccccaccccgtgccatgcaaaatcgaggccgtcggtgccaagtgctattccaccagccgccgctctggtctaaaaatgtggttattttttatgtttgcttatgtggtcacatcagcaccccatcagctaaaaccaccttcaatattgagactacatttgcatcgtttaggaagatgagggatgtgttataccccggttttgtggttgaagaatgtaattaagtcaaactcgacgtctagatgaagaacctaaagtgaacttattccacgaacagcacactacaacaatgtgggcctgagtgttcagaagcccacaacgcaacataagccgaaaatcctacccatcttccgcagaaagctacccgtccatcccacaagcaaacctacaactgaattgactaacatgaatttgtttaactcggttgctatacatacgacatccaatgcatctcgtactattatcagggcatgcggctatgggcaagggattaatctacgttggagatgcatcgtcgtacgtctcagtcggatgaagcggtcgtttgtgtagtgtaattcatgtccaatctaatagtaagttgctcctatattttatgcctgagtgagtaactatggttgacacgttttccgatcaccatgatgaatcaccgaaagccctacgatgttaaccggagtcgtcaaccatcttgatctagaaaactctaaaccaatatgggtttagaagaatgaaaaccaactagcataaatagcacaacaattatcagacaacataaatagattttgcataccatagttagcttagaatgttttaccaagattactaacttggtcgtacataccataaacagagttgacctacaagccctaggctatttaaccaaaaaagattttcttgcacactgccgcacggagggcacatttgcaccattctgctcccaagacgaaaccaccactaatacatgtaagagcgtgcactatcgtcttcacattctctcttgtgttattgacgtgccccctatcaaaaggatgtgcgtaatgcatgaatgttaggatcgtttcatttgatcagtaaaaatgaaataagttgtagcgcctccaagtaattaattacctcgatgcttcagcttgaattctagctacctaatcttcaataatactagctatcttgccatttatctccactccctcattttctaattttgccaatagatgatcaacctccttcatcttcctagcaacatcagctctagctccattgccagatccaccctgctaggattaattagagaaatatagttggaatggtaatgcataagctaattaaaacagctattcatgcatgttagtggatgctaatgagagagcatggctgcaattagctaaaggtagtcctttgagaaattatacgaccaaacttacaaaagtttgaccaccagtatgtctgactgtatgaaatttatatttactatacttgtttttggatatgctttaataacagtacaatatagaaaaatcattgttatataagctacaaagtagtggcaaaattatatttcgagaaacacaaaaggtcactaagggaaaaaaaataaaatgaggatagaatactcttcttcgccccaagtaaatcaaacgcccatatatcatggaattaggctgcattccaaagtgttgcgtggagtatcagaaataatctaaattactgcagccgcatgtcagggcttgcagcagctgcacactttgaaaaattgaatagcggctgatgacggttgccgttggagctgagggacggcgactgttggacctgatggatggctgtcgcaggcacggcgtcacgtatggaggagataacggtggggaaaagaaaattaaagctagaagcacacgcgcattgcacttagaaattaatgctgcagattaggattagctaacggcctggcgaaatttgagttttttttttctgctgacaaagcacaacaattaaagtgaaacaaatattgcacataaatgcgtccgatacataaatagttttcgatggaaggaaggagacataaatagtaggatacatatccatttcgaaaatggatgttaaaataaatattgaacatacacttctacccgtggtacatctgattcgcaatagtctcacgataagtcgacatagcttcctcgctgttggggggagtcgtaccaactgcggaggggtggcgcctgtggcacacgggggtacccgttgtacaaagggttctgtgtcatgaagtgggggtcattactatcagtcataaagttgtggagagcaaaagtagcaactataatcttcgtctgagcagcttcctctccatataaaggaattccccgcaggactctccactgactcttgatcaccccaaaatctctttcaactgtattacgcatggcagagtgcatgtagttgaaagtctcttcctttccaaccggtggtggagcttcgttgccttcgaaatcatcaacatggtatctaacatttgtttacggtggtaggaaaccgtacctactgggatagccagagtcaacaagcagatatttccctgaaatataaataattggaagtgttactagtcgacacaaatgaaaatttgtaattatgaaaactataacacaagcttagttagatcactgtactaaccccatggcaaccgtggaaaagcaaatggatagcggcgaactgcctccgatagaactctttggtcgtgtactgaaccaggccaaccaacatctacaaacataactcgttcgtcccaaccaatgatggttagcacatttctagaagtttcattgtggcggttcctatgtggaattgaattatctctacgcacaagaagcggtacgtgcgtcccatctattgctcctacaacaccagcaaagggaaggaatgcatcatcttgggcaagccggtaatgctgcgggaagttgtttggatcaacttgtttgatgatgtcggctgccatctcattgacagcattcaacaccctgtgaaaatatctattcatagtagcgttgcaacgaaccatcctattgttgacgctcctcacggaatgaccacctgccatggcgtacaaaaacattccaattgcttccataggacatacctcataggtaccatgcaagtggtacctacctgctcacaaggagattgtagagagcgtgaatctggtccgctctcatccgaaacatgttatggcactgctctgggttgttcattgtttccataacccattgcatgcccgactgctgaggtacccgtcttggtgctcgtgtgcttacattcctttgaaaagcatcagccaacaactccataattgtttcatcctcctcgcttgtgtatccatctttagaccctgaagtgttccctgaggtggtgctcatcttggtaggtcatgaaatggaaagttgttgtagcatgtacaaaaaaaatcatatctctgatgttcataacataaacagtgtaatacaagtgcaaactgagataatgttgtcgttagtgtatgtgaaaggaacaaaaaatgcacaatatgaaaataaaagttagataataatctgagaggtgcagtgactgtacaataaatgaaacacaagtttataacttaacaaaaaatattgcacattagcagtgagtgtaaaataaattattccattagaacaaccaacttagattaatacgcaacgtgtgccgaattgttcttacatcaatacaaatcaacctgcatataacataactatgttcgatttaaaaatcgaacacattatttcactaacataacgatggaataaaaaggcagagcaaccaacttcagcttcagtcgcaccagcagcagcaaaacttagcagcagtcactcagtagcaactcacagaggcacacacagcacggccataacacacagctagcacacaacagcacacaatagcactagcagaagcaccatacccactcaacacactgcagctccgtcggctcccccagcaccatcatccccagggtccccccatcacccccatcaaaccgtgtaccaccaggtggaaaccaaccccctgagcaagatggtggagggaaaaatcctccaccattaggaaacttcatggcatagtggaacctaatgtagtactcacgcatctccggggtaatggcatcacctaggaagaactcgcaaaagtatgggtcactaaagagcaaaacccccatgtggtaaacatctgagctaaataagtgcccatcagacttgaccaactcaatgcatgcacgagcactcatagcctcacgttctcgctgcttttgtgccttactctcactagacttaaccctcagatcagcgagcctatgcaaagcctcaccggtggagtcactgcgggtccttttggaacccctagacccactagccggtgttgccacccttttgcccctacccctggttggccttgaccgtgatggtggatcaggtgactgtggcgcatctggcacgtcgacaaggtcctcaacatcgaggagttctgcgttggctggctgcaactgctgttccagttcagtgcctgggacacttgaacggttgccgacaacacacctccccctgaagacagcatggtgctcagcaatgaatctgagaggtgcattcctgaaagacctagcacattttctcatctgcatttcagcaaaagagaaacaaactagagtgaacaagaagtacacatgcatatatgtattgcataaagtacagaagctaccaaactacaagcacacaggcatatatgtattgcataaagtacagtacgatgcacacagcaagcacacatggaatggctgcaacctaactgcccataatattagcaacaacatagcttatcaagtggttgcaattattatcaagtggtaagttaaataacaagccgacattttcagataattacgattgctattgcaatattaataaaacaacatcagcagggaagtattaatttcaatttgcttcagcttcatgtaaatatgcaaatgtcatgtgttatccaggcagtagtactactccacaagcactcaccacagctgtgaacaagtctcatatgattcactaaattataccacatgtcatacattcacaacactgaatataactactgcaaagtccatttagctgccaaattaatatggaaaatgctttcagagtatttaaaacatcaaagtgtgcatatgcatattacagatttgaccaaatattgcttagcgcaaagtattgtaaaatcagcaaggacaatataactgagtatttgggtataacaatcaatttttttggtggtaagcaaatgtagttgttacagccattgttttatttcactaaggtggtacttaacattatacatgcagtgagaagtgaaggtggtgttcagttaatgagatgaaagtagaggtatgtactattgaaatatattagcaacttttggaatgttgttaacaacacttgtactctagttggtactactatatcatctttcattttataaattaccaaaggtatcatcaaagggatgtctaagttcttaacaatataattgctcactacaaattatgtcctgacagaatcccaagcatgcatatgtgaatccatttgatgtgcactagggttcctgatcttccgaaaggttctgataaacaacgatttgggtggagtcgcgacacaaatcgatccggcttcttgaacgcgcacgctcttgagccccgcaatcgcagcaccacatctcctctggttatcacccttgtcgaaacgcggatgacctcaccgagaaggctaatccctgtttgccaatcgaagaacacaaacaagaacgagatagaaaacaaccaaaattgcatatgaatgattaagctcacgagttggggtcttacaaaccgatctaacagcgaaactgctctcgacagaataatctaagcaaaacccaaaaacctaaagatggcggcggtactgatatatagagtttagggtcgtgcaaccccctctcgatacaaccctaatgggttccaacacgatacatggcccaaaggcccaaatacggtgacgcagcaccgggacagattctggacgtcaacttgttcggtcgattcccattgactcggaaagaatttgggcgtgggaccagaaccattggaaatgttatcttcttagctttccatccatataaagaacgccccaatgcgagcacgtatgcgacctgggcgcctgttttagtgcagactggtcctggactccgaattgcacccgaggtcaaattggtttgggcctccaccttgacttggacgtcctcgtgttgacgaaaaaatcgaacacaccggcctgggagatctgcttaactcctgtgcatgtccaaagattgatgagatgcgagcgtgccagttagtttgatcctgcaactgacaagatatgcaaatagtagatcaaaatagccgatcggctgacaagccgatggagtagttccagccgatagccgataatagccgatgccgataccagccgatagcgatagggattaagcaattggctatatgtccaatgtggataatgatatattggcaatctgccgatgatgatataataaaataacaatataatccagtataaaccaatcggctagcaatgatatgataaataagtatcgatccgaaggttaaagcacacatcggctggaggtccgatgtcatgaaatccacaagattagattaaacagtgaaacctttgttgtcatcggctaaatccaacttatatgtatatgcaatccttatgagccgatgcaacgtccagataactcaccggctaaaaccccgatgaaacccttattggcaatcaagaagcaggctagagattatggttctaagcacgacttagtagatcaaacttaactgatgcagcactaagtatgaaaagaaacataatatctagacaatcaagccgttgactgagttttcagggtggtagatgtctaagctaatctaatctagcaatgtgatttaaccgataccggcagaaaccctaaaacgagaagcagccgatagagctaaattgatatgctaagactagattaacaaagacatatgataaataggtaggcaaatatatcatccaaaccagagcaatccaagaggtcgaatgtactgatgcagccttgaacgacaccgacgtaaacgatataattacctgggccgacggaacattggacttaccccttagccagagatcgaacaccgatgcagccccgcatcaggtgccaagtcccttcggacgataaaataaagtagaaaaggtaaaaggtggcgatgcgccgaattgtattgatcgtgaagatagattacatagaccccgagtgtacatatttatacctatgggttgatacaagtccttgtcggacaagaaagaaactttcctaaagataaaaggaaaagataaagtccttataggacactaaacacactttcctaaagataaaagaaaactaacaaactattcctaattaatagataacttgtcatgccgcattctctttgaactcggtctcttctggataagcttcctttagtagatcaatttccttaaccgaatatagcaagaatccgacaactgacgacttgacaactctcatcggctaatctcaggacttcgaagccgatgctgactctaagccgatgactactccaggcttaccaaatttcactgtgaacacctcgataatcctccatggctctaagtctttctccaagtgtctccttgtcccctccattgttactaatcacaatataatcattcggtagcaatctattcttgaattcatacaaagaagaacataggaacgagctcacctctaaatttaattgtcgcgcacgagctcttgatatcggtttttgaatgaccgttggaggattgttgtatgtatccgaggtagtgatgtccacatcaccatttgtacttatcaacatgatgacccagctaaaaaatggtaaataagaaataatcccttttgcaatgattctaacacattgtgaggttaccaattaaatggatgtaatacacttgacaactgacatgtttgtgtacttatcattgcaatctccatgtgtacttctcattggaaaaaggcacatttgtacagcacacttgctaacttaacaaattgacaagcttacatctgaaatattgaatacagctatttaaaatatctatgtgactatgtaacttgcaaaactaagttgccatgtacataatactaggtttgaacatttgcatctaaaactaagttggcatgtgcatctaatgctaaaatctgaacatttgcatctcaaagcaagtttcaaaactaagttgccatgtgcatgtaatactaagatctaaatatttacatgtcaaactaagttaacatttgcagcactatttgttctgaaactaagtctgaacacatggtttcggtaaagcaaaaaggaagagaaagggaggactaaccccttccattgcttcccaccactctggggaggcgtcaatgctgccggtgtacgggtttgttcccagccctgtagccatcgattccaaccatgtccaggtctggaaacggcggcgacaagcaccccagaagttcttcacttgctgcttgctgacatgcttccctgccttggacagcatcttggcctgcaagttggcatacccctgagtcttggggcatgacgaagtgatgttgcgagcttctatttcctccatgcagctttccaagaacgcatggagttcgtcctcagtccagtgagtgtgacctccgccggccatctaagcacacaaattgagcataccaaaataatcatgaggaaacacaaatagagcaaggtattacctttcttagtttgtccgattcgaggaggtcctagtccagcgagcgtgcaaccttctccggggtgaggcggcggatgaactgccggacggcttcgggggacttcgcagctacggaggagagtgcacgagtgacaagctccacatcgtcttgtgcagtggctccggatgcagcgtcgaagaggtaagatttggtcgaatcttcgctcaattccagctccacggactcctctcccagcttaccgacgtcgatgggcgacgccgaagaaggggaggagcagatcagaggttcagcggcctcaaatttcctcttggttcctcttgcagccatttgcgaccgaggggtctctaaaataggaggcctcggctcttcaatggcgcattttcgaaatgaatgtggccgtcgtcgatgcagacccactgtattgcatgagatcgatgcagcgattgatcaaatcatcctgcaaggcttcacgagcgcagcaggaatcgatgcctcgatgcccaatgcctcgtcgatgcagactgtcttccacgagatcgacgcagcgattgatcaaaacaaccttcaaggctgcatgaccgcagcaggaatcaatgccgcgtagcccggacgcggctggaatcgctgccgcctactgcgcacgccgcgcccctttgcactcgatgcggtatccgattcccctcgatgcggtctccaagagcctgctcacgagttgtcgatgtcgatcggctgtacggcacctatggcaaggagcagcggccgctgctccgcacggcacgccgatgctctcctcctccgcctcgacgactgccggtccgtgctgtgcactcttacgggaaagggaatggggtgaactgctggacaatggggtgagctgccccttgcgtcgacttcacaacatagggaggaaggagaagaccggtgacggacggctgccgtaaggttcacatcaacaacggcgtcaaactcccacacctacatctacaggaagcattgagcccaagacaacattagtctagagtgacgactccagtagcccatccaagcccattgaactatgcactttagaacgcagccttatccgttcatcgtatccgcgtgtagtcaatgtgcgcggtggaggctgtcacatcctgaaaaattcaaaatatataaattgttgtttaattggaatttttagaaatgattttaaaagcctagaagagaagatctaattttaattaataaattccaatataaaatggggccagataaaatttcattaaatactttgcttaattctataattcctagatttttctgggatttatttgagctaaggaagtatttttaataaatggaattgcatttcatgaataatttaaattgaaaaaggttttaaaaagtctcttttggctttgggccgaaagtcggcccaaacctcttctctctctcctcggcccaagccggcccagtccgccgccgcgcgcgcgcgcgtccgcctgctgacaggtggggcccgtctgtcagtcttcgtcttcctcgcgtcggccgccgcccgaaaccctaaccgagcgccgccgccgtttccttccaaatccggccgctcctttccttctccggccgaattgatagaggggaaatgatcctagggatctcctctaccttttcccctttggaaacatcggctaattcgttttggaagttcgtggaatcgagttcgattcggatcggcctctttccttcgaaccccgaagtttccttctcgtcgccggccgccgtgggccttcgtcgccgcctccgagcccctttaaaaggttccccgagctctcctctacccgccgccaccctcgccttcgcctctcgtcgtccgtagtgctctagcgccgtgtgacctagcgccgtcgttgccgccgtcgctccagccgtgcgctgccgccgttccggtcatcgccgttgctcgggaagaccgccgtcatggtcgccaagtcgccgccgtccttgtctgccgcttcgccgtcgccgaagatcgtcggagcaccgccgtcaccgtcgacccgaagaccgccgccgcttcaacctcgtcgccgtcgccgtccgttggtcttccgccgctcctttggtcaccggtgagttcgccgcgtcgcgctctacccgttggtgccttccgttcgcgccgccgtgccgtcgttcgccggcgagcatgcgcgcccaagccgccgagccgccgccgccggtggtgacgtcatcgctgacgtcatcgtcgccctctcccgtgagccgccgtggacccgatcgatctcgaccgtccgttttggatggattgatctcggccgtccgttcacgtgaaccgtcgcccgtgcgcccggtccaccgaaaccctagccgctgacgcaataaatcccctttttcttttcaaaaataattcattattgcgtcataattcaattaaaatccatataagtgttttaatccgatttaatcttcaaaaattcataactaattcatcttagctcggatttagttggtccaagtctctaaatttttctaaaattgagatctacatgttaaaaatatccacatgtactgttcatgcttgtttatgtgctgttttggtgtttttgctcttttctgtttagattccgacatttccggagagtccgttttcgcagcagaagaatttgaagagttccaaggccagcaaggcaagtcacacagattccaaacaaccctttgagcatgttgatcctatttaaagctattgtttctattcaactattgcatttattttcgaatgtcattgggtggaattaacctattctttgttatagcccttttgttcttgattactttattccttgataccttgggttattataatttgactagttgagctctatatgttggttcaactagatgtattagatataattgcttagccctgcttagaaacattagcacattattgggataacttatgactcactattatttcatgatggcttaatgataattcacgatggtcaatcgtgattggttaattaattaatgtgccaactaaaacctgataatggtgggttgtgagcacatggttttgagagtcgtgctcatgacaattaaggaccggttcacgagtttcggttgtgaaacattaaccgtgccaaccacaagccagcatgggcaacggctttatcttttatatagcatggttcattgcggggcaccagactgagaagtggcggagataagcccacgggggtcgctggggagtccataccttgtttataagggggtgattatgatccaggaaaggtgcgctgtagtggattgtgttatgcaaggggtattgtcacaactcctttccgaggtaccgtggtggtgttgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacttctcaccataataaaaggtgctttaattggtaataatttgattagctcctggtttggaatggtacattcctagtttggagatagaactgttcagccgggatggttgttcagaatggttgggcctatgcaacagagtatgttgtatagtgttggattaatattgattaattatttactccactgtttttcttctcttaaatgtttgctaaacgctgcttttgcaaatgagccctatactatgccattctttggtatccttgtgcacttgcatatttgctgcgtgacttgctgagtatgtcatatactcaccttgcaatcattcatcagaggaagagttctacagtgaagctgatggtgtggaggattaggtgtagccttggtcaagctgcctgtggagtggagccgtctgcgccgtttatcttattttccgctgcttagatatttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacagaggcagggattatggcccctacaccccactagacaacaagttgcttcagtaaaaattacttcctccgtttcacaatgtaagtcattccaccattttctacattcatattgatgttaatgaatctagatcgatatatgtttagatttattaacatcaatattaatgtaaaaaatgctagaatgacttacattgtgaaacggagtgagtaattgtcaccacttattttctttcgagcaatagtaacaaggttagcacatatctttacgtatacctcctctacaatctagcacttattgtgcattttttttgggagtagctatacttatggcgctatatttttcaccaaaaaatagtcaccatgtatttacattgtaagtccctaaattacatatgtaattttagtgtacttacaatgtaagtttcaaaattacatatgtaagtttctaaattacatatgtaagtttaatgtaattacaatgtaagtgcaagacaacgtctatattttgcattgtagattacatatatttatatactatgcagatacatatgagtagaaccatcaaaagcttaaactaatgaagcatgttaagttttaattaattgtgtaatgacagccgagaaatactaaggacctgagtggactgaacaacatctgacggtcagaaattcgactgtaatcagccataaaatatggcgacatcattttagcaaatccgttttttgtttgcgttgcgagttgagctatagcgctggctttgcctctatgtgagcctgtcatgggcctcttgggcctgcgtgactccaaaacagcacgctttttgtttgcaaaaggaataagttcactggaggtctctcaacttaacaacgagattttttttcccttaaccacgaaaccagaaatgtatacccctaaactcacacaaaccgttcaataccacgagaagagtgggagagagaagagggaagagtggggaaggatttttttttttacatgtgggtgccaaatagacctcacattacccaaaaccggtttcaatactagggcatcagcaatgtgctcgcaaaccgggtagtaagcaataaatacactcttactacctggtattaagcattgtggggctagtacataactacaaccgggtcatacccctactgccggaagcaaggaaatagaatatgcatgtacacagtgttttctgacagcaaaagcattgcttctcccaaccgttgcatgcatgctctgtccttgctacgatttttattaccccatggaccccaccttactgccaactcacagatataagcaatgtggagcacgtctccctctattaccgcctgtcatctgggcccacgctaataccgatgtggatagcaaacattgctgatgcccttaggactagggatgcctcgtacgcggttttgcggttaagggatgcgattggaacttgaggatgcaaatttcccccagttccctgatcaatgatgggctgcttcaagtgggccgagcccatccggcccatacagctccctccctctatcccccttggctggctggcatacacagctacacacggaaacggccgccgaacaaagcgaacaactactagtcgtctcgtcgtgctgcgcactcgccccatcgacgagagatcgcctccgcctcgcacccgccggcgccggcgccgcctcctcctcctcctnctnctnctnctncccgccgtccaccggcgcgcctctttcccgccccgatcggctgccgccgccgcagctgctcgccgcctcgtttccgactcccaaggtgcgccgcgaagccgactccctccccctcgatctcctcccggaacgagccacacacggtctctcgtccttagatatggatcggacgccgcgagttcgtgattggccgccgatttcggtgcgcgcgcgcgcgtcgggttttttagaagccaccgccgccgccgcccgcttttccttttcgtttcccgtggcagtgagcgagctgtgcctacccttttttgtttgggagcaaaaggaagctgaattttcgcaaattttttgccgtaatgcgtccccttttaagtaatactgtttctggctactgtaatttctgcgatttgtcagttagctcgattcccagcttgcgcgatcctcatctgatctctctttctcccaaatcgtcaacctataggagcagtatccaggcattcggatccctcatggcccccgagatctccgctctgatgctagccgcagcttagggggtccgatggctgcctgtgctgctcctccatctacaggccgccttcgatccgcgcttccgcctcgcgaggagcctcgtttcggtggctggatgcagggctgcaggagatctccctctttaagtttcccgcagaatcatgtttccaccggtgcccccaacgatcttttgccctgcaccattacgcgcagcttgtttagccaccaatgcggccgtagccatctcgcagtcatgagggctgaaggttcacattatatattttttatttccatgaaggatgttagcctggagcttatttctataatttctttccataaaaattgtttgttatctatctctggttatttctaatgtctagggacatataagctgtgggtgtggctaatatgtttatcccttgtcatcccagtatcttgacactatccataatacatattatatagatcaaagccattaacctattagtttctggccctttgatttttcattacacttcagtttgctaattctattattatttatatcagggcattcctccatgggtggggcaaatgactcaagtccatcctctaaacttcacacaagactgagactatgggagttcccagaccgctatgtatttgagccgattgatggtcttgctgacttgtatctgtcagctaaccgttctgatggttcaatgaatctagttgaagagttgccaccacgtgactcttctacaaaaccaaaatgtcaaacagtgtatggtgtgataggagttctcaagctttcagttggatcatattttttagtgataacaggccgtgattgtgtgggatcctacttgggacatgcaatttttaaagtgacaggactaaaagttctcccctgcagtaactcacgtagcacttctggcaatcaggtcaagcaatacttatgccttcacagttttatatagcttccatctatttttcaattagtgatttgagtaagctgttggcagagtaaaatggaaacagaattttcagaactcctgcatgctgcagagaagactataggcctgtacttctcatatgatatcaacttaacacttacgtgagtatccttcttgtcaaacatagtcacattctagtgtcttatagtcaaagcttacaacctcttgttgcatacttgcattgaggatttccagcatagtatgcaattctatgcatggggttcttctattttagtagatggcattctctatttatttttacagtccacctgtgctatcatctttcatttaattctcttcttctgtttttggcttattgcaacagcatgcttatctatgtttccttctattgcagtttgcagaggctacataatcttggtgatgagttcaaatcacttccgctttggagacaggtttgctgccttcaccatttggaaccttttagttctagagtttgtttatacccatagggtctgagctttctccattgttcttgtaatccctgatcttttgctgcctatactttactgctgtggtgccaaaagctacttcttgttcacttcatctttagctatcagtttacacatctgatgtagaaatatggacataaactaaaccagtctgatttttaattccaattcccagacacaatttgtaatggttgattattttgacatttatgaaaaagggaaattaattaacaaagaagtcagaagaggttgcatattggccacttgtatttatgtgttttgccatcatggttcaagaaggcgctaggcactagagggtcagcagggcgcgccctaggcgtcacttagctagcatctaggtccaacatgacttgtgaaatccaagcaattagccagcatattacatataaatgttagacagtaggacattaaattagcagctaaaggagcccacatggatggttagccgcccaaggccactcccaatgggagtttcattctcactaaatagagtgccatgtcaatattttttatgatgtggcaaggaattgatgaagagattaagggcctgtttgggggagctttagattctgagaagcagctgtttggtagccagcttctgcgaatctggaaaagctctgaaacccagcttctccagcttctggcttcttagctcatttttcagaatctgtaactacagattctcagaagctgtggactgtttggggcagcttttaggaaaagctgcagctgggacaagctcccccaaacagggcctaagagagaggtggaatgggtttcatcaagatgaaactatgtgtacactatgtccaatatctgttgtctcttgcatttattgcctaggaaacaacaaaatgaaaaaaatgcatcgtatgggctgtttccaccatcaactaagggtatgtttggatgctcaggtaagtttagctatagctcgaatgggcaaactagctcattttagctatgctcatttcaactagctcatttcagctattgctgctcttgcccaagcaccatatttggtttccttgcttttaccccacgttgagaaacggctatcagtttttcccctcacgtatgcacttcttgccgatgagagagagccaattcggttctcatggctgagcaaggtttttcttgcccatcaaggctagcttgtccctcaaagctagcttgtccctcaaagctaggatatttcatcggtaccaaacaccaagcctggctaggctaggctagaaaatctttagccaaggatccaaacacgggggatgctagtgcgcgcgtgcgcgccagggaaaggagccggcgcgtgcgccagctgcgtccctacacgtttcttttttttttctagatctcctattttaacgtcacttttttgtttccttttttaaaccgcttctttttttctagatttttttaatcgcttctttcttttccacactcgcgcatgatttttttgtgatattttataaattcaatctttcaccttcaatatcagttgagagttttgaatttgagttgaaaagtttctaaaatttaagtttaatgttttgaattttgagatgaaagttttcaaattttgtcaaatattttgaattttgaggtgaaagcttttaaatttgagctaaaagttttcaaacctcagttaagttttcaaatcttgacttgaattttttaaatttgaattgaaagtttcaaatctttagttgaaagttttcaagtccgagttgaaagttttcaaatccgagttgaacattttcaaatccaagttgaaagtttttaaatccgagttgaaagttttcaaatctgagttaaaagtttttaaatcttgacttgaaagttttcaaatattgactcctactcttagacgcgtgtggtagttaacggccaaaaaaaaaagaaagaaagaaacacggctgttgcgcctaccgaaaaaaaaggaaaaaaaaagaaaaaagaagcacgcaggcttggtcgtaggaggacccgccatgtggcacgctcgcgacttggagaagtcgcgtgtacgcgcgaattaggattcctgtccaaacgcaccctaaatgttttgttgcttatttggcattcttggaaacataaaactgaaaccttccactagtaatgatctaatgcctaattcaggtggctacctggcacctagagccgatttgtataacactgtttgccatttgagcgcctggaattttatttttgcttctgctgcttctatagtccagtaattgctgcacaattatcttgccatctaggaaaacatagatcccatctaggaacattggagctttaatagcatttgttttaaagacctgtcttgtccccaaaaagtagcatgctgtggcttaagttaaaactttcagtagttaagcatgaaaaatgtaaagagtgctaaatttttacagagtaacatactacagtactttttttccactggggagttaagtactgttgaattaacattttatactgtgaaacatccatcttgcactgtccttttccacaaaggctcaaaatgggtcatatgtgacaataattctgtaaatatctccttttttaatcatataccatatgtattttactttcaagactggggcaattccttattttgaattttaaatttataagctatgccttgaacttgtatacagtagcttcttaaagcaacaacatagtgctgctatgtcaaaagttgctcgtgctaaatgcctaaaagcacaacagattaaacatgtaaacaaaaaattcctgtgccttttcaaatctatattgcacaggtgaaataattacattctttacaggcagaaccaagatttctatggaacagttacttgctggaacctctaattgagaacaaggcaagaattaaatttgaagcttactgatttcatagttttgaagaattaaataactgatacttgcaaaatgtattgattgtttctttcttccttaacagctggaccagtacttgttgccagtcattcaaggcagtatcctttgtttgtcatatgacatttcaatttggtcactgtcagaaatgcaatataataatatattattatttgaacttgagtcaccttccctagggtcatatgtcaatataagtcgcagacacttaactgaatatcaggctttcagaatatccatgcagaagttggatcggagaaggtaaatgtgaccctgattgcacgtaggtgcacacggaggataggtgagaatcatcagtgatcagaataagttcacatgttctcttctgcttattgtcacttgaaaatatttttttatatgtatttgattattttttctaatttttattacatcctggctccttatttttgagaaactcactggcatatgagtagatttaattcagttgatgagtttttttttaactaaaaggtacacgaatgtggagacgtggagctgacccagagggttatgctgccaactttgttgaatcagagcagataatggaatcaaaagggttcacagcatcctatgtacaagtaagtttcttaggatagtttaaaaccaaccaatctgcctttctatcaatttgtgagttgcaatttcatcagtaggttattactattttatttttaccacattctagtaccttgacaaattaatgtgctttt

SEQ ID NO: 83235 - DNA, 3785 bp, Oryza sativa
ccgttggaggtgttctaatgtttgttgcctgtataaaaccttgaacgtgggagacggaatgtcctcttgcaagttgcaattttgtatgctgtacaaatatatttggttaagatcttgtttggttaatcccgaccacaagagaatcaagaggaatttgtatgggatttattcaatacctatttggttaatccatttaatcactcctttagtattaacctaacaagcctaacgcctaaggcctaagaagaaatacaatgctagccaggtaaaatatcatgctaaatcagtttgcccaaaaatcatgttattgcaataaacaatattctaccatttttttttgaagcgatgggtctgttcatatgatgcgactacacaatcatttacaaatatattgaaaaaatggatggcattttgcctaagaaggaaaagaagcaactgtttctacgagaaaaactacatatagaacataaacaatttactagtatgagatttattgttccaaaatgcaaacatgaatggaaaaaagcctggaattacttaagtgtgtgtttagtttggggatgaagtttgatggattaggttcgtcctatttctattttttttgggattggatgattccatctacatctacgtgcttgacataaaggttataatgatcctacttttttaagggttggaaggatgtggtccatacatcaatgagagagaaaattagttggattggtccatctgtgtttggttcacggtcatgcatggataggatatggccatccatattttgttggatatagcgatctaattttttgtttggtttgtatggatatggcgatccgatttcttgtttggtcggagggatatagcatggatggaaaaagccaaaagttagtgggacccatttgtcatatatatttttttatcaaaatataatcattcgagatcttgttttaaagatttaattgtaacaaatataatggtgtaatcaaatcataaattagataaacagtttaggagaaaaaaaatcatttggagcttacttaacagaaaatcaaaccaacaacagccaatcagaataggacacatcacccagaccaaaactggatggattcatctagccaaatcggcctgatgcactcatccagcatattgagggaatattccctattctgggccgcctcatccaccctgccctccaatcaaacactacaaaaaaccggacggccatctcctatccagtctcatccacccaaccaaacacaccctatctagagagaatatttcattctagagatcatgacttcttacctatcttcaagctaaacaccctgaaaagttctccccatctagacctattccattcctccaatcaaacacatgctaacattcactctgagtctagcttgggtgatgccattgctaactccatgatgccttatcataccatatgttcctatcatgataatagaaaaaatgattgaagagattcacctattgacattccgaacttcgtaaagcacatctagtactcctacttagggtttagggtatcactcagaaccacatattaaaggctagcaaaaaaaattaccacttatttctgaattgttttatttggttgtcttggagacaaaattttgggatagagttttggatatcttttaggttgagttttttttatttcactttcctaactccacctcccgaacgcagaattagtgatgctctgagaccaatgtgttaggttagtactaaagtggaaccaatcccttattttgaaactttagattactaaagttgctgagagcatcactagcagtaccctactccgtctccgatcctattttttttcaggatttttgatgaaaaaactgcttcaactgttccctacgcttcctctcaaaaatcagtactccattctacttcactctcgctctccaaaagttgggaatcgttctcgctcccaatttccgtcacttgagtgagaatgccatccgagaaaaggggtaagcggaagggcgttgacactagatgatatgatcttgataagttgcgggtaaagggaggcatacctttttatttttatattttagggagttaaatataagccatctattggaaggaagtatatacctatacaagttatccccacctactaatctcctgcactgtggttgctccacgtcatcaagttgatcacacccattcgatcataagagacatcttgaccatactctcacaatggccaattacagtactactaggggcagtagaataaaaaccacttcaaacaaaacgccaggcaaaaaaaaaaaaacaccaattctcaagagtggattttaaactctagagggaacatgtatatcactcgaataattatgaaaaaatttcaaaacaattaagaaattgtattaacatgtagtataccactccaaaagcatgcaagttataatttaacttttataagtaaaacacatataaaagagtagcaaattaactacaactagttaacatatattcacattaaatttatttttttcgttgcaacatataaaaaattaaatttaactttacatgtttatgaagttataattattttcataactaagtgtcatacaaataacgagatgacgtctcgagttcttcctgcagccaggttttgaaatttcggttcgaaatttccgaaattttgcccccccccccccccgaaatgctcacatctcgtccgaaattttcggttttttgcaatttttttgtgtatttggtcaaaattttatttaaaatcagcaaaatttcaaaaatttcgtaaaaaaaatccgaaatcggttctttcgcccacctgcagcagaaatcttgggctgtgtttagatacaaacaactttcagctttgaaaagaactaaacacagccttagtttggaaccctgcctgctgcaaaattataatatatgtttcgaaatttcaaacccagcctgttgtcgtcctgtactgtactcctgtgcattgtctggatgggcaactttttcatagcgaggcgagtcgtcgtgtgcgtgcgtgtgctggctcgtctcgtcttgttcggacatgacaagaacagaactgaccaaaaatggactggacgcatcagatgagggaggtccgagtatgcaggcggctgttatgcaaacagcctaacagcttaaacaaaatgctggaaacactgttgcttggcttggattttgctaaacatatgttatgattttgctacacacttcgtccttgttcattttgatttgttgtaatttgagaccgtaaggcgattaatcaggacgggaagaaaaaccactgaaccataaaagaccagactaaaaccagatcttgatgcaaccaggttcatcagatagattcatcattcatttataatttataaatttacccccattcttctacgggaaatttaactatttgccactcttgtgacatgtcaattaacgatttaccacaccttgtcaatgacatgtgggccctcatgtgtttatgacacgtgggctagtggcaaatcgttaagcaccactcgtaagagtggtaaatagttaaaagccccttcttctacagacagaagaagcactttcttcttgagctctcatacagcaaccaaatctagacaaaatcaaagaatccccaaatcctccccccaagttcctaaagccccaagcgaacgccatcttctcagaacccggccaccgccgcgccgaggagggcggcggcaacgagcacggcgccgctcgccacggtcctcccagcgttcccagtc

SEQ ID NO: 83236 - DNA, 4379 bp, Oryza sativa
  unsure (1)..(4379): unsure at all n locations
tcgacgccggcgagctcctggagctgtccctgatctgggacggcgtgggcctgaccctggtggagctcaacactccaaagcttcgtgttcttggcattgaatgctacttcatccaccacaccacgctgacgatgtcggcgccggggctagaggagctgaaatcatccttcaactgggaaactttggagaggctcgacgtcggcgacataatgtcgtgcgtgcggagcctcaaaaatctgtacttgagctctgatgggctccgcatcggcttcggtgatgtctccggacgccttctccggcgatgccccgccgtcgaatccctcgatgtccaccttgcttgtaaggtatctcatgccgatgaggaaggcgaggaggaagaggaaggggtgattgatgacgtgatgatgatgaacgacataccacatttgcctcttgtcacatctttgacggtaaatcctttttctcccgaggacgagactttttctgatgtagacgagcatacaaagggactacctagagaactgttgacagttttttaaggagaaaacttgctcttcctcctagttttttaacgagccaattataaactgttgacagtttataattacaatataattttatatataagtataatgtaactcgtatataaatattaaaataatatatgtaacactatatctaaattatatagagatgataatgtagttacagttcagttacatagtagttacgatgtagttacaatgcagttacattgtagttacattgtaactatattgtaactaggatgtaactgaagtataactaaaatataactcatcaaacttctctaaaacatgcaacagatcaagtggctagcatgcacgccttccaggatggagctctctaagatatgaacgacgcttatcttgtggtaagtcccctcttactgaattgatctcgacgtctatttcgataaacttttgttagggttaatttgcattgctgcacactgcaaatgtgctaatttaacattacaacaatcaaacattatgaaattagcacagtttgtcagttcattaaaaaaaattaaacattacaagttttgatatgctaacaactctcggattttttttctctccttttaattgtataggagcagacgaaaccaacagatcctgctggtaatcaagccgattacctcagcgtctcgttaccacatctcgtggaaattgggataaatggcttccaaggaacaaagtgcgaagccaggctgatggaatggctacatagaagtgccccagttgttaacaagatttgcttttttgaaacttaagacgcggaaaggaatatgaagatttgctacctcgaattcctttctctgtgcttggtagatggacggcaacctggactcatcgtaactgtgtgggacgtttgtgtggacgccgacgtctgaagaagagagatataattatatctcgtgagtttccaagatgagaagtaaacaaaaatggaagcatcatgcttattaaaggaaaaaaatgtgcgtatttactattgggaagtaatttaactatttgtcactattagatttgacaactctctatatgccccttatctattcatacaaatttgtcactggagagagattgcttcttaatttttttttcattttttgcatacatgtcatgaggactactcatcatcgtcttcttcctctagccgccaacctcctacctctttcttccttctcccatgtatggttaaacttccgcaatccaaaaaagctctcacccaacaggcgacacccctgccttacgcctcttttcaaatctctctctaggaaaaaaagtgggaaaaatagagagatggatgggaataggaaaaatgaaaatgttcaaaatgcaacagactcattttttttaacagtttggggtgctccgcctcccacaaccaatgcccatgatgggctgaaccgagcgaaaattaattgaaaatgggccgagcccaccgcgccacaaaaatgacttaggcacctcgcatcgccaaaagtggacaaaaacacatgggccaataatggtggggcagatctgatcaagcgctacagagttgcacgactgatcgccaaagagccatttcgatacgagtatgcagtgcagcggtgagcatggtgttttaggagaccatgtcccggtcaggcattgtgtcgagcaccgttaaatttctccaatcctaaaaagctcttactgaacaggtggtagtgacacccccaaccacccataggcacaacttgatccgcggtggtggggagagcttgtcggtgaggctatcccccacgggctgtgagggcagcggaatacgtggacggttgtggcggaccgcggtgggaggtttcactggtggcgaaaccatctttcgtcggtcggccgaattccccaagagtcccgggtggcgataaaaatcggggctaaagatgatctctagtcccggnnnnnganggnnncnggnnnnnnnntnnnnagnnccggttnnnnnnntnnnannnccaaccgggactaaagtcccacccctatatatgtcttcttcctcctctagctgcccgagcaagcttcaaaacatcttcaaaaaagaggggaggtcatgccaaaatttctagtgaatttattttggtgattatatacaaatcggaggtgcctaaaaggttagcaacttcatcctacaatgttttttttgtcatattacatttggagctatgttttgcacacttttttgtctccaaaatttagttgtaagttgatgagagagaaaatttgtgtggggaagaaagaatatatagaaatttagtttatttgctaaagaaggttttataaaatagttgagaaggaaaatatagtgaaagttaatcttaaataatagaaaacaaactaaaatgaaaattaaaagaagtaaaacacattaatattagtttaaaacattagagatagtaaataagaattatttggtgtaatattttataatttttgtataaataatgatatgtcattattgtatgactgttgaaagagtttgtaattattttataattattgtatgattgtcattattgtaagaataattatttgtgtatgattttttttcatgtcatgtagatgaatcggcaatggatgtacactgaccggcggtccaaagagtttattgacggcgtgtattattttttgagagtggccgaaactaacaggcataagggttttatttgttgtccatgcaataagtgcaagaatcagaaggagtattttgcatccaagactattcatttccacttgtttgagtcggggttcttgctaagctataattgttggacatcccacggagagcgaggtgttgaaatggaagaagatgaagtggaagacgacaatattccggacttacgttggatttgaaagaaatcaaacgggcgaggaggaaagggatgctgatggtaacgacgttgcggatgatcttggtcaaatattgtaggacgccaaggaggactgcgaaagtgaaaagggggcccataaattagacaagatgttagaggaccacagaacatcgttgtacccaggttgcgagcaggggcacaaaaagttggataccactctggagttcttacaatggaaggcaaaaaatggtattagtgacaaggcatttggcgatttattgaaactcgtcaagaacattcttccggagagaaacaaattgcccgagacaacttacgaggctaagaagatagtctgccctctaggactggaagttcaaaagattcacacatgtccgaatgattgtatcctatatggcggtgaggagtacgagaacttagaagcatgccctatttgcaaagcactacgatacaagattagacgagacgatccaggaaaagttgatgggcagttaacaaagaagagaattcctgctaaggtgatgtggtatttccttataataccacggctaaggcgtttgttcaggaacaaggggaatgctagaatgatgcgatggcacgctgaagagcgtcaacaggactggatgctgagacaccccgccaatggtttgtagtggcgaaacatcgacagaaaatttaaagactttggaaaggacgcacgaaacatacggtttgctttgagtacggatggcatgaatatccttttggagatatgagcagcggccatagcacttggtccgttacgatgtgtatctacaaccttccccctggctatgcatgaagaggaagtacataatgatgccgattattattcaaggccctaagcaacctggtaacgacatcgatgtgtacctaaaaccactggtcgaagatcttaaactgttgtggaagaacgaagcagtccccgtctgggacaaggacaaac

SEQ ID NO: 83237 - DNA, 12618 bp, Oryza sativa
cttggaactcacacttatcgatggcatttccgggacttagacgcttgtcaatagcatttcatggattatctcataaacacaagacgttgtcttcttcatcgtaatttgcactgtattaacatctatccaaaaaatttatgaataaaatgatatggtatactccttccgttccataaaaactaacgtaatactggatgtgacacattctagtacagtactacaaatttgaacattcattgtactagaatatgtcacatctagcccgagcactacttaaaaaaggcaaatagatgtcgccactataggtgccggcacacaaaacaccgacacctttatgtccaaatatgtgccggtttttaaataaaaccgacaactaaaacctatgtcagagaaatgtgccggttctagacccaaaaccggcacctttaatcttctccctcccccactagccgttggcgggccccatacataggtgccggttctcaacccaaaaccggcacctttgtttcaatagtgcttttatgaacgacggtgggccctacacaagggtaccggttcttggtatgacaagacaaaggtgtcggttctcgaccaaaaaccggcacctttaatattctccctcccacactagctgctatgtcacatcctgattttcgttttaggatttataaattatttaataaattattattagaatttatattaaatgttcattaatttacaagtgaagttaaatataggaaataaaattttctaaatataaatcatggcgggatttaatttttatttaattctccatgattaattatactccctgaaattttctcagatttttcggagctcaattcctaattttaataatataaagaacatttcagtaattatccacatattaaattaatcattaaatggtcttattataatcttgttaagtactttgggtgtccaagtattttcaggatttttcttgaaattatttgagcattggaagtatttttaacaattcaaagatcatttcagtgattaatttaattggaaaagtaattaaaatccctttttcttttcaggctgaaactggaaaagttcacctttagtcctcggctcattctcccttcctttcggctggcctgatccctcctccaaagtccatttttggtccctccttcaatccggcctagtaaaggaagctcacagagaaagtctaccttacgtccctagtactgttcatcttcaacccctggctgccaaactgagaccgagttggctcggtttttctcctccgaatccggccttatctctcgtgcattcctaaaattagttgaggggaaatattcctcttatcctcctctatctcttccaccaaaaatccgactttatccctttgaattcgacgcgaatttggattcgttttcgagtttatctctccaccaaaccctaggttttcccggcgcgattctttgcgttccaagcctgatctctctctcccgtggctataaatagtgtcccctccctctcctctttcggccgccacctctccctctctccaccgtcgcttgtagcgccgtcgccgcgttcgtcttctctctccgccgccggcagccgctccagccgccgtttgccgccgcctcagccgacgccctcctgtgccaccacatctctcggctccgcaaggtcaagagcaagcccagcagctggttcccttgcgccgaagaccccgggaagcccgtcgtcgccatcaacccgaagtccattggattcgcagctgcgaagtgaagcccggccacccttccattgtcgccgaaggtcgccgaaacgccgtcgccaccgtggacagtacctcgtcgccttttggagcttgtcgccggccatctcccgtcgctgtttctcgttgccgccaccacaggtgagttcgctgtgtcctcctattccttcctgtgccctttgtttccgttggagcatcaccgttggtcgtcgccgctgttgtccagagtcgccggccgtcttccgtcgctgtccgtcatcacgtaagggttggtaagaatcgccgtcgcctcctctacctcccggtgccctctgtttgcattattgtgtcgtggttcgccggcaaccgccgctcttatgtcgttcaccggtgtagtttatccctagggtcttaatccaatataatctaatccgtggttggtctagcgttgtcatctccgtgtgttgctgctggaacgttgtcatcatcccttcgtctccgatcactttggttcggtgagacttctatccgttctctcttttcaatggcatattatttctttttactatatgtcatctaccaaatataatctaatctttttcaaaggttgttttaatcttttctctcagttataaatcatttgtaaatggtttaattaatttggaatagtattttctttaataggtttaattggaattcatctaaaattatctaaaatcatgatctacatgtttgtttacttttatgtactgtttatttggtttttattagtcttttttcccattttgcgtgttagcttgttgtttccgtcgttgcgaaaggttcgcgagtgcgtcggaagtggttctgaagactaattgaagaccgattattgcaaggcaagtcacacagatcctaaacacagttcctttgagcatgttgatcctatatttaaattctctatttatttcaactgtgtatttatttcaactgtgaacatattcctttgtaatggccaattcgcattgattactctattccttgttaccttgggtaataaattgattagcttgaaccttatatattggtttggttcagctaaaagctatatatatatatatatatatatatatatatatatatatatatatatatatatataattgcttagccatgcctagaaacattagctcattaatgggatgaatcatactacattattatttatggttatatttaatggtagctcatgatggttaatcgtgttatgataattaattgataattaaaacttggcaaagggcggttgtgagcacatggttttgaaggtcgtgctcataacaattaaggaccggttcgcgagctactgttatgagacattaaccgtgccaaccacaagccagcgtgggcaacggctttaccttttgtatagcatgattcattgcggggcaccagactgagaagcggcgagaagtccgtgggggtcgctggggagtccatgcctctggttattgagggggtgattatgatccaggaatggtgcactgtgatgagttgttgtgcgaagggtactgtcacaattccgtttcgaggtaccgtggtggtactgagagcatggtgacatgttttggggctgtatcttgtgggtacaatggtacacctctggccagagtaaaactattcgaatagccgtgcccgcggtcatgggcgggttgagcaatgtttttcgtgattagtctcacacctctcacaataattattgatgctataattggtaataatttgtttagctcctggtttggagttagatctgtacaactggatatggttgttcagaatggttgggcctgagcagcatgggtgtgctgttcagtgttgattaaaattgattaattactctattgttttacattctcaatatttttgctaaatgctgcttttgcaaatgagcctatattatgccatcctttggtatccttgtgcacatatttactgtgcggcttgcggagtatgtcatatgctcaccttgcaataatcaatcaaccttagttgaagaaaaatgatccagaagaataagacgtttggcttataccccagttgagctgcctgtgtgagtggagctgaagccatcgctagaccgttaattccgctgttgttttcatttcttttataagtatgtaacgatattattatgatggatttgtatattaaattgtcagtttgtgtacctcggctgattcctggacgagagttttatgcacaaataagtttggaaattactagtgaatttccgggcgtgacacgctatgacaagacaaaggtgccggtttttggtctagaaccggcaccttttgttccaatagtgctttttatgctccacacaaagatgccggttgggaagacaaaggtaccggtttttggtctagaaccggtacatttgttccaatagtgcttttcatgcccaacacaaagatgccggttaggaagacaaaggtgccggttttgggtctaaaccgacacctttgttccgacaatagtacttatactccatcccatgccactcgagctgattgagcaagaagagagcggcacctctcgttcttgcccgatcagctagaggaggggaggaggttttgctctttttttttttgtgtttggttaaagattgaagcctaaaggtaaatattcattatgaatgcgaattatatgcaaatgtctagaatttacacttacaagcaaatgtctagaatttacacttacaattttttggacttacgaatttgacttgtgaatttctgagatgttgtagagctcaagcgatttagtcaagtctcctgggatgtgtaacacatctggtcatcgccttcgtgtggtttgacgggcacgtctcaggctgaagttgactggtgcgctgagtctcagcaatatctcatttgctctttactcgaggatatgaatgtgaattatatgcaaatgtctagaatttacacttacaattgtctggacttttgaattttagacttgtgaatttctcacctaaggatatatgtgcaaattaatgttcacaatttaggccgagttcgttaggactggttgggaacaagtatcctatgcacggaaaatagagcggtctattagcgcatgattacttaagtattaactatttttttcttcaaaaatagatcaatatgacttctttaagttacttccgtatagaaactttttacaaaaaaaatgtatcgtttaaccgtttgaaaaacgtgtgcatggaacacgagagataggagttgggaaaacttgctgccggacacagccttagacttaagaatttttggacttaaaaattttagacttacaatcttttgacttaggaattttaaactaggcacattttgagttagtttatatatgcaaatgtttaggatttaaagataagaattttttgacttacgaattttgacttaggctagtaggtttttatatgttatgaacttgtgatgaatggcttgtaggtttttatttgttgtgatgaatgtgaatgtgaatgaatgtgctgtatggatgtggggctctagggatgaatttgggtttatatggaattggggttgtgtggatgaatttactgcaattttttttgacccaataaataggtgccggctttaaactaaaaaccggcacctattttaacagccacgtggcaatttggcttagaatttgtgatgcatgtttgtctattattgtaaataactttcagtgattaatatatttgctaggaagttgtaagttatatatagtctttcagaaacactacatactgaaaagagaacgaacgtaatgattattgaaaaactgatttagctaaggaacactcctgttactgctcatgatagaagtacttgatcacatatgggtataacatgcaaagagccatagcatatacttattgggatggtagcatgtaaaagtgccaaccctttctacggtgactactgaagctagctagttataattagttatcaccaatcaatgcatcctgattgaggatagaaaaaattaaacatcgattaacttgcttgtagctactggccaagtgagtaagtgtattccattttccatgtaactctgtccacagcaacaatgagcatgcatgcgaaccgaacaaaatctgcattttcagtacaacacaaatgttaatgagaggaaaaactcgaaggaatgaattaattgtgttatgcacaaaaaaataggaagctgaaccttgaaattatagctgcaaaaaaaaatgccccctattacttatcgcatttgccctgttcaaaagtatcagttattccataagtacgagccttgaaataatggctttgtttcataatacctttttgtttaagtagttctaggaacagaaatcgaaacgggtgattagcatatgattaattaagtattaactataatatattttatttacgaaacatatcatttagaaattcgaaaagcgtgatcaaattaaatgataaagtcaccaagtccaaccgtagtatagagcacagagttagctagtatgaccagacattgagaggcaatagatatattgagcccagtgaataactccaacagaaatataaagtagccaagcaaatgatcctctaaatgtacaaatcataacaaatatgttagattagcataaagttctaaaaggctgcagcaaaatggggatttgaaaagagaaatgggactgacacaatccaagtgaggaggtttcattctctaacaaccatatacaatgagttgctttatgatggagagtatcagtcgaaccatgatctaattgatttaaaaataaaatggaaacacatttcatgataagaccaactgtagaatatactctcaaaatttagaattgaaagagctcccctaaaaaatagttagaaagagtttgtccctcttcatgtcattttaaaagaaaaatgtaattgtcattattttaagtcgaactaactttcttttaattatgattttagatttgtgtagcaaccacctgaaatgatggcgattgcactggttatgctaggatttctactattatctggatatgtcacgggattatccaattatctttagattcattgtgaaggcaaaaactacacaccagacaatatatacaagcgaaacatgcaatttttatcaatgacactgccacttaaggtctcatctatcctagatttgtttgcaatgatcatggccaatagcacaaaagaggagatataagcagttggatggtgtcgtgctgatattagtagtactacagacaatagttgtgttatgtatgcaatacggaacgtgcaaatagtttgagcttcaaagatggaagctaccatcttttacgacttgtgtgggcttagaatttcttgtcacactattcatttcaatatttctaaaaatatagacaagatagcaatactttgcgacccattttccttttagaacccataatataactatattgttctattacttatttttgccttgacaagtaaggcaactaacttgtctataaagtttgtcacatgaaggaaaaatctcatagcaaatggctacaactacaccatatatggccttgctgagtgctcatctgaggtcacaagttttgaatgccagatttgttttgaggatcttaaccaggccataagggaaaaggtggaagaacgtcaacaatttggtataatttttcatgacaatcgggctaaatgcttgtgcggattagagtatactcagtggggggccttggccctctacatcgcgtgggggcaaatgcccctatcatttttatgtatacattaacctattctaactaagttgtagactgtcgacccccactcattttgcttcctgcatttgcccctatccaaaaggaaaaaaaaaccccaataagtaggtacggaccctaaggccccgttagatctcaacatggagataaattttggattcacgcaaaatgagaaaccttattagcacatgattaattaattaactattataaatttaaaaaatggatttatttgcttttttaaatcaacttctagaaactttttttttaaaaagcatcatttaacagtttgaaaagcatgctaacggaaaacgaggaagttgaaattggagttgaagaaatagaacagagcctaagtctttatatgttcaacagtacctttcgccaaaaggctataaaactaatccacgtgatttctaaaggaactcccattttttcctaaataaatttgctcctactagataaaacaaaaacaaatcaaatccctacatcatttcatatctggtacatatttttccaattaaaaaattattggagcacacattagaccaaactcgctcaatttcataggcttgcacaaagactatggtccatggacaagacgacacggtgaaaggcaggtgatgctcgcccgccatggaccatgtgtcggtaaaggggaagcaaggggcttggcactgaaggaccaaaaccgctggcgaagggtgattgacggcttcgtcatgatgggctgtgcgaggccatttgaagctacaaggagcccacatcgatctttgaagaatatatgatgaaatggttttggtgttggcatcccttaagacaaataaaggaagatggcatgaagacattcctattggtataattattttcctatttatatttgaggatagaatgccatactattaagaggtatgcaacgtcgatgtgtttttgtatgtctcggtgcttaaagtgacctatttgagagaaacccattaacctatcctttgagtgattttggaccttctttttggttgagttgggtaatcctctgagtgagctttccataaagtctaagatcgtaaaaaatggacttccgatcaaaaagttatggccattttgctctctggtgtttttcagaatgtccaaaaatattttgaaaagaccaaaaattttcgaaaattccgaaaatggctgcaaaactaagattgttttctgttgatgcatttcggcacatccaaaaaaggaatctttgccagaaacgactagttttcaggggctctggtatataaactcctccacccctccattagtgatggctattcttgagtttgaaacatatctatccgaagtcacataccccctctctaatcccctagctaagtggtagatctttgtgagtgagatttgagaagagaagggagttgggttgagaaaaggattgggaagagaagctaagagctagtgagtttcacttcatactttgagcactcaagttcatacttcgtagcaagcaattcttcgatctccatctacatatgtgccttgttatgttaaacagtaatatactaatcaggaatgagaataatttagtgaattaaaaattatacattgagattatgcttggtggatcttcagaataacaatagctgtgcattgatgaaatcaagtttacacactaccaggatactcgcagatcggacacactacaagcagcaacaactgcgatcacgaagacgaggacccaaggaggacttgccggcgaccatcgagagtttcaaccaagaaatcagaaaagtggaaatgggaggtagtggaaccctacccctttaggccttgttgggttaatccccatgagggagggattggagggaatttattccatacctattatggtgtggaattattccccctcaatcccctccaatcctcttcaatcccctctaaaccgaacaagaccttcttttaatccctctctcacaagtggaccgagaggattcggaaggatttattctacacctattatggtgtggaattttttcctctcaatcctctctgaaccccctttctcttgcagattaaacgagcccttatggcggcgataaactgctggaaatggaggggaatagggggccaaactacagagaagctattggggattttgagtttgcctaacttgttgattgactgaaaattaaggagagaaggcgatctactgacctagattgattcaatgcgcaataaataaactgcaagaagaatcgactgaggttaattgacccaccggtgtgcaaggaagaacggaggaacagcactgccgggcaccggcggcagacagccatcgccagattgggttttcctattctgttacaggagagtagagatggagaggttcagggatgaggcgtggaaaagtatgtcatgtggagtcattactaccagcgctgaagcaagctggatggtgctcaaccgcatgcatagcaagcaacaccaatcaaggaatagtcctttggaaagaatcaaacaaggaaagagttaatttaggaggaataatgacatttccttgtattaagatggccacgagccaatataaactatgtatccagccttgctaaaggcaagcaatatcaatcaacttttcctaatctcccttcttccaccattgggtgtgcagggaaggttcctgacacctcaaccgagtcgagctacaaactgcgtagccgcggcccggctatcctcggcaccgacacgcttgacaacttggtatcaggttccaggcgttcctcctcccactccaatccaccatcgtcacccactccatccatcacttccaccatggctaaaccatccaccaccgagctcgccgcgctcatcaaggtgctcacggccaccgttgacaagctccagacttaggtcacctcgctccagcaggctgcaccttccggatccaagtcctcaggcgaccaccacaacgatcggcctcctcgcttccagaagatggattttcccaaatacgatagcaagtccgatcctctcgccttcatcaatcgttgtgaatcatactttcatcagcagcgcattgcggatgaggagaaggtttggatggcctcctaaaccctggaagatggcacgcaaatgtggtacattcaagtccaacaagacgaaggcactcctccatggtgtcgcttcaccgagctgctccacctccgttttggccctcccctatgttccaatcctctcgcacaaactccgtcatcgagtaccaagacaagttcgagtctctcttgcctcgcgcaggcacactcacggaggaacaacgcatgcaaatcttcatggccggccttcaaccaccgctcagcctcgacgtcgagatccataatccacagacgctcgccttcaccatgagcatcgcccgcaagctcgagctgcgcgaccagtgcgccgcagctgccgtaccagggcctccgaaccagtgccaaaactagcggggcctgctgccggcgccaccccagcaactcgccctgccggcgcctcctcaaccaccagtgtcagaccctgccacggtgaccgttgagggccgaatggtcaagcgcctatctcaggctgagatggaggaacggcgtggcctcggcttgtgcttcaactgcaacgacaggttctcgcgtggccacaaccgtgtctgccaacgcctcttcctccttgacttggccgtgcctgacgatgaccacgacgacgacagcgcccaagaggggaccggggagacggagccacaggtgtcgctccacgcgattgcgggcgtccgttgctgcgacactatgcaagtctgcatcgaccttggcggcgccgcactcctcgcgctgctcgactcgggttccacccacaacttcatctccacattggctgccaacggcaccaagcttccgctcctccctcgcggcaagatgcaggtcacagtcgccaacggtgaacgcgttccatgtccgaggttgtaccgcgacacggccttcaccatcggcgccgaaaccttccacgccaacttcttcgcgctgccgctggcgggctacgatgtcgtcctgggcacgcagtggctggcgtcccttgggtagatcttgtgggatttcgactcacgatccatgtctttttggcggcacgaccaccgtgtatgttggcagggtgttgcaggctcgacggccccatcgctgcaagtcgttgccggccacgacatcatgggagccctgctcgaggaattcaccaccgtcttcgccaaaccaatgggcatgcctccacctcgatcacgggacccctacatcaacctcgttcgtgcttggcgccagtggccgtccgcccttaccgctaccccgcttcccacaaggatgagttggagcggcagtgtgccgctatgctgacacaaggattgattcggtgcagcacattggctttctcctcaccggttctcctcatcaagaaagatgtcgggtcgtggcgatgttgcatcgactaccgcgccctcaacgccatcacggtcaagaatgcataccctattccagtggtcgacgagttacacggtgcccgcttcttcacgaagctcgacctctgctccggataccaccaagtcaggatgaatgctgccgacgtcaccaagaccgcgttccgcacacatgacggcctctacgagttcatggtcatgccgttcgggctttgcaacacccccaccacattccaagcactcatgaacgacgtcctccggacattcctacgtctcttcgtcctcattttcttcgacgacatcctcatatagagcgactcatgggcagcccacctacgtcatgtacgcactgtcctctaagtcctacagcagcaccgtctctttgtcaagtggtccaagtgtgctttcggcgtctcctctatcagctatctcgggaacatcttctcctccgagggcgtcgccatggacccgcccaaggttcaagccatctccgactggccacagccgcgatcggtgcgtgtggtacaagaattcctcggctaggcgggctactaccgcaagtttgtccagaactacggcacgaccacagcaccactcacaacactgcta

SEQ ID NO: 83238 - DNA, 2583 bp, Oryza sativa
cccgtgccgcagtggttgtagtcgtcccgcgtcacctccagcaccgcgtccgccgcgccgtcgaacttgaacactgcgccagcccaaccagagaaggagaagaaatcagaacaaatcaagaaacagaggaatccaagaaacactgaggaaggaatcgagctttgttgactcaccgaggttgtcgccgatgtggaagcgggtggcctcggcccacctgttgagcgcgtcgggatgcgccggcaccttccacccgccgccgttgttgccgccgaccacgaggtccctggcgttcgccacggccacggccgccgcgaaggccagcgcggcgcagagcacggtagccaacaccttcgccatcgaagtagggtgggaggactagcaaaagtagaacacgagagcacgagaggagggaaacaggggaacgaggaggaggagatgatgctgtggcggccatgggaggcggatataaatagggtggtggagtggaggtagccgttggggtattcgaacgttcgggaggggaggcagtagagtagcatcgggtgccgcgaagacgcgtggcgacagcattcactggcattgggatgggatgggatgggatgggatgggatgggaggagtggcaggctgttgctggcttgctgctgctgcttctcagcactgggaaaggatgcttctgttttggaccttaccgttgctgttttggccttttgaggaggcactgggctggatgggatggcactgttctggtgtagggctgtcacctatggcccgtggggctggggaggcttgggaccagtggagtggggtccacagggaagtgagtgagaattgtgtgaaccttggagttaatattcctcctggaagaagtgtttgtgttgtggcaataaaattatcattttttttaaaaaaaaagtcacatgaatcgagtggactgttgggttcagcctcgttatcaaaaccctcaccaaattagaccctgtttagatgggactaaaacttttgttcctatcacatcggatgtttggacactaattataaatattaaacgtagactattaataaaatacatccataatcttggactaattcgcgagacgaatctattaagcctaattaatccatgactagcctatgtgatgctacagtaaacattctctaattatggattaattaggctttaaaattttgtctcataaattagctttcatttatgtaattagttttgtaagtagtctatatttaatactttaaattagtgtttaaatagagagactaaagttaagtccctggatccaaacaccaccttaatctacgtcacgtcaacctatgtgatcctgaacaattaagacatgtttgatagagttctaactctaaaaattaagtctttctaaatcaagcttcacctcttgagtttattttgtgagagcactttagtccactctatttttttttattgttggagctaaaactttttgtttggacttccaactttagaagagatggagttggagctgaagatccaaacatgcccttgatttggtttgattttgcttgtagatgatcaaggcgtcgatgttggatgagatcatcgatcggctacgtcaagttcttgctagaggcggaaatttccctgttggggtcggagacccaccctaagggccgggatcgggggataagggggtgttcagttgggactaaaactttttagcccatgtcacatcggatgtttggacgctaatttagagtattaaacatagactaataaaaaaaactaatttcataaatgagagctaatccgcgagacgatttttttaagcctaattaatccataattatcaaaactttactgtagcatcacattgtcaaaatcatggcgtaattagattcaaaagattcgtctcgcgaattagtctaagcttatgaaatgggttttataattaatgtatgtttaatactccaaattagtgtccaaatatccgatgtgacaggtacttggaataagtcctggaaaccaaacagccccctaattatcacccgtgggtgaacgggggcgagccgaccgcacccttcatctcccaccaatcgctattattgcctgtgagtgaggcacgctgtgcgggccccagtggtgcgggtcatcaaagaggccagggacgaggcccgggttcatctcttctagtaggatggggccgggtggactcgcagggggagcagggtggacccgcacctgtctcgcccccttgccatacctagttcttgcagctcatcgattgtgcgttttgatttgagctcagctgatgctgatggcagctaaggatcgattagacgtgtcatagtgactgctttgacactgcaggatcagcaaccagtggcgaatccatgatttacatcaagatggggctaaagcaaactagatatatcagcacgatcagcatttctctatgaaacccaaatacactacgataaacaaagagataatccatgaaatgctattgacaaacatctaagtcccagaaataccatcgacaagtgtgagttctaagaaatgccatcgtacaaatgtttttgtcccaaaaatgcc

SEQ ID NO: 83239 - DNA, 3456 bp, Oryza sativa
tactttaataaaggaagcatccatcgaggtacaagcgagagaagaaggcaaacaatcccggctttctctagaactccgttagaagaatgccaacactccggcactccatcaaattcttggaggaactctgatattttggagcactccttctggagctttccctcactttctactaagccaacatactaaaaataaaactacaagtgtgttgtactatacttgagctgaaagttgtgtttgttgaagtatgtgaggtctcctcattttatagcttccaatgatggttagaatagcggttaacccctcacaactgtcattgggacttcatcagggctatccacgtgtaaggtggagatgaggtgggacaggatgggttcggccgacccctgggccccacatctctccaccaactttctccaatagcttacaggtgggcccctatggtggttaaggacggttggtcccacttttggtttcgactgacttttgggccctctgttgacggtcattatcgatcagtttcgactgtcaatattaccaaaatagagaactagtgatgcttgcaatgcataaatatgttagaataataatattccactagtattaggtctactaaccttttgcagagaataacaataaagtggaggagaatcgacatcaactcaaacgataaatcaattggacgatgtcgagaatcagacttatgcatgaatgggccaagaactcagaattgacacgatgaattgggcaaaaattcacaagtctacaaagtgaagcaaaagaggaggtcgtcagccgaagatgggctggtttgggccagcccatggttcggccaaaccagggggttcggccgaacccccatctccaccgtgatgccaaggttcggcatggacgtccaagattgcaccccaatgacggttggagggtacttcggacaatcccccttctacaaccgtcataaccacctctatataaaggcttcactctcttcacttcaacacacacctcaagcaagagctctctcatttctctcaagtttagtttagtagtatctagctggtggaataggaatagagtagaaatcaggagtccggaagtcttcggaagagttcgggtatggctctagtagctttcctttcctcttttgtaagctttgtacttttattagaatactcttctatatacatttatggtattgaaatactttccgagtatatgagtacctactttacattatgttcatattatactgaatatacggctagtttatctgggagatgatttggtgcgggtataatgtttgcttatgcaattaatctttgtcatgaagatgatattatagtagtatctggtagtttaggcgtggtgtctagatcacgggatatcattatttggggttatatgctgtggatgagaggtgggccgctgatggtgacagctcagtacgggtattcctccgcacatgtatatactaagttaattccctggggagggtattcctccgtatttagccccggttgtatggtcatgacgggctgtcgtaagaaactcggcagtcaggggtggtttctcgaagtaccaggagggcatcgaatagagggtattagctagtatatcggttaactagaatgtatgtatactatgtatattagaagtataggaatagattttctttctcttttcttcccacttagcttagataatatattatgacaatgagtagctaatgcttgtgtgtcactctacccttggattattttaacccctgcttagaatatgattatcacaagtaatatataaactattagtcaagttctctctacatgatcttcccacggaataaaataaatacgacacccttggaatactctcgggtgaaatgctacaatggtatatccgtgcgcttgtggatgaactctgtaaccataatatatcagaagtatttctgcgccattactgggaattatatttctagtcatgacgttaagaaataccgacaccctccaatccttgtactagcgtatgattggttaggggttcattttcatcgcatggcgggtgtattttctccttaaatgacctgcatacatatatttgtcaaaactagtagaagtggttagtagtaaattcgtaccactaagttttgataatatgtttgaaatcttttacccaggagttgatggttaaagtttgcacttaacaaccgtcaacataccctaataatcttattgtactactagcttcgactttaaatttttagagctacacatacctagctctaaaatttataggaggtcgaaatctgccaaaattaaacctaaattaaggaaaatttggatactaaatgattgcattttagataccccacttttgatgcaaaattttgtcgtgacacacgaatgcctaggagattggcttagctccagtggaggtgctaaatcttgatgaggttcgggcgtgccagttaatttgatcctgcaactaactggatggaaatatatcaatgatcaaggagctgatcatcaacttaggggctgaacatcaacttagggagacgatcaacttatgaagctgattttgataaggttttgatgaattgactataggttccatttatgtaaattaaagtgtatatcggttaactaatcgatacatctgatagctgaagtccacaataatgataactcatcggccagaactcctatgaacaccgcataaaaaatatcggcttactagaattaaacttattagcaacaatgtaataaatcggacctaaccaagaaagtataagatcaaagataataaggacaacctatttggctaatagatctacacaaacatgatggacatatcgatcaatctaaagctacaatatgattacagaaatagaaacttaggcagaatatcggacctaaccgagaaagtcctaactaagctgatatgattctaaacaacgatgcagttaaagatagaatcaatatatctgagaggcctcacttacttcaactggaatagaatattagacctaactaagaaattcaagtcgggcccttaattaacttgtatagatggaatcaactagatcccgggtagttacaggcttacagaagatcaaatccattctgaaaagattagaggaatgttattcttaaagatattttttattgaaaatgttggaggactacatttcatttcattaaggagaaagaaagaaagaaagttgatttctatatatatatataaaatagtcccccgcaaaaaaaaagatttataagatcacttaggggtttttaccctccatttcttattcctattaggaataactcactacaacaaagctaacaactcttaaagaaccagatttgtacatatactattttaccccttgttgaatggatgatactccatattagaaagacattgtgtaaagtagagtttgtttgctaataaagcgaa

SEQ ID NO: 83240 - DNA, 18199 bp, Oryza sativa
ccttgccacctgggcccagatgcaaaaagtaccagccaaatgctctttagggctgcgaaaattgcatttagcccagagggcagcaaagggctaaatgcaattttcacagacggcggcggacggcgccgtcgagccgccgtctaccacgtcagcttgccgccctccattagggcggtatggtctatttttgtaatttttttcgccaatagattatttctgtaaatattaaaagaaaaaaattaaaaaatgaaaaaaattcacgcaggttcactggttcagtgaaaaggaaaaaaaaatttcaacatggcctgttctaataacttcgtaaacatacaaaactttcctcgttttcaaactaataaatggttatcttatacgaaaattttctacataaaaattgttttgaaatatcagataaatttatttttctaagtttttaataattaaaacttaattaatcgcgtggctttctcattttgtgtgcccgcttttaatcttcatccttagaagattcgaatggggccttacacaacactttgcgtagttgcgtcggagtatataatatgcatttatttttatataaaagccaaataagattttctatgggggtttttaaggcagaaaatatggttgtaaatgcaagtgtatcccctgacccatcgtcacgaatgaacggttttctcacttttacaatgagatttcctctttttacaaggaggagtgttgcagttttcaacttgaagtagagaaacggatgcttgaatcatgggtttttctaactctgtaaattcttgaagttggagttgttgaggtgagacattaaaaattataatttaacctagaaattctatgattttacaattcaggaattagaagcataccaaaacaataccagggcaattgatcagccctatccctcaatttagcacgcaatttttgttgcacgcaaaacaagaaacctcattagcacataattaattaagtattaactattataaatttaaaaaatatttgtatttactttttaaaacaacttctatatagaaactattttaaaaagcaccaattaacagtttgaaaagtgtgctagcagaaaacgatgaagttgaagtctggagttgaagaatagaatatggccttagttgtaaacgcttaatccataaaaccatgcccctttattttgaaattgaagcatcagactagaatattagaaaatatttctgtctaacattatacttttataaggatatacaaatagggacaagcgtgattttatccatatactgatgtattatgggttgacacctttcaacatcaatatcctacttttttcagttgctacaaatgctctaataagtttatttacaaataatatgtgaagcatcgtacagttctgtttggtgcaaaatacctgtaattattgttggcacatcgcatcaaagaattggtcacttctaaaatactactccatcaaatcaaaccataatgcagtgttttttcaacgaccacttagccatcaaatcaaaccagtaaattcttgttgatgtagtactaaacggtagctccatagtgcagtgttttctacttgatgcacaacaactattctagcctttttaacttttaatgtgagtattagtgcatcgtctaaaagccttaggtatatgaatcatgacccttataaaaaccagaacataacctataaatctacacattttccaggtacacatatatttaaaaaacataaaaaaaaatagaaagaagtatgcatagctcaattggttttgtctcttgtggtgaaaccagcctgtctgagtttaaaccctaaacttgtggtgaaaccagcctgtctgagtttaaaccctaaacttaagtacttaacatgagtttcgtatttatggctaattattcatttagttgtaagcgatatacctatcaatagcgagacatttgtggccggtccaattttccggatgtgctcatagggataggatgtgtgtagagatggcaatggggacccataacccgagacccgacgggtttttactctattaggagctaatcgtgttcttactgttatacccatgggtctactaacgggcgaaaactcttacccattgggtacgtgggtatgggtctgttctttacccacccgtacccaccaacccgtgggtaaaaaaaacccgttgattgaacctaaaactatgagcaatataagtttcaacgactactaaatcatagcataaaacttctttcacatcttaagcattgttctatactagttatgtgaaattattattagatttattgattatgtattgtggttgtataatttttttactcgcctttgaacactaatattaatagcattgttgctagagaaaatattgatagtttagaactctaatatggctaattagagtacaaaactataaatgctacaagtcaattatatgggtatgggtacccgttagatacccgttacccgcatgggtatgggtatggggacgattttgtacccgcgacgggtgtgggtatttaagtaggaatattttaacatcatgggtgtagggctgtgaacgagccaagctcgagcgagtttgactatgtaggcttgagcttgacatgaactcgagccgagctcaagccgagcctgccagcctggatactgatcgagcttgggaatgagctcgagtttaagctcgagcgagcttcgagcctactcgagcttggtagcttaacttggtgaaactccaaagaacttactcttatataagagatattaatgtaaattatcggtagtcaaaattaatgggtgctatttgtcttgaatgaagcctctgcagcttttctcatgaatacatggctttgaaacgttgcaattaacaaaagctagctactacatctaataggaatagtagtactattactagcagccgaataattactttattgataagcattgatggggtcttgagacttgagcaggtcaagcacaatgacaagtatatattggcccatcaaaaatatcttcctacatgcaatgcatattatactaatcaagccttgtcgagctattcgagctcgagcttgctaggcttgcgagcctcagcctacgcttgagcttggcttgtctagtattcgagccgagctcgaatcaagcctgtaacgaatcaaactcgagcagcttgcgagctccaaacttttttgacagccctacgtgggtgtgggtatggggcaagggaacccgatgggtatgcacccgttgccatctctagatgtgtgtccgtattcatatgggtgagtatatatatgtcttgtgtgtgcatgtggatgagtacgcaatgcgagtgtatgcatgtgtactgtgttgctaaaaaattgagaataatttacttttaaaaaagaagaaatggcatcaattttctttttttgaaaaaaaaaaaggaatcgacaacaatacttcagaaccaaggaaggaccgtaacggccgtccgatcaccgccccagccgcggaatccaacggccaaacttccatccatccacccgttgcccacccccaaaactcaaaatcaccgaaacacccttacccccgcacgccccctccctcactgacacgtgggccccacgcctcctctctctctctctccccagatccgcgcctcgaaacattcatctcgtctcgtcgggcgaagaagcccgacttcccacccactctccccgtctccagaagcagcagccgagccgccgccgacgagcggcgatcgccggcggtgggttgggctggcggctagcggcggaatgggggtgccggaggcggtggcgctggagatacctgcggcggcggaggccgaggaggaggttgaggaggaggaggggtcgccttcgcctccggtggtggccagggtgccgccgcggatcaggaggcggctcctcctccggcaccgcgggggagcgccggccaccgcggaggagatcgaggccaagctccgcgatgcggacctccggaggcaggtgggtcgctgtgatctctcggcgcacccggcgcggcgctttcgagatttagttttatggttttttttttcgtgtttctgggtgatttggttgtggttttggtcggtggattaggggcatctgtgcaattcatgtcaatatacgtttcatcaggttggtagttagtgaattgggagtagcattccggagtgcagattttagtcacgtagctggattactgaatggtttgtgttagaagcaattggccatcacatgatttgctgggagttgattatcaaggtaacgctgttcttgatcaaacccgggagccacaatataacttggggtttatctcaaccatgtcaaaatgggagcccagattcattttaggatgattgatatttgaaggcttccaattttgctgtcagcctgtaaaatgggttctacaaacaacaattaaaattggtgttgttgccaagttcatttgaaggactggcagaaaaaagtacgatcactgtggcttgttaactcatgtgtattctattcctccagcaatttcatgaagcgttatcgtgcaaagcgaggtgcacagtcagatacccttcgtgtccatctcaggaggaggatcctaagaagcgccttgaagcaaagcttgtggctgccgagcagaaaaggtaacagaaagagggacctagtcacctagcagagcatatttatctgatcggatattaagatagggaacagtgagaagtgatttctgattgcaggttaagcctcctggctaaggaacaaagtcggcttgctaagttggacgagctgcgtcaggctgctaagaatgatgcggagttgaggttcaagaaggagagggaggaacttggcatgaaagttgaatctagagttcggcaagcggaggagaaacgtacacaactcatgcatgctcgttcgcagaggagggctgcactggaggaaagaacaacaaagtaccttgtgcagagagtggcgtgggaaaacaagtacagggagcgtgtacattcagcgatcctgcagaagcgcactgcagctgagaagagaaggacggggctattggaaggtgagaaaaggagagcccagggtaggttttcacaggtccaacttgctgccaggactttatcttgccagagagaagctgacaggagcaagttaaaagaacaactagaagacaaacttcagagggtattcctttttatgctgcagagttggtataattgttttagtagctctttgacttacattgcaaactatttatgcaaaacaggcaaagcggcagagagctgagtatttgaagcagcgaggaagtactcacagctttacatacaccgcttcagttaaacacggtgattttctttcaagaaatctggcaaggtatggtagacttatacagtcaactttctcgcaattgtttggcttgtgtgtatactttaaattttattgattattctattcgatttgatgcttcagatgctggagaagattcataacatctaggaagacaacagtggtgttggctagggcctttgacatgctaagaataaatgaggaatctgttaagcctatgccatttgaaaaactagctctttgcattgaatctcccacagttcttcagaccacaagggcatttcttgatcgcttggagagtcgttttactttatctcagtcatcaagtccatcatcaccagaaaatattgatcatctgctcaagcatctgggatcaccaaagaggactctatcaaaaagtgggggaagaactagagtgacaccaacaaaggcagctagaaattcagatgttagcaagttacctagatattcaccgaggatagttctttgtgcttacatgatactaggtcacccaagtgttgtttttaatgaacgaggtgagcgagagaaactacttgtggagtcagcagaaaactttgtgaaggaattcgaactgctgattaagacaatacttgatgggtcaagtggtgcatgcatactgaaacagccaatactagatgatctgtctcctggatcttctaattatcaggaatcttctgccgttgttgctgatcggaagaaattcagatctcagttggcttcttttgacaaagcttggtgtgcctatctttaccacttcgtggtgtggaaagcaaaagatgcaaagtcactagaggaagatcttgtcagagctgcatgcaaacttgagctatcaatgatgcaaacatgtaaatttaccgctgaaggccaaccagagaaccttaatgataatttaaaggccatccagaaagaggtatggttatatacctggtgccttttcctttgtttttttcttttacctatttccctgacattagtaattgagaagtattttaagtgcataaaatcccgctattcagctattgcaggaagcagtccattcctacaactttgcacttagtttatttattttgattatagttttcttttgtctagtcaaaactttactatctgttgaaattgtttctgttcatcacccaggttatggtagaccagacacttctaagggagaaggttcggcacttgggtggtgaagctggtattgagcggatggaagttgctttatcagaagcaaggacaaagttttttgaagcaaagggaaacaggagccccttggcaacaactataaaaaatgtagcagctacatgttcttctggagaatctcctatttctgacatgaaggagaattccaacattaatgataaaaggccaagtcaggctgtccaatctatgttcagagttccctcttcaccatctgaaagtaacacagcaggcatcaccatgagtaatccaatgacagtgagcagcactctgtcagaaaaacggccaacagagaacgagcagatggtcaatgagattcttcatggttttctagctgacagctctagtaatattgggactgttgagggtggtttcaaggttagatcctatgttacatttatactaggattatattgtaagttttcatattgctggggtgcagacaataataaccaaaaatgtataacatgagaaagaatttgggaagcttttagaggggctcacatgctgtgatttagggtctagattctattaatgtggtacgtctatcagcttaaatatgaacttttttgcatccagtcactcttttttttctcaggaaaaagtaagggaaacaatggagaaagctttctgggatgtggttgtggattcacttagaggagacatgccagactacagctatctggttcagctggtaaaggaagtcagggatacattgtatgagatggttcctaaaggttggaaagaagaaataatcaacaatattgaccttgaaattttgttgcaggtaagaagagcttgagtgattttatcatgaatctacagaatatatctgataccagttttgttgttttttggttgaaaggtacttgaatcgggcacccaggacatgcaatatttgggacagattttgcagtactctctgggtatgctgcgaaaactatcctctcctgcaaaggaagacgaaatgaagagaagccatgacaaattattgggtgaattaactgaacactctgagtgtaataacagtggttcaaattcatttgtaattgctgttatcaaaggtttgcgcttcaccatggaagaactaaaggtttgtgaactccttgagttcttaaataaacttcatggaatatacattgtgaacctataacagcctccattttttttattttttttgtaaaataaacaggctctgaagacagaagtcagtagagcacgtatccaactattagaaccaattataaagggctcaggtggagtggaatacctgcagaaggcttttgctgatcgctatggattcccgtccaatgcatcagttgctctccgttcaactgctcagtggatttccacatcaaaagataccgtggaagtagaatggaatgagcatgtcagctctttttcagctctgccagaaaccgatcatgttaagtctatgaattaattttatgcagtagtcacagcagtacacaaccgctgtttgtagcaatagtagttcaagtatctattattttcacctgctgttgattttacttacacatccctcgtaacaggctcagccatttgttgccaccctccgatcaggtcatggagttccagatcagcgacagtctacaatacctgtgtcaggtatttattcttttttccccttgtatggccattgttctgaactccttaatcatttagtgtcatgataagcagatgatacggggctaccagagtgcacggggcaaaggcttgaccagctaataaggattgggttgttacagctcatcagtggcatagagggtgtgcaaatgcagtcagtaactgagaccttcaagctcaattggttgaggctgaggtctgtacagagtcaattccagcaagtgattgtaattgcaacaaggtgaaacattactcaattttttcactttattcacttcactgctctgagtatcagcagttagctagaatggtataaccaaacccaattacgcctcttttttttcctcgcagcatgcttgtgcagcgtcaagttttggcgaccgacgacccaaacatcactcccacagagctggaaagcgcgacatcacaactgttcaacactctcgcagagctactggacaacttccccgacgttagcaccgccaagatcatggaggtgatgctccgttcgtcgtcgtcgtcgtcatcaggctcgacaaccggctctccatcagatgaaagaaccgagagcaggaagcagatactggccagggtcttcctcaagagcctccagaccgatgaccccgtcttcaagaaggtctcccggtccgtctactgtgcgttccgcgcgatcaccctcggtggcagcggtgccaggggacggaagctcgccgacgccgccctgaggcgcatcggcgcgacgaagctcaccgaccgggtggtgagatcggccgaaatcctcatcagggccgcgtccatttcacagcaggtccacggcccttggtacaatcacttggtgtgattcatggtggaaaagctagtgaaaacggcgtcgtttgagcaatctgaaccgctaagcgttcgtgtgaagaaccgaagatctcgtcttgtttacttgttagtagtggcaaggcagatggtagattggtacgtgagcaatgccctgctgctttgtgtgaataaataaaagagatggtactgtactatgcttgtatctgaaatcctgaacaatgtgtgcgtgtgtggtggtgttcatacgtgtgatcaaatctatgcttgtatatatacgaaacttaaaaatggtttcatcaatctaccatgtagtgtatacgtgcatatccttcatcagtacatttgaatctttgtgaactgtgatgatacgtatacaagcatcatgtctgaagtcacagacatttctgatcttctcttcttcttctctatctgcagcagcagcagttcaggaggagagctggtcctctgcggcggcggcggcgggggacgccggcgccggcgacgaggcgtcctctgtggcgggcgcgtcgacggcgggctgctgctggagcgcgaccgcggcgagggacggctggaacttggcgacgtagtagctgagcggcgggccggagtagacggtggcctgcggcggcggctggttcttgccgacctggatgaggatggacgacacgccggcgacgaagacgagggcgaggccgccggcgatcgccgccgtgttctccgacccgtccgccgccgcgcccgccgcccccgagctgatggcgctctccgccacgtacaccgtcggcttcgcccacaaccaattcaggtcagaagaaaaataaaaagaagatatttcttgaccacatttaatacgcaggaaaaatccgaaaaatttgaattaatccgattttttttaaaaaaattctataccgcatttaatacgctcgcgaaatttatgggcctgtcggctgcccgggctgcccggcacgaacagaccgatagtttaatcaatccgaaattttgaacaaaacgagatgaaactgaattgaactttcaaaaacaaacctgatactagacacaccttaactagaatgaatttgaacagaggaacatgttcagattcgtgatgttacgatgtggagtactatgtatgtgagtacgtttttttatgggacataggaaaaatacaaaaaaaaagaaagaaagaaaaaggaaaatacctcgacggagtagatgttggtttggccggcggtgtccttctcgacgtagccggtccatcccttcttcttgggagggaaggtgccgaccaccttggtccgctcctccgccagccactccgcgctcaggctccccacctccttctccggcgcgcactcctcctcgttgcagtcctccgccgccggcgccggcggcggaggtgaagaaggcgacggcgacgacgacgacgacgaggcgttgcaggacagcaggaacagcctcccccctcgcgcgaggctcgccgccgccgacgccgcggcctgtggcttggcggcggcgctgctcctcaggaacgcgcagcagctggtggtgctcgccgacagcatcgactgcgccgggcaagccatctcgctgcgcgccctcctctctactctctccggaccaagaagaagaagaagaagaagaagaaggaggaggagaaagggatggcgtggctagctagctagctagttggtggaatggtggagtgagcggccgcagctagcggaggagggagacgagggagccttttatgccgtcgtgtcgcgtcgcgtgcgcggcgaggaggaggaggaggaggagaaagatctgtctggctgtgcgagggagaggatgggattacgtgggtggagcggggcgggggtgtggtgggtggatcctccacgtcgcctcagcttggtctgtgtgtactgtatcaacggccaaccggcaaccggtgaagccgtcaatactcaagacagagaccccaacgtgtctgcctctgtgcgcgccaatgcctggaggctgcccgccactgttcgtgtgcttgcagcttccccggccgtctctcaccggggaggcgtccaaatataatccttttagccactaaaatttatcgtaagagataataatttttcgcctatattttagttttaatcaattgtaacattttacaatttaaagttttttacatgcatccttttcttaaccaataacagcattcctccatttaattctaccaacctttttattatactcgtgtccaacactccgtactagctaaagtgcacctgtatttttgtaaaacacttttattagaaaattatgatgctcgtactatcatgccatgtttagaaaatgggtttggatatgatttcccacccctcaaagggcatgtttgaatcttcatccattcttctcaccccgttttatcctatacctccattcgtttttattttccaaacacaccatcagtgttttcttgcttgatgttccttactgacttctttggttccgaccttaggaggtatatttggatagcttttagatcatgagaaattgtgggtggaaatttgaccggagagaatctgaagaataaacttcttgtttttctcgattatacaactataacttctcacaatctagataaaaaagtagaattgtctacaagagcttccctcggaatcaaaagcaccctatacaggacttgtttttttactttctttccttcgttcaccggtacaaggcaaggcgaaggtttcttatgttaatatttcgcatatgtccctttgtttctaaatataaatatttttaggttgtttagaataaaagaaactttttatccttcattgtcttattggtcaaaacttgaaatttaatgttgagttaattgcggtttggactggatttctttatcaaagttgcataatggactaggtctcatctcatattttcactttaaaccagatggacttacaaattgttgcaatttggacctgattgatgcatgagccacttgatgagctcttctccatgtcctcaaactgaaacatggttgcacgaaggaaggatggagctaggcttgctcatcgtcaaccataaaccgtcgagatggccgcctcaaatcgacgcaagcgcagatccgctcaagcttaggggctatgtggtgcaggagcaatttgacgagatgcgaacaatgcgacggagggtggcacttcaaagtgctctgttagttattgcatgtttgagctttcacatcagcctagcgagctcaaggagagagagagcgcaagggaagagagggaaagatggagaagaagcaaagtgtcccaaagtgaaactatatgtaatctttcccggttcaaactaaaaatgttgtgctgctcctattccaacttgccacatgggtaaaaagaagtggccctatatgcaatttactcttttaagttgcttgattcttctcgtaagcacatgacttgggattctataacatatctcacacttcccttctaatccacctacctctttccatctcaaaactctcctcccctctcactctctccagctaagcttagctttccactttgagcgaccattatcacctctctcatttcactcggccatctatcaatcacactatcttacctcaacttcctcgccctttcttcttctcgttgaaatgcatgtaagctaatgaaaaatgtcctcatgccatcgccagttgaatgatatgctttctccattctaactccattctaaaataagtgggtttatttttatcctcttgtcatttgttcaaaaacaagttaatttctatctttggtccataaatcaatgaatttcattacttcaatactccttaactacccacccatatactttggtctttttctgttaacaagatgcactttattccctctctctccacgttattttgtacacccaaggttaaagttaagagttattttaggatatatggggtatgtaccaacattgtacggcacgcttgtttcaccagtgtctactgttgaccatggattacataacaattgctaaccagaatggcacacatatacaacattttactcgtcttgcgttgtgcagctaccaactagtaccaaattggatttgtccttgccactttttctgaaagtaaaatgtaaacctcaacgtaacatgtcacattgccaatttggcaatttccatagttcacgtaactggggctaatggtaatggtgctatgtgctgcaacaaacttacaaccacatgcatcagtgcatggcctcaaacaccattcagcagttctacatctaacaaggcacatctcaagtgaaaacaatataatgatagagaaatgtatcccctgcgactgataaatccaaaaccggcataacatcagcagcatatcagtttagcaactcatggttcctgaggctaataccatgtttacatgtaagataagttacactgggtatatagctccaaaaactagctctggtagcgctctatcagtccagtgtaaggctgtaaaccaacaggttaattggttttgctacctagtgatgattgctcaaagaacagccatgaggattggctaacaaataacataccacctcatcagaccttcatatatgttcctctgaaaacaaaaccctgtcatcgagtagctagctcagttcccccacctgcggacaagctgtcctcttggctacttagttatccttccatttgttgacatacttcaggaatgacatggatgggttatcccttggttgagcccggacacgtgtggaacggcgcaatacagcctcttcaagcaacaatttgtgtgtgatttcttttgatcgtttctccagagcattactgtgttacagaacaggaaatgattagttgaaaattgattggtgtagtaggaatcaaccaatatatttctaactacttatgatacgaataataaaatatagcaatggtaaacatcatagaattatacatgatagcagaaacaaataaaagtttcgatggtagtcttcttccagaatcaactagcaggtaatttataagagaactcttcaagtatcatcgatgagatgcagtaattattgagtaagaggacagcaaaaccagtatacacagtattcattttgcagaaaaatagtatgtgaagctacaaacaaaaatattatttttcacgttaagaacaagtgtaacgttagcccctttctacaatcaacagaaccaaaagttctaagttgaccaattgtaaggttcagaaagatctatgtaccttatcttactgtacaacttgtccagctgccgtttgagagctctctcccttaaaccttttacgttcagtgagctcattaacacatcgagctgtcattccaaaatatcaaaatatgatcacgactgtagcaacaataaataacaaaaagaaatcaactagagcaaaacagtcacctcttccttagtgctgtagtatccccattcttttgaatctgcactttcaacaaaaagccttccttcacgcctgaaaaaccaatacctgttatagtgtctgtcttttccaagggggctggaacggatggataatttttcaatctctgtttcgaggtgctgtacctacaaaaagtagggagtaagcataataatcaggctcactaccaattgtggtaaacaataacagaacatgggttaaatacagagaaaggtccatcacatgcaagtacatggattgagaacagatgctcaccccatggcgtttcccttctgtcttgcttcgagagatattgttcttatccttttcttctttccccttaccctgctcatcaacactctcattgtcatcttgcaatccatcaatgcttgagttctgctcatcctttgcctttctagtactctctcttttagtcgcagcgagcgcttgccgctggtccacccgttcacttagtttctctcttacaggagaagttgtaatagcttcttctactagttcccggagaatcttaagtttgatatcagtatcaataagactataataaccctttcttactgttgcaatgtttctggtgagttcttcagtttttgtcatttccaagaaatcacagagatattcagcccatgttactaaagtcacctgataaggaaataaaaaagggattaagaaacggtttcatcaatggagaaagagggagatcgagaaatgggcatgagaaaacctttagcttccgtttcttggtccgcagaatagtgaaatagtcaccttcatccttaataagcaagtggaatatagctgtatgtatttccacaagaagtgcattgctttctttgtggcaaattgcattctccaaatctaccagtgaaaatggggatagattcagaaccctcccgaaggacaagcagaagtcccataccataaggagatcgcccacagaatattttggtactctaaaatctgtagccagaggaggtctcttcaataaagcatgatcatctgcagaaggttgtactaagagatcatctattgggtacttaattggaacatttatgtgttcctcatctgcaaatcataccaaaaaaaaatcgataagtatcttggaagaatgccatagccaaaaggctgctaacagaacaattgcaacaaaggtgccagattcagatgaatcaccgttcttcatcttttttttgggatctcccataggtccatcctcacgtcttttcctccctttcttttgcaaaccttcaccaaactagacaaagaaagcaagtgttagtattgtaacatacccaaggaaataaaggacagatgaaaggggcacataaccaactcaccatcatgtcattcgggggctcaatgggtatgccatatcttttggcaagattttcatgtataacccatggggcattttgagaagttgcatctctaataaaaatcttcagcgtattcctactaacaggtggcctccggtgaatcaagtcttcacctttgatcactgacgtactgatgatagtcttgtccctaagaagccaaccaacttcatacatcttggtgccatcagaccctaaaatcttcaaaatcctgcaagcagcctctaaaccatcctgtttagcatataattctaatccttcaaatacagcttcctgcaggctagcatatatcttctcaacaagctcatataatccaagagtgcctgaaacaaaaggtaaaatgaagtattatttccaatctaattaagtgaaacgtacaaatgagaagcaatctatgatgcttcttgaatgaagcgcatatagtaggaaaaaggtacatggatactttagaattgcaaagcataacagtaagcatgcatgcctatttattacaggttgtcatgtcagcagcttagcagtccaagcagagaattcagagctataccttaatatcagtaaacatcaaaaccagatcactaatgcaaaagatacttagattagaaagaggttggtatactgtactctcttctagatattgttttagaacacatgcaataaaactattggaatattgataaagaaggtaagattgtcacactagaaataattactgatcattacaagttttactaacatataattagataagttatgatagtggaaattatgtcgctgaaactaataagtagaaaagaacggtaaaggatatacaaaagttcaaacaattaaaagaccaacagtttcacatgccctttttttaaaaaaagcaaattgagtattagtatgtctagtagctttgtctacagggaaaaaatgtaagaactgagaaatgttagaataacaaagaagaaaacaactgtaaccaatatactatcaagatccaggagcacaacggaatttcataaatattacatactgtattgaatcatccgaagaacaggagccatcagttctgtgggtaatttctgagcctttgacactgcatgatgctcggagaccaaagcttcttcaaaagtcaagtttgattttccggatatcttacatgaccaaaccctttgccgataaagattcaacctgtttatgtagtctctaattgagttgttaaggacacaagcattggagaaatattagtgcacatactgcactgcaaatgcaaaaggcatgaattcctgcaatgccacaattcagctgcattggcgtcatgaaagaggatactggtaatctcggaatatctcccttgtgaaccgaatttggaaaaccttctccttagaatccaagtccttggggggctcaagtaaggagaaaggtttcctcttgaaaagaggcattggacctccgatccaacctacataatagcaacgcacacggtttacatttaaatagttaaagagttaaccatgtgaactggataaagaatctataatactgccaagaacaattaggcaacagtgcatgaatatttagatgatcacgccacattttgcgaggcagagaggggaaaagaccagtctcaagccgcgcagatatgcaaaatgtgatgtaccaatcatccaagcaggaaattcagaacccagaacaacagattagcccattcgaatccaaccggccaatttccgatgtgcgaatcagcaaccatagcatttcacttaaatacatgatgagtcgcacaagctcaggctgctctttctctcacgcatttgcccccaaaatgtgcaacgcaaagcattcctgaccactcagctcacgaaaatggacccccgtgctccagaatccagcattcggaaatcctcgcatcgctcaaaatccccccattctctcaccccccccccccaccacaagaaatcccctcacccaagccgccttcagaatccagacaacaatcccctcgccggcgcccaccactgtgaaacctcccgctcccgtcctggcatcgctcgagggtggcgtgaacccgaccacctgaccccgcgtttgaaccaaccacgaacccccccaaccacagtttggtcgaggaaaccaaaacaacaggaaaaactagggcttcccgatctcaccgacgacaggtcatgcagggcgggggcacaacgccacactgtaccgtaccgcaccggaacaagcgtgggggtccccgggaagccctccaagcgcccccggcgccgccgaagacaaccgatctgccccggttgccccaagcgtttgg

SEQ ID NO: 83241 - DNA, 27124 bp, Oryza sativa
tttaatttgctttcaggaactactaacccactagcttacatctcggccgctgagccccttaacgggaacaactatggctcatgccgagagaagatagagatagcacttgcgctgacatagctctcaccgagcctcgccccactgagcttgttactccagtgagggcagaaggtgagagtgaaggtgactttaaacagaggatgctagaccatgcggcaataagattgaagtatgatgttgatcgtgcgaagtgggagtcatcaaaccgcaagtgcttgatggtgattaagagctccattgtggaggcaataaggggagcaatcccagcttgtaccacccactgagtaccttcagagagtggagaatcaatttactggttcttcaaaggcctatgccagcaccctcattaagagcttagtaaccatgaagtacactggcagaggggttagagagcacattttgaagatgagtgatatcacttcaaagctcaagaagatggacttggtgctccctgataagtttctagttcaccttatttttgcctccttgccttcagattttgaggcttttgttgtcaactacaactcacagccagaaaactgggacattgagaagctcattgccatatgtgtgcaagaagaggatagacccaaggctcgtggtgattccgccaactatgtgaagcacaacaagaagaggaacaactacaaccagaatgttgcctctcctaaggcacaaggaaaggcaccacaaagtgatccacatccacgaccaagcaatgtagaagtggacaaggacacttgcaagtggtgcaagaagaaggggcactattagaaagattgccctgatttcctaaagcatctcataaagaaaggtgaggacattattacatttgaagatgaatcactgtacataagttatttaaaatccacttggtgggttgattcaggtgcgatcattcatgttgcaaattcattacagcgattccatatgaggaggatgctaacaagaggagaaagatgcattagagtggcaaatggagtcgaggctgaagttgaagcaattggagaacatccattagaattgaataatagcttcacacttcatttgcacaatgttctctatgtaccctttttgagtagaaatttggtttatgtttcatgtttagcggatgatggatataattgctttttcgatcaacaattatgttcaattatattcaagaataagtgtgtgggtcttgccatataacaaggccagctttatatgttgcctaaacatgagaatgagaatgttgtatgcaatggagagaatgttgcgtgcaatagtatgtcttccccgtctacgaatgtaagaaataagcgcaaacgatgcaatgacgaaacatctgcgaaattgtggcactgtcatttaggccacatttcgaaggggataattgaacgattaattaaagaagaaattttgtatccgttagactttatggattccgaatattgcatcgattgtattaaaggaaagtatgttaaacaaataaagaaaggagccatacgaagtctaggatccatggcttacgggaaagcctatgatccttggcttaaaagggcctagtgtttatttcgaaatagggaggtattgtagttgttgcgtctgatggctcagtggtgactgtcatgatgaagcgtgctctatacatcaatctatttagaagtgaatattgagtatgagaagtaagaaaggcggagatcaaaggggagaatgttagttgcaatctcctggggaatcaggaaaccgattccccactccgcactcacacgccctgatctggggcgccagccgtacgatggctgtggtccctctcacgcagtgccaaataaaaaggggggagtggccggcacactaaaagaaacgtttgacggcgcacacgcactccccacaaaaccctagaaccctccgatccgggaaggcgttgaagtggggggattcctcacagccgcaccaccaccaccgccatcgtccacaccgacgccgccacaccgtcgccatggccgcatcaagctcaaagaccgacgccggtatgtctctctctctccccttccccgttcactccctaagtcaatcatctttatctccatgaggtagttcaacccctagatccgcaccgaatgatattagaatcctaacaacagttgcccattacggtgtgcacagtcaagttatctagcttacgccttgacattatggacctgtactttccactggaagggctgtaacagtgcttcctaatgtgcttgagggcaatgcatcaactacctgagtgtttaaagttaattagctgcaacaatcattggccattgtcctcttgttgcgaagaaatttggtggtttggcctctttatcgtggaatcgtgtgctgcaacaagaaccatgaatactggcaaccacttgaaatgatggacaataaaatcgattgcagagatggagtatcaatggcaccatcaagaaccatccacacaattggcagcctatatgcacctcatggcatagggtccttgagcagcaatcagcaagaatccagtaaaaacaattaggagttgaggacaaggaaacacaggccccgcatgagcaggggccattgccagagcctctgaactggtatttctttgttaaggacagccatattgctgcttactccatggtatatgtggtgttatatcaagtccgatactggttactgatcacgaatttttgaaacctaagttcaagataaacctctacacctcccatttccaaatctgaatgtatttggctatttgcaattccgttatagctggtgctacagggcaatactgtcatgttgggaagagatcatggtgttgcaaagatttggccacgccactcgcaatgatgtggagcatggcagcacacgattgccatgccaccttgtgtggtgtaggaagaaggttcatttagaaaaggatacccccgtaactttattttagaaaaatgatttcaaaaggtatagaaataatttcttacaataaaagaagggcaagaacacattggcatgaaaataaaaaggttacatgtgaaagagaactcaccgccataggtaaattttgatagcagttcagcttcagttgccctcttcaaaggataaatgaaaccaatcaaatttatatcaataacgattacttatagggtcagaaaaacaagcaacactatggaactatgaccttgccctcataacatggaaaaacttaccttgccctcataataaccttgcaacaagtagttcacaaaaccaaagtccgctgctgacacatacacaaatctcttaatacctgcaggtagagcatgatgtggaagcagttaagtcccaaccaaaaataatgtgcatcagcatagacttaattttactttgccatatcatatgaaataattgatcaaaaatgaaagatttggagtgattcctgccttcggcctaagcaagcaccgggcagtatatgcaactctagtgactagatgtcatgcatcgtcactgtccaagcagtccaagctacagtacatggctgaatggtacctctccactttttgtgtacgacagacaagcccaatatgcaaggaagtaaagtgcatgtttctagataattattcttccagagataactttgtgaagtactagtaagaaattgtatttatttatttttttggaaattatgacacaagagttagtattctgacatttacccttttgctttaattgatctgatcataagaactacacactatactgactaaaggagattacaaactagtggggagaatcatatcaatacatgtgaaaaagagcatattgatgaattgacagaaactgcaaacataacatagaaaatgaatatggtgctgcaacaatatgttctcaaacataaatacctttctcagctgcaacactgatggcattgatgtttgcagttccattaattttgtacatgtaagaatttgagccaaagcctccaacacatgatacctatagcaatttctctcatatgagtaatgtttcaagattcataaattcatgttagcataaagcagttactacttatatgttataccttattagagtatcggtgcataataaatttaaaaggtatcaacggtgttccagggatgatgataaaaggtttaacacgaagtggaaatatttccatcatactaattaatccagtgctcatagaacctagatagtatgacccaataatccaaaattatctgcaggcaagggaagtggcagggatggatttgaaaacctaagtgataacaatttaaaaagatggcctgtaaaaaaccatttccacctagatcaaccaagagttatgagcaatttgagccaagggagtgcaacggatggagcttggaaactaaatgatattaattgagaaggatggattttagaaactaaaagatattaacctacaagactgtacagatccaccagatactcattggtgccgacatgtatggagtaaaggcatcagatacctcttggtagtttcaagtctagtagtctaatgaatggtacctttaattagatttccatgacaataacagcagaaaacagtcataataatgcgcatacaaaataacaaaaaccctaaccccaacccaatcactaataaggatttgaacaaagaaggtagcaataagttagtatttgatgcttgaggtgcccaatatatcatttcagaatcatatattaacttagtacaatatcctgcagttgtttcggcatcatgtaaagaccagacaagtgagtctgtttcaactttcaagagacttgccaaagatccaggaaagtacaagggtaaaaaaaaaaaaaaaagaggaaagcataaatgcaagaatgcagttttcagtacaaaaatgtgcaccaagttaacaaattcgaaaataaaagtgtaaacataccacagcagaaacaccttccataatatccttcagggaatcaggttcaagtagattgcctgcccaataaaagagacattaagcaacataatcatttataagcacaataaatttatctcactagcaaataacctttgttccatataactttgtcagcccaagattcacttattgatggctttccagatctgttaaagtcaaaaatcaagagaatggtaagtcattgattgaaaataaagattgatgattttgaagtatataaagtctgatatttgtttgtctgataatacatcagatgtgtcaataaggaaattatgaattcaataaagcttcaattatctaaaaataataaaaatttaggaaattcaatgcaagactacagctactgaacagcaataagtacattcataaattacatgagtattgctctcagaatacaccattgacacccccttgaaaacactcacagaagaataagatgaaaaagaaaagatcaaactaactctgattatatttttacattgttaacaaacttctagaatcgaaatctaatatgagtagaaacagcttcacacagttctgttcagtgaccacaatagaggaacaaaaggagaatgagagtctcccatgaattttttctaaagctaaaggcatcaacacaaacttaagagaaccatataaagttatctacagttagattagaggattcagagtatccattgctcttccatatcagatatcagggcaaaaacgtgtttaagtttcaatagacatacagcctctgtagcaatagtttatttatgattttggctagttacaaaaaaaaataaaaaaatatatctcaaaatcaaacagtctgacaacaaaatgagaatgaacatgtcaacagatacagcttacagaaatacctattaagactagcaacagtaaatcctttgtccaaagcctccttgcaaacatgtgaaccaacaaaaccatttccacctagcacaagaagctatgtcgacatatatgtcagtagcaattcagtaatcttcaccaaatggaaagcataaagaataactccatagaaaaatgtacataatttatctaaaagctcgaataacacgtagttagctgttaatattaaacaatacatttccaaaaatatattaattgctgttaaacctgcaggaacaccattcaaaacagaatacttgttataatatttttatcggtctgtaatatattgctcaggataatgaagataagaaaacattggaaataggctaagcacttgtctacatgaatattttagttatatatgacctttctgttggaaatgaagaattgctttcccttgaagataagcacactatagagatttaaatatcataaagcaggatgtatccgtgacatattcagggaaatattttgggaaatgcttaatgcaaaaacacaatatgctgcacaaagggaaaaaagaggtttccatatcaaatcaatctgaagatctggtaaaataacattgtcggtgtagtgaacttacagggcttatgtagataacatttcaagtctaactgtttcaacattgagagcaatgacaatgaaatagttccgataaaacagcacaaaagaaaggcgagatgaaagaaaagggaatatgttagcattcgaatcaaactagcacgtttatgtttcctctaatgcattttcagttcgaaggactacatcgagattatcgaattcattttgcaacttttcagttacgtaactgatggctgcactggatatctccccaacagccaacatgtccattctatgacaataatctacatcagatacaaccgcataaaccaaaattcatcccgctgatagtttaaaatgaatacactaggtcactagcccactatgatagattgctcattcagaaaaaaaaaaaagaaagggaacaatgcaccttataatatatgggtaagaaaaggataaaacgactgctaccaagaatgactgccaaacaagctaaacacaagaaaaagtcttaaactagtgcattttacgcaaactagtaataatcacattaattataattaccttgtccggggaaggcggtggcaccttcacggtttctgcttcctccaccttgaaaggctcctccacacgcttggaagcatcctcgctcaagaaagccttcccattattgttctttaacaagtttgcggcgctgttggcatcatcggtcacacaaggtagaacagaacaccactaatttagcatcataataaaatccacaataatcataacaaaatccccctattgtggtggataagccaacgaggaggtaaatgcggctcctaattccccatcctaacgaagcacgcgcacctttgcacgccatctcatctcatctcatctgaatttaagggtttattgtttatctcttcccaaaaacttgggggatgtttcgacggcgggcgcgcgcggggaggggctcacctgagacgggagggcgagactacgggggacgaggaacggatcaggcgggtcatggccgacctcatcgccgccgacgatgccgccgccgccgccgtactactcctttcctcgcgatctatcgagagcggaagcaaagaatacgcacgcgacgcgaatggtctttttttcctcttgcgagtttgtttgtaggcgagaaaaaggtgaaaagcggtggcagatggcaccgctacgtgttaaggctggcaggctgccacgtgatagggttggcaatggggcgggccgggtgcggccctggccctggccccgcttttctacgggctcgctcggccctagtccagcacaaagaacaatctcgcaccggccctagcccccgcaggactcgtcaccggatcggggcctcacacgaggtgactcttgtctccgagaatgtgaacggcgactagcgctcccgacgtgggtggtggcatgggaatagcgactagcgccaatggcacgattggagaagaggatggtaggtggtgcatcgttgtagcagacagttgaggaatcgccaaagctacagcgacaataacaatgtggattggatggagtcgtaggagcggttaagcggagagacatgatgagaacatattgtgtgtttctcaatgcatcttcctctattaggtttattgaacagtttttagaaagaaaaaatctcaattctcctctcacctctatttatctatgaaaatcatatgtggcacctattctcattcttatgccattatttatgctcttacttatctcaattgaaacatgactatatgggaaggcatatatggttcacatgcatacaaacaaaacgaataccttatcccctctcccacatgttcccctcgctcccatggcatcacagcaccactacccttatagtgcctttgcttaatgccacaagtaaaaaccacgcccttatctattttcctcctccaacgagctctccactcctactctgttcctattttcccaggagtagatggtacgtacaatggtgaggcaaggtgggcttggttgaggtcacgagtgaggcgatgattaggctggtggcgacaactccaatgtgcatgaggggccttcttcatcctccctgacaaggcaacgcgtggccaaaatctcatttttcttcctcccctaattatgtgtcgggccactagtgagtggtggttagaagtttatgatttgaaatagaaaggttcacatatccggttggaaaaaaaaatctatttttgagcaaacaattccaaagattgttgaaagttaatgattttgaatagaaagttttggcgttttttagttcatttgaaatttcatgtgcacaactttctatattgacaagttctttttatgtataaagcttatagactgaaagttcatatgtacaaaaaaagtttataaatcaaaagttcctcaatgtattacatttatacattggaagtttatgtaaagtttatagattgaaaacctctggattgaactcgaacatccatctattccatgcataaataaataccaggaaaggtgtttaggtgcgtcaaaaagagaggacaaccaattggcactccgagcacatgtgactgaacgttcactcattagggtttttgatagctccaagcttccactaacaagcgaaataggttttttgccacttatttgcaaggcggaagtaaatggcttcgctctataattaagtggggtattatccttatatatttttgtattttttaaacgtggtctatttatataaaaaagatgaaaaggataactacaatagaagacaaaaaaatactttagtagtaaacatttctagaactaaatacataggagaaaatggttgtatgttaataccagaaccattatgtgggaacaaaattttcttactgctttgaaaccgagaacttcgtataaaccacaatattaaccacaatattaagtaccacaattgatggggtcgccgaacaactttggcgtcagaatcttcacgcacactaagggggtgtttagattcataggtgtaaaattttggcgtgttacatcgtatatactgacacatatttgaaatattaaacgtaaactaatcacaaaacaaattacatattccgcctgtaaactattagatgaagttattaaacataattaatccgtcattagcaaatatttaatatagcatcacattgtcaaatcatagagcaattagacttaaaaaattcgtcttgcaaattagtcacaatctatacaattaattattttttaaaacttatatttaatattccatacatgtgtccaaacattcgacgtgagggtgaaaaattttatcaggtgatcagccctaatagaaaggccagcaatgaatggattttgtgctacactcggtacgacttcgaatatttctatgtaaattatcctttccaattcctattatttggcatgaacgtctccaagattactctttctaccattttatttcgtgtctaaccggagtgttttgtcgaatagtttgcaagaattgaggaatgtgcctctgtttgaaagcgtcggaaatgggtgtgtgcgcaggaaatcagttcagacatttgtcatccaggcttatcaagccttccctggctgcttcgatcaattcattcagccaattcgtcagaattgtcacccagcctcttactaaaattcctgcaaaatactgaactcatactacaaattcaggtcctaacattcaggtattatgctaaattcatactaaaattcagttaaaggatgtgtttagttcctaaaagaagttgaaagtttgaaaaaaattgggagtttggaaaaaaaaagttgaaaattcatgtgtaggaaagtttttttatgtgatatgatgtgatgaaaagttaagaatagtgggatactaaacatggcctaagttctaaatactagtaaaattaaatccaggagaggtcctagtccacatgttaaatccaggagaggtcctagttcacacgcaggttcttcacgttgataggaatcatttggcaaagtagccaggtatgaggtatcccccgaatctgctttaggcgatgactgcttttggcaatgacaactgttctgtaattgtttggcaatgacaactattctgtaattattcattaaagttcgcaattatttcacaggttgtatttagcagttttataccatgcaccagaaaaggataaattcagacattacacgcagctaccggactgaaacgaaaccaaaaagaaactgttttagaatggaggatttgtgggacaaagaaccatcagcggcaattagatttgacctcaaggaaatattcagtccgcatcatggttggatcgccaaatggcaaacccacatcatttggttcttcccattatttttatccacaatgcacaaaacagaaaatgcaggagaacaggaaaacaatcgtccctgctcatccaagaacaagagaacaagaaacagaaaaggcagcaattttgtttcttcaggtgaatgagatgaacaggctcagattgataatgggtagtaagtctgcttgtcagcaagaacaggagagagatctctcccgagttcagagtggtgcatgactagttcctcatcatcgccatctcgaatctcgatccaagaaaaacaacatccacaaattgaaaggaaaagaaaaacagccaagcaggatgaatcgaaaaccccccaagaacccaaaaccagacgagacgcgagatcgaatcaaaccgcaggaagcgtaagaacgagagggatcctcggatccacgaagcggaggagggagagggggagagattcgtcgcggcggcggaggcatcgcaggaggggttcgactatttatgggcaaatcctcctctagctagggtttccttctcctaattcggaccgacgagaggctgacaggcctggcccaacaacccgagcctttctcagctagctttgcccggcccggttgcaggagatgggccgagctatacaaatggcccatgtgccaagcccatctagcccatgattcccttttattattatttttttttgaaaaaagagggagcccacgccaaccatgtgggactgacacgtgagcctagctactcgttaagagaatttaggcggtcttcggcaccatttttcccaacctccaggcgtgtacgtttttcaaacggcaaaatagtgtgttttttgcaaaaaaaaaaaaaacttctatacgaaagttactttaaaaaaattaaattaatccatttcaaaaaaatagctaatacttaattaattacgcattaatagactgttccgttttccatgattaccggttgggaaccagcatgcccgaacacagccttaagccggtttggacgcatatgcccttctcctcccttcttccttcagcattgcgtgagtttctttgtttttttgaaagctatttatataataggctttttgtttgatcttttcttttcctcctaggtcaaggtgttctagttcttatccaattaattatttattgtgtttaatttcaaagtaatatattaggccaacacacattagatgatgacgctaacgtatacgtcgtacttgtagtgttggttataaatatttttttctcctaccttcttactaagaacaactttgggtttgttcgggggtccagtctgcggcaacgctgtgactgggttgtagcagtaaaagacaaaaaaaaaagttcatgctggttttctgctgcagcccgcccagccgcaaggtagccgaacggagccttttgcatccaaagctatgggttttttttgtgccatttaaaggccatcatcggtcatattactatatacctccaatcacttgccataagatgccaattgatgaagtgaaagagagaagtgaggagagagagaagaatgcacccattatgaagggacaagatctatataaactctaatataattatgagagtattagagttatttggatttatatgttagagataactatttatgtgttgttgtctcttagtctataagtagatgagataaataaaattagatgtagtagtcatggtaacatggtgttcatctatatatgatcttcgatatggtataaaagtttgagtactcatacactatggattttcattgttgttaatataaattatatatttatgtataaataactatgaaaataaaaggtttatatataggtaccacacaaaatggaggttttcatataggttttgataatgcctccattttgcatgagaaataaatgttagataaaatagattatcccttatttatcaaattccaatgcaattatttcttattttatctactctcaatgcatttattttctactctcacaaacttcaatttaataactacttaaaaataaacttattttgggagaaactggataagctaaaaatgaactcgtttcaggaaggagggagtatatttttagcatcacatttttttaatttctttttacgttgtaaattgtaagtagttatattgtaattacaccatacttactacaaattttaataggtgtaattctttaattactttgttatatgagatatggaactaaaaaataattataattgtgtagtagtatcagtatcctaagattgggtttttttttaatacggagggagtagttatactatctatgcagattaacaaataaagtaaaaaaacaaaagcaaaaacaggagagagaggccaaggcgcccggcccgtgcacacgatgttcaatcaagggcatttgaaccgttaagatctgactagtcccaaaatgtagcgacacctttttagcaaatccatttgatcaaatagactaatttaaagctgatgacatcaattattgttttcacacagagctaacgctgacgatgagaacgcgtccattgaatcttttcagtttctcgacgtcctttctcttaggaaaaatccggcaagcagttacgggttgacccctacagttattagtacaaaatgagactaaagatcattttctacatggagcttattctaaatttccaatctaggcgacaatagaccaacatcagttacccttaggcaggaagatagagctagtactccctccgtttctaaatatttgacgccgttaacttttttaaatatgtttgatcattcgttttatttaaaaaaattaagttattattaattcttttcctatcatttgattcattgttaaacatatttatatgtatacatatagttttacatatttcacagaagtttttgaataaaacgaacggtcaaatatttagaaacggatggagtagctttttatcctcctgaaaagcttacaaagacattgcagccaacaatccaacataagctgaagtttcaccaaacagggttctacttttcctttggaacggaggaattttgttggagaaattttgaagaaaacgaattacttgaaaaatccaataaaattccatgtgtgaaatgtattcattggcatagtgataggtgcatgtgtgcgattttaaccccaagatccccgtgttcagctcttaacacgctcacactgtattcttaattattcgacaccaaaattctccttggttaccaaacgttctcagttgctgtgatataaaatccacatgtgtttgcccttaattgattctccagtagcgtgtttggaactgggaaataacaacatgtgttcccttggttagatggatatcactgtcttggccagattctgacgtcttgttcttggttagttaggaccatccactgatccgtggtgacaaattgacaaactgaccacttctcacgtcaagaaacccccttccttttacttctacgtgtcgctgcaggcaagagatttcagagtaagcagcagcacgcgcgtcagagaaggagaagaggacaggtcaaaggaaagggagcagttgggaacagatgcatgcagaaaaacctgagctatctcttgatttcctgcaccctcaggtaagcaaaagcaaagcgaagcaaaggagttttgaactctttttttttttttgcctacctccatctggaagcaaagtaagacctgttccgttaatcaacatcatgcatgcccacaaaatataatcttttcatgttcatactcaccatacacatacacaacattgtctttctttggccttaaaaaaaattaacatatgccaattgatggtggctatactgttatagtagtgttttttttttttttggataatggaattcaatccggtctctgcatcgaagatgtacacggccacataatagagcaataactctggatagttggtgtttcagagatttccatggaatagtattcttcatgcttcacctaaaacattggatggctcactttggttgcaggtaaccttcaaactattaggcctactggttgaatcgtagtcaaatcaagattcctcctctcttttcttttcttttcttttttctgtcctggtttttgtgtgctgtgctgtgttgtgtctgccttttcaccacattcacttactcgcttatgtagtaaccttctttgtaagcttcattttagcagtttacctaaagcaatttcagattcagtcatcccttgggtgcaaaggcactgcacattttttttgcttcaggtccaaccaaactcttcccagttgatcagttgggtttggtgaacgtcagagcttctcctgcttgtgtatatggtagccaatctacattggaagtacaggaaaagaacctctgtttcttttagttttcttttctgttcatgtctactcttccattcacctgtaccaagaaaatgtcccttgttgatcatacattactgaattatcatccagaatgattgagtagaagtagtatgtagtacagttctgcttgttcttcagttgtgtacatctctgtcagagttgcacaccaactctgtctttgcatataacataagtaaggtcacacctgaagcaaaaggaatgttaagagagtgagtgagatgaaatgaaaacacgcatgcgaccaaaggaagacaaatggaaacaactgaacaacccttattcagacaggactgtgtcttaggtttgtagtaggatttttgggactgattgctccctacatatgcactcacctttttgcaggccaaggattaatatcctgtgaattaaattaatgtgattggttgcgtgcatcttagttatgtagaggttgagaaacgctcaggggtcttccggctagctccacaaggtggtgggctagccggcctaggttcgaagccttacccccttctatttatttgatactagatccttccctaatacctgtgttttcttttttagttatgtagaggttaagagtgttcttagtacggttgtatcaccttgatgtaaattggctaagttcaataaagcttccttatcttaaaaaacaataaattaatgtgatctgttccaaaaactagtgacaaggaccaggtctccaacagttcctgcaggaacttgtcaaacaaggggttgttcttctggtcacagctctcctgccaaatctataagttgctctctctctttgcctaggtttggagctctcatcatcttttgctgtcaagccatgcattccattgcctcctgagaacctccttgataaacatctcatctttctttgtacataaaccctctctgcaagtgtgttgtctcccttgcttcttgctgttcagctgttctatctctcaaaaacagttcaaattttcgactcgatatcgagctaccagagttgatataggaggaagataggaagatttatcaatcttcagagtttacggaaagtggaggtttatcagcaaagttcttcagagagctgggccacctgaagaagggtgattacatactaggattcaatttggagtagtgttttttttttgcataaaaggatgagaggttttgcttgtgctcatcatgcagagaagaggcaccgtcttgacagaactctgtgagtcttttcttccctccagtagttatagcaaacttgcttcctctgcatatttttgctaaatatttagcaaacacagctaaaatctagataaacctggctaaaatttacatatttagaatctcaggttcccagtgaaaacttaatgttatcttcacccgagcatcatgcataacggcgccaatgattccttgagcaccgaacattttgaattccatccatgcatctatccagtatttaatcttgtccatgtaaacttgttttacatcgttgcatattcatcatcgacaatgatacgcttggtgataaatactatgcatgatcttaagtttacctgctatcaagttttaatcctgtttaaatacggttcttagcgtgttttcgtggtcatgttcctgagcccatggaaaaggttacatgaccacgtatgttagcaatgcaaaatggtcgttttgaagtcaatatttgcgagtatttttataacatagagtagttattaactaccaacaaaattgcagttttttccaatcacagtacaaaagtacgtcatcctggtgactttagcagagaaaaattactccctgaagtagttttttttttccaccaatagaaaccagaagtgatgtgcccaacaaaccaatttgaattaatcctcctaatttcgtgtgctctgaaccaagagagcccaattctccaaagtttggcgagctctgctaatcaaaattcctacctttaggtgagctaacagtccaataaaagattaatttatagtaaatcacgtcgtaggaagttacatatatagctagcaacctgcagtttcaccaactccgtttgcaacttctgaagaagaaaaagtcacaatggcgtcacgagttctgaagaagtctctcttcaatctgcatgccaaattgccaatttggatggaagaaaagaaaactgtgttctgaaattaacagaatggtgaaaacaaataggttcatgtaagaatagagtcaaaggtagaaaaaaagaaaaataataaggaacaaagctattagggattaaagcgataatgaagagggaattggcacgatgatggagacgatgactagttgtagatgtaagcctggaccgttgaagcatggaactgactgttcttgatgacttcttacaagaggagatgaagaaagagagccattcctttaaaaaaaacaagaagaaagaaagaaagctatgacacatatgactttctggtcttggtctgaaagtaatagaggagatgttatgaaattggtcgtttgaagaaaagtagaaaatgaccaaatgcagaaatagtgattgctgatcacatattggtaaaagccaaagaaaacttaacacctaagttttttttaaaaaaaaccaacaccttagtaaagactgacaagtaattttagttacaggtaatgatttggtcacaaggggcaatcttgttcagttcaaccatatgatttgtgacctttgttagaacttttgaagccctcaactgcacatgctatcgttttctacatatggtctaaatagttatgcaatattctgaagaaaatcgcaaccggattatgaactaattgtgattatttacccgtgttaatttcagcaacagcctgagcaagaggggatacataggaagctaccactacgagaaggatgccaagtacaggccattcagtgcactgctccctgagggttcaaaccccaagatgctctatgtcaagctcgtcctcatcatcctcatgtgtggctccttcgtcagcctcctcaactcgccatctatccatcacaacgatgatcaccacacagagtaagaaaaaaaaaccatacaaaattcatgtttttattcgcaagatttttttaaaaagcaataagttgtaacaaatatttcttttgaaaagataaaggttacgatcattaccacaaagctaccaaattatgtaacataaaatgtagtaccgtttggtgtcttgtaccaggagataccatatttcacaataaaatgtagcacatctttgtatctcctcaaatattataaaattactctttgaaaaaatgattttaatgtcgttgaggaggtagtgaaatgtaccaattttttaagccaagggtcataaaatccgtcttgcagccccattgtttggctgataagaggaaataacgaaacaacacatttgcaaacgaaaaataatttgtgaataaaatttttatatgcgtgttcttaataatctaaaaacaaaggttgaaaaataaactacgatgggaaaaaaatcccaaaatcaactctaaatttaagcataaacgaaaagatgaggccgttgatacgatggtcagtgattaatcctttgcttcgtctgaacttgaaacgcgcaggtcatcagctggagtgccgagagtgagctacgagccggatgataccaggtacgtgtcggacgtgacggtggactggccaaagatctccaaggcgatgcagctggtcgccggagcggaacacggcggcggcgcgagggtggcgctgctcaacttcgacgacggcgaggtgcagcaatggaggacggcgctgccacagacggccgccgcggtggcgcgcctcgagcgcgccgggagcaacgtgacgtgggagcacctgtacccggagtggatcgacgaggaggagttgtaccacgcgccgacgtgccccgacctgccggagccggcggtggacgccgacggcgacggcgaggaggtggccgtgttcgacgtcgtcgcggtgaagctgccgtgccggcgcgggggtggctggtccaagaacgtggcccggctgcacctgcagctcgccgcggcgcgcctcgccgccacgcgcgggcgcggcggcgccgccgcgcacgtgctcgtggtgagcgcgagccggtgcttcccgatcccgaacctgttccggtgcagggacgaggtggcgccgcgcgacggcgacgtgtggctgtaccggccggacgccgacgcgctccgccgggatctcgccctccccgtcggctcctgcaggctcgccatgccgttcagcgcgctggcggcgccgcacgtcgcggcggcgtcggcgccgccgccgcggcgggaggcgtacgcgacgatcctccactcggaggagctgtacgcgtgcggcgcgctagtggcggcgcagagcatccggatggcctccgcctccggggcgccgtcggagccggagcgcgacatggtggcgctcgtggacgagacgatcagcgcgcgccaccgcggcgcgctggaggcggccgggtggaaggtgcgcgcgatccggcgcgtccgcaacccgcgcgcggcggcggacgcgtacaacgagtggaactacagcaagttctggctgtggtcgctgacggagtacgaccgcgtcgtcttcctcgacgccgacctgctggtgcagcgccccatgtcccgctcttcgccatgcccgaggtgagcgcgacggcgaaccacggcacgctgttcaactccggcgtgatggtggtggagccgtgcggctgcacgctccgcctgctcatggaccacatcgccgacatcgactcctacaacggcggcgaccaggggtacctcaacgaggtcttctcgtggtggcaccgcctcccgtcgcacgccaacttcatgaagcacttctgggagggggactccggcgagcggctcgccgccgccaggcgcgccgtgctcgccgcggagcccgccgtggccctcgccgtccacttcgtcgggatgaagccgtggttctgcttccgcgactacgactgcaactggaactcgccgcagctcaggcagttcgccagcgacgaggcgcacgcgcggtggtggcgcgcgcacgacgccatgccggcggcgctccaggggttctgcctgctcgacgagcgccagaaggcgctgctccggtgggacgccgccgaggcgagggcggccaacttctccgacggccactggagggtccccatcgccgaccctcgccggaacatctgcgccaccgccgccggcgacggcgaggcggcggcggcgtgcgtcgagagggagatcgagaacaggcgggtggaagggaatagggtgaccacgtcgtacgccaagctcatcgacaacttctgacgtgggtgcatccggagccgttggattttgagatcggacggtgagatcgaggccgttagggatgggtgacgtgttcaccaatttttggtctctcgtgcattgcattgctatgcaatgcaagcgtgccaccggggatgttgcgtggtagcgtatggccgaaatttctttattacaatgatgagaaaagtagctgtgaataatttaggtatttgctttcgtaaaatacttagaatttttttgaagagtctatgttttccaaccgtaacattgcaaatatgtcatgtttgctatgttaatcctttaaatatgatgatactagtgcataacaacaaaattcattttaaaaatggattgtcataaatcattgacacatggagccttaggttagtttcttcgtttctcatgctcactcggtcacttccttagttccttacatgtccaagcaaaaattcacgcttagcttgcccttttgtatataccactcacatccttacatgggctcttttttattgatcaaatatacattgtaatgtgtgtttttttagaaaaaaaagaacaccttacttacatgggccttcttttggttctagataaaagaaacaccttcctttccagaggagttatgtgcacatgatttcgtcgaaatgcaaatcttacactattacaaaataattttcgtggctcttggtattatttttcactgacagaccaaaaggaataatatctatgaaaacgtttgaggccgtcttggggtaacaaaccacgaaaacctattttccgggtgggtccttaaggaaaatcgcatgtgaaaatatatctaatttcgtatgcggttttcctaaagagccatatgtgcaaatcatgaatttatgaggtggtttgttaagaaaatgaccacatgtaaaaatggggtaatttttaccggcgattctcttagaaaaaatacatgtaaaaaatacaatttcatgggcgattctcttaatgaaccacccttagaaatatgagcactactatttcaaaaaaaataaaacgcacccttccatataaaatcagatgacaacgaactctatatgaaacttagagcatcctcattgtctaaacccctccaacggtactaaccaagtctacatagaaataaaggctgagagatactctccccgtccaaaaaaatataagggattttggatgaatgagataattttaacccttatattttagacagatggagtttacgtgcagtgtgtaaagagtacttcaacactatagtgggaccacaaccatgtagaatttatgtttctctctcccgtattggctcttggccaactgttgctgccatttttgtaaaatgtgatatttattttatttggagtgttcgctcccatgggaagagtcgatttgctatatgcttggaagagacatgttgcctgcaatgtgtagtgccgcgaaaatattcctttaggccatgttcggttatacaaggatttaatccggaccgggaatgataagtatagtaagaaatttatgatagatacaacgagagaccgggattcattctgggccgggaaccaatttactcatgatagggacaataagagactggaaatcaatccactagtcaagaggtgtggaactaatctggatgttttgttgtacctaatatgagtaaactggttcccgacccgaaataaatcccggtctcttattgtatctattataaatttcttgttatacctatcattcccggcctggaacgaatccttgtgtaaccgaacaaggccttagtgtctcccttataaccctcgacgggatctacaactaatctggacctatgcttttacatgccataagaagcccaagagaagaaataccactcctacatactccctctgtcacgtaaaaattcaatttaatactgaatgtgacatatcctaatacaacgaatctagacatactcactccatcccaatatattaaaacctaggaccagataggacatttcctagtactacgaatccggatgggacatctagtactatatttggcttttttgaaccgatggagtatattataccataaaataataagatgtttagagtcgtgcatgctactatcagagtaaaaggccaaaatgcggtgacaattggcaaccgcctcgtcaaggccagacgcccgggccgttccctccctctgctacagcccaatcagcccatgtacggcttgttcagatcatgcatggacgctgcttgttgacttcatattgtcattgcacacaaattttgacaatttgaccttttgaaaaaactaattttacaaataaaccgacgccaaaacttatttcaaaattgacccttttgttcagcgccaaatcatctggcgctaaacttagacacttcagcgtcacgtcaactgacgctgaatgccgtgccaccgtggatggatggaaggctaagtcagcgtaccaacgcacattcagcgccacgctatttggcgctgaggtatctaagttcagcgctacacgatttggcgctgaacaaaatggtcatttttgaaatactccctccatctacttttgatagtcatatttcatttttcatacaaaccaaggataattaattctacttatcatccatttaaacatgttactagtcattcctcataaacaagcgatttattaatatttacatttctcgatgcccatgcagccaatcttgtgtggaagaatatagagttacacattaaatccgagaaagtcattaagaggataagttgttggattgaaatatgcctatcaaaaataattttttcagatttgaaaatatgactatcaaaaatatatggagggagtaagttttagcaacggtttatttttaaaaatagttttttttaaagagttaaattgttaaaatttgtggtcattgcagggaagagatttttcatttgtgagaattccaaacatgtgtgtaattaattccagccggtttactcgttcagtcttccactctccattctaccaccatacgttagcatcaaacttactggtagtactgatatatagcatatactactatccttctattgtatacttcgtttgttaaaaagaaaatctcattacgaatatagatatagactatatttatatcaaagttggatttttctttaataaaacggaggatgtatcagtgtatgtcgttgtctgcaacaagctcgattcagagttaaggaagagaaaaacataccttcatcctgaaatataatgatgttaaaaagaaacgtgcaattaagaccagtaaattgactagagcaaccaacacagttgtcatcagtacagataattgacgtgacatcagcgatgacgccgccaaactgcgcttctctcaaatgccacgaaattttcaggcagacaaaactcaaaagtacgtagcgtgtagagtactttcgtcttttctgttcctgttactagtaccaggcgctgtttatttcagcgcaaagtttagattttggttgaaattagagatgatatgactgaaaagttgtgtgtgtatgataggttgatgtgatggaaaaggactgaagtttggatccaaattttagatataaacacagccttagttaattaagaaccgaattaattgcttgaggcctaagctaatcatccctaatctttgactcaaccccttgcacggacagacacagtcagaccgttgcgtttgttaaaaacgaaaaggtagctagccatcgactatgacagcaaacgctaggcttaatagccagctatttagctcttcgactgtcgccctctcatgcgactatatactggagcatcgtcagcgtttacatctacgattctcgctcgacaactcgccattgtgcatggcatatccaactaaacatactctctccatttcaaaataaattaacctaattaatatataatatgacacattataaaactgaacaaactgtttcttggacggagggagtaaatgcatatagcaagagtacatataaaaggtacgatatatctaatgaaaattattaaataagtgaaaacccatacgttctctaaatttctccattcactctgcaccaatcgaaacacacacttcctccattcaacatatattagttgtcaggtgtttcaatcttctccaaaaacaaaagttctctaagtttaaccaattttttttaaaaagtaattaacatctataatatctaatcaactctaaaattaagctttaattcaaattttcgctgtgactgataaactaaaaaccaaatgtgatgaagccataaaatttataatatataacttatctatataagctattatctataatctattacagtactattatattaatcatccaagaacatgctcaaagtccattgtcaacctctatatacctcctctctacgcaccattctttctgaattcgctgcgaaggatccttcttgtagtactctccgttgaatcttcggctgtcgtcgtttcagatgactccggctaatcatcagacatcctgtacggtagactcttctttgctcaatcttttgtggagtataggctgtgttaagttcacactgaagtttgaaagtttggttgaaattggtatgatgtgatagcaaagttatgtgtgtatgaaaaatttgatgtgatggaaattgaaaagttggaagtttgaaaaaaaactttggtactaaacagggccatactataggagtacgtacttatggactagatctgtatgcggtgttctagcacaccacataggacgacgacgtagaaatttgtgtcaatgaggatgcgatggaataataattaggaccattttgcaaattgacttttactcgtacaatttatttgtcactttacaaggttaatggttaataaaatatatttttacaagtaagaaaatatttaagcacgtagtgtagagtttgcctagacccctaaaaatgtagagaaggtggtgcagtaataaaaacaatcaaagcatcggcagattaaaacaacggaaatatttagtgtttaaatagaagaaaaatgattttaaaccattcatatgaactaatcaaagttttcgaaaatccagctaaagctagtacaaattagtgacttaaaaaccgtgcgtgtatagagttacaaccttggtgtccattttaactttcaagtgatgcttaatacctctaatttaaaatatagcaatttctaactatggtcccgttcttttctccaacaaggttggatgaaaattaagattttcgtggcacgtttttcaaactgctaaatggtacgttgcgtgcggaaactttctatatgaaagttgctctaaaatatcatattaatctattttttaagtttgtaataattaaaactcaatcaattaaacgttaataccacctcgttttgcgtaaaaaaatcaatcttcatcttcaagagaaaagaacaccacctatatactagtattatttatgctttggtccaaatacttgcatattccctccatcccaaaaagctcaacctaccccttctaggacaacgaatctgaactaccttttgttcagattcattgtcctgagaggtctcccatccctttttaggttgattttttttgacagagggaatacgagtaagcttgcgttggaaggcatagggcctgttcactttgatgaaaaaaaaaaaaaccttaccaatgccaaaaatttgatatagttatcaaaatttggcagcaaactaaatatagccactttttttacaactttaccaaaaacttggtaatgttaaaaatgacatcaaaagtgaacaggcccataatcacgaggaatgcatgtacttgtgtgaaattaaatatagtattaaaaagaaaaaaaagaaaactgcaaaacatttgtagcactcgtatcagtccaaaacatctccttttccttgacgaacagatcggagtactccactacggagtacgtcatcacccccctcgacgtcaccggtaggctgttttgtgggcccccactccaccaccaaactccaagcgtcccctcgcacacggctcgcctcgcgaagattcctctctctctccctctcccgcacacacattccccccctgggccccacaacccgccaatccgtacggcccccaacacacacacatacccaccgtccaggccacgcccaacccgtgtcactgtcacgtgggccccacccgagatcgtccccgctcgctgtcgcgtgggccccaccccccgatccgcggggcccgcgccgcacctggccgcgggttgcgacgcacgcagcacgtaggcaaggcagctagctgtcccgcacccccgcgcttttattactagtagtacttctcctagcggcagcgcaagcagcaggagagaaccaaaacaaaaaaaaaaagaaaaaaaaggaagtaaaaaaaaagaaagcggccttctcctccagctccacctcacgcgcgcttcgcctcgccgcgcctcgtctcgtgcggctgcggcggcggcggctgctgctgctgctccggcggcggaggaggggggaaaggctcgttcggtaatagggaggaa

SEQ ID NO: 83242 - DNA, 33579 bp, Oryza sativa
  unsure (1)..(33579): unsure at all n locations
cgccgagggactccgtcgacctggggggaacgtccgcgtacccgtccgcctgcgcgtctccatcctccaccacgccgacgccgacgcggtggggcgccggcgccagcgccgtgcccccgcgatgcccggggccacaggaccagcaccacgggctgccgctcccgcggccggtgtccaagtcggcgccgatgcccctggcgtcccccgccgcggcgccgccgtcgccgtcgccgccggcgtgcgcgtcggcggccgagtcggtctcgggcgggagctcgtcggacgacgaggcggatcaccggaattacaggtgatttgcttcgtactggctgctccgttttacagctaccgacctgctatttttttttcatttttgtttttgtttttgtttcggtttggtcgggtactccaattatgggcgtagctgctacaactccaaaccgtgatcgcaacgaattcgacgcgattaccctttttccagttcgttagtagtaatcacgaagtgtgccgagtgatagtgtgatttaggggtcttgagttgacttctaaaagaccaaactgtgtggagactgaggcttcgcaacaactgccatacggccgttgacctcgtctcttctctcaccgcctatagcgtacaaaaccgtattcctttgtttattactagtataattcggtggacttggggagtcaggctaccaaagcgcgtcaaaagttcaacccatccttcttttttattcattcaattgtatttaagatattttatgctaggatatttatgatattgttaactaacagaatttcccgcgtaatttgtttgcgtggaattcccgcgcaattttgcccagatagaattggatttgatatacaactattcctgctttgataagaacaagtttgtcttatgtaaacctttatcaataaatctgcaccgttgtaatctaaaacagcgcaaatctttctcatctttcgttaacgtggaaattttttaggcatagaacaaacatggcggctacttatagatagatagaatgtctaatgtattcctaacaatcattctatggaaatgaatgctttgttccacttggagacgcaaatctttctcatctttgattagcgtgggaatttcttggcgtagaacaaatacggtggctacttatagataaatagaatatctactgttttcctcacgatcattctatggaaatgacgccgaggtgtttctatgctaggagtagcattatctgttccttcaagaatgatgccagagcataaaagaatgcatctttttatggcgtcaagctaaatttcaacacattgatggttcttttctttctgcctgtagttatagtgcgtgtttcatgcctttgccctttctgatagtgtccctgtttggctctattttgttttctattgaaagatgacctattttgtttttcgacaatctgttcctacagtcctggaagtcctctgatatttcctgtttgttgttggaatctgtaggtatacagatccagttgtccacactagcggaaggactgtgctacctgatggtcataatggcatggtagaagagaagcgttttgtatcatgtggtattctccaggagcatcaaaaattctttgaggttcctattgcaaatgtgaacgaagttcatcacatgcaaatctttgaaccttcaacaagtgaatctagttattctcggggcagaatgttgcctgaggatacatttgctgtaagaccaagaagtcattcccctggtccgagagggcatgcttattctgcttgctgcgcaagagattttgggtttaccccaaggtcaccagtgaaaaggatggatgatcctaggagtccatctcaacccttgcctctccctccagttcctgttgctagctcatccattccttcatcttccattacttctagtcaattccaatcacagtggaaaagggggaagctattaggtagcggcacatttggtcaggtttatcttggtttcaacaggtatggaggtttatcttatagaacattaaaagaataatatggtttcgaagttcacccaaagaagttactatgaatgtgactcattttttcatgtactttgcatccatgcaggttcatctttgaagtttatatagaattttagttctatggctagatcgcagctaaatcctttgtttttctgtctaaggctgtatacccaaaatgttgctatgtgtaatttgattacgtacatgcacaaaagtttgatatttatgtggacccacatgttcaattcggtaggctagaacatagaaaaaggaggagagggggtatgtgaagtcataattatcacatgtatacatggttctatttaatttccttaaacaaaagttgctacacaacacacttttttggcatcacatgagagcatgaaagaaaatcttagaactatttctatgaatctatttcactcttgactcttattgttgccatcttgtgattgatcttaattggcgttgtacagtgaaaatgggcagttttgtgcaatcaaggaggtgcaggtttttttggacgattcacattcaaaggaacgccttaggcaattgaatcaggtcatttgattgccctatacaattgataggctgtgtgtcattttgaacaatttatttttattgtaacacaaacacttttccaacctgtctctgactacatcctgttttggtttattaacttgtccatcttgtaatgacaggaaatagatatgcttaagcagctctcgcaccaaaatatcgtgcaatattatggaagtgaactggtaggttcaatatgattattgactaattgttcaataagcatgtcatgcagccacataattttattctttctcatcttagcatatttgtattgtgcgttgctcattacaagatggatctgtgagggaaaattataacattttttttggtgggaactaatctgatgatgcatagactcactctctggtgcacagagcataaatttatgcatcaattttggttctaatgcttaatcgtgcatgctttgtccttttcctcttttctaaaatcagagggtatacgccctggttccagtttccaccaagaaaggagacaccatcagttttactaattttgtgtgattgttcacttattttctgaaagttctcattaagctttggcttgcctaatttaaacaattttgagcaggctgatgaagctctgtccatctatctggaatatgtttctggaggttcaattcataaattacttagagagtacggtccatttaaggaacctgtgattcgtaattatactcggcagattctttcagggcttgcctacttgcatggtaggaatactgtacacaggtaatgtaaattatcctacactgttagtgattttcatggtaggcactgaatacaatgatcactttgtaaattttatttttgtggacagagacattaaaggagcaaacatacttgtgggccctaatggtgaagtcaaacttgcggactttggcatggctaaacatgtatgcagttatattttcgttcttcccggggttttgcttgtttggttgtgtagaagcatcattaaaacctcactgagaccacagaaagcatttagtagtcatctaactgaatactctctccatactcgtaaaggaagtcgtttaggacaatgtttaagtcaaaccttggaaatataaatcatgaataactctcaagttgttgagtttgaaaatataaaaattatatgtatagatttgtcttgaaaaatactttcataaaagtatacatatatcacttttcaataaatatttttatagaaacaagaagtcaaaattgtattttggagaccgtgtcgctgtcctaaacgacttcctttacaagtacggagggagtattaagttcctcctctgacagaatgctagatgcaactcagtaaaatgtctttaacattgagcataaacactggcttcctctaagtttgagacttgggagtgataaagatctgtactatgtctataaacttccctttatgttgtgggctggtgatgtcatttctacatgatttaaaaaagatgtctctgatggctatggaagggcttcttcaattcaacaacaaaatgaattccttttgagctttggttgtctcttttatctcatttcaatgcttatgttgaaacaggtgacatctttcgccgaaatacgctctttcagaggaagcccatactggatggctcctgaggtatacggtttcctgtttacaacacttggagcactgtgtcatatgttatgtaatttacttcaccaagaacggtttgtccaactaaatgtaaaacgtgcaggttgtaatgaataacaaaggatataatcttgcggttgatatatggagccttggatgtacaattattgagatggcaaccgcgaagcatccctggtatccgtatgaagatgtatgctacttcgtttaatatttaccaaaatgctttgttccacttggagatgctattctgcctcttttagtgaaaataactggaggactcttgatacttcttttatagttggtgagcctcatgtcagattcttggtcttgcaggtggcagcaatatttaaaattgcaaacagtaaagatataccagaaattccagattgtttttccaaagaagggaaagatttcctaagtttgtgcttaaagcgtgatccagtacagaggccttctgcagcttcgttgctgggtcacccttttgtccatgaccatcaggctgtaagagcaccaacatgcaatggtactcagttgagaaatggaatttcttcccctgcagcaagtcatagaaaggtgagatttctgctcatttgtttttttcagagtcaatgtcgagctcttttactcttttgaagtaccaacaggacatagtagattatatatttctagatgtttacaagatnnnnnnnnnnnnnnnnnnnnnnnnnnnnnttgtatcatcgcatcagatgatggggggcagtagggctgattcatgtgttgcacataattctttttaggaagcttgctttacatatctgttgttgataaattaattacgtgaaaccaggtttaaagactggattacacgacgtaattcccatgtccggacatccttgtcatgtcttcaattttttccccttttgcagccaaacagagaatcctcgtcaaggagaaacattgctcctctgcatggtatcgcaggactaagcgcaagggaattcgctggattttccacagcctatccttctcctcacaatacctccaggtataccattctacctcctgcccatcctttgtttccaagttcatcttgtaacctacttctcaacatggccgtgcacgtgcagcagcccaactgcagtgagagcaaacatgtctttaccggtgtcgccatgctcaagcccgctgcggcagttcaagcaatcaaactggagctgcctcccttcaccaacgcatccggcgctctcccctggattatcagcagcagcctacccaaacaatcccttgcagaaccagtcgaggcgaagcgccgcagttccagatccctggctggagttgagccagccgagacctccaagcccatatggctctccaaagagattctaggccttctgacctgcagagtttcttgtagcatggctcctcaaaagagattctaggccgtctgatctgatctgcagagttgttgtagatgatatgtgttgatatctgacacaagatagagagggagtcgcatatgttttttgttgacagatcatttgtaactatatatggcttactctgatctgattcatcattcattgtataccataggaaaaaggagggcattaggatgatctctgatgttctgtaaatctgtaggactagaaatgtggagtggaggcttggaccagttgcagaacttgtaaatttttagaaaatggaataaaatatcccggccgctacacacccgaaggaagtttttctaaattgttataagcatattatatggatacttgcgatgttggctgatcgaaaagctaggtttaccctgaatttctaagggagatagagaggtaggagaatgccactgaacagcaagcggaagcagcgggccagtctgtttcgttagagtttcgaatggagagagatcgacaggaggttttcaaatttaaacagcatataagttaaacaaaaagatgtaaagggggccatagtttgaaagatgtattttattttcttaaaagatgagggatgaggctttcaaaccaattttaaacggcgcacaagtttaaaaaacaaaaatgtaccaaaaacattgcggtgagcgtggatcgaacacgcgaccttcagatcttcagtctgacgctctcccaactgagctatccccgctatgcgtgacaagggtctctgttccacctatagtgacgcataacttcataagttagctttggtttatgccaattgaactcagaatctttggattgaaaccacacgtccattgccattgcactatcaaatacatctcgatccatatattagtatccaactaccgaactacgcaagcatgaaggcaattcaacaagttcaaggccacaagggacgtacaccgccggtacacgcatacaggctatccatgtactacactagtacacacatacaacaaagttatccatccatgtacacaccgggtacacactacacgcatatggccagatgcgtgcagaactgcagatgcattagttagggccaaggggaaaaaaaacttatggctcgttaactcgtttagctcagctcagctcgacttttaactcgttaagataatgagtcaagtcaactggctcgacatcaattggtcgacgtcacaagttggtgtctcgatgtgagcaataattaattcattcggtttcctaagttgtacttaaatacaacattagttttggtattataagtgcacagaaagtattagtattgtgcgcgtttattggcttgtaagaggtaccacgctatgctttattgagttactttcttgatttattttgtattatttggtatgttcatattaaattcatttatgattttggatccaaacaatgctttcgttctattttagacaccagcctaggggtggtaatgggtcaagacccgtggatcctttcacaacacatctcaacccttagatatttttagcacaaaaaaatactaaatttcaactcaacctttttacccaacccttacattttgtaggtcaaaatgttaggccaattaccaccctacggcagcattgtcttatttcttttttatgttgcaccccttaaagttagtcctatatttgtcactaagcaagttatataacaaagataaataatgatagcaattccgttagttatatatataacaacgataataatatcgattcggctaactgtataataatgattgattaaattttgacattgtgtaatataactttatcaaaataaatgttatgaccttcaaattgttactaatatactactcaacaagactattagtcccgctctttcttaaaaaaattaatgattggtcaatctttatagcgttctaggctactgatgccctcatatagcttttggcaactatggcgaattttcttgaccgcaatactttacatagaactattacgcagccctcctgttacacgaagcagtacaaaagagtcccgtaattctatcgaaagtggagacacaaagtttacgggtgagactctctttactaatcaatgctctaatcaactgtacaatgagtaggcccctccactctttatacagtgcaatccaatatatgcaaggttcggtgatgggcccaataaatacatttgggctaggtcttcatgggccaaacccaaaatttcttaacaagaacaatgctatcatggaaaaaataagtgcgggtatgcgtcacttaggttgagcctattttgacctagtgaaaattagctgaatttaaacatcttccaaatgaagaaccctagctttaatgactacatggatcatggatggaaaattaacgtggaatagaatcgaatcgaatccctgtggccatgtgaatatgtgatgcaaatgatggagccctgcaggacatggaggggacatgcatcatcccaggcagtgtaaagccatctcccatcacatgtgcacaacctttatagcttagcccttttggtccctgccttgcctctctcccaacaaactttgcccagtgctgcagcattgtgtgttgtgtgtgttgtgcttgaggggtttttatgtctgcatatttccaggggttggctggtccagggggttgctgcagtgtacactagttaatcaacatcaaggaagattcccacttagctctccagcagaaattaaaaaaaaaaactaaggtgaagtatattcaattgcattcattgggcatgttgcacttcatttttactaaagtaactaaaacatgcaacattgttaggatacgatacctttttttcctgccatggttaaattaaggatatgatacaactgatgaaataggaagctaatgtgattcatggtggctagctttgctgaacttgggtcggttttatttttaatatgaaaaacacaagaagcaaaaggatgttgtaaaatattggtacttattttttctaaaatatttaaaataataattaagtttttttttggatttgcccccaagacttttttttataacaggcattcataatacccggcttttaaacaaagccgaagataacggcacagaagtcttacacaacacaaagaaaaacaagtgacttaagggaacagactaacgctggagcataggtatcactggagaggcccaacaatcagaaaaaacacacccccggacaccctaaaacaaggcacctaacatgctaaaccaaaacccaaccccttagcctgttccaagacttccagatattaattctttttttaaaaaaaatcagagtttgtttttttttttaaaaaaagatgatctggttcatttacaagtttgtgggaaaaaaatacaaaaaatgtcatggcttactaacgactaggctttttacctgctcctacataaacaatgtggctaccacaagtccacaagtcgtaatcatgcacatccattcattaacaaactctaaagaatcccgcaaaaaaaaaaaacaaactctaaagaagaaagggaaaagcaaaaggcacaatcctttcatttaaaaaaggtctgcgggatctcaaaccgaagtgattaataacatgcaggagttagtatatatatattgacataagactgaatcaaatcaaagatacatctatataaataccaatttatgttactatatatatgtgtgcactattttgttggggtattactagatttcaagcacatggaaaattgcatattttcaatcacctgaaattgcacactcataagtctaaaattataatagtatgcaaggtgcatttttatttctatttaactgtaagtttgttgctatatggatttactttatttttatccatgtttaaatatttttcatgtaattttgtaaaaaattttgcatgtaattttgtaaaacttatgtataaatgtttttcaacgttttatacaagaaaaaaaaggactaggaatgataattattggattgacattaaagtaacgagataagttactggaaattttgaaaattctcagctaaattctagccactcccattttatcttatatggagtagctaactacaaatttgcacaaaacccctgtttcaaaagtttctctaaaaagaacacacctatattccgaaattttcaaattcctttttccccatccctcaaagctaatccttttatgtataaccctatcatggtcactattcactaacatgtcccggctatatagttctatgtgtttagtacgttcctctcattttacttataagtggagatgttgaatatataggttgtgggtctggtattaggggagaaagtaggtagtccgcaaaccccctttagggtgtgtttagttcacgctaaaattaaaagtttggttgaaattgaaataatttgatggaaaagttagaaatttatgtgtgtaggaaagttttgatgtgatagaaaagttaaaaatttgaagaaaaagtttggaattaaacgaggccttaggtcgcttaccctataaccctataagtgggctacgggctaggcacttacgcttaactgtggttccagtttcatacagtcacagactcatagtacatctctttcacaaacattaattaataacctgtttaaccaaaaggtaagggtataataatctactcacttcgtactattctaagtgtagttctggtttctatgtctaacgtttcaccgtctgtcttattttaaaaacataaaaaattaagtcatgtataaagtacttcctccgtcccaaaatataggtatttttaaggttggtacggacattaagaaagtaggtgagaatgattggagaaggtgtgtgattggttgaaaaaaaaagtaggtgaaggataatggttctgattggttgagaggaggaggtaggtagaaaaatagcttcattttgagacacggtactgtgctacaaatagctacattttaggacggaggtagcactactcatgttttgtcatctaacaacaataaaataataatcataaaaagcatttcaaataagaagtacggtaaaatgttgaacgcttaaatacacaaccgtacttgaaatgggatggagggagcagacgagtagtaaccatttaaaaatgcttgatttgattccccggggtccactgcccatttgcccccaaggaggaggaaatatagaaaaacaaaaggagaaataagtttcttttttcaaaaaaaagagaaagaaaaccgggcgacctgtgctgttctgccacctcgcgccgcgcggcgcatttgcgccatttgtttagctcgccatgtccgccaccaccttccctcaccagcatcgcctcgccgcccagctgctgccgctgcgcttgcgcgtcctcactggaaagatggcccccctctgctctggcccctctccactgcggtatgaatgaatgatgcgccttttctccctccccccgcccagatcgatcgccagacctgcactttccagttccccatccatgctctgtctgcttcatcctgtcccagcttcttcttcttcttcttcttgttgttgttgttgttcttggtgcgggagggtgttcttggggtagggagcagcatcggcggcggcggcggtcatggcgaaggagaccgagttctacgacgtgctcggcgtctgccccgccgcctccgacgacgagatccgcaaggcctactacatcaaggtcttgcttcttgcttgttatgccaactctgctcggagagtcggtgctgatttgtttttttttttcggtttttggtttcttgatgtccaggcgaggcaggtgcatcctgacaagaaccccaatgatccgcaagccgccgagaaattccaggttgtttcctgctactcagctcaagttggtttcttgcttggatggtttttttttaattaaattcagtttgctttgtctgaccagctgagctttcttgggtggattttttgcaggctctcggagaggcctaccaggtgctgagtgatcctcttcagaggaaggcctacgatggctatggcaagaccagcatttccaagtagccaaacaaacccatctgagatgattgattgactctctgcagtctgtggcaattcaagtttcaggttaacaaatgttttgttttgttttgttttgtttgttttttcagggagaacatgctggatggcactgtggtgttcacccttcttttcgggagtgagctgtttgaggactacattggccaccttgcaatggcaacaatggcttcctccgagatggccagcgacaatgacaaccctgaaaagcttcaggacaggctcaaggtcagtgagctcaatagccattgcagccatctgtgattatggatgctccaaagccagtttgatttttctctcctttctgatggaatgttggcactagactagttgatactaaccattctgttctatgtttattgtgacaaagggtgtgcaaagggaaagagaagagaagctagcaagattcctcaaggagttcctctcgcaatacgttcgtggtgaccaggaaggattcgcaagccgtgccgaatccgaggccaagaggctgtccagcacttgtcagtctgatcgatccccgcaattcatttcgatctctatgccaatctaagaaaagcttcttttaactgttctgaaatgccattgctcagcatctggactagacattcttcgcacaattggatatgtgtactcccggcaagctgcaaaggagcttggcaagaaggccatgtaccttggagtcccattcctggcagagtgggtgaggaacaagggtcacctatggaggtcacagatcaccgcggcgaaaggtgaaaatctcgcaaaccggggcttttggtgtgtattcattaaaattgctgactgattagaggacaaaaagaacaatgcaggagccttgcagttgctgcagctgcaagaggaggcctgccggcagagcggtaaggacggcttggccaccgagagggatgtcgatctgcagatgaggatgaacaaagacctgatgatgagctcactgtggaagctgaatattgttgatattgaagtgacccttctacacgtttgtgaaatggtatgcctcaagatatcatagaaatttgcagtgatatgattaatagttagttggtagtatctgaactgcgatcgccaagtagcacgacatgcctgtcttatcttccaggttaacatgtcaaaatgattagtacattaaattgaattgattctcttgtacttgttaggtgttgcatgaaaacaatgtcaagaaagaggatctcaaggctcgtgcaatggcactgaaaattcttgggaagatattccaggtatatgttacttggccttttcattaggataattcataccgctacatgagatttattttatcataatttgcaaataccatattaattcaattggactacaaacagagggacaaggaggcattgccaggaccatcaaaaccgaccattctcgatgatgacagcagctctgatgaaagttcagatgacgacgtggctcggacagtgccttatcggactcctgcagttactcaggcaattactaaactaagcagcttttatgttgcatagcaaagcattgcataatcaagtgcctgctaatattagttcccatgttttgtggttcagggaattggcaggttattcagatgcttatgcaacccagcatatgatgttgacgatgactttgaaccacgcaaatgagtggtaaagtagcagagaggttgcaactatttaagagatccctgaatctttccagattatgtgcttctgaacagttggggatcatgcatcaccataatttgtctgggtgtgcattgtagattctactgcagcactggtgatcaggccattagctcaaaatcgttctttttctgtccatgaacagtagattctttcttggtttttgatatagattttatcgaattgtgtggtgtttatgtaattgtttggtttgggagttgtcaaaagaaagaaagcaagaacaagtgtaactggaagtccatttctctctgattttaaaatcacatgtaaaactctgacatgaaaaatcaacttttgatcctatcgtctgcctactgtcaccatcctctgctctaaagatcttctatctcatattgacatccctgattgctgacctgccagatgaatgctgtcaaactccaaaaagagtgatctactgaaatttctttgagcttctgctagaaagatgctgtacaaaagatgaacagatagctcaaaaagctcattcatgcaactcaagagcagtctgcattctgcaatctgcattgcacagaacagaaccaacaccatggatccagcatttttttctcatttcctacactggtaggtagagctccttatggtttatggactatacaacaacagcaatttctttttctgccatatgccacacgcagtttctcaccctcaccccctaaactctaaaatttcaactgaaatctccttctccttatggcgatttgcgcaacccgaaaaagggaccataattcttcagagattcaggtgaattatatcatgctctgagcttggcgaagaggttgccgaaggagaagaagctggtcctggacagggcgccggaggcaggctgccccggcgacttgccgttggcggcggcggcggcggcggcggaggaggaggagggggaggagggcaccttcttgacgttgagcatgacggtgtggccgacctggacgcggaggccctcgatggtcttcatgtccaccggctcgccggaggcgtcgcggacgtagaagacgttgatggcctggccgccgaccgtcgtgacgtcggccctcgtcaccgtcaggccgtgctccctgagcacccgcgtcacgtcggacagcagcccgaccctgtccctgccgcacagctccagggtgaatccctgcatcatcaaccaccagtgttagcacatattcaagctccagttcgagctgaaagagatcctctgacttaacgccatatcaaagtggaactcacatgtcagtgactcaattgtatgtgtatgcatgtgtagttaagtcagaggatttgcttctcggtgttcgagctattgtactggtcggtgcatgtaactcaatctgacttttatcttttttctttttcagaaatagaatcagaattcagtcaaaggtatatatgaaaatggagaaaagacaggtagaagggcagtatgttactactggttaatagaactaaatgatgaactgaaacagtgtactgaaaaaaatgaacagattaatgtggtaccaggtgctgtagcaaaaccgacatactagtaacagagttcagtgtgagtgtatcgatcaatcaatgtgactttactactaggagaactatacaccataatctgcaacatgtcctgattaatcccttgttccagatgcagccaagctcagaaattcttttgcaaaatactactaacagttactacttctactgatgcagtgatgctagttgcttgtacagacagtggcaaagaaggttcagacctcagatactcttctggagatggccgcttcaaggcacttgatcaccctccctgcttcgtccttctgtagcgtgcgcccatccttccgacgaatgtacagctcctgacaatattaaaataaaaaaaaggaagttcattgcaatgtcaaaagtcaacgttgaccgagtcgcggcgcagagctcctttgaaatgcaggaatattctttctacaaatcgaattatttcatgtgaaattcttagcattgtcgtggtaggagcttcgatatggtagtagcagctgttgacatgctagagtccagagtacacacctggatgccgtagatgccgtcggaggagacggaggcgtgggagacgacgtagtgcatgtcggtgagcgtgcacacgatgtcgaacagcagcttggacctgtccctgcacttgacgttcaccaccgagtagtccttctcctcgcagtgctccaccgtcaccaccggcctctcctccgccgccgccgcgttcccggcctcgcccgacacgatggcgcggctgtcgaggccgtcgtcgtcgtcggcgtccacgtcggcgtgcatcaactggtggagccgccggtcgacgtgggtgttcgacccggcgccgccggaggagaagaagttggcgtgcgccgggccgtcgtcgccgtcgccgtcgtcgccgccggcgtggccgcggaggacgaggcggaggcggtgctcgatccgggacaggcggcacgggtcgccgacggcctgccccgacgcgacgtcgttcacgtacacgacgcaggcgacgcgggcgcggtgcgtccacacctcggcggcgagcacgttgcagccgagctcggcgagcacggcgaagacctcggagaggaggcccgtccggtcgggccccttgagctcgatggcggtgtggtcgccgatggagtgcatccccaccgacctcaccggcgacgacccgcccttcgcgccacccagcaggttgctgtctgggcctaacgcctgcaattttaaccaaattgatactgccacttcagttttcagtttttcacttcaactttaatttacacttcagtgtaaatctatagtcacaaaaaaattcttgatttcatggaaagttttcaaaggaattgttggctccatatctccactatccattccaaacacctcatgaaaaatagtactgcggtctaaatttgtaattcattaaaggaaaacctttaaaatgtttttcaaaaactgaaacacatactgacatgatgaacagatacgaaaatacttcacctaaactaccaatactttcaaaccaaacactatcaggatgcagttgcaccaaaaataattctgaaagcttgatatagaggataaaataggttttcaactttcaggtggtaaattttaagaccaattttcaggtggaaaaaaaattacaaaccttctcaatgtgcttaatggtcttctcatcagtcaccttctgcccttgcttgtccaccacatgaaacactgcatcaggttgtaacagacatcatgaataaaccggcaattgatgtccgcgaaccatacatgagtttgcatatatatgatataattgcatagcataggctgccttaccatccatgaaccatccaccatcagaggtgatgtacgccttcgagatggcgagatcgagatcgctcagaacttgcaccacctccaacaggatgccattcttgttcatgctgtcgacctacctccaaacgcaaacagacggtgctcgaagcaatcagtgaaacggttcttgaatattggaagcagtgttcagtaagattatccagtcaagttttgagagagagtagtaagtagttcttaccttcactaaggtgcagtcgctgcaggtgctgttgtcaatgcataccctgcagaaaattatcagcttgttagctacagaaagtagcggagcttccgacaatagcctgaaatgaaacaggataatgatatgaggagctctggaatttagatgtttaaattagagatccacctaggagggttgatgcgctgactgaagttctcatactccggatcaaagtaaggcagcatatcttccaaggttacgaatcttccctctgaaagaattacgagttgaaaaccagcactgtcatgatgcgaggtatgcagatatatataagcaaacagaagtacacagtttcgtcttgtgaaccatctgtgatagtttccaatcatgagggtagaaacttcgatcttaaaatcatcaccggaccaatgatgggctcctcataaagaagatctaaattactttagagagtagattagaccaacctttcagtagattcttctttcagcagggcctgaaagttcactggaaaattttcgatggcttcaatcaaaagctaacccccaacacttcacgctttagtatcctgaaaaagtcatgagcagtttcgagtcaatttctgtacaacgatacctgaaacctgaacgcacctgctcaccctgaaaactgcctgtcaaaaattcagacactgacatggaacacataaaaactcaagaatcgcaggcagaactggatcgaaatctggatcagaagttcagagcacatcgcttataaccataaaaaaaggcaaccaacttgaaccactgtgatcagaaaactaacaattgccaagaaaccatgggctactgcaaacacaacatatacacatctccctgaaagcaatccacccccattgatcaatcaatcaatcacctcacctcacagaagcaagatactcttttgcctggatgaacaaatcagagaggggcgcacagatctgcatactttattgagtgctcgtgatgcatgaatcaacagccacccacaaccgatggccaagaattgcttgctgctgctggctggggatccaatccaatcatcccaactagagctagaataatcgcccggcctgaggaatcaagaaccacgtcacggtgactggatgtggggataaaagaaaagaaatgcacacccgctttgcgccgcagatgacaaaatcgatctgcttttttttgttttgttttttcagtcccacccgccggattctcgagcgagtgcgcgtgcgtgccagcattgggaggaatttttttcccaccgcctcggttgatgatggtggcggcttcggttggcgttggcgttggccctgcttgcggcgatcgccatgactgaatcttgagaagaccttttctattatctgaacttattagggttcgttgtggtttgttacttatacctgttattactgtgttttttttatttcagaggttcttgttgtgatgttgattaggccgaattttttattcataataattaataatgcagaaattaaatatataataaagcaaagtcaatttttacgaaaataggaaggacactattgcataggacgtccaggtgtggatgctgttgtagacaacgtccagatggggacgcttcttacaagggcgtccataatgctgcagttgaagaccccacagagccgtccaattcaccggactaagattggactttggatccaatcacacaatggtcgaactctgcctcgttactcctatgcagactattgtctcttgttgattgcttgcttgccgagtaggcaccgctctctacctgatctgccagacagggtcgccatcccccggctctccttcaatgcttccgctgttccgcatgacggacactctactcggggtcatatgtgaacagccaccacttttattttgagatatttgattagtttggtttttgttctggtccattgtttactacgcatcgagctctctgctgactgaatcttgagaagcggccgccagatgaactgcatgcgaggttttcgatcgatgctttttttccttttgcaacaagccagagattggaagtcatcgggcgacagatgatctgatagaaggaggatgtttgcgtcctacccttcgtaattttgcattctttgtaaactttctattgcagaacatatacacctgaataccaaaatctatgaactgagcatacttgctcggccagccacctggagtgaggcgatgcctggacttgctgttaggaaccaagaggggcggacagacgacgcaacacaagccggcacgagtgggttattgttccagcatgactcaaccagaacgtggatagcggctgcgacctcccggtgtgaaggcaaaaagcggcggcgtcctctccggattcgagagccttcgaggtgagttgaggtgaactgcaatggcagattcctgacattgtggagacggaagccggaaggcggctgttgcagtctcccagagtcgaggtgaacggcgggcatggcagcaccttgcccgagccctgcaccaacattgggcctgaggagaggagagtcgacgatggcgcctctccgcatggcggcatgggcgccccaaaccgagcctggacgtgcttcggtacagcgtccacctctggacacttcttggaacagcgtccaaatctggacgccctttgaaacaacgtccatcctatttttacaaattcaatttaagatttaccacttatttaattcaagacttattaattaatataaataaaaaattcggttgattaggtcttatttttccagcgttgcatgccgcggttagggcccacctgtcagttagtagcacgtgtttgaatacgaaaatggcaactttaagttaaatgttattatttaaatcatttattctcaatatctctaattttattgggtgcatgtattgtatttattatgatgatatgaacaagaaaaatgataataattggtttttggtctttggactaaggatagttatgtcttgtattttaaaatagatggagcattgcccagttttgaacaatatggagtttaaagagcaaataatcgtgaaaagttaaatgcaaaatgatcagatttactcgctctgtctcagaatataacaatctagaatcggatgggatacatctattataaaacatccatttcagttgtagattactatatccacatgatgaagggaatagttttttttaacaaaacaagtaatcttgttcaagatttttaagtgcgagaaaggtcatcggttcactattgtatatagtttgtagttaggtgaacgattttgtatgaagatactaatgtgaaatgttcctttttttttgttgtttttctgaaacaaacagagagtataaagttacttacaaataggcaagcaagtacttgaaacaattggggattaatcactaatcacagagatgtcctaagacctaaacctaacctactactctgtaaaaaaaatcaaatatgtccaaatttaaatatagggtttgattttttttttgaacggagggtagattaatcagcagggtgatagaccaaatcatctttgccttggtaatccacatggtctcaagtcaactggtaagaggaattcacatttctgaatttctgattggcacataattgccttttatccaggtaggagtagttaattgcggagtagtcaactaccactggtggtcagccagccacgtggcccggtggggcacctgtcaccgacaggcgggcccaatccgctgcgcgagaggaggccaggcagccagccacgcgcgctttacgctttcccaaaaagggaatccgctttccgcaggtgcggcgggcggcggcgcctccccgattggaatctcgatgccacgtggagcactcccttccgtccgatctccatccgacggtccagataggccacgcgccccccttcctcctatcagcagcgtgtggcacggtaactacagtactatactactgctactgctacatcaatcaaaggcttcccaaaacaagcaaacaaaaatgaacaaaaaaaaaactctatgcaattaattaactaattaattgtacgtggtgctaccagagagatacgactacagtgtacatgcgccgtcacaagccaaccatccaatctccaatcataacatccatgattttctttcccctttaattaattaattaattaattaattctctcctccctctgatcgcgaccagaagaaacaataaagacacagagattttgcaacaaagtggacgagtggggcccaccggtcggcgactgcagccgacggctgatggaggcagtagtagtaacagcagcagcaacagtagggcagatggggggcttcgaaagagagatttttgctttcccaatcaacatgatgcaaaccagccaagaaccaagacaaaactctctctgtttttatttttttttgttttgtttttttgaaaaatacttagaacagaaaaaaaagaagaagaaggaaagaaacagagacacgaacagcaagtcggttgtgtcggcccacctgattgacgaagactgcaatcattcgacgctaataaacataaaaatgaaaatgaaaaacaacacgattctaatctaccgtcaaacaaggcaaaccaaagaatccaggagagaaataatttaagagagaaaaagagagagagattggtaaagcgttaattaccactgttcttggattccctcttaattctctcctcctttttccttctacttgctgctgctgttcttggcttcttgagattttgagatttttgattcgcgcgtcgtcttacatctcacgcagccggagcacggctagctgagaggaagaagaagaagaagaagaagaagaagaagaagaagaagaagaagaagaagaagaagagctctctgttagtgtaaggaaggggagagaagaggagagaccatgggaggaagaagaatcaaatcaagaaaaagggacggcaaaaggaagggagatatggatgaatggatggatggatggaggggggagagggcaaatgggcctagtaggggagagatgacagggaaagagggactcacactgcctctccacatatgcccccactttggatgataccccgataccttccctttcctcttcccctcctccgtcgaggattatatagtcccgcgcggaccggggaagtccaggatagcgctcgccgtggcgactgtgtgtgtgtgtgggggggggggggagtcagaccgagtggcgagacacatgtgagaggtaaatgcggatagtgtatgacaagcgatgccaagtagccatgtagtcgatggtgtggcgtttgttagaaggtacaactaagcatgcggtggttgttgcgctagctggtgtttcggatttgtaaagtgtgcattattcacatgttttttattgtgcatgttaattaagatcatggttgcttggatggtaaacggtaacataccatgggttcgtactataaattgttcatgcgcattctcacgatgttctcttataccctcgtctctctctcatcccttgtctaggactataggtcttgtgagtactcgaaaagtctagaatatcaccccacaattatgaggggaggccatgtatggtaattctagatagcatacgacaagtgcaatgtaatcatggcgttgattgtgtggagtttgttagaaggtatagttaagcatgttatggtttttattatgcttgttacgattatgggttgtctagtaaacgacaacaaactatcagtttgtgtggccaaaatcttcatgtgaattcgtgatgtttcatgtacgattataagaaaaatgaggtaaacctacctaaacgtacaatgccgatgagtaatcttccgctaggattatatagtctcatgagaattggggacttctacatatttgttatatagtctacatatttgctgggattataaacaacaacgcactattagtttgtgtgatcaagatgttcgtgatgttttgtgtatggttataattaagaaagataaggcaaagctaaaagtactatgtgacaagcaatgcttacaaggttggtaggttggattttgatgaagatgcactaaagctatcgctactatgcgaaaagtggtctatactaatctcagagtagatacgatatagtttgttaaaaagcatatcaaagcttggagtgtttgttgtgatagtatttcaaattttgcaaggcacgcaattacttgttttttaatgcttatattgtgattatggatctacgaagcaaacaccaatatttcaatcattcaaatagcttgaatgttcatatgaatttgtgatgttccatatagtattatatgtagtaagaaagatgcataaatctattggtattgacgagcgatgtcaagtagtcaaattgttagtggcttggcttggtacaaggatacagctaagtacgtcgtagccatttatttggctttccactagatgattttcacatgataaagaacatatcacatatgatttatacagttgaagtgtttacacatgaactcactatacatagaacaattaattcagcatgcaatattctggagaatcaataaacctgtataccttggcaccttgcttcaatataccatttttaaaagttgtgaatattaaaacatagtatattaatatacgcgtgtgaaggatacctgtatcaacattgaagtttagatataaaagtagattttcttctaaagagggaggggtcgtaccataagatatcataaacctcaagcatatccaaaattagaatcacatttatttgaattttttagttacatatttatccgctctaacattatactctctgtgtttacaaatagatgatttaggatgagcacagtcaaacctcgatatcttattggctatctcccccctccctaaatatcagtatctttgttcctaattttcacaatatagcaaaaaaaaagtctgggctaataccatatatgttcatgccatacttttttagccagctagcctactagttatgcacacatttttttttgtcataacttgttacaattgtgaccaataaagtgtgagccacaaaatgtgtgacatgccatactttctcatttgtttttagataggtggggatgccatccaaatagccccttgaatgtgccaaggaaaaataaatactgggagacatttaatttccttttattatgcacacattaagtacaataggtttcctaaataatgaagcaacaaagtacaccgaatacatatacttttgtgaactgtgatgaagcattacaatgctggacacacaattaatattggctgtgtacggtacggtgtcaaaatggaacaaacaactacaaaagggcacacaaattaaaacattctgagaaaaatgcccttttgtcaaacctgtgttagtgggcatggcactattaacaaattagcatctcagaaaactataaagctcctgtattctattagctgttgccttcacaaaagagaaatgtctggacacaatccagaagtattattccatagctgacataaggcaaagattcactcacccccatcgaataattcctctgaaaatgattgctggtcaactttgtgccacagttttattttttgtttttctttaacaaaagggaagcatattggatatgtctgtgatctagtgcaggaacaaacaagagagatccagtccagctagtgcaagcaagagtagcagaacatgtttggtgtgatgagagattccaaacagatcgactgatcaaacagcattgcagagaattttgtgtatagtaaggtccaggtctggatgtgatcatgtgaaggattctaattccatctccagtgacatgcacttcagtggacagtcccctgtatgactatccacttatgaactgttcagataagcttcagtgattgattagatatttcgaagaagatgaaaaaaaaacactatctggacaaactggatctatctcttcttcatatctcccgggatgatgtgcgtgattaatatattctttttaattgatgaaagaacattctccttttttttcagattaaggatttgtcactcgtctcaattgttgctttagtttatatggtttttattcgccgaaaggtttgcttcatttgaaacctgaatgaagttgaaatttctttgtttcacaaatttatatttctaaaataatttggatcaaagtcaaaagcatgaatatcacaacttcaactttggaggcaaattagaattgataaaaccttattgccatagaggaaaaaacatattgaaaaccctgttttctcttctatcactacaagattgcagttccctcttttactttactccactcatgctccttttccttttaccacttgtccacttccatcaagtcaacataattgatctaaccccaccaagaaaaatactaaaattatataaaattcagaaaaaacaccagcacaattatcacggcttatcagccgtgaaaaaaaaatgaacaacataactaaaaataattaataggtgtgttcttatcgatttgaaagctaatactagaaaatgaactacaataaaaaaacctcaaccctaaaattaagtttcacaattcaaattttggtttcagctgaacaagcaaaagatggagctaaagaatactaaaaaggaacatcagcaaaaagatatataccatcataattttcagatatgattttatagaaatctagttaaatttttagaatcttctaggactcatgtagccgatggtccatgaaaaataaactttgtagcgtgtacgatgggcagacaatgggggatgacacggtgccacgccaggtaccggggctatggaatgtggattgccttgtctcagaacaccacttaaacctcctcctctctttctttgctcctcccatcgccatctccatcacctcatcaaaaggtccctccccttgccatgatttggtcatttgcctgccctcattgaggagctatggcctgagcttgccattttccaaaaatggtgcttaggtgcactgttcctgctaggcccaaccccaagtgcaaccacccacagcaatcagctcagcttgcagcctcaatggatgcaccaacattttcatgtgcatcaacagcgacagatcaagcaaagagccatagatgaaataattgtgtaagagaaagaaaaattcagttagtttccacatacaaaagcagaccaaagtgtgcgttaggacatgaaaccttttttcagacaaagaaaggacatgaaaattcagcaggttaaccgattctttcaatctttcctgctgaatatctatctatagtcgatattaattcactggcatatgcatttggctgcattttttgtgtgtgtccttgcttggctgcttaatttgcatcaagaaattaactcatgaaaattaaatggccctagccaccaaagatatgtgtaggatgctgactgtcgggaggccattgatggtggctgttccctcttcatgcttcaaggcccagacagcaacatggagccatggacagagtctgcagacattcttgcatgatctctcttgtgatgaaggaatggccacgttgaggtgcttccaaacaaacacaatttcaaggttcagaatttcagacggaaatttttcagttctttggcttgttctgcatgccattgcctttgggctttgtcactacggctgaagtgcagagtgactgactgagtgagtgacaagtaggatagatggagaatttaccagttaccgcaaagagaatgtaggggctggctgtttaatttgtttttgtcaagtgcgattttacgatccttgacgaggtactatattttccagtgtaaaatttgatatctcttggtatcttcggtacgaggagatatcaaatttgaactaaaaatttggtactacctccgtttcaggttataagactttctagcattgctcatattcatatagatgttaatgaatttagacacacatatatgtataaattcattaacatacatacatatatatatatatatatatatatatatatatatatatatatatatatatatatatatatatatatatatatatatgaatgtggacaatgctagaaattattataatgtgaaacggaggaagtacctcttattattttttaaggaccgtaaaatttctcttttgtcaattattgataaaaaggaagctttttattcttatttttatttatttacttatttatttatttatttacttttttagtaggattaggcccagcttaactggagtgagagaaacgtaaccgggcctaaaatgcctgtccggctagagttaaatctaccctggcccagctctatctactaaacagtttggttcaacgtttgctttctaaagggaagttaattctggtgtccagataaattttaataaagtaaattgaattgacggtatccgacttgtgtcaagtgcatataatgtagtacatataaactggaaccacctatacatttgtcgataaattttctcctaaaaatttgacagatataattatagtacaatcgtagtgtaattacactgtaacttacatgtaactacagtgtaactttacacttgtatgtaagtttcatgaaattttgaatcgttagatctattacaagatttgttatggtgaggaagaaaaaaatcacagcacacacatatgtgaaatgatttgttcccacgaccttcattttaccgaaataacatgttatagataaatttttgaaagttacgtacaagttacattatagttacagtgtaattacatgcaagttacagtgtaattatactacgattatactataattacatctgtcaaattttttggagaaaatttgtcgacaaatatatagcaaaattgtataaactaataagcgctcgttttggtgcaccaacttgtacggcgagtgcccaaggataaaaaggtactatatgaccaatcttgttgattaggatgtaacataagcatgtatataaaagaaggatagaacaaagaaggataaagataaatttagaaacaaagtacatcgttgtttgcaaagatagcatgtctcatgtcctcctcacatggacacatcatgtttaatcaatatctgacctagtaaggttagctacaccgtgccttttatagccttgttttgtactccctccgttccataatataaccgattttggtggaatgagacatatcctagtactatgaatctggataactctctgtctagatttgtagtactaggatgtgtcccatcccaccaaaatcccttatattataggacggagggaatacacaccaagcaagttcgtccatcaaaacgagtcatttacaagtttatacactagattgcatccatatgataagttcgtgtacagtcaatgcaatttactttacttttaaatgaataatgtcacgacttaataacaaggttttacggatttgttgttgatctgtctttgaatgagtctgggtgtcaaggagaccacattcatgcataggtagcgttgtagtagtggtgctccgtgccttcgtccgtgttccccacgctttgttgcaagaattactaataaatttttaatatgttttttaccaacaatcgagctaaaagtaaaaaagaaaaataataatgaaatattagggtttattggtactaaacttaaaatagtcaaatgataccaatgctttagtgcagaatatattgataagtatacgttaagtattataaaaataatatatatagatatgtaaaaatattgtggaaatgatatggtggatgatgattggatatgtttgcatgctgatttgtagaattcaatagattatagattgcatgcttgcatgaggtttgatatgtaattatcattagcgaatgatgatgtgatatggttgaatgttgagctttaaatttagtgagttgtaactttatagaagatatagattataggttattgtccagaaacctaaattgcaggactttgtcacttcggcttgcctacatttggaacaagtgatcaaggagttttttaccccgacatatgggtggcgacctagtcttcgggttgtagggccttgatcttgcacgctgtttttttctcttattttgtttgtgttggagtttgctggctgtgtgcactgtcatggtgcaaaggccagaagtatcctcagaatgaccgagatcaataaagcttgtattatataaaaattagaccagaaaaagaaattttgttaaatccgtaggctcttgaaacatgtaaaaatagccacgttctataaaataatgtgttttactttgagggtctgccgctcacacaaagggcgcgagtgtgccattagaaaagctggcgcacacgtgcggcctgcgggtctcacgtgatttctttagtgaacatgattttattttcatgatttttttattttttttcacatgattttttttcgtgaatttttttaatcacatgcaaatgttgagtaaaaaagtttttaaaattttagctcaaagtttaaattttgagtttgaatgtttttaaaatttaagttgaatgttttaaactttaagatgaaagttttcaaatttgaattgaaagtttcaaatatttagttgaaagttttcgaatccgagttgaaagtttcaaatcttgatttgaaaattttcaaatctgggctgaaagttttcaaattaagtttaaaagtttcaaatctggacttgaaagttttcaaatatgagttaaaaagtttttaaatctgagttaaaagttttgaaatcttgacctgaaaattttcaaaatctacgttaaaagttttcaaatctaagtataaactctcagatatgaatttgaaagttttcgaatgtaagttgaaaaatttcaaattttgatttcaaaatttttaaatctgagttaaaagtttgttcagttaaaaaaaagaaaaaacatgcgcgggaaaaaaattttccgcggaaaaaacaagaaacatgcggggaaggttttcttttcgtgttgtggaaggagaaatggagagaggatcctctgacttacttccgtctgactttgagtcactgacacccacacgtcaatgacataagttagagggaaatatgttagagccttaggctgcattcgttacctctcgttcccaacttccctcactcgttttctgcgcgtacgtttttcaaactgctaaatgatgtgtttttttaaaaaatttctacacgaaagttgcttaaaaaattatattaatccatttctttaaaaaatatcaaatacttaattaatcatctgctaatcgctgctccgttttccgtggcagggtgagaggttccagtcaggagaaacgcgtcgactggcgatggcgagcgaaggaagcagcgatgtgaagttattgcagattgccccataaccttttgaactaatcacaagctcacccctctcgcttcgcctccaaagcccctacccgccgccgccgccgccgccgccgtcgcccgtcggccgcgagccgctgattccgggtcgtctccggcgggaggatatgctccggcgtcgtctcgtgatgcgccaggtgatctctagctctcctcccgcaaacactcagccggacgcaatgcaggtcgctgatctccttaattatcttgcccccccgcctcatgcggccgcgtgattaatttcttactcgtagacgagatcgatggttcttgttcctgccaaaaggggtggaatctaatccgtgtcgctgatggatcgttgaggtgataagagatcggagattttgttctgggatttgtggtttccctttccgagggagaggttagggtttggttaattctgccgcgaagattagaatgtgttaatccggtccgagtgagaaaacaaaatcgattggtgggttatgggcttttgattgatttgagccctgcgtgcttgtgcatgacatttggcccaatatttcttcgtgtcaaatgttaggagtcgcattgtcccaaataaatgcctgtgaaattagtttattaattaatttctataaggttgtctcaactcttgtcatgatttggcagtagttttttatgcttgttttcaagcttaaagagttgaatactgaagagtataatgtctgtcgatatagtatagataggaaagagggttcgatgaaatggacccgatttaactctgctttggacactgttttgcggttcatcatacttgaatacttaattgatgtgttatacatacaattaatttgtacactctcggtctctccatgttattctcacacatagaaccagttcatttgttgcctgctatggagcacgtaatgctatcccataacacatcatttgttgtatagtcataagtatttctgtttgtctctgctcagacactctgcagaatattgtgacatttgtgaattgcgtgtcaacttccaagttctttgattcacagtttcacaccatgcgaaacagataaccttgcatgggttagttttgaattttacagttaactatcatccgggaatttacatgctttatttgactagtcagatgcaaattaaagaatcacaatttccttctacatatttcacaacaatcattggtgtgaggtcaacatcaaatgatcatattttgtgctgtggaccctcttttctgagactccgtcatacaatcagattttcatttttttttctagaatctagattgcattgcttagctgctattctaaacaattgaaaaaacatggatatgaagatggtttttttgtgcaatttgtgttgatctacatggaatgaatgctcccaagatattaagaagaattttctgtttcagtcctacgttgatgtgttgaagtgaactagttggccatgatgtgcatatcactaacataatgaatgcctaggaaaaaaggtactaaatgcatgaatgtggccccgtcggcaaatgcacttacgcatggatagataatgttgtgtcacaatcttaggcatacatctgtacttgttgaaaactacatggatctaacccatttcaaaagtccccaagcgtgtctttctaatgcatgtgaagcaactagccagatggctttcaaaacatcatggagaactgaagtacaagtttggccaaaaaaaaaaatttgtgcatccatttcagttggctttgtaaacttattagggagtgacttcagtaaagtatatacactgaggtgagtttactctagtatgtcataaatattgtttgggtgttgtacttactgtggagttctttacataggctggtacaaagagaatgttaatgtaaacattagtgagcacactagcaaagttagcatgcatgcaaccttaatgtaggattcaaagggttgttagcttttgaagtgtcatgagtatcccaattggggagttaggtatgtatcctcttagaagaagtaaatgatgttagtagtatagacgatgtgcttattggcattcggctttctagcatcattagaagcacttaggaggtaaatttgtatctgctagtagatggaaacaaccaggggtaatccatcaggctgtgtcagctatttcattaaactcaatttgggtttgcaggttcaataatttggaagaaaaagtgagcaaggcaatacttccaagtttggcatggactttatttattaccatgttcactgccttgcattagtagttcaaaattccctttgatggtaaggatgtaaaattgtgtttgctgggcttacagactttaaatatgtagttcaggaaccatgctactgattcaacatgatagcaatctcctcttttctttttccataaagaaagaatgtcatttacatattgctgctctcatttcaggattattggagcactatggatagctgtatgattttgtttcttttccctaggtcaagcacaatgaatcatattaattcacaaaatgcttgatctcattgtaattcaggtatatgcctttggcaattattcttatatatggtcagttaaaactacttaatcactactggtgcttctatgcttgcttatttcatatgttgttatttcttttcctaaccacacttaagcatgtaggaacaataacaagttagcttatcttgtttctgcaaatgctaatactttagttcaccatatttggcactatcaaagtggcagcagtgttcggcgatgagatattttgtgtatgtatacaacagtaggggatatagtaaatatgttatctggctggcaattgccaaagtttgaactttgaactctctattcagctccttttgtttttttaacaattactacctccgtttcaggttataagactttttagcattgcccccattcatatagatattaatgaatctaggcgcacatatatgtctagattcattaacatctnnnnnnnnnnnnnnnnnnnnnnnnnnnnnnnnnnnnnnnnnnnnnnnnnnnnnngcgagaggattaacacaat

SEQ ID NO: 83243 - DNA, 1306 bp, Oryza sativa
cagacataataaagacataagtgcgatttataaataacaatcgctaaaaatgagttataatctattatggctctttcttttaacctatcatggaggacatactacgtcatacgctcctaccacgtgttgacgtcatcgtctcctctttatttctcgcttgctatcccctctctttaatttatctctttctaacatatatactctaactcccaaggactcgagccagttgttgcctccttgatccgtcctcgaactccagccatcatcgcctctggccccgaaaacgagccgccaccaccatcttcaccccctaaccccaagcaccggccaccaccttagagatgccagatccaacctccctgatatcggagacactgaatatgctctccttaacatcatataggtggctagatccaatgcaagccaccatcccctaagccccgagtgctagtgagcctctggacatggtagtgagatgtgcccgcttgtatctcggtggcctagtagtatgacgggcacaaagatgggcttcggaggtgtgtagctatatgggcatggcatccggatctggccacccccatcttggtgaccttggtggcgcagtaccgctggggtctggcaaagatgacaaggaccatgatgacgagcacaacaacaacaatgggcttcggagggggcatgcgatatatagtggcacctttgaatgggcatagggcataaatgaccaacatgtataggcatcgactggcttgtcgagatcgtcaaaaagtacaagatcatctccagaacgctcagcctggcctcaaccaccaattcctatatcccttccttctcctgaaccgttgggccagagccaaacaaaaccccttccccctccccttcctcctcctcctcccactctcacgccccttcctcacctcgcctgagctgacaaacaatagtagcagcttccctacaaacaaagatggggtatatacgcacacgccaagtactactcaggcctatagaacaatatcacgcccttttgcaagtctattttgctcatcataggcttcagggtcagccgctgtatcacccccaactatagatggtcatgtgggccacccggcacggcacggcccaagcccggccgtgctgggccgaggcttgtcgggccggcacggcccgaccgatgcaccaggctgtactgtgccagctcacgggcggcatacacggcccaggcacggcccaatactactcgagccgtgccaggccggcccgaaggcacgatgggctatcgtgcttcctcacagaaaatgtctaattt

SEQ ID NO: 83244 - DNA, 583 bp, Oryza sativa
ttatccttcttctcctaatattgaatgaattagcatgttttgatatgttccaagtcagctaataagtgtatcagttcattctggttcgtagttaaactttcttccaaggatcgcaactctcttaatctaggaggatttccacaaatgtggttcttgcaagtttgatggtgtttagtgtccatctcagttacttctattatgatgtttgctgatgattagctgtgttgggttacccaggaaactgaagcaaagaagaagagattacagatggagaagctcaagaaacagaggcttttggctgaagtcaagtaagggcctgaactcatcatcttctccagtgtgatttacatgcctggatgattatgctctacgacaatgcaaacatgttgatattgtctcattatcctgcgcataattgtgccgcgctgtaggtttttgcggaaaaggtacaaatccatgtccgaaaatccatcccagacgtttgtctatagagtaaagaatccggcattgccgcccacattgcggcaacctggttggtctcatggtgaagagtaccacacggttcgggctatcggaagctcta

SEQ ID NO: 83245 - DNA, 884 bp, Oryza sativa
ctcaagtatagtacaacacacttgtagttttatttttagtatgttggcttagtagaaagtgagggaaagctccagaaggagtgctccaaaatatcagagttcctccaagaatttgatggagtgccggagtgttggcattcttctaacggagttctagagaaagccgggattgtttgccttcttctctcgcttgtacctcgatggatgcttcctttattaaagtaagtgtttgagtttctttatgttctttaactagtgttggtatttcttatgttcacggataaatccacaagagcacggaacactgttgtaacacttccccttagtgtattcgaagggtatcgaacacaaggaacatgtgtgtattatctatgatcaagattctatccaatgacaacaacctaagataaagtggctagagaggattcatatgtcttttaattagttaattaagataaaggtaagaatctatcaaatgcttcaggcaccggtcctcccatggtctgctaggacaagtccaccgttaagctctatgatgtacccgaacatggagagatacgaaggatggacagggctgtcaccacctaacgcctatctcacttttcgtggagcacacaacaaatgaaggtaatttctaacctatacacctcgccattactactctagccttgcacaaaaacttcctcctctatccaaagacctagtactagagcactcagttgcacactaagcgacgaacccacaccgatgagaatatactccctctgggttgataatacttgtcattttggacaaggacacggtctccaaaaaacaactttgaccattattttccattataatacgtataaaagtgttaacaaatatatgattggtaaaatttg

SEQ ID NO: 83246 - DNA, 1162 bp, Oryza sativa
cggtcaaatagccgttagtgccacgtggcgccttcccattcgaccgccgcccgccctgtccgcgcctgacgggccgccggcgtgtcgtgtcgtgccgtgccgcgggccgtgccgtgccggcccgctacagtagccgtgccgtgccgtgccggcccgcgggctcggccagcggcccaagcacggcacggcccgttactgtagcaggccgtgccgggccgtgcctgctacaggttcggccgtgccccgggccgcccgtttggcccggcccatttggccacctctagagccgatcgccttgcaaattgggccaagccaaggttaatctgaattcgaggcccaatactgattcccggcgagtccaagcgggccgaatgaataggccgcgaagcggcaaggtaagatggcgcaggcctaatggtaaggagccgactgagaatagtgtccagaccattataatttgtggaaaaagtacaccaaaggtccctgaacttgttcgagttaaaaaaacgtccttaaactgcaaaatcagatatccggcgtctcttaactaatcaaaaccgtcactttagatccttcggtgattttgatcctggttttatccgatgtgacggctgagtcagcgtgggccccacacgtcaggataccacgtcatcccccccttctctcctcggttcctcctctccctcagtcttctctgcctgtagccgatcggtggggctagcggaagaggaggaggacggcatcacgatggtggccggcggctgccaaagatgggcctgggaaggcggcagcaaggcggaaacggcacgggcgtcgatagggaggcgggggtcgtcgacggcgggcgcgatgctgtcgaggtcgctcacctcaccgctaccgggatcttcgacctcgagctcacccgtgccgccactaccaacgcctcccgggcctctccgacagtccgaccccaaggtcgcacgcgccgccactgcctcccttctcaagcgtcgcagccgctgccgcttcccttctctcgtgtcgtcgccgtcgccgctggggtgatcgagataacacgcagccggcggcggggaaggaggcgcagctgatagatcgataacgatgcccgatgattcgatatgatgtttttgaaaaaaaatttaaaaactaaacaaggcct

SEQ ID NO: 83247 - DNA, 3680 bp, Oryza sativa
taattgagtcaaattcagctaactcatccaatttcatcttatttgggaatctcatatggaacactcctttctcctgcattctggccttccaagtctagttccacttgaaatgttgagtgaatccttcctccagagcctgctcagtaagatcacctccccacataattgtcacaatagccaaagggttaacatgttctttttgcactatacccttagcactctgaatcagcacacagcccagacctggagcagcacatcccactactttagctacaggtttcttctgattcttcctaaagcaatcctctgtcctatgagtctcttttgcacagatcatacagaacactgacaatttgcaacctctagacaaatgactgtaactcctgcatttagaacaaaaaatcctctgctgggaatgggattcaccaacctgatgcttggactcatctcgattttgttgctgatttggctttgcttccaatcctgaactgacagaatccatcttagcacttgattcctgtagatttggacctgcttccttccttccttcagtttttagtgtgtccttcccctgcttccccttctcctcagcagcttgcagcattttctcatgcttcgccttcccatcctctactcctcaattcagatctagaggtggcggatgtggaccttgcggctcctgtctcccaacctgcaaagggcggaaacgtccccttccccctgcatctcccctccagaatcgattaggcggcctgaaaggtggacgcggcctccatcctccgccttgatttgccattggagagccgcttcttaccaccttcgcgaaacttcagccgtcccctcgaacgctcgccgtccactcccgccgccgtccaccaacgcctacccttggtcactcctccacttctctcacctccccttgcgtctccaccctctccaatctcctccacccgccctggaaccctagctcctcaagactagctccccacaggtggtgtagaaacggagtcaggagagtcgactcaaaggtgttcgaccgatccccaaaattgccattgttggatctcgacacgtgttgcccctccacctctctctcccccactattggatcgggctgaaaaccatgggcttcctcccccccccatcaaaaactctttcgcgcgctgaggagcactctcccaactcccgaaggccatcccctccgccgcgaatcaccgccggcgatcgtcggagcgccgcgggtgactccctcgtcacctctcctaaggaaatcctagccattcggtcccaaacggtttccaaactcacaaggcaaattgtccaactaagcacgtacagcaagaaatataacgtgtactatgtactgctgtttaatgtacgagtataatactattattgatgcatatatacttcggtttttagtacgatctcctcgcgaaattacactgttgactaccttaatttgtccttagcttgctctggaattttttcaggctgaactgacccatcagggtctttagtggcacgcaccgtactttgtattagcagggtcctaaatggcggccaataatattgcatactccgtacttgaaacatgaatctcccatgatggcattggttatttcagtgattagttcataattgagatcgtaatggccttcgtgaaccaatgttcaatgttcaatcctggggcacggcgagctgacgtccaccacgacgtcatcctctttttaaacgctcaacctttgatcaaagtgagtttatctcacaccacacctctcagagcttatcaacaacggaacctgaacattttttttcctctatggagtagtgtaaaataataaatgcactctcacactgtgacacgtgttctgctcccgggccttaggtttttttcttagtgatccatcattacaattttctttttcacgtacggcaaaatttggaattatgcgtaactgacgtatataagcaacaaagagaaaaaaccaaaactagaacaacaggcactaagacgtgaccgtgcttgaccaggtgggaagccatttaagcgcatccccacgagttttaatttctgaagcgattcaatttgtccacgatcgagcagtagctgtacgggtacgtggttcgctgttcagattaatgttatttgcgctttaaaaaaagattaatgttatttttaaccatatcatttttcgataaagttattaaaaatatgtctatatttaatttattattaaactttgacaatattataaacttaccaaaaatttagtaaggtttattttggctgaaattggaacagcctctccgtattgattttttttttcttcaccccgttcacgtccagaagcacaaattttgacgtacagtcggcgtctaccccgtcgtcgcgtaccgagtttttctcccctctagttgacttcagttttcccctgtcaatcgccggcctgtcgattgatctgtgatcatgactcatgtgctgcggactactggtacaaggtaacttttgatttttattctggttctaattaattggatggttagaaaaaaaagagagagatacatcggactctttagaattattcttttgaaattgaatataaaaacacacatgttagggataaatcccattattagaacttgggttaatagactggaataatgttcttcttatcctgttttccttatcctgtttggttttcttttttttaagttggtttcttcaaacttttaacttttccatcacatcgaaactttcttaaacacataaacttccaatttttccatcacatcgtttcaatttcaactaaactttcaattttggcgtcaactaaacacacccttaatttagactacactcttctaaagtgctatattataataattggttgtagctctcttgagcaaaggccggtatgtttcatttcattatcttaaaaaaaataaaacttgggttaactaatgtaatacaaactaaaacgtcctcatgataataccactctcataaaaaaaggaataatgatgtaattttcggctacacatgaatagaaagagcgtcaagagacaataacctctcctcactctcctccctctacctgacattagcaagggactcttcacaaagaggagggtcctttgtcctatttgttccaacaacacccatctttgactattagttgaatatttaatttaattaattttgaaattctaaattaatatttagcaagttgtagtaaagtgggcgtagttcaactagttagatttcttatggtgtaaacagcacactcggtttcaagtcctagacttgaaacgagttctctcatttatggccaactattattttagtgataaacgacgtacccatcgacgtatgtgtgtttataggggaaagtgcgtgcacgtaatgatatataatatgtctttatcatattattgaggagttaatattgaaaatctcaacaataacaattctgtgcaacttacggattaacaactaataaagctaaccaatatattggaaatggtaatcaactctatcatttgctcttcagcttatcaggccctgtttaaatcctccaaaatttttgccattttgtagcactttttgccattttggatctaaacactagtagcaaaaattggcaatttggcatttggcatttgctagtccatagtag

SEQ ID NO: 83248 - DNA, 6723 bp, Oryza sativa
  unsure (1)..(6723): unsure at all n locations
cccccccccccccccccaatggcccaaggtacggacacggactcttatggccacgacagcgacgcagcagcttgaaacacacacacacacacaaattgaaaacaaaaaaaaaattcacaggcaggcaggcagacacaacctgaacttggggaggcgtcatggctctcgtatgaatccgatcccttttctccccccggaagattattgctgttgcctcgtcgcttcctcggctcctcctcctgctgctcccctccactccgatagatagtccgatcctcatccgtcactcactgcgttcctccgatctctagctggtaaaaataggcctagcttagttcccaattttttttcaaaaacatcacattgaatctttggacacatgtatgaagcattaaatataaataaaatgaaaaactaatagcacggtttgtatggaaaccgcgagacgaatcttttaagtctaattagtctatgattagccataaatgctataataacccacatatgctaatgacgaattaattaggcttaataaatccgtctcgcagtttccagtcgagttataaaattagttttttcattcgtgtccgaaaatccttccgacatccggtcaaacccacttccgatgtgacgcccaaaagatttcttttcgcgacctaaacagggccatagtcggcacagatcatttatgttttaacaaagtcagttacctaatcccctgtttctatatacaaagatgattttagtatcttcgaaaaattttcgggaggtactatattttcagtgtaaaacttgatacatctggatattgggtatctcgaggtacactaaaatttataaacatttaattatatgtttttttctgtatattagataagaggaaaattttccttccaatctttccattacgatcaacttttgaattttaaattgtctgaattctgctcctaagcacctaattagctgataatgaatcctacattagaattggtgttctaaaattatttatattattatgcataaattttaaatgctagaaatatttatatttggaaatcgagagagcacctgcttactgttcttctgcatatggagtatttcacatgtctatctgtcagtccagtcggattggatattcgatccactggatagtgagatgtctttatagatgtttggtcatatatatttcatcacacgaactgtcgaattaagtgccttccgctagtatatgctgactttgatgtactcatgtgtctatgtagattgatgatgaacaaacgacagatattgcgccggtcctatctgatcagaattaattaatcagttgaaacttggaacacaacatgaaacgcgagttgctagctgataaagttgaaagttgaggactttgcaacggagggaaaaaagaaaaaccaatcctatgaaaagcttcgattgcaaccttgccttcggtgtacacgaggattatatacataggattttctcactttgcatcggtctcgtcagaaaacggacctgatgaaaggatccttgtcgggtgacccaaatactcctctgaattgatcgatgaaactctatcatcctgattgaccattgcaccacataaaaacgatggatttcaatcgctaaatgtagggtgctgaagtgctttgctcctgaatcctgatctagtaattccaacgagaatcatctacagtcatgtccatgtattaacagtgactgacctatatacgggaccagtcttacatccgtgaactagtaactccagactaaatttgatattgtcgtcgtcagttcatatgcactttttttttttgaaaaagggagggtatctcccccgttttcattaaagaaaacgcagatgattacaagagttccagaacaagttcttacagataggacgagaaaaaaaggaaaacaaaacagttattacaggactaaaacattggcatttcaagcatcaaaacacaggtttccatcgccgtcttcaaactcctcgccatcagtttagcctgcctctgtttcccatcctattctttgtctgccgcccctccatccaaattttgagtgaaagatctcatttgctacctgccttagtagctgcgccccccactgcatttttcctctgtctccctcctttctctgcaaaatactccaagagtttaaatttgagcaaatggtgtaaattatttctataggatcaacaggcagaattccatcaaagcaggctctgtttcttgctttccaaatggtccacaagactgttgtaacccccaccatgatcaacttcccattcccttttccaaatttcaaaacccaggagctaaacatttcccccacattcctgccaggcttcacattgagagcgcattcaacaacactccaaatgaagtgagccatggggcaatctaaaaacagatgttggatggattcactcttgtcacagaattgatatttaatcgagcccttcctccaactccttttgaacaaattatcttttgtaagaatactatttcttagaaccagccaggaaaaaactttcaccctgggtggtgctttgattttccacatttttttgtagggataattgatcccctgtaatatcaaagctctgtagaaagatttaacagagaaacctttgttagacagtctccaaatcagtctgtctttttcattagttagactaacattgtccagggctctaccaatattagcctattttctctgtttaactgcatgtaggtctctcctgaatttgattgagcctaaccctctctttttgatctctgccacagtcacatttttgtcaaggttatgttataaagatctggagcagactctttaattggtttacccctcccccccaccaactatcttcccagaagagggtactctccccattttccaccttcttgtcacaaaatctcaagaacagctctttgatatccattaaaccagaccaaaagtgagaatccccattcttatgtttgatttgaatcagagttttctttttcaaatacttgtttcttaacatgtcttgccacaaatcttctgtattctccatattccatggtcatttccccaacagagctttattcattacatctaaatctaaaatccccagccctccctgatctttagggaggcagatcaccggccattgcactagatgatatttcctaatactttgatcttcttgccacagaaatctccttctacaaaaatcaattttttctctaactccacaaggaagagagtatagagacatcatataaagtgggacactgctaatgctagagttaatcaaagcaaccctccctcctattgccaggagtttcccctgccaacaccccaacttcttctcaattttttcctctacaggtttccaatctttgttatggattcttacttgatctatgggaacacccaagtatttcattggcagtcttccaatttggcaagtgaacatttggctatatgagtcctgtctctcagctgcctctcccaggcaaaacacttcacttttatgaaagttcacttttaggccagtcaattgctcaaaaatacacataatgaatttgaggttttttgcatattccagagaatcctggatcaggcatatggtatcatcggcatattgtaaaatatccaccccttctctcatgacatccattcccaaccccttgattagtccctgttgctctgctcttttgataagaagggttaaagcatcagcagcaatgttaaaaagcaagggtgagagtggatccccctgtctcagccctttgtgtgttgtaaaatagtgccctatctgataattcactcttatggccactttcccccctttaaccactttcaagatccaatcacaccatatgtcagggaatcccttggccttcatcattttatacacaaaagaccacttaatattatcatataccttttcgaaatcaattttgaaaagaattcctgcctgctttttttgatgaattgaattcagaatttcatgcatagttacaaccctttccattatatatctgttttttatgaaagctgtttgattcaaagcaatcaagacttcaatcacctcagctagcctttccatcaaaatttttgttatgattttgaaactcacatttaaaagacatattggtctgaatttctgtatcattcttacttctttgcatttagggatcaaagttataacaccataatttaatctctcaactccaatttttcttttcatgaaatctatgattagttccatcaagtcatccttaataagataccaaaaatgtttgtaaaattccacaggaaatccatcaggcccaggggccttattgttttccattccaaaaactacttttttcagttcctccatttctattggtctgattaatctctctttttcagcttcactcaacatagctatgccttccagattcaaagtaaaatcattctctggagggggaccaaaaagctgtttataaaaatttgttatatatttcattagatcactctgtcctttaatctccccatcttcctgatccagagaataaatcatgttttttcttttccttccattagctttagcatggtaatattttgtgttatcatccccttctaaaaggtttttttctttacatctctgcatccatttcaatctatcctctcttactactttcttcaactcttcctccaatcccctctctcttttctttccagaatagtcattccatatgcttcacattttttatcaatgtcttctattttccccataatttcctgttttttccttttgtacatcccttcccagttcatgttccaaccttttagtttctctctcattttttgtagcctctattgccatttatcaatactggatccatttatattacaagatttccaaacttgctcaaccacagtattaataccttctctcatgagccaactattctcaaatttaaatagaggagactgccacttttctccctcaacattgatcaaaagaggagtgtggtcagagtaaattctctctaagacccttccacatgccaaagggaacttaatctcccatttatcattaaaaagaattatgtccaatttttcaagagttacactttgtttgttattagcccaagtgaattttttcccttccaaggccatctctctcaagtttgcattctcaattatagaattgaacataagactccatttattcacccctcccttcttgtttttttcattctcttgtctcaggatgttaaaatccccaccaattaacaggggttcatcacacccataacaatcctgagctaactccctcaagaactcttccttgtgttcaggttgagctgccccatacacagttattaatctccacacaaaattgtcatttctattttttactttaacatgcaacaaaaaattcttcttggaaacttccataatttccattttgtcttcatttattccaaccaacatacccccagatctacccctaggaatggtccaattccaactaaacttaccccctcctcctattaaatccaagtctttagcagtgaaatcctgcttcacagtttcttggatgccaatgaaattaactttatgctcttttattaaatcattgagatgctttattttatcatgatcacccatacctcttatattccaaaacaaacctttcatgatttcttttttgtttttttcttctcatttttgccactacacttaggagtgaccttgaaaatctcaaggtttcctctgttatttttcctcctcttttttcctgataaattgctttgagaaagtctcaacatgttttcagcataatcaaaatcagacatacaatcatctgaatgtaagacttcatctatgtttatgtctatgttactcaagttctccccaacattttcacactcccctttctgagaagtatttagtttctcttttaaaaacagatttatcntagccaattccagatttttgattaagttcagatttgtatccacagcttctagagcacaatctaaattaacacctaacagactagccatttgagctaaagaaaaattactttcatcaactatagatgggatctgtttgttacctttgttgatgaaagcattaagagcctttttcctttcagctgcagcatcagccaccttcttgtcttccttctccataagtcttagacttttcttcttcttctcctctgtcatgtcttcatcagtctgagacaaaacaactcccacagctacagcaaagtcacttgattcttgtgattccatgttctcctcacttcccaccagttgcactcttggttcatcttcatcataaatcacctcctcactgtcattttccactctttgactagtaccacttttatctgccatcccctcttgtgtcttctttgttttctcattttccccctccccagcctgtgcttctctgattccaccctctatcatccctcctgctacatctttatcaagttgaatctgcttgactttaaactgttcttctagttgtactctcagagccagctccctatctatctccatctgtttgagcttcaccaattctgcttgagcactttcattgtctgaatcctcttccacaactatggctttcttcttgtcccctgccttttccaaaacccccatgcttgatgcagcttcttctttccttggtttcttattcctctgcatgtgatctatg

SEQ ID NO: 83249 - DNA, 55066 bp, Oryza sativa
tccatggtgaataaggtgttctgcaacagtagtatgagtgattcaacatctcaacagcttacatcggatactacaatcgaggtaactaagtcttaggctctctcctgactctgtctttgtctgaacatcatccgaaattactggacacaattagcttcttgtgacaaatttccaggttacaattgatataccatttccatttcgagcattacctgttgaagccattgaatcaagtggcaggcagttcttgagcaactactccgagtcatgcttccacgatttttgaagcaggttagttaaatacatttttttgtttccagttaaaactttgttgcaaattctaacaccagtcaagacatcaagtgaaggcagctacttttatttctctcgtattaatttgacacctgatgtatcatagatagttcaccactatctgttttctattgttccatgttgaattttaggcttgcattcagctctatacctagattttatttccaacaaattaatcaatatttgaagtcccacgggtgctttagtttatagtttactttctatttgtacaatgatataactaagaaactaaatggtctgaaaaaaaagaatgatacatgatagtatgaataagatttatgttgagcaattgccaatgtgccggctagaactttactaggattatttgacatgagtagcagttcctatgattatcctaatatttatcttagagattatttgtcaactgagaaaattattttgctctcagcttgttaaagactaccaagcatgggcttcgggtgattcttcaaggaaaccacttggcactggtgaaatatgaagcttcgcagtgtctccattaggcattatagtcttttcttgttgcattagttattgcttgatggggtatagaaaagctgtttatacgtcgttttgctcacaaaatccatttgcttctttgtggtctttgcctgaagatgttctgtagtgtgtatggatttgtgccatgcgaccagtcacatacatttgtaggttgttcattcacaatgtgttgttgtaagattaacaatatccgaccaaaactcttctgcctccatacacattacaaattatggtcctgtgatataaggattgtctatgcaaggaaggggtcggatatggttttctgatattgagagcaatatgtgcggacaacgaaggtgactactgaccagatcggatggccaaggggaattttggctatcatgttcatttaacagttcttaactatcttttccagcctgggcgacggttgatgtttttgtagcttgtgttatccataaatcatgaacatacatagtctgtctaatgtggaaagggatggtttagcaatcagatgtaaaaagtaataatacagagcttcatcatgcttaattatctgactctgttggatcgaagctagatgctcttcaatgatctgctttcaagaatcaagatatgcctgatgatcagatgacgcaatgctatgaagcgttttgtgctacattttaattacctacctgtgtaaagataagttatatttgctcaaactaacacagagctagaatctgtgtttagttcacgtcaaaattggaagttcgattgaaattggaacaatgtgatggaaaagtttaaagtttatatgtgtaggaaaattttgatgcgatgaaaaagttaatgaattatgcgcatttcctaaaacttcaaaaagcttcaaccaccgactagctctacccttgactttcaagaggagaaaaaaaatcagaacaaaggccccgttcttttttgctataagtagtgaataaaaattttcatcttcatagcacattttttaaataagtttttgcttataatgtttgaccacctatcttatttaaaaaatttgtgcaaatataaaaaacgaaaaaatatgcttaaattactttggataataaagtaagtcacaaagaaaataaataataattctaattttttttaataaaacgaatggtcaaacagtgcaagtaaaaactcaaaatcccttatattatgagacagagggagtaaatgatatgtttcgtaccgaatatttttatatgaaaattcttgtaaaatattagataaatctattatttaagtttgtattaattaaaactcaattaattcgtcgatatatctcgttttccgtgcaccaaaattataaatgctatccattcggtctatgagcgagagagataaggacccgaagcgaggccatctcaattctcaaacagatgcgtttccaccggttcgttgtcgttgtcagtttccttcccgtccccaccaccgcggcgccacccgtatgacctcacccgccgtcgtgtcaccgccctcggactcgacccttttctgagctgtctctcgcctccctctccctctccctcctctaggagagagttctctccttacttcctcctctcccctccaccatggctcgatccgtggcgtcctcctcctccatctccaccatgccgtcctcctccgcggcggcggcggccgccgccctaggtgacgtctccccgcgcccctccccgccctcctcgccgcttccgagcacgctctcattcgcttcctctcgtggctttcagaggccgtgcaggtcctcgtcacctccctcgccgacgaatcacccgtcgcccgggacgccgcgctcgccgccctccgcgagatcgcgccgatgtaaggggatcgcttccgccgcttccattcttccgcgtgaagcttaattttaatccgggtaaattcgttgcgtgttgcgttgtggttgcaggaacccgctgctcgtcctcgactgctgcgccaccgtctccagaggcggtcgtcgggtacgctcgtgcgcatttggggactaaaattcacttaccgggggcactgttttggggcttgtttggatttggggttgtgaagctttttttggtttgtctgtattgcagcggtttggcaatatagctggggtttttctcgtgatggcttctgcagtgaaggctctcgatcgctctgatgctgagcgtgaatttcttcggaaacttgcgaagattgcaacagcagagattgttagctcaaaggtatgggatgctgccagcctgtctattgtgttcttacttctgagctgaacactgtgagttcaagcagtaaacaggagcacttctgagcactgttttgtagcccaacgtaatgccattatttggggcagattgctaaacatacaacgtccaaaaactgacataccatggggctatgcttatgatacagtaggtccagcagatgtatgattattactttagattttacatttttggccttttcgggaaacaaaaccaattacagctgttacggtaagatgttatgaaaagagcaatggacatggttctttagcaaataattattatcactatcaaggaaatggttcctgttccaccttggaagccaggaaattagggcatatgtttgtctcgctcttttgttttgtggttttttgtttttttttctgcctatgcttatttagtttatctaaattattgttcattggtgaacaggaactcaatgtcgactggcaaagagcagcagcgagtcttcttgttgccatagggtcacatgatccagacttggtatggcttcacctccatacattatccttttctgacatgaacctttagtgttcttaaaggagaggaatgtacttaaaagctgtgactccaaaagctacattattgtctccttgcaaagcttggactggctgacttgactttaccaaatctactcggcttccttcccaaacctactacttagttctaacatctaaccattaactctatgttcaataacttacagactttgtgtttactaactttatcactaacctgccaaaagataactctatatcaactaatttatggatttcattgcaacttgtctcatccacccatcgcagccatctgtcatggatagaattatcagatgcattaactaatataattaagttcgtattcacattcctacataggaacatgttttgtagatatgtggtctacaatagagtggaacttgtaaaataagaaattgatgatagttttttttggttatttcaataaaaataacagtggataatttcagaggatccaacaaaaataagattttatagcatcatctagcggccatcctttgtaccttttttttatggtttcacattgagaatcccttatatcttgtttcaagtatagttttcctgtttcactattgtcaggttggtctcattcttcatttctctgttggctttgggtgctcgctgctagcaattctttactaccatgtggcctagcattttaataatgcaaatctgttactactcttattctagatgatggaggaattatttctttacttcgctggaccaacttctgctttgccagccatgttacagatacttgcagattttgcatcagctgaaggttaagcacaacttttagtttaactataatctgatattgggttggactgctgaatttgcaactcggtcttgcttatttaaagccttgcagttcaccccacgattaaaggatgtacttttgcgcgttttacctatcctgggaagtgtacgggacgctcaacgacctgtttttgcgaatggtactgcatatgaatattcctccaattatcatttctagttactcctttttgttgttgagcaaactgcattttggttctcatgtttctggaaagacaaaaatatctatcaatacaatgttccttttgcagcattcaggtgttggtgccaggcagcatggcagtacataggagatgccccctctgagcttcctttcgatactgacgtcatgtaagctttcaatatggcaaataatccttttttgagataacttaatcttttatgcaatctatcttatatttcaatgataggtcctttatgaattcagtatttgaattacttctaaaagtatggacaggttcgcgtgatctaaaggtaagctttggctttgacttgattcttttatttgctgatttgttactatttagtatttacaccctttacaaacagcactgcccaactgatacgagcaagctgtatatgtttggatacgcgtattatgcctggacctcgaaaatagttttttgtacaattgtcagaaacacatacgtgcctataaaattgatacactttgataaatttgtacatatcaattgctcagtttagtgattaatggtgtagtcaataagcatcatgatgcattgatgcaccctatccagctttatgaaataatgtggcgaaacgagactggattttaccatctaggagtgtattctgtgagtttccacccaatccaaaggatacatttagagatgggttaattggattcatgccacgcccagtagtgcagatcagatgactgtttgttactagccaattggatggacatgaccgtgagttcacatttaagggaagctcctaccagatatggctgctgggccctggcccaaactggagattcaatgtttgtcgctccttgtatgatggaacttcttccttcataacacggcagacttgctacagtttgctgggatgttattagcttagcgactgcttttgcagtaatatatatatatccatcttctgaattcattccaacataatattgcatgatcaaatttacctgtaatattttcatcaggtgcggttgtcttctgttgaggctttgggagaaatggttggtcttgtcacaagatcacagttgaaatcagcactgccaaggatcataccgacaatgttggacctgtatgtatgggttctattctactccctccgttccaaaatataaggatttctgcatgtttcccaaaatgtatctgcacattttggaacggaaacagggagagtaatatatttactgaagatatttgccaaattctcacagacattttttttgctcatgtagatgtcggaaagatcaagaaattgcttttgttgcatctcacagccttcataaccttcttaatgcatcattattgtcagaaagtggtcctcctttacttgattttgaggtaaaataagatcatgcttaatacatgttttctttactatatgtggtggctctgcatttttgtgtcaacttttggtactctgcgttaattgctacggtaatgggaatcacctaagatgctctttatagggaatatatcaaatgggaactgcccacaaaatacaactagcaacattgacaatcagatcagattgtggtggctcagagcctcagaccatccactgtaatctaattgagttcatagttactgttttgtccttccaccatgtagtgatatgtgctacatctagcagctctccctttgatagatattgctgatgcactgtcctgtgaataccatatttctgcttggaaatatccatcatgctgattgactaatatcttcttttagtacataattgatatgaatccagatcatcaaatactccctccgtcccagaatataagcatttttagagttggacacggttattaagaaagtaggtaaaagtgaatggtggagggttgtgattggttgagtagtggaggtaggtgggaaaagtgaatggtggagggttgtgattggttgggaagataatgttggtgtagaagttgttatattttgggacaaatcttaagagctaaaagttgttatattttgggacggagggagtatataatataaacacgttcaacatcttatgttgatattccttgtgtgtctgctatttctcttgaaacaatagatgagttgaagataataagaatgccttaatctttggtagaataaagacattagttttttttagacatcttacacacatgtcaaagcatgatcagtcaggattttttgttccttatgtggcaggagcttactgttgtcttaattacacttcttccattagcatcggccaacaacagcaaatttgagcattcgtatgtttcaaagggactgaaggtgcctgccttaaatctttcacacctattctggttgaacatatatattcattgatttgcatcctctgctggctcattctttttgtactttatgctgtcacaatttgaatagtaagatatactaaataatgattgacgcgttcatgaagtcagggttctttttggtagttgattggacacaccagttgttagtcgagggataagtggggactggagagcgatacaaagtggtatgatggcaacatgccaactgcccaacatatacctcaaatttgtctcagcctagtaggtgtcctagtaggaaattgttcatttttggttctgctctggcacatgcactgaggatcaggatgaaatgttgtataaactcctcaaatagaccactaagattcagcttagcatctgttttggtaattggaagaagcaacctagagttggaccttaatctgctgttgcaaaacagcactgctattttatgagttaaacaatatttgcatgaaatgttgtggggcgatgggatattccttattagccactttgtgcaattgtgcaaccatcattagttagcatcaattgtgctgtattttcttgtcaatgccacctgcataatgtctctcatgaagcgattcatgttgctgcatggttaactactggatctgtatctaccctaaaaaagagaggggaaaaaaatactgaacctgtatccagtttgttcctgggaggcacttgtacttttcttacatttgagcaaagctatcagataatcagacttattccatttgtattgctgtgcaatagatgtattctgctgttgataaaacatttactaaatactaatcatgtgctcgtgcctttagacatacaatgaaatccaacattgcttcttggtaattagttcagcataccccgaggatttgtgcatgttccttttgaatgtaagtatagagctactattttttccacctttaaataaagccaaaatctattggggatggattccctagtttgtgcttacaaaaaaggcttatatagactattgctgcttccatgtactgcctacagaaatgcaagtcaaaagacgaagcatctattgttggggcacttggcacaataaaacatctattgcctaggttctatttctctctctatctctccctctctgcgtttttgagttgtttgcagggatctctataacatatctatacaggttgttggaatcatggcatactaagcaagcgttacttgttgaaattgtgaaatcacttttggaggagcagagcttgggtattcgaatggcactagctgaggtagtaaattctgtattaactttaactagcatatatcttacacaatattgtagatgataatgatctccctaagattatgcatccaattattcacttaatactaattcaatgatgtacagctaattgttgttatggcttcacattgctatttaagtggacatcctgctgagctggcagttgagtttttggtgcgtcatagtgctataactgatgatgatctgaatgatcctaacactctgaaaaacgagtactttcaggacaaaagatttgaggtctcacttaatcttagattctacaaatttacttaactattaagtactccctccgtttcataatgtaagactttctagcatttcccacattcatatagatgttaatgaatctaaacacatatatgtctagattcattaacatctatatgaatgtggacaatgctagaaagtcttacattgtgaaacagaggaagtatcaattatttcagtgatttattttctgttttcatttgccagatgaaaataagcctatctggtctttcagagctaagagctgtatgtgaaaagggtttgcttttgctagcaattaccattcctgaaatggaggtaaaaataagcatgatgttgtccttttatgctatgcccatgccccatctagtcagaaaattgatctatgaagctaccatcatatacttttgtcatggtaaatcaaatattcatagttatgtgagtaatgtgctctagatttttctattttccagcttgttctatggccatttatcttgaaactgataattccgaagaagtatacaggtgcggtagctacggtgagtacttttatgttatttgctacacctggaaaatatttgttaaaccaatgtgccttagttttttttactcttattatttagagtagataaataattaaataatcaggttcatatgattggtgatacctgcagatctgcaaatgcataactgaattgtgcaggcataaattgtctcagacaaacccactatatactgaatttaatgcttcaaatgagatccccaatcccgaggtagtttacttgatcccagatgtattttattctcttccttggacagttctttcttatctaagtatggttggtgcaggatttgtttgctcgtttgctcgtgcttctgcacaatccacttgctaggggtcaacttgccacacacatcctgatggtttgtcttcttagttcttattaattaaacctaaaatcattagaagaatatttacacgaaagaagcttcgccttaggcccttagctttgaccatgcttttttttaataaaaaaaaaccacatgttcatgttcatccatctattttcgtgtggtttagctttccagccatctgtatgtttttcctctacagtaggccatataaatgctttgcctctttacatgagtttaaaaaacggtgtaattatgaacttcatattttgatgactagttaccatgattcttgaaactttatgctattgatacagattttttattcatagaaaattgagcatttgcttgtttaatacgagaagaggttatatcacaatagcttcagatttctggtcaactggagtagcttctgtcattggtagtcaatgggctgcctgatactattagttttactttatatctggattatctagtaacttgacattgttttgtacttgattttcattacaactgtcgcaacaactaatttgcatgtttgactgcctcaaattaagtgattccatctgttactggccaatacttagatggctcatgacatctttatttttgtttacagtctcttagctcttctaggtcgctgttgagtcttgactcacacaataccataacattaagtttatttgtttccattcgtcagcactcattcctcctctcatttttttcttgtaggtgatgtgttacttgggtcaacttttcccaagaaacctttctttatttttacaagatgaggtaattcgcttcatttatttgtttagcacttgagagttctttcttatttagttctaagtgtaaaagaaagaacatacaggttgtatttctacactttgggggaattttctttgcatatttttgcagtaatcatgtcttactttttttatgataaaccccgaaaccgaaagagaataaaacatgtgctgcccaacctggatgtgtcctggaattaatatttgcttgtcctgtgcatgctttatgtataatgcatgactatggaactcctgtggtgatctacttaacagaaaagaggccgagagagcatattttatagggaaatgctaatatttcggcttgtccttatcatgttgttaaagtggcttaatatatgcatcttttggcaagtattaggtccctaagatgaaagcttacatcggtgaccctgaagaccttaagcaagatagcacataccaggaaacgtgggatgacatgataataaatgtaagtctcttattcttattgttcgaggataataatgatgccattgccaaaatctatacttattaactataataatggtggttgctttggtaaaacaaaattatagctagttgagtggaacaaaaatgcagaaaggattgtctcatgtgaatcctcaaatgctacctacttctctggaaagctgatcatgccatacctttcagtttttagcagaatctttggatgttgtgaatgacagtgagtgggtaatatccttgggcgatgcatttgctagacaatatgatctatacgctacatgtgatggacattctgctttgctgcacaggtaaagttttgttaccccttgtacattttctatagaacttttagtttgaatactttggaatgtctaaaccattctgtactggtagatgcccatgcaatctttgtgcttgaagtgattgttttaaattttattttgcagatgtttaggaatgcttcttcagaaggttgatgaccgaatttatgtccgtgaaaagattgactggatgtgtgcacattcaagcatgtctattcctattaatcgccttgggcttgcccaaggcattggtctggtaagcgggtttaaatgaagttctactttttgggggctatcgccttttggtactgaacttgcacttgcaggttgcagcatctcacttggatacagttttggagaagctgaagaacatattggagaatgcaggacagagcgctctccaaaggtaagtgcattaacttttttgtttacagtagtaacatatgttatcttgtccgcccagtgttagccatgctgaagcagcaacttgaaacttaaattggatctataactttgctcacgtgtataaatgtattcctgaaccttatttctcacctccaaagcactgattactttccattttaaccatttagaatagattttcttgtattgtgattaaaacttctatataacccacttaaaacatttctgtttatgtccttgttatgcattttagttattcccatactgtttttgaagaaagataaattgaaactacatgtaaggtggatccaacaatgcaactatctttagcttgttagttcattttttccaggccatgtgtctagtttgttccttttattaattcttatggaacctttaattctgcaggttcctatcacttttctcattgggagcaaaagttgaggatgttgatgacacatatgcagccctggcattgatgtatggatatgctgcaaaatatgctccatcaacagttattgaagccaggatcaatgcacttgtggtatgctgtctaattccaatctatcaacaaacttgtttctgatctgttaccttaacacgacaacatgatgagtgattattacatattcccattaaagatgattattacataatcatttgtggtcaactggtcatgagaagaacagcaaaccactaggttgggctaatccttaggtgtcagaaataggatcggcttcttgggcttctctgggaaattgaagccccatatacaacacttcctggttcactctagcaccctagcttgaatagtacatttatgatctttattgtctggccattctttaattttcagacccaagaatccatccactgattgtatgtgttattgtctgctgcttatgtttctgtgctgaccttattttactgcattgtattttaagacaaagacacgatcatttcatatgttcttgatttcttagcttatactccctccatccaaaagtctaggtcatatttcattttctgtttttccaaatgagatggacaatattgttccttggttttgtcacatggtagatgtgttaattcctccttggtcttggtgataaaagaaatatgccttagacttttggatggagggagtaaccgaataagctgaggctatgcctcttttaagattaactgcagatacgttctattttggttttctagattgaggaatgttctttacttctgtactcaggggactaatatgcttggaagatttcttcatgttcaacatcctactgcaaagcaagctgtcattactgccattgaccttttaggtaatttccttacaaaaaagctgcatatcccgtcctgttttttggaatcaatttttcatttggtagagaaattgatcttcaggcacacattcgtttgtttccctgcctctgtgtgtgtgtgttttcctgggaaattgtttccctgctttgtcacaattggtattttgctatttgcatattgttattgactcagtaaccttgaggattcttgggtgatgtatatatggatgcgatgtattttgttgtggaggtggtagcctagaaaaatatctacaattcacaaagttatccatacaactcttatgtacatatctctctggtgaattgttctttaatttttaattgcattaaatatcttgaataaaaggaagaggagaaatgacgttgatatgtagaggtccagaactagattggcatgtacttaaaaaggtatttactttattttaggattctacaacgaaatcttacaagtataattatttcaaagaaatatataaatgatctatttgtcggcacaagatcccaccagctcagaacatggtgccagaccgatggaatgctggactaaccaggagaccaggaccaccaccactaggctctttgtattctcaatataattttcttctaattgtacctcatatgttgcccacatctaatggttcgcacgaatagtttgcttgattgcatttagatccgagttcgcacaagatacatctccatgtaaatattgcattgatagttagtgcccgtttgatttgtatttacagtatcatgaatcatctatcacaactcagtaaatgtatgcaatcgtaaatttgttaattgaatcagaatgcaagtatcaatatttttgtgctagcagttaagtttccgaggttaacttataatttacatttttttttgtcttactaacatatttttttagataatggaagctttatttagactcagttaattacgtcaagatgatacaatcaaactgagtcacccccggcctccgcataaaatgcacacagccaaaaaagaagaaagaaacaactagaacatcttccaagcacaaaagtttgatagaaacatatatcttagtggctatcaatccgtagactagaccgccacccatgctcctgggtaaaaaactcctgcgccacctggtccaactgtcgtgataccaccgtaatagtatcccgcagtcccggttggtggaggatagcccaggtacgtagccagcgagtaactaaggtgataacctgcaaaggagaagacaccatcttgttataaaaaattactccattcctgcttagccaaatagaccaacacagagctgttgcacccatcaaaagcagattcctcatgtcttactaacatatgctattggcattattgtttaggccaagctgttattactgctgctgaaatggggatttcattcccactgaaacgaagagaccaattgctggagtatgtgctaacgctaatgggaagagatcaaaatgatgaccttgttgatttcagcactgagcttctgcacactcaagtatgttactaagttttaactcttgcttttgctaccatttgtcaaagaaattcttcacactggctgaatcctttacatccataatcctatctttaaacttgtattcacacttaaatacttcatttcagtgaatgtttattctacctggattcctcttacatatgttgatatgcagagtctagctttaagtgcctgtactactctggtttcgatagagccaagattacctatggaaacaagaaaccgtgtgatgaaggtttgcatctttgcatcacagtagtgcaacgccacaaaaactttgctaataatttgactactgtagtttcagttaaactgccttcatatgattttcatttgttttttctattttcaggcaacactaggattttttgctttgccaactgagccctcaaacattgttgagagcctcataacaaacctgattattttgttaggggccattctgctaactaggtaatgctttaatctctttttaattttatggttccattttggatcgtcttattaataacgttgcagtttgttagtttttgtcctgctacttgaatgaaatggcgatgtatctagtattgtttttccttcttgtattgtgagaacatctatttttcttgtacaccaaatctatctgactcttctctaatagaagtgacgtggcttcaccaaaaaggagaaattcaatatttgttgcagttagtggggactgtttgtttagatatataggattccaggaaatgatgtcctaaaattacaagcaaaccttgttgaaaacattatccctagccctgtgacttacatggtaaccacaaacacaacttcaaccaaagatttcaactacaatccagattcacacaatgctaatcatgctaaaacaaagagcactcgaagcagatagctatctaacaacaaagcactatctcctctgccacctgatgtttatgcttagctgtacaaaccaaactcgtctttcacctgacttttgacatttcattagaagagttctgcaataacgtgtctccatctagtattttgagatatttcctaatatctcaagtgcaatgtttacttttgattagtgttcaaatgattttactcattaactcttcctatgtttgttcttttccttggcagtggtgaagatggtagaagtcgagcagagcagctcctgcatattcttaggcagcttgatccatatgtttcatcttctgccgaacaccagagaagaagagggtgtgctgctgtaaatgaggtgttagttaagttccgcaatctctgttctggtggatttggtgtgttgggttcttatccaacattcacactgaacaaacaaattgatcaggcagcccctaggagcttgtcaagtttgccatgtatgttgatttttttctaatattactagtgtgactgtttgatatttgtgatccagtagcattaaaaaaatgtctcctatgttatcaccagctgcatttgtgttgcctacccgagattccttaagcttgggagagagaataatggcatatcttcctcgctgtgccgatacagatgctgaagtcaggaaagttgctattcaggtttgtgtggaagtagctgatcctggtagcagaactttccttttggctgttaaaactctatttcatgcgtagtgtgccttttttcaagctctgaattgcaacatgtcacttggaatgaaattgtgacattaatttcctaattgttctgacggtgcaacatagcatagtacttatataattcttttggaaaatagtaatgctattcagttggtagcacaagcacacacaccatataactgaactgttaaggttatatttacccgttgaaactgagttcataaatttattccctgcttttcttgttgcagatacttgcacttttcttcaacattgcattgtcacttccaaagaagaaggcgtctgtgaacgacattgatctggagtcttcatacagcgctttatcctccctagaggacatagtctctatcattagaagagtgggcgtgctatcttagtttggtttctgttaaagtgtgttctgtcaacaacttctgatttattttgtttgctgttctcaggaggcatcaattgaccaggccgaagtatttcacagggttgtctcctctctgtgcgtcctattatcgaaagatgaggtaacctctctgagcagatttgatattgaaattgaagagggagataaaataacaattacaattttctgtgtacatatatagcttgttgtcttgctacactcctgtacattagcagcatgtgataaagtaaagcaatcatcagatggttcaattcaagctattatcatgtttattatcagaagaggcaaggagctacgtgaagctgacgtattgaggttagtaactaagtaggaaattagctcagaagattacaaaataaggaaagaacagtttgtaatagattgtctcagcttgatgacactagaacacattaatattggaaaataaccctgctaactggaatatagcaaatagggccttaattacacattttttggagtaacactgaccctttttgagaagggaaacatagtgcattgagctttttcttgaaagaattgaatatttctaatatcctattgctgatgttataggacaacacaatctttgctgtcgtctgcagtctcgcttaccaacaaggagtcacgccgagaagttctcaatgctgtatccatgatcgatttattattgcatctatggttcatttttttcaatctcaatattcttgtctaggattacaccctgagttgttttttcccttgactgataatagatatcgtgcttagcagaaaacaccaatcacaccgtcgtgtttaatgaagttctatttgtggctgggcgggatatttgtacaaaggacatagcaagaattcgtggtggctgggctatacaggatgtttttcatgtaagttgggcagaggctgggcacttccattatgtgattctagtcacttgcattaggaacattcaaatttaaaatatatatttaatagatgcatgcatatattgctttatatgaatgatgtttgcataagtggctgctagtcctgctcatgacccagtttgttttggtagcttttaggagaattcttgtaaagttaattaagcatatatattattataatcaggattagtcagataagagtaaaatttttcatacttttatccataacgatgaatttctcgggggaaaatgatgcatggttcactgggctagatctcctattctgaaatgggtgctatatccctcctttgagttttttaaagaaaaaacatgccatatggtagaaatgttgtctcaaaactctagcactgcctttatatagtttaattgaaaaaagttagataagtgcgagcattctacgtggttgcactgttagaaaacacttgcaggactaatgtgttaaaccaggatctatatgtttcatctgcatctgaatagattatttgtcatggtccactgttgcctataatagaccacgtatcatagcggcaatggatggtagttcacctagactcatttgcctaataaattattccatacttcaaaatggctagttaaattctagagctacacttcctaattatgtttttgactgtatgcccttgaattcaggcattctcccagcataaggtgctagctattctttttctggagtacattttgtctatacttcacaaggaacctgtggcaacaaatgattcagaaaagggggagatcacctctgagtcatcagctgatgactgtattctacaagcaactatgtttgctctaaatgcatttatgaggtactggcttccatttgatggttgactaatggtggacaatggtcttcttttgatatgctaagtttatgttcttgaaaacaatggggatttacaggggtggtggaaagattgggaaacaagcagttgaacaaagttacccttctgttctttctgcccttatactgaagctgggaagtcttcatggtcttgctgaattgggccggaatgaacttctacggtgaatatgggactttttttttggaatctcttaatatgtaggctgcatatgaattgatgatatatttttttatgatctgcagatcattattaattgcgtttcagtcattttgtgactgtgttggtgatattgagatgggaaaggtgctttgcttaatgtctaggccttgccaaacatttgaaacaactttttgattgtgtaaaatccttgcctctccatagatattaacccgtgatggcgaacaaactgagaaggagaagtggattgatcttgttcaggaggttgcatgcagttccctcagtaaagaggcccaaagaggtaacctctagtattttcttactactagtacattctgagacctagtagaaagcatatattaagctatcttattactagtaagagcctaagaggaaatcaagactaaagaaagtactttgattatgaacttcgctgtttacattcaaataaaaaaggcatggtttggcagtcaatgatctttagttttgatgcatttgatgttttatgaaatcattgtactaaagttattgataatattatcataggttttgccaacttgcagcatcttaagcaaagctctcaacaaaaaccagagggctgaaagggaggctgcagcagccgcactgtcagaatatattagacacaggtaacaaattagccttcaataagtaagtctgtagatagaaaagcagtgctggaacctttagcttctgatgcatagttagaatcttaggtcaatttcccgtaggatgtcagctagctattggtgattactggttttctctgattaaggttgttgttccccaaaaagcagggaagggagacccatagaaatataatcctgttctttacattgaaagcaaatattctagacactatcattctctgattcttaggtagataacatagaagctggaatatataaatggaacctgaatgtaactcttaatttttattaagaaaaggttaatcctgcatgggtgggaatggaactgagaacctcacacatgcgcatccaaactccaggcccctaaacatttttaagacttttgggcattctgggttaaaattttccaactaagggccaaaaggtactattctcgagaaaaactatgctcataaagttgtattcatagtttatctgttatccatggtcaaattattttagtttcaactaattctattgaatatgcccacaatctgcattataatttgtgaatatgcccactacctgtattggcacatatacacttttatcatacatgaacttgtcgttcacttttttttttgattttttttactgtgcagtgaaaaagaacctatattgcttgaccaaatggttctggagttgtgtcaacatgtctctgatgactcgccaactgtcaggagtctctgcctacgtgggcttgtgcaggtcatcaatctaaccatagcaattttcttaggatacattttctcttccttacatattgttggactctttgactaacatagatgggtaatattgtttgactaacaattttgaagatgcttataatgtttatctttcacaaatcacaatcatacatcatattagcatattgcctgtgtgttgaacagaattttaaaaaagaccctactcatcaatccgtttttgctatcactatctacatatctcctctattgataggtgggccatttgaccccagagtgtactgttttcttttttcttttttcttcacaaaatgtagggagttggttggggggggggggggcagattcaccactcacctccaccatttgcttctttcaaagtagtatatattatctttatgtgcagaacatatcctgcatttccttctcaatcttgttttgtgatgtgcatatttttcttgctagctgagtagttcatgattcaattgatgccttttgtgatattatttattgggcgctgaacctaatttatcttttgtatcatctctttcagatacctgagagctgtattcctaaatacatccagcaagtcttaggggtaatattagcattacttgaagacaccaaggagtctgttcaattaactgctgtccagtgcttgttaactgtgagttcttcaattgattacaatgcaaattgcctccatttccatttattttccaatttgactgaataattgaatgccaatatgccatgaaccactttcaggttcttaatgtgtcagaacaagatgccattgacccagttttaatcaatcttttagtaaggctacgcaatctccaggtaatcatttatgacaagcatactgacatgctcgcatgcattactgtttaatggcattatgcagaacgatttgcattactttaccatgcttattatggaacatgtggggtgcatggcttatgagttacagagggttactttggaatttattttgcatatgggattttaagagacatactaattgcaaagtgcacatgttagcaagttcactgtccgggatatatcctcggtaaattttgaagatgtatgcactgtctccatgctgcctaagctcgacatcgtcatgtagttgtaatcatctttgtactttatttttctcccaaagcttaatgaaattggtcggtcgtccttttggccgacccggcaaaaatgcactatctcatacaggaatgttcaacccaaataaataatgaaataaataaataaatcaaactctcattttgtgccagtgtattttgatcacttgaacctttatattgcattatttcttttatctgttggcattttcctcgtgaattcccagattgtttgttttaatttcatcgttcttttcagttttcaccgtagtgtttcaattatttatctccaaatgttagaagctggtggcagtaacaaagctacggttgcaaacttttctgttgctttttttgcttcaggtttcgatgaatacgaaaatgaggtccaatgcgtttgcagtttatggtgctttaagtgcctatggtgtaggttcacagcagtttcttgagcaggtagtagcatgcaaagtcagcttttagtgtgttattagcagtgcgctgctatcttgcaagccatcttatagggcactgctgtaatggttgcaggaagtgctaagtagttttggattattttcttatgttatgtgtgttaatctgttaacaaattcgttgcccctgttgcagattcatgccactcttcctcgcttgatcctccatcttcacgatgatgacctaagcgttcgccttgcctgtcgggtaggtagtcattacaaatcagacaaattaatacttcctccgtttcacaatataagactttttagcattgcccacattcatttaaatgttaatgaatctagacatatatatgtgtttagattcattagcatctatatgtatgtgggcaatgctagaaagtcttacattgtaaaacggagggagtactttgttttcccttggctttgcctgttgtgtaggtattctttacttattattttgttttcccttgctacacagttgctttaacttgaattatattccccccccctcaaaacagaatacgttccaactcctagcgcctttgatggaagtagatggtttgtcttcactcctcagcaaaaaatatttcacctctgatcgccggtttgtgttgaacaatttgctagccatttctactgggatttgatattttagttacgagtgaaatttttacttgttctaatgtgctttgtctacagttcggattatgaggacttcattagggacttaacaaggcaactctgtcgactatctcctgccagagtcgacagctactttgaatctgctatccaggtaccgtcttcttgtagtcatagcctgcgctttgtgaagtatgccaacactgattttgtttgtttcaggcgtttgatgcaccttggccagtcatcaaagcaaatgcagtttgcttggtgagctgcatgctatcctttttagatgatcaacggttcctcgctccttacttctcccaggtatccttactggattctggtagttcacttgtttagaacatttcatgtttaaggtattaacacaattttatgtcgaaggtgtttgctattttggtcggtagactgagccaatcaccagatgcagttgttcgagcagcatcatcttctgcactgggccttctgataaagaggtctaacgtggttaagacgttgactccgaaatttgatcgggctgattcatcccagaattttcaacatggagatactcgtacgaaaacatcatccgagcctcaacaggagactatagatatgccaaacgatacacaacgagagccataaagatggtcaaaaccaatctctgctagatgtaactctgtaaatcgtgtatgtacggtttagtcgtgcatgtgcatgactgtagataatagaagagtttttgtgtaggacatgccaataggctttcggtagcgagtggcggctgtacagaaatccgtcacgttcgttgattgttatttcttttattgattgaattcgctcagcagtaagcatgtaaaaagatacctcagtgtcttgtgtgggtgatatgtgtggatcagtggatggatcgacatgcttgttcgcgacgaataactacaaaatttagtgccaccgtgaggctagcattaagagcaagttcaatagtatagtccactaccagttccaattcatctatagctaatctaatagctaatttatataatagttgcttactatactattaatatatggtcccacctgtcatacacacctttcgtattggagtccgtactggagctggctataaatctatagcccgctgctcatctctctcatcctttatcttattaaaatatgtttataactggcttgccattgtacttgctcttaggttatctgaattcattccgcgtggaaggctcctatgggtactgtactcctggaggcgtgcttgtctcctggatttttcacattttggtccttttaaaaaacttatttcgcaaatagacccctgaaaaaacttatcccagaaatggtcctttttggggcgccagagtggttggcgcgtcatccaacgggacggcgccagcctctcctcctgccaccgtggcgcactcgaccgccccagggaggagggcgccagccatgctggcgccgccgcctccattcctgtttctctgtatggagttgcaacggtgtcatttttattttatttttttggatgtttttttacactcaggatcacgatacaaccaaccacaaaaaaaatttaaactcgaactaccacttagctaagtttaaaaatatctagtataccacttagtctactttgcaccttcactaaaattagaccataactcctttagtaaaaccctttgatcaggatgttaaacataatgcactctaccactatatgaaattacttaatctaatttaaaatataaccacatgaaatgacatatatataagttaaacagtacatagagatgtaattttttttatttttattttatttatttgatattttttcacacttaggagaacataggaaccaaccgtataaaaaataaactcaaacggacaaaatatgtgacatgtagaattttccaaaactctatcaaaacggataaaatatgtcatctattaaaataggtgtaactttctcatacggactcggaatcaggcaaataatatatgcacggacatctacagaaaaagttacattcgattctcccctctttgccgggttaggcgatattaaaaccttcaaattctgcttgcaagattgtgttttcgaggagagaagtttttcggtggagctttggaaaattccacatgccacatatttcgtccgtttgagtttattttttacatggttggttcctgtgagttcctaagtgtgaaaaaaatatcaaaaaaataaaataaaaataaaaaagttgcacatctctctcctctgcactagttcggagagaggagaggagaggaaaaattctatatgtcacatattacgtccatttgagttcaatttttctatggttgattcttgtgtgtccctaagcgtgaaaaaaatatcaaacaaataaaacaaaaataaaaaatttcggggggagggcgccagccactggggggcgccagtcactctggcgcactccccctagccacctcagcatcgccccgccacgtcggcagggggacggcgccaaagaggctggcgcggcagccactctggcgcctcaaaaaggaccatttttgggataaatttttctaggggtctatttgcgaaataagttttttaaaaggaccaaaatgtgaaaaatccagtacttgtctccgtgtacatcgcgtagctctagcacctccctgttcccaccaagtccgacggcgcgacgctgcgaaggttgacgtgcgggtgtgtgccggtggacgcgtatcgcctcctaccgaggcgacgcagcgaagattggtgaagcgcgtggaggacagcttcaaacaaaactcacacaagcaaactaaaatgaagctcacacaagctcaggggtatattttgttcaaaataaaaaaatgaaatgcaccagccgggaatcgaacccgggtctgtaccgtggcagggtactattctaccactagaccactggtgcttgcttgttgaaatttttctaagaatttatatatcagcagcatcgttcatcaatcaaggcactactcataaaattcagtatcacttcaaaatcaatcatgggttcagatatcactaggctcaagttctgagttacccctaaaccagcccagttctaccctgtaatggtctatatatggggggcatacgactatgctatacacactaccaaggctaccaagtacccagctagtatttctaaatgataaaggtaagcaatatgcactgacacatgtcgacaacctaactgcaaaaacacaaatttgctgatacacatgctccattcatagcaagtggagtacaccttgactaccccaaaaggaagcacatagtatatcagaaagcactcaagccaaactgtagttccacactgaccccccatgacactgaaagtctgaaccatattagttttagagcctagactgacaccaccaccatctcacaagtgatctcacggatcatatttgtcacaccttggcgagcaaagagcaggaggaggttgacgatgacaacacaaagctgctgcccccttctcccccttgtgatcgagttgtggttgtgacattgaagagacgagcacccaaaagaggagcaagaaattgaagttcgcactagtcgcggagtacctcagctcggatatcctcaagatgccgctggggaaagagcctagctcatgtggacgccgagggaaagtgcaacaaaagagagaaagccacgccaaagttggtggcatcaccagcctcgaaactcgaaagcgctaatgctcgccgcatatcctttggtagataccgttccctcttctcctgcacatctccctgaagattgcgtagttgctccctgaactacaccataattgcagagataagcaaagcttaattgcgtcttcaagtatttgctttgctctaactgatgatctgtgcacttggtttatgctaatgttactctgcaaacaggctcagagctgcttctttcagctcaactattttttgctctgttctactggtatgcactctgtactacatacaagtaatacgtgtgcaagaattattacagacatggctcatgagggtgaattcactgaattgtaatcattgagagtattgtggagcaggtttcagttaatggaaagctaatgtctgttgatgcaaaattgcactgatttaggtacaaaaggcacttttaactaaagaaatgatttcctgcagaaagcccctcaaatctcaaagaggcaccaatacttccaaataaaagcacccaatgggagcttcctcttctcccccctcttaagcccacgtatgctcaagggcagggcacactccacattatccatgcatatgcatcatgtaatccacaagatcttcttagcttatgtcatgcgataactaccatcatcttgttcttaattttggagtgtgtccgtgcaatgggtggccgtgcttcacacgcctatagagcgtgggctaatggtggccatggaggctagctaagctacttcttcttggggaggaatggctatgcatggcctccatagtcgacgacttttacctctactaaggtagggcaacttgtatcctttggcaattattcggtggatgtctgttggtggtggtgttagggattggagccggatgaatcttgagtttgatcttggctgtatgatgttagacataaagaggatggtgaaatggtatatggatgtacgatgtttgtgtttcggtccttgctctaataatcagttgttcttagtgttttgttttttttttgccctctttgttaaattgtaaccaccctacatatatgtactagtatcaccaataaagtgatgaatttgatattagtaattaagattgtgtgtgcaaaatctgtgttgattcttccatcgataaacacgtccatcattcatgtatgatcttcaattccccgagttgtgttgtctactatgagcatgcagtatataccaggcagcagccgtagtccgaatcagaaggtgttcgtgccggccaaacgtccacagattagctgttcctattatgggtagttttatcagtcttaataaggtacagagatatttctagtgtgaaacttgggtatctctagttacttcttggtatctcgatgtatgaaattttacagttcttgaaaaattatctcgagttacctaaattttacactaaaatttttgatacctaaggtattaaattttacactagaaaatatggtatttctaagtactttttcaaacatggtaaaattaccctcctcttaatatagcattagcaaatgatggcttggtttaaaaaaatctctctcttaatccctttgttccaaaatataagtttggttggatatgtgacatatcatagtattatgaagctggacagaaactaacttattcagatcagtagtcctatgatatgtcacattgtcaattagaattatttcaagttgtggggagtagatcccatcccggaggtcatcgagcacctctgacctctcaaactcgtgccactcccgctgatgtgggactacctccaagcccccaatcacctgctcgtcgtcgtcttcaacgacgtgcccgtcgatcaggtgcacccgtctcaaccttggcgacgccttcatgacatgcttaacaaagccgatctgccaccccactgcactgaagccgacgatggtgagatccttcaggcgatggtacagatgctgttgtgcttgcacctctagccaagaagccatctttaccgacccattgtcaatctgcatttaggtttcagagttcatgtgaattcacagatatattccattccgtaaaaaaaaacagatatattccacaaaaaatgaagcggatctttaagagaaatgacatggttgttaggttataatatatatgatcaataaatttgcatacgtgaacatggcatggctccagggcaggcgcagcatcaagcaggaggacaatccagaatatatcccaattcattggcacatttgcaatgaatagcttcttgagatgaagcaacgggctgggtaaagctattggctcaatccaaacctgcacacaagaaaaagaaacacaattttcacttagagacaagagcccattactacacttatatttttcatttcaggaacatatgatttgcccacctccggccctttgaactgtagaacgaggctctctatcgatggcatactcatgacgaatttgctgagtcgatatgttgtgttgctaactgcagaaggctcaaccttggtttttaagtagtccaaactgacatgcctaagtcgaggcacctcgccatagtacacctcggtaggctgcacgccccggcaagcaaaagtttcaagccaaggcagcgaatccagatagatttccacaaattcgcagttgtcaaccagcaacttcttaaacccagaatctggcacactgaactgaagaataggctgggagcttcggcaatgtctgatactgaagtccaccagagacacacagtttgacagaatacgactagcccctccataatacgaagctttgcacaactcgagcttggtgagccaccgaagcatcaagcaatcaaatataccaatcggcttgcagttgatcagcacgagccgctttagccgcatgctctggcattcatccagcacacggaagtcatagtcgacgcggtgctcttcgacgtcgagctcgagatcctcggctccccacctgccgatcgccgcggtgacccatcgctggatgcactcgctccacctgccactgccgctacgggtctgaagccttagctttcggatagttctgcggacgccgtcgtcgggaggcggcagaaggaacgcgtccacccgcttgacgtagcggcgcatcgcgcagcgcttcgcgcagcgctcgtagcgtcgcatgatactttccaagagcgggcgggtcctcctcgtccactgctgcatcctctccttcgtctcctccgtggcgctcctcctcgccgccaggtacgccgccttctccgcctcgtacgccgcgctgccctccgtccacagccgcgcgcctcacccggtggtagcgtgggggggaggatgtcgtcgacggcgaggtcgtagcacgtgtgggagcgccgagggagacgaagccatcgcttcgagaggatggtggtggctatcgtcgatcgcgcgtctagcctgtcgaggatcaggaggagtatgccgtcaggtaagctgctgatcatgtcctcgtcaatgttgtgctgatcttggctcatacgcatctagggaagaagaagatggaaccaacaagattacggtaattaacgtgagttcttgcagaaaatgaggggagtggattctaatccctcgaggggatatcccctcgtatatctttcaaattcgatgcaaatagttgtgaaaaattttgaaaaaaattgacaatatagagtataatgatgcctactaatccaccaaaattcatgttcaaattcgatctacacatcgagaaacaaaaaagacaaatttagatataaacagtacgctactattcatacgctgaatttgtcttttttatatctcgacgtgtgagttgagtttggacttaagattttgtggagttatatatatgtgttgtatgaatgttgtcaaatttttctaaaatttttcataaccgtttagatggttgttaaacaaacgaggaaacatctcctcgagagattagaatagtttcccgaaaatgagggactaaaaagtttctacagtaaaagtgaaaccctattttttctgtacccgcttggaggaggaggcgccggtgactgtgcagacgtcgtaggcttcttgagacggcggtagcatcgtgcacttgtctcctctgaagccatctgatctgatcgtcagtggctgaccgagcgagcgggcggcggcggcggatctgagggtttgtacctgcatatatgcacggaagagtttatgccggcgtgctggaagttgcaggacacgggctgcccgcatgcatatgtttacctaaagccagcttataagaatctagaaaaactaggtttctcagcttcgtttagttcattttctgaattctacaactgcttgttagaatctagactaaaattaagccggactgtttgagagagctgttgattctaggagaagctgcagcagctagaagctcccccaaacaagacattccagaagttcccttacatatatccagccttctccctaataatctaagatgcaagtgtctaaggttggagaaataatgcaaaatcgcaaaccgaatccaatcgatttgtatggcaaacgtgttaatctgacaagatgaacttagtttcttttggagaaaaaaagaacagaaaatcggcgaccgaatgggacaaaatgattgaaaaaaacaaatctaaactttgtgatcttgcagttgtataaaaatgtagctagaacttttgattcatactccgtcttaaattcaatcaaaaaagacgcgaatattaagaaagtgtctaatatcaaatactaattagaaggggtgaggctacgaacccagatcgtctagcccatcaccatgtggaactagccgaaagatctctaagcatttctcatcttaaattcaatcgtaaggtctttaagttttgtacatggtctaaattacgcacggaagaaccacccaacatggaagagcacagagttcagtaaccaaccagaacaaatctgaactccagattgccatagcattcttcagttcccccccctactctttgcaacttcaactttcaagaaaaacacagaaaaatgcaggttgcttcgtctgctatatctgcattcgtctcaatcaccctccgctcagcgacaacaaaaatgagcaagggcaaagacgcagcagcatgaacaaataacacacaagttcatttacaggtcaaacatcattttatactacactgttatgcataccctgtggctcagttaatcagttcagaattatttcgagttggggcgagctaatcccatcccagaggtcatcgagcacctctgacctctcacactcgtgccactcccgccgatgtgggactacctccaagcccccaggtacctgctcgtcgtcttcaacgacgtgcccgtcgagcaggtgcacccgtctcagccatggcgacgccttcacgacatgcttaacaaacccgatttgccaccccaccagctcattcaggcaatggtactgacgctcttgtgcttgcacgtctacccaagaagccatcttttccgacgtgttgtcaatctgcattcagatttcgaaattgttggtacagatgtaatcaagaagaaatggaagtgtataataggagaataaagacacgtttgtgatgtatatatgatcaataaactgcatacatgaacatggcatgactccaggacaggggcggcgtcaaggagggcgacaatccagaatatatcccaaatcattggcacgtttgcaatgaatagctttctgagatgactcaacgggctgggtagagccattggctcaatccacacctgcacacaagaaaaggcaacgcaatttcacttagagacgagaggccaaatatactgttagcacatttcaagaatatatatagatcgctcacctcaggccctttgaactgcagaacgaggctctctacaggcggcatcctcttgacgaatttgctccatggatatgttgtgtggctaacagaggggccaatgttgttgcctgcggtttacaagtagtccaaactcacatgcctaagctgaggcacctcaccatagtacagtttggttggctgctggccccggcaaacaaaagtttcaagacaagggagcacatccagatagattttcccaaatttgcagttgtccaccagcaaattctttaatctagatgttggcacattgaaacgaagaggacagtcaaatactggatcatatctgatactaaagtccactagatgcacacagtttctcaaaatactaacagccgctccaagaaatgatcttttacccaaggagagtttggtgagcctccgaaacgccaaggaagtaaatataccaattggacagcactagccgttccagctgcacattctgggatccatccagtatcttgcgaaagttaaggctgacgccgggttcttcaacgtcgagctcaaaatctttgactccccacctgccgatcgtggcgataatccatctctgaatgaatacactccaccctctgccaaaggtatgaagccttagcttttggatagtccggtgcacgccatcgggaggtagaagaaacgcattcacccgcttgacataggaacgcattgcctgacgtttgtagcgttccagaatagcttcgagtacactgattatcctaatccgccgatcattgtggtcctccgtggtgtaaatgtcagccagcctctgatccatagggcccttgctggccagcttcagggcatccttctccgccgcaaacgtcgccttggcctctttccacattcgcttcaccctatggtagcgtggagggaggaaatcatcaacggtgaggtcatagcatgtcatggagcgccgaggaagatttttccatctcttcgaaatgatagttgcgattattgttgtgtgtggatctagcttgtcgaggatcagggcgagtatatatcatcaggtaagctactgatcatgtcctccccctcgtagtagttgtgctccttgctcatacgcatctagtgaagtttgatgagaaaggataatgaataacagtcagcgatctaagccaataagtaatttccaggagtgtgtgaaaaaaaaaaatcagagattaatgccttcgacacaggatccaactcaacagcctacatggcgacacgagcaagggaaagtgtcaactcctctcacagatcacaagaacagataggttatcgtcgactcgacccaaccggatcgagcgccgccgccgccgccaagccgccaccaattcaattcatcgatgattcgagtcacggatacattgagtgttttataccgtatcccttctctctctctctctctcttacagccaacagtattacagctggcgaattctttccctattacaagaaagatgttacttggcccacattggcccactatagcgagggttaggaacacgagctcgaatgggcttctttgctgtagcgattgaagtctcttctatctcctgctctgctgctatctccagttctgctgtattgttctcctgttctccatcaggaaagatcttgacaaccccctccccttgaaaagtggcttgcccccaagccagtgccattggaaaacgctgctgaagatcttcccgatcctcccaggtggcatcctctgcaacagaatcagaccaatatacaagaacttgagaaacagtgcgattacctttcctgatcaatcgctggtccagaatctgaagaggatagacagttgatttcaggaatttgggcagccgagattgaacttgatgcttaaatccatgtgcaaccttgagctgggaaacatggaaaactggatggatagtactgtcatctggcaattgaagcttataagcaacagtaccgacccttgccaatatctgaaaggggccatagaacttgaaagccagcttatgacaagctcgagatgcaacagacttctgaacgtatggttgcagcttaagaaatacccagtcccctactgcaaattctctgaatgacctgttcttatcagcatgaaacttcatcttttgttgtactcggtgcaaatgctgttgcagcaattctgccatcagtttcctctcatgaagccaaacagccagatcgggaatcgcacaagtttccatagtaacacccaactgaagagggttatggccatagagtacttcgaatggtgtcttgttcaaagcagaatgaaagcaagtattataccaataccctgctaaatgtaaccaagtaacccacttaaaaggggctgcattagtgaaacaacggagaaacatttccaaacactggttaaccctcttagtttgcccatcggactgtgggtgataagcagaactaaggtgcagggcaatgccagatttcaagaaaagaaattcccacaatttgctagtaaaaattttgtctctatcagagatcagtactttaggcatcccatgaagtttgtagatgttcttcatatatgacactgcaacatctagggctgagaatgggtgtgacagaggaacaaagtgggcatacctggagaatttgtcaaccaccactagtatgcaattgtatctctctgattttggcaatccctcaataaaatccaatgagaccacttgccaggcaccttctggaatcggcaagggttgcagcagtcctggatatttagctaggtctggtttcgcttgctgacagatagtacaattctttacccactgctgaatcattttcttcatctgtggccaagcaaacagtgcttttactcgctgataagttactgggaaaccagaatgtccacctatagggctggcatgcaaggcagtgactagctgttgctgtaaggataaattatgcccaatccaaattttacccttgtaccgcaataccccttgcactaaatgaaaatgttccctggcagtaggatgcaatgccaattcagttaagagttgctgagcctgctcatcagtttcatacccttttaccactgctgttaaccaaaggggttggcattcggatacagcccacaattgatcatttgtctcttcatcccttcttgataatgcatctgcagctgcattagaggttccccttcgataacaaaccttatactgcagtcccatcaacttagtgaaagccttatgttgcaacggagtatgtaatctttggtcagtgatatgcattagattgtggtgatctgtgagtatgacaaactcatcatgctgcaaatatgatctccactgatcgactgccaataggatagccaggtattccttctcatatgtagacagccccctggtttttggacctaatgctttgctaacaaaggcaatagggtgcctgtcctgtgacaaaactgcccctattcccatatcacaggcatctgtttccacagtgaaagtttttgagaagtcaggcagtgccaaaactggggcactaaccaaagcttgcttcaaggcattgaaagcttcatccatttgtgctgtccatttaaagggcacccctttcttaagcagctgggtgagtggtttgttgatagttccaaagtttctcacaaacttcctgtaatatcctgccaaacctaggaagcccctcaactgcttgactgactgaggaattttccaatgcagcacatcagcaatcttagaaggatcagtggttactccatccttgccaatgatatggcctaggtaagccagttgttgttgtgcaaaggaacatttactcaacttgactttccattgttgagcttgaagtagttgcaaaacttgttctaaatgctgaatatgcgatggtagatcagggctatagattagaatgtcatcaaagaaaaccaatgtaaattttcttagcactgtcgctagggtatcattcattgccttctgaaaagtagctggtgctccagtcaacccaaaggacatcactcgatactcatagtggcctgagtgagtctggaaggctgtcttgtgctcctctccaggttgcagccttatctggtgataacctgcccttaaatcgagtttagagaaatacttagctccagaaagctcatccagaagctcatcaatgacaggcaaagggtattttcccttaattgtaattgcattcaggtgcttatagtctatgcaaagtctccaggtgccatctttctttttgactagcagtgctggtgatgaaaaagcactattgctgttttgtatgactccagactgaagcatttcagttacttgacgctcaatttcatccttgagtgctggggtatgcctatagggtctgaggttgactggacttgctccttccatcaagggaatcttgtgatcacaattccttacgggtggcatttctgtgggttcttggaacacttcctgaaacctgtccaatacatgcttgattgaatcaggaatcactacatcagatgtctggtcagtcttctgaatctgtagtacatgcattactgactcagtcttcataagccctttgatctgcagagaagtaatctgagggtagtggtcagtttgaggctagataccctcaattctgatcaaccttcttgccagaggaaattcgagccatttctgcacccaatccaccttcatagggctgaactgttcaagccagtccatccccaggatagcatcgtaccctcccaattgtagatgtcatgtgggggcgcacgtatgtgcgacgccgcagagcgcgagacgttcgccgagctgcggaacgcgcggcgcgcgcagaggcagaacgcgcggctgcggcagatcaggccacggtcagtggctaggatggaaaggataattagtttcctgttattagcccttgcatttaggagcaattagctctttggttagttgggccttaggccatatatctctgtaatcggcacattccagaaattaagcaatttggttattgtcccaattcttcccttctctcgtaactctcaagcctgcggcggaggggcaaacctcgccggagaagacggaccgtggctacgaactccgtagccaggggccagctaccctagggatcaacgcccttgacaacctggtatcgcggtcacgtcgatcttcgtcttccgttgccgactccacctctgccccagccaccaccgatcccatctacgactccaccaccactccagccgccgcccctgctgtcgctccgcccaatttcccacctgctgccgccgcctcccctgcgtcctcaccctcagtcgcgtcctgctcggcccaccacatgggtgacgacctcaaggcctccatcgaggccctctccaaggacatggcgctgatgcacgagtcgatcaaggccaacgccgcctccatcgcggccaacgccaaggcgatcgctgcgctcgccaccaccaccagttcatctacgtccggcgcccgccccggctttggcgatcagccgccagaccggccgcccaagcactggcgacccgacttcccgcactacgacggcaagagcgacccgctaatcttcatcaaccgctgcgaatccttcttcctgcaacagcgaatcatgcaagaggagaaggtttggatggcctcccacaacctcctcgagggcgcccaactttggtacatgcaggtccaagaagacgagcgcggcacgccgacgtggactcgcttcaaggagctcctcaatctccgctacgggccacctctgcggtccgctcccctgttcgagctgtcctcctgtcgccgcacgggtacagtggaggactaccaggaccggttccaggccctgctcccccgcgccggtcgcctcgacgaagaacagcgagtgcagctgttcaccggaggccttcttcctccgctcagcctccaagtccagatgcagaatccccagtcgctggcggctgccatgagcctcgcccgccagttcgagctgatcgagcagtacaccgccgttcccgccaaagctcctggtcggggtgtcctgccggcacctgcgcctcggccgcaactcgccttgccggctccagctggggctgccaagcccgcgccgcccgccgccaccgctgctgataaccggccggtcaggcgcctgaaccaggccgaacaggaggaacgtcgccgcctcggcttgtgcttcaactgcgacgaaaagtacagtcgcggccacaacaaggtttgcaaacgtctgttctttgtggacagcgtggaggacgaggacgaggaagcgccggaggacgaggtcgacgcggaggcaccggtgttttctctccatgccgtggccggcgtcgccgtgggacacccgatcctgctccgggttcagctgggcgcgaccacgctcgtcgccttggttgatacagggtcgacccacaacttcatcggcgagtcggcggccgctcgcaccgggctatccgtccagccgcggccacggatgacggccacggtcgccaacggcgaaaaggtggcctgcccaggcgtcctccgccacgcacccatcaccatcgagggcatgccgttccacgtcgacttgtacgtcatgcctctcgccggatatgacatcgtcctcggcacccagtggatggccaagctgggccggatgtcctgggatgtcaccacacgcgccctgacgttcgacctggagggccgtaccatctgctggcagggcgcgccaaaccaggacgggccggcagtccgcgcggccagcgcagacgactccctattgggggggctcctcgactccttcgccgacgtcttcaccgagcccacaggcctgcctccacagcgcggccgtgaccacgccatcgtcctcaagcagggcacgtcgccggtggctgtccggccctaccgttacccggcggctcataaagatgagctcgagcggcaatgcgccgccatgatctcccaaggcatcgtccgccgcagcgactcggcgttctcgtcgccggtcctcctcgtcaagaaggcggacagttcgtggcgcttctgcgtcgactacagagcgctaaatgcgcttaccgtcaaggacgcttttccgatccccgtcgtcgacgagcttctggacgagctccatggcgcgcgcttcttctccaagctcgacctgcggtccggctatcaccaagtgcgcatgcggcccgaagatatccacaagacggcgttccgcacccacgacgggctgtatgagttcttggtcatgccgttcgggctttgcaacgccccggcgacattccaagccctcatgaacgatgtgctccgctccttcttgcgccgctttgtccttgtgttttttgatgatattttgatctacagtgacacatgggctgatcatctccgtcacctccgggctgtgctgacggtgctcagggagcacaaactcttcatcaagcgcagcaagtgtgcctttggcgtcgactccgtggcataccttggccacgttatctcggctgctggtgttgccatggacccggcgaaggtccaggccattcgggagtggcctcagccacgctcggcgcgtgcggtgcgcggcttcctcggcttggcggggtactaccgcaaattcgtccacaactacggcaccatcgctgcgcccctcaccgccctgctcaagaaggaaggattcgcctggaccgaggcagccacggcggcgttcgacgccctcaaagccgcggtctcctcggcgccgatcctcgccatgccggacttcaccaaggccttcaccgtggagtgcgacgcctcctcccacggctttggcgcggtcctcattcaagacggccatccgctcgccttcttcagccgtcctgtggcgccacgtcaccgcgccctcgctgcgtacgagcgcgagctcatcggcttggtgctggccgtccggcattggaggccgtatctttggggccggcacttcaccgtcaagaccgaccactacagcctgaaatatcttctggatcagcggctgtccaccattccccagcaccattgggtgggcaaactgctgggcttcgacttcacggtggagtacaagccgggcgcagcaaatactgtggcggacgcgctgtctcgtcgcgacaccaccgaggacgcttctgtcttggtgctgtctgcgccacggttcgacttcatcgagcggcttcgccaagcacaggacgtcgacccggcgctggtggcgctacaggcggagatccgctccggcacacgcgcagggccgtggtccatggccgacggcatggtcctgttcgctggccgcctgtacctgcccccagcgtcgcccctgctccaggaggtcctgcgcgctgtccatgaggagggacatgaaggcgtccagcgcactctccaccgactccgccgggatttccactttcctaacatgaagagcgttgtgcaggattttgtgcggacctgcgaggtctgtcagcgctacaaggccgagcacctccagcctgccggtcttctccttccactgccggtgccacaaggagtgtggactgacgtcgcactggactttgtcgaagcgctgccccgtgttcgcggcaagtccgtcatactgactgtggtggacagattcagcaagtactgccacttcatccctttggcgcacccatactcggcggaatccgtcgctcaagtcttcttcgccgagatcgtccgtctccatggcgttccacaatccatggtgtcggatcgcgacccggtcttcacgtccgcgttctggagcgagctgatgcgtctggtgggtacgaagctccacatgacgacggccttccaccctcagtccgacggccagtcggaggcagccaaccgtgtcatcatcatgtacctgcggtgccttactggtgatcgcccccggcagtggctgcgctggctcccgtgggcggaatttgtcttcaacaccgcctaccagacctcgctgcgggataccccgttccgggtggtctatggccgcgaccctccctccatccggtcgtatgaaccgggggacacccgcgtggcagctgtggccaaaagcatggaggagcgctcagagttcctggaggacattcgctaccgcctggaacaagctcaggccatccagaagaagtactacgacaagtcccatcgtgcagtgtcgtttcaggttggggactgggtccttctgcgtctccgccagcgcgccccagcgtccctgtcgctggcagtctccggcaagctgaagccgcggtatttcgggccctaccgcatcgcggagatgatcaacgaggtggctgctcgcttggcattgccggccggcgcccgccttcacgacgtgttccacatcgggctgctcaagaagtggcacggcgcgcctccagacgctcccccgccgctgccgaacgtgcaccacggcgcggtggcctgtgagcccgagcgagtcatcaaagcccgcttggcccgtggggtgcgccaagttctggtccagtggaagggcacttcagcggcgtctgctacctgggaggacagggagccattcttcgcccgctaccctgctctacagctcgaggacgagctgcctctcgacggagggggagatgtcatgtgggggcgcacatatgtgcgacgccgcagagcgcgagacgttcgccgagctgcggaacgcgcggcgcgcgcagaggcagaacgcgcggctgcggcagatcaggccacggtcagtggctaggatggaaaggataattagtttcctgttattagcccttgcatttaggagcaattagctctttggttagttgggccttaggccatatatctctgtaatcggcacattccagaaattaagcaatttggttattgtcccaattcttcccttctctcgtaactctcaagcctgcggcggaggggcaaacctcgccggagaagacggaccgtggctacgaactccgtagccaggggccagctaccctagggatcaacgcccttgacagtagaactctgaattcagttctgaaagagcaaccttgtatccaccagttgcagttaggtatgcttctatcacactgcatggttccaccgtcagcaatcttaatctgcactggatgtgataaggtctgaattcctgccagctttctagccacttgctcatcaatgaaggagtgagtacttccactatcaacaagcattaagagttccaagccctgaacccaacctctcaccctaatagactttgaagattccactccagctattgcctgacttgaaactgccataagagtgccctcagcttcagccacaatatcatcaccaactgggtcatcatcttcttgcaaagcttctaaaagctcttccatgacatgtaactgtactgttgaggcacatttgtggtcccttccccacctttcaccacaagtgaaacacagccccttagattttctgtaagccttaagtgaggacaatctatcatctctgggagtaatcttagctgcttcaggggttttcttatcctcattcacaacaggtctcactggtagaggtgtcaaagaaacttgagcagtgttcctgaaattggacttcactggagtagagaactccaaccttcgagttcccagcattgcctcctcctgtaataaagccaaagagcaagcagtatccagatcttgggggcgttgcaccataattacagtgtgaatagcatcctttaaaccctctacgaacttagtgacgaagtacacaggcttcagttcactatcgtaagcaatcaattggtgcatcaagctatcaaacttatccacatattcagttacactaccagtctgtctaatgtgtatgtattgccttatcagctgttgatgcctatccctagaaaacttagcacaaactttctcacaaagttctacccaagtgactcctattaattgggacctaactgactgcaaccaaaatgaggcattcccagaaaaattgagggtggctatcctaacccaatgagcagggctgactccataagtatcaaagtaggcttcacagttttctctccacatttgggggttatctccatcaaattgtggacatggcataggaggtaaaccagtgcttgtgcccacagcactaccagtaaaagcagttcgcatggctggatcatggaaataaggagcaggtgtggagaacaagattgagttcgtaccattggccgggggtggtgattggggatgagacccaagcacctccgcccgtatttcagcagcattgcgggcgcccaattgggcggtaaggtcaggcttcggctccgccttgttcaggagttgaagctgatcgaactgaagctgcagatttccaacggtggtcgccagatcagtcaccttcttctcgagctgtggcttccacgaatccactgatgtcttgaggttcagcatatccgcgcgggagttcttctccagatccaccaacttggagtccgtctcggtcagcttcttcaggatcagatccagcttggcctcgttctccatgattttgaacgcttgcttggtttgataccttggcttttctagtttgacgcaacgggatccacttcccctgttcctaatccagcaaaccgagaggggcaagttaccttttcgcggatttcagctgcaagagccgatctccaatccccaatcggaacccttttgctgccggatcaagaattgggtgggatagtaggctctgataccaagttttgtcaattcctctcacagatcacaagaacagataggttatcgtcgactcgacccaaccggatcgagcgccgccgccgccaagccgccaccaattcaattcatcgatgattcgagtcacggatacattgagtgttttataccgtatcccttctctctctctctctctctctcttacagccaaacagtattacagctggcgaattctttcccctattacaagaaagatgttacttggcccacattggcccactatagcgagggttaggaacacgagctcgaatgggcttctttgctgtagcgcttgaagtctcttctatctcctgctctgctgctatctccagttctactgcattgttctcctgttctccatcaggcaagatcttgacagaaaggtttaagcgaccgaatttttagactaaattaagactttctacagtaaaatgaacacagtgagctgcatttctacaagaaacaacaaagtattgtttcatcaatcatcttgaggccgccatctgatggtgcaatccaaaataaaggggtgctaaactagtcgaccattattaaacactctaatcctacaaagtacagaccagtaaaaaaatgcatttttttcttcaacaatataactgtatgagctttcaatcaaaagccgggttagcatgctgccttctgtctaagattaaaaaaagaaaaaaggatactgtaacagtaggacgggggagaagggatacctacttgaaggtcgagggggcaacggcgatggggacgactgtggagacatcggtagccctcttaagtcggcggtagcgtcgaggggttggctcctcagtaccatcggatggatcttgatcgtcgctggctggcggaccgggcggagcgcgagaggcagcgacggattggaaggggcggaggcacggagaggaatgggaggggcggcgagggatttgcagggggaggtctttccccgtgtgccattaaaaaagatggtggctgtctctgtgtcactaaaaagttcgagcctccctctataccatcgtcgaactttatcgcgtcctccacaccactccgtccgtttttttcctaacggtgggtaacggtgcagcaaaatgactttgttaccctttgaacaagtttgctcccttctttgctcttgtccggatttggtatagaagcaatttcgagtgattattttcctttttctcgaattgtttttttggtaggtttgtttggcgtgagcaatggtgaacgacaacgagcaggtggtgagtggtgacgatcgccaaggccagcccggacacgtccgagaggaattgccgcatctgctacctcggcctcgacagcgccgccgccgagtccggctccggcatgttcctcgactgctcctgcaaggacgacctctcctgcgcccataagcaatgcgccgagacctggttcaaattcaggggcaacaggtaatctctggaacgccgtcgtgcccacggcgctctggaacgcgcaccggagcgacgccgccacgacatcatcttcctccccgtcgatctgcaccacgccaagttgagctgccgcgccaccatcgtcgtctcatcaccacgaccaaaacccctcaagaacccccaagattgatgcaccatggacggagaacggcatcatcttctccaactccggccgccggcgtcaaacgtcgattccgcctcctccggtgagccactgtacaattcctcgcgcacacaccatccctgtggcctcactaacctcgtggacacacatgcatgctagatcttggagacgtttgagctgtcgccattctcccggagctccgcatcgccgtcgagccgttccaaccgaagctgtcgccgcgcaggaggtagcgtcggccgccgcagttgaacctgcgcccagccgctgcgcagcgccggtcgccacctccatgacgtcggtgccggtggcctcgcagagcgcggagatggcgttcaccgatgacaccctctgcaccaagaacgcgttcacggcgagcttggacagctccgccgaccagaggttggtggtgatgatccggtcgacggggacccattgcgcgtacacgtccttcagcgcctgcacggcggcgatgtcgcggccaccgatgagaacgcaggtcagcgacggccgtgccctccgccaggaactccaggttggagagcacctggaactcgacgacatgggcgttgtgcgcgaggatcttctctatggcctcggccgtcttgacggggacggtggacttctcgacgacgaccttgctggagcgtgacgagtcggcgatcatcctcgccgcgctctcccagtaggcgaggtcggcggccttgccggcgccgcctcgccgccttgccgccacgccacgcctggccgcttgtccaccggtgccgcctggcctctctctgaaacaaagcagagactgcaaagggcaagagcgacatttttcctatccagacccacatgtcagagctgccaaacggttaaagctatatagaatagcgacggaatggtgtggagggcacgataaagttcgacgatagcatagacggaggcacagaggatgatcgaactttttagtggcacagaggcagccaccatcttttttaatggtacacggaaaaagacctccagggggaggggattttcgcttgttcgtggagctgcgagttcgcgggcggtccacgggcacgtttatgcaagtatctgaataaggattttgccttgtgtgtaacacagtccgcgtcggattgcatttttaccaaaaatcagtaaggtttggggctgttcactttgaatcattttcaaccatataattttttgtaaaattaccaaaaaaaatatctacatttgatttgttgtcaaatttagtaaatatataaaaaatactgccaaaattttgccaatattaccattgctaaaatttggtaaggtttattttggctacaatctaagcggacctttggtttcttttccaaatcacatccgacactttttttttaccaaaaatcagtaagactaaatctcgaatagccatatatcttcaaatgtttcttccagcaaatattgagcagataaaattcctgatgtaaaatattttttatggatggagtgcgtgaaagaacagtacacatcctatcttactgtaaagttataacccactaattctaaaattcaacatgtaaacatgtcagctcaccatccactggcaataattatatacaaaacttatgtaagcatgcaacatcatatataattcattgaattctacaaatcaacaatcaatcatcttccttcacattatttttcacaatatttttaacatatatatccaccatttttaatacttaccatatatttatccatataatcatataatcacagtgcgggatatcatatttcatctagagtctcatacagactctactaaatttattctctcttaacataggctgagtttgagagagggggataaagaagattggagagatacgcaaaacgaggtgagccattagcgcatgattaattgagtattaactattttaaatttcaaaaatggactaatatgattttttaaaacaatttttctataattttttttttgcaaaaaatacaacgtttagtagtttgggaaacgtgcgcgcggaaaacgagtcacaatctccccaatctctccccaatgtcctttgaaagaacgcagccatagtgtgacaaaccagttttatttgttgttaacacctaaaataatttttacttttagcttaattattaaaaaaataaaaattatttagtaatttctacagtaaaacgcggggaatcatctagtttccttaataatggagataaatgaatcgatcctaatgatatccccatcggaagactgtcagcttcacactgctaatcaaatcaaacagccaacaagcatgaagaaaacttgatattttgcataagagtcataaacgaatgatatgcatgcacattcctatctagtagaaagctacggattattatcacgatcacagcacagccatcaagcagcacataagcatcgactatacagaggttggagagtaccaaaagcggctactcactggccgaagatcccgaattttttttatttataattttttttattaaaagttttacaaaaataattttccattttgaaaattgacggaaatagtcgcctaccgccctctgggagggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcctgcaaatgggcggcgagggggggcatggaaatttgcaggcggcccccttgccgccctccgcgagggcgattttgcactgtgcgggggcccgcctgcaaatgggcggcgagggggcatggaattttgcaggcggcccccttgccgccctgggggagggcgattttgtactgtgctctatattttttttatataaatatcaatagttatcaaatctttttatattgaaaactatacaagattaaaatctccaagattggtaaaatacaattttattattttttagggcatatttggaatgttaccgtacaaatattttgttaatgccaaaatataagcaagttttggcactaccaaatatttggtaaggtaaaattgcatttgatcatatttggtttgctgccaaaatgtaaaattgtagtgaagaatgttgtacataatctcaattctagattacgtattaccaattaataggcttccattttcgtgtgtggtgtggtagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtataggtatttaacagtattaataaaaagtaaagtaccgtgtgggcgagggatcgacgctccgtgagaggaagagctggcgaacgcgcctgaagaggtggcgaacgcccctgcggagctcgcggaagcgccggtcgtgcctgcgaacgcgctcgaaggcatacgaggtcctgcgatgaggaaacgtgcagttaaaacatggtgacacattcgtgcaaaagctgaaacaaaaatgaactaatatctgggctgaactgtaccgtgcgaaaccggtgctgtaggtcgcactgctccgaagctaggggcgctcgaagacaaacgaggtcctgctccgacggtaggaccgcgaggccgtgggtgtaccggaccagctggaggtacgacgtccacggcgctgcgacaggagaagacgcgcatgaccgcacgcatcttctcctgcatccggtcgaaggtcgacctctgctcaacgtcagtcaagtgcaaacctctgttcaacctcacctggactgcggtgatatcggcactgatatcccgtgccgcatcagcctatgcaagatggaaataaaaaattcagtagttgtcctatattatgcaagataaatgacataattgttggaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattgtatggctcgatgatgtaattatcataaaaatttagaaatgaacaatccgaactcacgagtggtcggcaggggggacggtcggctgcacgttgccgggaaacacctgcctaagtccgaactgtctcatcacacgctgcggccagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaaggaaaaaaaaagaagaggactgataaacttataacgcagcgaagttgcactaaccccacgtcgacaccagtaagtccccatcgtgggaccgtcctctggccactgcgcgctgcgaccaaccccgtagggtgcgctgtccaccactggtcgccctatggcaaacctctcggctgcccaaagctgaagcaacataggacagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacagttaagaatgaaatgttagtacaaaacactgatccggtcgcaaataagcacgtatgataataacaacttatttacttacagtgaactggagcaaccaagccttgctaggcccgactgtagagtacggaggaagggtggtggtcggtcctaggtgtggaaggcgcatcacctgctcgaagcgcgcagtgatatcctccttccacccaaaaacaccgtcgatgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtataaaacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattatgatacaacaccgaatagttcgcaatactactagtacaacaatagtcggaggtactcattacaacaagattgaattgaaattacacgatagaagtatttagtccgaacactcattacatcattttatttcctaaatcgaaagcattgttacaccatggaatcgcctgctgcgcgacgacgccttggccttgcgcgcctgcttgttgttccttcaccaggtggtcgcctaccatcacttgcctgtccagatagactagcatctgcgccgcttggaacttctgcattcttcgggcatgtcttgtaagtatggccgcgcagatcacacttgctgcagcgtaaagtcctcccacctgcttctgactcatccatatcatttctgatgcgtctagtttggcgtcgaccctttttcaccctaaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtaggcttgcgtgccgtgaaggatgaattcaacaatagcaaccaatggaagtacccgaactcctcgcattacccagttgtacacctctgccaaattggttgtcattatgccataccgagatccatcggtgtcgaacaatagagcccacttctccttaggctcattctcaatccactgagagaaatttctgatggccgaccctgacctccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttctatcttcaaccgatgtaaatgtatgtaggtcatagtaagtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaatgaaactgcccaatgcttcaccgcctccttcatctcatccttatgagcataccttgcaccctcaattacctcgtactccttatactcccagggtacatgatcaccctctgatataacaagaccagagaagtcctcatttgcccaatcagtggccattacatcaccttcctcatcggatgatgcgtcgtcctccgcttgctcattatccgaatcttccctctccatttcatcaacaattataccgactctctccccctcatccgccatgcccatggcctgctcctcccttggttgattttcctcattttgcatcgatggtccaacaacatcccctgcattgctaggaccctccacatcttcggtttgcattgaaacatttgtatctttctcttgtaccgacacaaatataacgaggggccatgaccgttcaaaagccatttccacataccgtctccaagcagcagtgctgtccatcggcattagttcccaaaaataaccttctattgcacgactcactacaacagatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgatattgtgcctgatgaaaacaataactgcgttaacctcgcatttctgtactacgccctaagttacattctctacaatattgttctctaaatttctaaaagtaggttacattctccagatcaaactaaactacatcttacaattaacactactgtctatgtctcaattcatactattatattctatgctctggatctacacatatgtgctgtgtgctacagatctgctaaaatatatggaactaaaactaaaacgcaacatatgtactcaaacgtaatatattagtacaaatgcaaaagatgtatgggagcatacctgtgatgaagtgagcgaaccagcagggcttcgccgctccccttctgctgccctcccctctctctctctttcgttttttttggatttttagtgaatataatgaaatttcataggggaggggctgggctttataggggggaggcaaaaatcgccctcccccagggcggcaagggggccgcctgcaaaattccatgccccctcgccgcccatttgcaggcggcccc

SEQ ID NO: 83250 - DNA, 19416 bp, Oryza sativa
  unsure (1)..(19416): unsure at all n locations
ccctcccagagggcggtaggcgactatttccgtcaattttcaaaatggaaaattatttttgtaaaacttttaataagaaaaattataaataaaaaaaattcgaagatcccgaagcagctagtcgacggcccaggcccatttaaagtcgcttcccttcaccagtgtggccatggcccatttgagaggcccacggcccacatagaatccgtcccattatcgccattctcctccccgccgccaatctgctccggcatcaggtacatgtgcctcttctccatctcgtttgatcgaaagcaaattggtttttctttgtcctatgtggtagtatttgttaggctgttgtgatgccatctggcttttgaaggcacatctgcagctagatcaatcgcacgcaggacaggacgatcgatcaatcggcttgggagttgggagtctcatctgtttgttgtcgccctcctcaaacagaagccttgctggaggtactcttcttccttgcacatagctgctagatctaggtagctactattgtttaaatcgagggtttgcctctcaacaattcaccttgttttgtccttgcctttttcttgtaactaatctggatgtgtattttcatccctcgagaggatatccattcgttgattgcatgatatctaaataattatgattttttttaaaaaaaattgacagcatagattaatatgaaatatatattcagttcaaaaaaatatgaaatatatcactccacaagcatgcaaaaccaaactggcaaactcaacttctgcaagttgcaacaaaaagaacaaattaaactaaaaatagttatcgtgcattcacagttatatttgttataacttgtagaagttgaatttaaacttgcacatttgtggagtgatatatttcatattaatctatgttaccaatttttttaattttttttatgattatttagttgagacgcacgaaacgagatgatatgctgatgaaatcactctcccaactaatttcaccttttctttttaccccttggactgcgtggtatttgtttgtcttttctgatgccatctcgcctttgagggcacatcacatctgcagctagatctaacgcatcatatataggacgcacaatagaatttggagtctcatccgtctgctgtcgcctgcaagaggtactcttccttgctccgagttgctagcgctatttacttgtttgctctgaattgctagatctaagtaacaagtatctaaatctcgatgagttgcctctcaacaaatcctcatctttctattctctcctctctgtactagtaactaattttgacttgataaatatattttgtcctctccgttgtaaccaattttgcctttttcttattttctcctctcacagtcacagtccgtctgtatgtatccgatgatggagtcgactttgggccactcgcggcgatttctgaatctgatcgtcggcatgtctggtgtcaaatcgctctgctgcatcgacctgatgcaccagccgttgttcaatccaacaacacctactacacagccaccaaacggcaacggatcgcaatccgtcccccagacaccagcggctttgatgatggagcagcttgtggttcctgcctcgagtttcagcttccaagcttcaccttcagcacccaactacgaccaacggaagattgagtgcttccccctgaccggtcgccaggtgatctgcgcggaccagttggggcgcaccttccactgcgacgcggagaggggccatgtcaggagcattccctgtctccacaagcccaagtcgatgcccttgtctctcttcgtacccaatcctgatgtcgacaatgacaaggaccttaatcgctaggactggggcagcagcctcttcgtcattgagaggttcccaaagtctgaggttagctatcaagtcgaggccttcgtctaccgccatcccagtccagcacgctactccaggacctggcactgcgagctccttcctcctccgccgtatctccatgaacccaacaagtacaatcgccgcctggagatatgctcctatgcagcacttggctcctcaagcatttgcatatccgtcaatggcatcagcacctaccgcctgaacatcgcaacccagacatgggaggaagttggcaagtggacccttcccttccacggcaaggttgagtatgtgcctgagcttaatctctggtttggcctctctgccgagtcccaccacttggctgctgctgacctctcctcgttggaattggactcccagccacagctactagtaggaccttggaaggagcttcacctgccggaggaatggaaggaatgcgaggattctcagcttgtcagtctgggctttggcaagttctgcgtcgcaaggttcttacaccctaatgataggattcacaaaggcgagctgggcgatgaggaattatctagccagaattgtatcactgtcttgactggtgtggaggtggtgccacgtgtcccgaatgccaacgtcaattcaaatagcagcggcagcgttagcagcaacggcatatcggaactccggatgatccctcacaaatcgagatgtcacacttctaatggcactatcgtccatactgtgttctagtaatttcgggctttgctttcaagacttctgttttatccattatgttttgtctgaataacttttggagttgaatgcaagagataatggcatttttacctttggacttggatcgagtatctccttgtgttcattgtatgctagtggtatttgtttcctcatctcccataatggcaggttatattaccatactagaaaatagatgcgccagttaacgtgcccgtggattatataacctgctcgtactatttagtacttccaggtgaggacatgttaccttgtgcaaccgtgcacatgcaatacacgtttcctgtaaattatgccatagtaatcatataaagaccctaaaaatttattgcattttacaacaataaatatcacacaatacatacatactaaaaattaactttatatactataacgtagtttcacatactacaaaacgttaatgtaaagcagctaactttgccaaatatataatgtcatatatagcttgataaatatttgaaaagctcatagaaatgtgtctttacggcattgaaatgaagtccgttggctatagtatttaatcgaaaagttctccacatctccagctccactgtatacataatagcttctcttcacctacagccacttcaaatatacccatcttcatctataattaaaatagcatttacatgatcatcactaaatttatatcacccgcggtgcaaccactagaagttcatctctctttcacttgaaaaaaaaatatgttcatcaaaatagtatccagaaaattatcatcagaacagtattcaacacggttgccttacttgaagtaaaaaggagataagaaagtgcgaacattctggaaacacctctacatttgatgttacaactatgcataccagtaacgtagattatatgagcatgtctccttgcctatataagattaggtctatataagaaatgaggttattttttataacaagttaatgttttctcctttgcaggttattactctaattacccgatggcaaaatcggaaaaaaatacgaatagaaaaaaaagcgcgcgcggggaggagggccagctggcgcgtacgcacgcattagccacccccaataaagagagatctgcggtggggcgcggcctacgcatccggcgcacacgcgtgaactaggaggcccctaacttatgaggtggaatatcaaagttgatgtgacttatgggatgaggatttttgcaactttcccttcaaattattccctcgaaaaatttagaaaactattctatttattttgggccgaaatacctccagccggcccatcccttcttttgtttccttccctcctctggttcctggccctaagctgattcgcttcaccagcttgggcaaggtccattcaaagcggcccacggacagaagccgagccgatctcctccccgccgccattctgctgcggcgcggtggagcatcatcctggcccttcttccccttgtccggcctcgctcctcaggtccgccgcttgcatcttcatcttgtttgatcgaaaggcaattccttctcttccttctgcgtggtatttgttcgtcgtcttttctgaagccatctcgcctttgagggcacatcacatctgcagctagcataggacgcacaattaatcgaatttggagtctcatccgtttgctatcgcctgcaagaggtactcttccttccttcttatcgacatacaatatcctggttctttcccttctctatgtaattaattgtctctttttgcttcttttgacggttgattagtaagtcctgtgccgatcgactcgacgatgagcctctcgtggcgatttctgaatctgattgtgggcgacaatatgcctcaaaccagatcaatttgctgcatcgaccttacacgacaacaattctttcagccgtcaccaccagaatcagcggtagcgcaagactcgactgctcagacaccggtggcagcttcaacgatggagcggcttcagcttccgaatccgatcttgcgcctgtggaatagatacttctttccgctctcagagcacaagatactcagcgtggacaagtccgggtgctccttgctctttgatgccaacacacgccacttggtgaccatgccattccttaacaagcccaaacgggatcccatctccctcttcgtcccaaacggtgatggtgacgatggcggcagcatcttgtcatggacagggttccaaaaccagagataggcagccgcgcgcaaaccagcgatcaattcgaggccttcatctatcgcaagaattttgtcgactgccaactcctcccgccaccgccatacctccgtgattacaagcactgtgagaggcgccacaagatcaatgcttatgttgtggtcgatggcggctcacagatatgcatatctgtggaggacgttggcacctattgccttgacacggcgagccacacttggagccaagtcggcgactggacattgcccttcgacgccaagctcgagtatgtacctgagctcaagctctggtttggtttctctgctggtgcccagcactttgctgcttctgacctctcctccatggattgtcagtcccagccacagctagttggtccttggaaggagcttgaaccacccatggaatggcgggaaacgtatgattctcaacttgtcaatctgggctctggcaggttttgcatcgcaaggttcttccaaactaagcgagagggctgttatgacgaagacgatgtatatctttggcaggatgttacggccttgaccggtgtggaggtaaagccgtatgtgcacgatggcagttacagtggcagtggcagtggcagcaggaatggcgaagtaaaacttgaaatgcacactcacaagtcgctgtgtcacatgactgagagatttggtatagatgatgtattatgaatgatattgaggctttgctttcaagcagatattccttgttttatccgctatatgtatcgtctgcgtctgagtagtttaggtaatgtatgagctatctaataaagattgaaagtgattgaagaaagaattgagaaaaagcttagtagttggaaaggtaaacatttatttgtcggggaaaggttggtcttgattaattctgtactttcaagtttagctatgtttatgatatctttcttcgagatactcaaaggggttcttcaaaagattgattattatagatcacggttcttttggcaaggtgatgatcataagaaaaagtacagacttactagatgggatattatttgccaacctaaggatcagggaggccttgggattcataatttggaattacaaaataaatgtcttttgagtaagtggttgtacaagctaataaataaggaaggggtttggcagaacttattgaaaaggaaatatctttataacaagtctataacccaagtggacaagaaataaggtgattcccatttttggtcagggcttatgaaagtcaaaagtacttttttagatatgggctcttggattgtgaatgatggggaacaaataagattttgggaagataaatggctaggtaacttggctttcaaggataaatttccatctttatatgctatagtccgaaggaaatcatccactattgccactgttatgggatctgttccgcttaatatttcttttagaagagctttagttggtcagaatcttgtatattggcatgagttgtgtgcttctattgtacatattcaattaaatccttcttctgactgttttagatggaattatcatcagaatggtaggttctcagtaaggtcaatgtatctagctttaattaacaatggttatgttgagaggaacaaatatatatggaaacttaatatgccgcttaagattaaaatctttatgtggtatttgcttaagggggttgtgttgaccaaggataatttggcgagacggaattggaatggtagcttaaggtgttgcttttgtatgaaaaatgaaactattcaacatctcttcatggattgtcattatgcaaaattcatatggagagcaattcagttttcttttggttttaatcttccaactagtatatcttatatatttgatgggtggcttttggggattgacaagaaaaagattaaactgatactggttggagcttctgccatttgttgggctctatggttgagtagaaataatttggtttttaataaatcaccatctatttcatatatgcaggtaattttcagggcaacgcactggctccggttttgggcacagctacaaaggtgtgaggatggtggggagtttctaaaggttgcatgccgcaagttggagtcgatggttatgcaattatttgccaattatggatggaggttcacaaatagacttcaataaatgtgttctccttattttggcttagtttcctctgtttttgtttggtgtcctatttagctgaactacgttcttttctggattgatacaatgtaataattggttgtagctctttttgagcaaaggctgggatgttaaattccattatctaaaaaaaaatccgtaccttattgcaatttaagacatgaaagtctccgggtggtattatgttaactagctgagtagcccacgcaattgcgcggctagcatcaatttaaaattatctactttttacaaataattttatttaaaattatcattcaattgattctaataattttgtagtttttaaaagccacgtcagtcgctaccccttacttctttgtcacatttttatttgcttactcgatctaccactgctattcatcatctttaaaactttaaaaaaaattaggccttatagtttttagagttcattgtcttgttgggttttgttttcataatttttagaagtatcgtcaaacatcgccaatttactactctacggctcatccgctgccacctctctttattgtcattgggattttaaaaatcaaacataattattgtttgtgttttttttactttttataagtctcgtcaaattgttattagcttcgccactatactgctctacagcccacccgtagcctcccctccttaatgttattgagattttaaaattgaacatgattatcattggggtttattttactctccataagtcctatcaatcgacgtgaccatgtcgcataacggcatgcccattgtcactgagattttatttgaggttttgtttatagtttctagatatcccatcaaccgcgaacacactccttcacaggcctattgcttctctcctctttattgtcatttgtcatcgttgtgttctaaatggaatttttttttataatttttagaagtcttgtcaaacgttgcctccatactactctacggtccgtccactgcctcttctctttattctcattgggattttaaaaatcaaacgcaattaccgtttgggttctttttttactttctagaagttccatcaaactgtcagcggctttactactgtactcatgtacagttcgcccgctgctccctctttattgtctttgagtttttaaaatttgaacatgattatcattggggtttatattttaatttttaaagtcccgccaaccattggctttatctgagtaatatatttcctttccccgaaaaaaaagtcccgccaaccattgtgaccatgctgcttaatggcccgtccatcgtccctctttttaatcatcattggaattctatttggggttttgttaatagtttctagatattccattaactgccaccactctaatcttttacatgcatgttgcttctcctatatttattgtcatttgtcatcattttataatttgtagaagtcatgtcaaaccctatcaccatacttctcttcggcctgtccaccgcctcttctctttattatcattgggattttaaaaattgaacataattattattttagttcatattttactttctataagtcccgctaaaccgttagtggttttgccactatactgctttacagcttggccgctcccttcctctttattgtctttgagattttaaaaattgaacacaattataattgaattttatttttcacattttagaagtaccgccaaccgccaagaccgggctgcttaacggcccatacggcgtctatccttttaatcataattgggattctatttgaggttaagttaatagtgtttagatgtcctatcaaccgccaccattctacttatttataaacctgtggcttctccccctttttattgatatttgtcatcatttgtgttctagatagagttttttttagaagcccatatttttcattccgatatttttatttataaattatattactacctgaactctaataatatttttataatatntcagaattaatatttttttattcaaaatttaattattctcgtcatatgttatagaaggtctctcatttcaatagtatttattttttaaaaaaatgtattcctagttgaactattattttttatttttttctaatttcggaatttattttattttttatttagaattttagttaatatcgtatttgtgtcctatatgatttattattttaatattttttttattttcaattttatagttgtttcaaaattgtattcctactcgagctatcttttttatttatctaatttctgattttattttatttttattctgaattttaattaatctcgtattggattcttatatggactctttttttaatattctttattttatttccgaatttcagttatttatttattgtattcctacttggactcttcttttttccaatttcagattttattttatttttatttcgaattttaattaatctcgtattgggttcttatacgaactcttctttcaatattcattatttttaatttcaaatttcagctattttttaattgtatttctacttggatttttcttctagatcgattgtgggctatctccgcctaatgtctcttctatcttagcatgtgcatacggcatgacatgcatgcagtgttctccctctttactatcaatggccatgtatgtatggcatgtatattttccagccatatatcaaacgtggatcactatttcaatttgcactctaattaccatctagatatggattaatgtaatttgttttgtactctaatgactgtccataaaaccataacatcaatattcagacaacctgtccgactcctaatcaatcaacatgttcgactcctattcattcaacatgtccaactgccatatttcctattatatcaaagttgctttctatttatactcaatattgtcctagataatctataccactaaaaatctagtacaacctacgatctaatggtgtaaatatttatctttttcttcaattcatgtgggaatttctagcctccacagcgaacatggtgtcttttttcaaaactgttttaataatataatagatatttttctctgaaatatggtagatcgtaagttatggccacctttgtttatgttttatctttcagtgctgaaatttatatggacgcgtccgatctgacgcaaaacatcagttggtaactgttgttcaaaatgttctatcactcgattaaaaatgttccaaaccattgcagcatatggttattattttggattgagcaatttagtaatggctggtgaagaagcatctgggattatttcctcctaagctgatgtagcaaacatgtcatccaggaacacaagaacatggacaagcctccacatctgttgacactgtacaccttacaattggagcttattcatggcttcttccactgcacgttcatagtatctgtcacgtcccaaaacgactctaaaatacatcatctaaattatgcctagaataattaaaacccgtgtgaaagcctccaacaattaaaaggtgcaaagttaaaagccaaataaggcttgggggatttttgtatatttcctaaaagcctaaaatgcgtaaataaattttagtggaattttcagagcacaaataataattattaagaaataaacaaagttaaaatgattttataaaaagaaaaactctaaaaagtcccctttccctccctctccctcttgggccggcttgtcccatctccctccccctctccccgcggcccatccggcctctccccgcgcgcgcgccgctgacgggcgggcccgcccgccaccctcgctgacgggtggggcccacctgtcatccccttcctcccgccgctcccgccgcctcgtccgcgccctagcgccgcttccgccgcgaatcccgccgcctcccgccgtctccgcgtgcaataaagagagggaaatcactccccgtgatcccctctcccttttccccccattttccctctctctctcgcgttcaaacgggcggatttgcccccgcaaatctcgccggcgccattgatggcggccggacctcccgcgccggtttcctcccttccccggccaccctctctcgacccggctctatttaaaccctccctgcacctcctccgtccgtttccgcctctcgccgcctttcctcctcgccggaatcgagctcgcgccgtcgctctctctcttcgccgtcgccgtcgagctccggtccgccgccgtcgtcgccccggaccacctcccacctcggcgccgcctccttcggcttcgccgcatcctcgccgacctcgtccacccctccgtttcggtcgccgaccgccggaacgccgtcgaccccgtcgacccgagccgcgccgccgccttccttcgctccggccgcctttttcgtcgtcgccgtcgacctagggtgagccgtggaccgccgcctcttttcccccttccctttccctctctcagccaccgtgcctatggccgccgccggcgaccataggggcgcgggcgccgcctcccgccggctgcgccggcttggccgtcctcgggcgcgccgagtggctgccgcgtggggcccggccgtcagccgctcgcgcccttaggtgcggctgacgcgtgggacccacggcgccggccggtgtgagcccgggtgcacccggtccaccgtggaccgtgaggctgctgcgtgggccccactcccgtggacccggtccgcgcgccccctcccctcggctgacgcaataaacccttttaaaattaaaatttaaatgaagaaattcgcaaatattcatttaaagagcatataaacttcaaatgaccataacttggccatttgaactcggaattggaccgttcaagtctctaatttttccttaagaagtcaagaagccatttttgtgctttgttcctgcttgttatatggagtttattagagtaaaagccttttcttttctgttggtcgtgtagacgctgcagcttcggaagatccgctcttcgtggaagttgaagccgacgtttgggaaagcgagcaaggcaagtcacatcatccttgaacatattgaatcccattttataaagttattttgatttaaattattgcattatcgctttatttaaattcccgcgttatcactgttttatctagccatgcctatgtacctttgttatgaccttattattgttattgttattattaccttgttcaccctagaataaacaaaaccccaactagtggacactctactcatggtaccactagtatgattttaggtagatgcttcgctggttaattaggcaacattaggtggttttacaactctagactttgggatattcatatcacctggacactatggaatggttggattattgtggaattggattcacacctccccctctattcaaaatcctcaaaatagttttaggctgggctcggggtgcatggttttgatagtagcaccttggccatataaggaccggtcttcgggcctctgttgcaaagcactaccgtacttccacatgtctagtgggtaaggcttagtttgtggctcagtctggttaaaaacaaaagtacatggatggagatggacgaagtcgggggtcgatggacatctctagggcaaatgaaggctacacgagctgcggcccggtagtcgagatgtcatggcacagggccggtgtcctgctgctaggggctcagtcctgcctacctgtcccggaggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccttcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttatttaataatattgtatagctttaggatcgtatttacaaaatagctttgagcaactaaatgtcttttaatgctgtttgctgcaaaccctaaccctttatattataacccccttgtactcccttgcatttatcctgcacttgtgggtgtgtcttgttgagtacggtggttgtactcagtcttgctcaatttttcccaaacccagaagaggagcccctggatgatgaaggctttggtgtctagcttgtgcctgccgtcaagcgcctgtggtcgtcgctctagtcttccgctgtttcccgtttgtctttgtgtgtgctgggccttcgccgcccatgtaataaattaactatttacgcttccgcttgttaaactctgaactgtgtcaacttttggtgtaccttgcctcctgagacaaggaataatgcacgcacgtaaagaacgcccgttgggttatttccggtcgtgacagtatctcattctctgtgtagctttcactgcacggtcaaaatccctcttgtcgaacgcttcctggaaaggaatttggaccaggactctagctttctcctaatctgagaagtggcatacaatgtgagcctataaatcattccaaagctttctcctaggactctagcatttgttgaaagttttatggacttttagtatataatagatggcaggttctacattatgtctattcatgcatatatggttatctcagttctcagccttagcactgcttgtttgtttttcagagaaattagtgacgttattttttcttgttttaaatttagtcaactttctcaattattttctagttggttactgaactttggtctttcatactgggcgttttatcgggaaggaattgtcaattggtgcttcaactaaattatataagcatgttgtttaagctgccatactgagttgttatcatctgactgcaaactatccaaacagcacgtgaaacatatgctctcaaagaagcaatttggcctttttcccgcggaaaaaacaatttgatctagtagtaaccatgcgcatgtgcagttgtacaaacaccatttccaaaattctaccgcggctacaaattaattgagtaggaaacaaatataaaaactaaaatcagattgtcatagcattcttcatttactcgccctatttgcaacttccgactctgaagaaaaacactgaaaatgcaggttgcttagcctgctacatctgcatccttctcaatcaccgtctgcttagcgacaacaaaagagcaagggcacagacgcagcagctggcatagatacacacaaaacacacacgagttttacaggacaagcctattttagaaattttacatgtactctctcttattgatccaaagggttcgttcatctatctccttcttgtacgctaccttatgctgctgtcagcttcttcttcttcttcttcttcttcagtaactggtgacgatgagcagcccgatcgccgtgacgacgatggtcgacggcaccccgaaccggaggtggctccagaaggagaggttgtagccgaagaactgagctcttctagcctgctcgcagacgatgaggttcgcagccgagcccagtagtgtgaggttcccggcaacggtgctgacccacgctaggataagccaggccttcctctctgaatcgtgagagattgcagcagctgatgcagccactcttgtgccgagcagtagtactgaaagacaaagttcagaaatgttataaaagtgccacaaaagaattgttcagaactttgggataactttgacagtcagtatccaaaagaatattgttctgaagatttacctgtgggaacatttgaggccacatttgagaggataagaattaccacagcaagaagagcaacacccttagcactgtcaattcgtgaatacggttcaacgagctcccaaagtgtgttcggtatgccagttttgttgaagccatcgaccgtaataaacatcccgcagaagaagatcagcaatgagtatgacacctatcatcagacatggcaaacacatgaaatttaattgtcccaatgaacatgattcagataaattgttgattcaggcatcagtaagtaaaatcataccttctccagacaagcctgtgcatcagtaaaatcaagcgccagaagaacaagagccgcagtgatggctgtccatgacatgttaagccccatgagaagtgcaatgagcatgccaagagtgatgagataaacagcagtcttccacacaaacaccctccatctcttctccgcaacctcatcttccttctccttgtcgccattgctggcgggagacggcggcgagtcctctatgatcacactcctctgctggctagcagttcttgtgaacttcctggaggatgcaccttcatccctcctgtcagtgacagttgagacctcgaccatctcatgcgacatgctcgatgcccggagcgacttgatcgcgagctgtatgtccgcctccgaattcacactcctgctcctcagattctcattagcactggtgctcctcacgctgttgctcctgatgattggctcacttatgcagtccatatcatccgggttcagagatgagacgtgtgacattcttgcaggtgtgaacctgtgtgaggtgacctcgtcgtcggcgaccacctccggcccagccggctgcccgccttcctgatccttctccactgaaaggtacttccagaagtaacagaggaggatggcagcatttgtcaggacgccgacgatcatcgccgggaaaactccaagcaagaactgtccaaaggagatgccgctctccacggcaatgacaaggttctgcgggttgccgatgggcgtcgccgcggagccgatgttggagctggtggcgagggcgaggaggaacggctgcggcggcaggttgttctgcctggcaaccttgaggatgaactcggtgagcacgacgcagcaggtgtcattggtgaagagcgcgctggcaatggcggacacgatgcagacgcggaagagcaggtccttgctgcccctgctcttccaggagagcaggttgccgaggtacttgaacatgtcagccctctcgaggaagatgctgacgaccatggtgccaaagaggaggccgatgattgggaggtcgatggcggcataggcgtcctccggcgagatgacacggaagaggaccatgagcatggcgccaaggagggagccggccgtacggccgacgggcatgaacgggacggtggggaagacggccagcacccagaatatcccaaacgcgacacatcccagcactactttggaggtccctgccaacgccatgttagcaaatctctcgtcctcgaacgatcgaacgaacgaacgatcgattgatcgatctatactagagctaaaatgctacgaacaatttttcactgatgatgttttggtttttgcaagaacctgtcacgaactcacagattgaagagacagtacagaacaacctttccccccaaaattacgttcacaatctcaggtcaggttcaggctacgttcacaacctccttgcccaactcaaactcaagaacctgcagaaattggagcagacaaacaaacagaggctacaggttaattctaaaatctgtaaaaataagagagagaaggtaataagatcatttaaaaaaggaaatgtaaagatccttttgttgttgtggttgttgttgtaaaataaagtttctttgatccgggggaacgaaaacgaattagcaagaaacaacggtgttagatcgactgcacgaaaacgggaggacacatatttgatatttgagatcaagcaccaccacgcctactcacggtgtatcctgcaaacaaattcaagcgagaaacagaagcccttatcaatacaaaaatccttcgcacacttcaccaaactaaatgaatagagctaccgagatttcctcagataaattactgtagttatggctaaaaatccagattttttgttccccctattctacgcttcttgcagttgatcagatcgaatggattggagcttggcttaccgactaaaaagaaacgaaagatccagcacaaacccgtgcatgcagtggtgccaaagaaccccaggaacaagatatttttttcgattgtttcgtgagctacgactatgattggtctctggacgaaaagagaagaaatgaacttcggttttgggttgctcacctcggagtaggggcgtggagagtggagagtccacagtgccacgcgcaacgatgagaactttggagtttggacttggagaagtcagaagtggaaagaagcaaaagcaggcggcagcggcggagtggtggtggtggcgagaataaagcggaggtggaggaaggaaggaatggagggggggcagctaaataaagagagcgtccactgctttcatggatgatttgaggtgactggtgggtcccaccgttgagggtcctaggaagggccgatttatcatgtgaacccaaagggtggagctcccattgtgtgagtccgttttcataattttgtgatccgcatatttgggacggtggtatagtgctacttgaatacttcatcacaaaataaactagttcttgactataatttggatattctctttgtaaaaaaataaatatttaaattcgttgtactagactacgtcacatttaatccttcttaagatctctataaaaaaacaaatttataggaagatgtgacaccacctagaaaagcatccaatccttattaggatccttccgtctaaaaaaagtttaatctatatgaagatgtgacgctttgtccagatccaaaactaatcaaagatagtattatctttgtccaaaataacattttcagttatagaggttattatggagcaaattaagacaaataaaatgacctatatgagaattattatatggcatgtgaatgtaagtgagagagtagttaggggtaaaatgaggaaaatttgaatgagataggattcatcgaagtgacaactagtactctattagtaatgtagaagtacttatttagagacaaatttaaatcctaatatttcatttattctgagacataggtactatgatatcatatgacggatatatgccgatcgcaaaattatatgttatgattgtggaataccgttttatatgggaatgtatatatgattactctgtatatatagttttttctatacatttattatctccttgctttatatatttatgaaagaaaatggagaatttataaagtaaggactatattggttggtacacatggggtgtggggctagcagttttcccatacgaactctcctcctatgattcgcgaagttgccaacgatttggatttgcatgcttggtttgctgttgatttggattgcgcgtgggacgtgtgtggcggccagcggagagatcgcgccgtttcttccgatacaagaaatctcgacgatctttgaagccaaaaacgcgtccggatgacgaagcgatcgacaagattagcatgtcattgtcgcatgattttgccgtatttctagcgaataatgggcatcctgtgggttctcctgcttccatccacgctaccaatgattgtacgtatgcaacgacgttttggtggtcaatttgcatcacaacttatcacagccgcgtgagcgcgactactctggactttgggacactggagtttggagtggagtggcaatggtacgaagtagtaccacaaacacaggtgatcgtttggcctaaaactgataagccataaaacgacgtataaaaaaaggaataatttatagataaatttgtattcgcggttcaaaattcaatgtaaaaaataaactaaggtgaaaaacctaaaaaccaactctaatttaaatttgaaaattcaaattttagtagataattatgagctgaaggctaacaaagacgaaccacctctactttgggtgtaagcgcgttagatccattattattatagatggacttcatgctagcccaaagcccagctagagagaaaattaagacgagcctggtcttatgggaaattttgtttagttaccgattgttttaattattttctgataaaatagattattttcataatttgcattaattattttctgataaaatagtttgaatatttgtattaagggaattaaatttagccatgtagtaaaactaagatcagtctcgatttaggccatgtatgattcagcttaggattattataatctgaattattaggaataagttcaaacaaacatatagcttattatgatagattattacaatctataagccagattactataatctaatc

SEQ ID NO: 83251 - DNA, 4109 bp, Oryza sativa
agaacagagaacagaatgacccgggttttttttcctgggtcggccaaagaaaggcagatcaaatttcattaagaatagtttggaatgaaacaaggtaaatccatgaaattaagtttcgatttgaaatgttcctgttaatgaattttatatcttccaaacaagctaggttttgaaaatgtctccatgtttgtataacaacacctcccctacatatctctaaacatggttttatggtggtttcaattagtagatatttctaggatccttagggcacaagaacaaccccggccaccacagaaccatctcagatgtgcctgctccagtgctcacccctctgtctcactcctaatactacataatggctacagctctgaaccacaaacccatcaacttgtggacagcaacagatcagaccaaaaccaaaaagattactcggtctccattatcacggccaattagagtaggatatcatctaccgacggatcaataattgagtagtctatgtactattatacagagcagataagagcacaagcatgcatagccagtggaatgatgaatctggtttgcaaggtgaaagtgcttcgcccagtacgtatacttaagtgctctccacgaagggaactctgctctgtaaagcaacagggcctgaccaaccagccatggatctgaggccgtcagcttgtcaattgccaggattaaattggctgcatgatgaactcccagcaagaggaagacaagtcatgtgattgatgtttcatgggcttaattacgtgagaatgtgacaattcacctactatttgacaacatccatttttccccctcctccaatctctagctaaggcccagctcaaatatgcagtttgtggctcggaggggtgaaacattagcccataattaattacgtattaactaaaaaaattatataaacacactgtttaaccgtttaataaaaatattaacagaaaatgagaaaattatcgttttgagttactcaaaagaactaagtctaattccccatgcgatagcaaacacatcgaacctttccaaccaaacctcgaatgccaaacccacaacaatccgtgcaattatagggagagatgaaaagagtgagaagcacttttgtgcccacatgaagcgaccagctttattggccagcattgacaaataatcacccgtgtgtggggggagataagatcgtctttactagtactttgattttctttcaccgtcgctgtgctaagaactaatcaggccagataaaaagttgatcgatgcagtttcagaaaaacacagcaaagaaaaaaaaagaaaaggctcgttttgtcaacttcttccagtgccaagcatctgcgtgtgacgctgtcagccaagcatgtggcaattgacaaaaatgacaaagtcgtgtactgaaaacctcgaaaaattttgggttttgtttggttggtgcctgatggaacttggaagccccatgtcaatcttggtggtgggcaacgaaatctggggtttatttggtaggtgttagttttttctttctttcttggcccgcaaattgacctgacacgtttgctaaaaccctttttgatggccaaatcactggttttaattggttttggtcccaaaagatcggcacctaactatatgtctctttctcattaaccgtgtcatatgggtttacaaaatttagtttggcctgtgttactatgtggttttttaataacttttttcgattgcacggaagatgcacgtgcacaaatatcctattacctaaattaattatgttgagttttatgacatactactactcaagtcttattgaataagccctgtaaccctacattcacatattttgtaccccatgtgttgggttgttcatgcatgaacaataagcactttccagcccctttgaaacacatgaataataaacacagaattttgatataaaagcatgaaaaagtggatacaaaacatagaaaaaacataagtatattgtttggatagaccgtagaaaaaaaatatagaattgaatgagggagagagagattcaaaggaaattttctaatagattggagctcttgttaacacctttttttcccctccaaaatctccgtgcattgaacccttcctaagaaattttacaagatttgagaagtttcgatactttgtttcaaacggctaaatagaaaaaaaaatccatataggattaaaatcctataaaacttcttcacaaatcctttgtttcaaaaaaggtccatcgaccattgatgtcagcatgcatatgcagccttgtgatggtgctatatatatatggacatgcgtgtattctttcaataatacaaagatctacttgtcaacacgtgaatacgatcggcaagtactgtacagtgaaccgcaagtactgctataccgttgtacaatagtattattactgtaattaaatttatcatacaaacggtttctatttatagtggacgctggcaaaacagttggtccaacgcagaattgtctaaaagtagcataaacgaaatcatcgtagttcaccacaacgacaaatgaagccttaattggttgaagggacagtaggtcaatttttaaaatgcaataattacggctacagaaatcatctttttttaaaaaaaaacaactacaaaaaatatctttgcacagagtcataacatattttcacataagagtgaacaaaccgcctctaacttaaaacctacaaaagtactcaaacattgacactcaatctattttgttattatgaaccacacgtgctctttcgtgacccgccattgacaaggttatataatgcttctcttttttctttccatctcttttaaagaaatgaaaagaaactcttgtgttatgttgtgaatagcaacataggcgaagttaggcgtaggatggttatggcttgaaccccataatttcacgtaaattatataaaaacactactcttctaaaaatagttattactaacattgagcttaaaagtgaagtttgatttagattttttttaaaaaaaaagcaaaacaagtcattactatataattaatagaattttaattattataaacttgaaatatggatttatttgatttagaaaactaaaaaggtatcgtttaacagtttaaaaacattcttatgataaacaaggaaatagcaacatccaaactctgtttaacagttttaaacttagctagcctaagaccctagtactagctcagtcataggcgtaagtttttcatggctttgcccctagccaccatatagagcgatatgaacatacttcctacgtctcataatactggatgaaatatttcatagtacaacaaatttagatactatgctactatattatgggacgaaaagagtatgatgcactattagcattgtggctttgtaaattattgaagtattgctatgatagccagtagccactatacgtgcacatgcatgatgcataccgtcctcccaccatattgggctcacaaagccagcttaacttagtactccgtacgtatcaccagtagtgctgacacctgcctctactccgaatttactgctactccgtactgtacttatatatgcaacgccatgccaatcaaaaaggtcgatcaacagagctaccaagacataaacacggtcgatgattacgaggatatagctcgaaacacaccgcaagatcaacgcccaattatcttagaggttgtttgggaactaggaactaaatttagttccttcagggacttatatttttgtgagagagactaaagtttagccccactttagtccctccaaccaaacaccaccttaggcacgactcgtccaccaccaccgtacttgcattgccaatactgccatgcgcgcacggggcacccgtacgtacgtgcgtgaagcccatgaacaaccaaacaaaccagcaccgaaccgcgcgataaaatccaacacaaacattcgtagtacatagtacttaccagaggaaaccttgccgctgccaacgtccacgcgacgctcgacgtactccgccgcggcgccgtttggcgcccgcgctctccgacgacgcacgcacgcaggcgcgcgcgggcttagagtcgcttgcgcta

SEQ ID NO: 83252 - DNA, 2741 bp, Oryza sativa
tcttgccgtgggattatcatactattcaacatttcaacaccgacagttacctgaaaacttgtcattttgagcctccacaagcggtgatccctcgagctgcaaaacgaatatttcgaattagaggcattgatcacaatctacaaaatacacctaccgccattagtgaagctgcaagtaggcaccaccacaccttgcaggagaggaggctaatacagcagccgttgggctcctcgtcgacgcgaacaagtagcacggggcagacctcgagcgcgaagaagcggaagcggtagacgtatcagcggaaggtggactcgtcgacgcgctcgatgcgctccgcgtcgagcaccgagtactgactcgccggcaagctcatgtactccgctacacgacacgagcaaagcaaaacatctcaggctcagcttcagggcggggatctctccgacaaacgaagcgcgaggcaaaggcgaatcccgagcccggggttagtactcgggaggggaggaggactaggagataccgaccgagcgggcgggcgagctgctggacgaaggtggactcggagcggcgggcgacgaagcgcgccttgggtgcggacgacacggccgaggaggaggacgacgaggaggaagaggcgcgcacgacggcgcggcggcggcggaacgccgcggcggggaaggggggcggcgaccggagcgacgcagccatgccgtgccgggtgagtggctagcggtggttgcggccctccgggaactggagcaaatgaggcggaggtggaggcgtggtgtgggggaggaattttgggttcgatttttttttaaaaaaaatggacggataagatggagtgggatggtgacgggtggtagatctggccacatctgggagcccgggttgggcgatgtgttcagcttatcaggtgggccaaggaatccttgagggaaaaaaaaattggaatcctccttagtagaaaatttccttgctcactgaaaggtgggccttaatcctgagaggctggtatatactagtactgttgcatacacatcggtggccgctgtgccggtaccgtatgtagcactactacgtgagaaagtgacttgttcatctggaagaaaatttgtgacggataatggtttctgaagtacccactgttttgttcattattcccggtgaaagtccaaactttcactatctgagtgaaaggtggaggtaccgttgaattttcgagttgggagtttgaatatttggtttttgaaatgtgaaactttgaagcaaatagggacatagtatcacctaaggagcatacgagaatcacatactccattcacaaggaaaagggggtttagttaaaaacccaccatctccggtttttagctaaatcagattatcagactacctagaaaggttaagcgcactctaacagagttttcttgtactagttcaaccaaaaattatgttgagatttacaaccaaatgtgcctcggtgcaagatagcaagatgaattgcacctactacaacaataatgtaaataagctatactcattgagaataactcatcagtcatcaatcaaaagtcattgggccatgatgagcaaaattacatttttcatttcaacttttgtacatcatctccgaagagctaatacaaattacaaacctattgcctacaatgcaacattagactatatccaccgacaatctatattccctagcttacgttgcacaaatgatcgtgtgatgtcgcttcaccagatctcagatcagatgtcatgcttgtttaatcaatctcagcatgcacgtaatctacaaatacaaaattcttctggagcgtataaaatgcgtacgctacagcggcactaaccaaagcagcagcggcaagcaataatctgaactgaacatccgcaggaatcccagcagttgcacagaacgccactgtcgctcccatgaagaccttttgcagagtctggaaggcgttgtatgcccctttgcaagatgagcatttcagtgtgtgctgctcatatctatctagcatctgcataggtaatttgcaactcggtcaacatatagtcaaatataaggatacaaggattgaagaatacatagaaacgcaagcataaatgaacatgtttttcataggaagtataagttgaaatttacaaggaactgctgtggttgaatcttcaaatatgtggaactgctgtggttaaatcctcaaatgtcaggtactatgagtacttcaaagctatcatacctccatagatattttaaagtacattactgagcttcacagctaaaggcgccagtaagtatgacaattaaaatatagcacagaaacaaaaaaaaatcgtgccaataatgagcaacataaaacctttgttttgtgtccaaaacaatatatcaaggttcatggaaggagtagtgtgcaaaaatacttcatggaaatcaattatctgtgcccataatgaacaacatcaaaccttttgttttgtgtccaaaaaaaaaaaaacaaagttcatgcaaggaggatagtgtcaaatactttatggaatcagcgcgtaaaaagttcttgcgagcaaggtagtaaacataactaaattccttaaaccatctaaagactagcttcaaaataaaactgcataaatgctctcacataactagatcccagaaatttttacctcacgctttgaaaggacagtggaaggcaacacttcttggctaggatttccaaaccagtcaggttggctgt

SEQ ID NO: 83253 - DNA, 1024 bp, Oryza sativa
ttagattgttgaaaacttgaaaacaaaactgtttgcaaaataacagccttccctttaagcctgcattaaccacctaagttcccctggcttgctgagtacgtaagtactcacccttgctctatataaatatatatatagttcctccgtcttgaagaaaagatgaagtgaagcgaagattagggtttcgtcctggatcccagccgtcgcctgtggtgttgggtgttagaccgttggttccgctgcagctgctgttgttggtgttcgcctcgtccgtgtcgtcggttgcattctcgggctgtctgagctgcaacctaagttaaggtaaataagtcctctatttattctaaggatttgcaatgattcatatttgtcaccgtgggtaccagcactatgtcctgggactggtaccgagttcgcggtttcgtaggaagcggttcgcgccgtttttcctacgacacgctcctatcaggtgccgttgtgcggcggtgccggattggggtgtgacaaaccgtcttaccgtgggatgacaataaccccatccaaaacgattcggtgaattgtgctatggaggctccttgacagttgatgtcggcatgtgcaagcctcatcgctgcttttatacttggctttcgcattgcaccgatgctattgctagctgcaatggttgatcggagcaagctaatattcagaggaagaatgaatagaaataattgggaacaaaattggcatagacaaagttatttaaaattaaaataacatattgtccaaacaagatttcggcaataataaaatagggtggctatcaagctaggaaagtggatgggtttggagacaaggaattttatacaggttcaggccttcttattcaataagtaataccctactcctgtccggggatgattccgccgagtatgttattgattgtataaactggaaaaaaaaatcgccccccaagaggcacacggaccctccttatataggggaaggagtccgctttacaaaatacagtccatatcctaatgga

SEQ ID NO: 83254 - DNA, 533 bp, Oryza sativa
tcaatgctacatatttttgccaatggtcaaaagctttttttttgtgtgttttctcaatagtttttctttatttcctatgaaaacataagggtgtaaaggacatttaaatattaaatttgcatgcagagatgatgtggcatgtacacatggcatgtttagagggtctaaggactatattgaatcacacaatgaacttaaggtacttgtttggacaatacgaaatatcagggactaaattgatccttaagcgaaagttcaaggatcatgttgggtattcacccaaaaataaatggaggattttgttccacttaccaagctatccacagcaaaaacagagtaagataatatgcgcttgcctagcattgcataatttcattagagatagtaaactagccgactgtgaattcgacatgtgtgaccaagatgaaagctatgttccattgtctgagcaaagtctttaatcaaatgatccaaccagctctttggatagtcaagtgatgaatcaatttcgggacacggttgccaatggactg

SEQ ID NO: 83255 - DNA, 1098 bp, Oryza sativa
attcctgcagccccccagactgaagctgctgttgatataccataatatttggattgtactgcattgaacagggacaagatggatttcaagagcatattatgaggaaaaccatcaatacgttccaaaaaaaaaaaaccttcgagagacaaagttgtaaaaccaatattatatagaaagctaaagtgttatctgtctgaataaccctaaacttagaaacaataaaatgagccatactaaagaatcctcttaatattttatcctctgatcgcatgaacaaaattagggtgctatatggcataagtatgaaaaaagggttaactcaagtactaacactttcagttatttgacatatggtcgggaagcaagaaacgcataaatgtaatttgacatgctaatactacatacaccacaatttagtaaagcaatgcccttttaaaatttgacagcatcgttttagactaaacgcgacaaaagtgcataaatagatcatgtgtgaaacagatatgtatatgattgagtaactggagtatgttaagagtaactaaaatgcaatcttaaaaataaaatcatgttcaccttcaagccagggcagatggattcaaattcaatctttaagcttcataaaaatattgcccttcaaataattcctagggtgtggaacaatggccatgaatccggtaactgacatatcaaggcctcctagaataattgacaatgatgaagaacacattgcatttaccaaggaaacttatcacaaatgcatgtactccaattatacatgtgtccaaataaacatgtcactgcattgagacttcgaatcagtaacacgtttccattgtgaatttagaggatgtcacaggaaacatatttagaggatatcactgaaagagatgctcatatttatataacaagcatcagaaaatggtgacgaataaatgtattatgatagttccggtaaccgaacagaagaacatatgcaaattatactgcattagtttttttgtctaaacatgtatataataccaccaccaccaaacatagaagaacagagacaaatcattcaagggtaaactaccattgattcagatgcgatcgtca

SEQ ID NO: 83256 - DNA, 8705 bp, Oryza sativa
aagagagggagatgcgggagaggatgcgcggtcgcgccgatgcggaggaggcgcgtcgattgcggcaaatagagagagagagagagggggggggggtgcggagaggatgaggaccgacacgcgcccatgtgggacgtccgatctaacacatcggatgattttacaccgttagatatgtgatatgatgaatgagtaaatgaataaaatcatttgtttaactatagggtagatatgcaaatagtagattaatgagccgatcggctgacaagccgatggagtagtttcagtcgatagccgatattagccgatgccgatagggttttgagctattggcaatatgtcaaatgtagataatgatataaaggcagtcggctgatgatgatgcaatacaacgacaatataatccagtagaaactaatcggctaacaagatgatatgatagaacaagttctgatccgatggttaaagcatgcattggctggaggtccgatgtcataaaatccacaagattagataaatcaatgaaacctttgttgtcaacggctaaatacaacttatatgtatatgcaatccttataagccgatgcaacatccagataacttatcggctagcaccccgataaaacattagcatgaacctatcgacttagcaagatttatattatcaacaacaatctagtaggtcgaacctaccaatgcagcacgagattgtatatgataatctaatactcggtaagccgatagatctatctaatatgatggatatagcaaatctatttaggccctctttgtttaggcttataagccaacttataagtcgaaaagtctaagccaaaacaaacaagcagcttttttatttggcttttttgaagccataagccactctaacactattaagccaaaagctaggttggagaagcttttttggcttatatgagatagatgtatgactccaccactaaacttaggacattaaatccactgacttataaatcatataagccaataaactgacttaaaagtctaggccaataagcctaagcctaaacaaagagggccttagaacatcattgtgattgtagagatatatcggctaagacagaagatcagacctaaccgagccagtcccaactaaaccgatgcgtctctaaacacaatgcaattagggatagaattgaggtatcaggtaggcaaatatatcaaccaaaccagagcgatccaagagatcgaagcgatgcacccttgaacaacaccaatgtagtcaacagattcaccagggccagcggaacgtaggacttaccccttcgccggagatggaaagctgatgcaaccccacgtcaggtgccaagtaacgtcagatgacaagtaaaaaccttagtaaagagggtggtgatgcgccgagagtagttgtattgattgagagattgatagattacaatgaccccgggtgtacatatttatacccatgggtagatactagtccttgtaggacaataaagaaaatttcctaaagataaaaggaaaacacaaagtccttatcgaacactaaacacactttcataaagataaaaggaaactaacgaactattcctaattaatagatacacttgccatgccgcatcctccttgaactcggactcttctggataaatttccttcaattgatccgactccatcaagaacacaactgctgccgatttgatgactcccatcggccgattctaagactctgaagccgatactaactttaggccgatgatgactttgggcttaccaaattttggcgttaacacatgccccaaattttggagtatgaaagctcatgcttcaatcttatctcatttcttgtcttggtgactccaaaactgatcttcctttgcttcgtgcagtcgactttcatgagccgatactgtctgcattagatgagccgggctatcaaactcgtagcaaaagaatctctctctgatatgtgctgacaatccttgaaatgcgagatctgctagctgctcatcgctcaggctcaaactataacatcggctgcagatattccgaaatctttgaatatattccatagccgattctccttcttgctgctgaactgatatcaaatctaaaagcttcatctcatcgatgccagcaaagaaatagtcatgaaattgcttctcaagattggcccatcctccaatagaattcgatggtagtgatgaaaaccatgtgaaggctgatccagtcaaacacagtggaaaaaatctaactctcagagcttcctcagccgttgcttccccacattgcactaagaattggctgatttgttcctgtagatatatcatcttgccctgaaaatttggagtaatttggaactatcggtgtggcaatggaaccctatcaaaccactcggcatatggcagccgatacacagaagtatgttccttaggattgattccaaactgctcctctattacctttgcaattctattggccaaatcttccctataatgatatctttgaattccttctggccgatattgttgatatgcctcatcatgctgacaccgatgtgcttgccccccgagccgatgctgatgttgttcttcaatctaccccccgagctgacttttttgaataattaactcatcaactgttaccttgatcaaactttgtaatgtatccgccaaaactccagattgattaaacaatgcgcgatgaattgcttcatcaactgtatcttgaagtgtttcaaccatcggcttgcgagattgctacttcttggtattgacttcctcttcagacatgttgggtgcaaaacttgtgtcccaccgggcgtgccaaaaattgactcgaaaaacacacactggcttgggagatctgcttagctccagtgtaggtccaaaggttgacgatatgtgggtgtgcccgtcagtttgatcctgcaactgacaaaatatgcaaatagtatataatgagccgatcggctgacaagccgatggagcagttccagccgatagccgatattagtcgatgccgatagggttttgagctatcgacaatatgtccaatgaagataatgatataaaggcagtcggctgatgatgacgcaatataacaacaatataatcctttacaaaccaatcggctaacaatatgatatgatagaacaagtactgttccgatggttaaaccatacatcgactggaggtccgatgtcataaaatccacaaggttagataaatcaatgaaacctttgttgtcatccgctaaatccaacttatatgtatatgcaatccttataagccgatgccacgtccagataacttatcggctagcacaccaataaaacattagcatgaacctatcgacttagtaagatttatattatcaacaacaatctagtaggtcgaaactaaccgatgcagcacgagattgtatatgataatctcatactcgataagccgatagatctgtctaatgtgattgtagagtattgtgattgtagagatatatcggctaagacaaaagatcagacctaaccgagacagtcccaactaaaccgatgtgtctctaaacagaatgcaattagggatagaattgagatatcaggtaggcaaatatatcaaccaaaccagagcgatccaagagatcgaagcgatgcagtcttgaacaacaccaatgtagtcggtagattcaccagggccagcggaacgtaggacttaccccttcgccagagatggaaagccgatgcagccccgcgtcaggtgccaagttccgccggatggaagtaaaaacctcagtaaagaaggtggcgatacgcggagagtagttgtattgatcgagagattgatagattataatgaccccgggtgtacatatttatacacatgggtagatactagtctttgtaggacaagaaagaaactttcctaaagataacaggaaaacacgaagtccttatcggacactaaacacactttcctaaagacaaaaggaaactaacaaactattcctccttgagctcggactcttctggataaatttctttaattgatccgactccgtcaagaacacaactgctggcgatttgacgactcccatcggccaattccaagactctgaagccgatactgactctaggccgatgatgacatcgggcttaccaaattatggtgttaacaaatgtgtgtggtcaaatcttcctccagttcatctaaggacaccaagcaaaggataggctaagatagagaggattaactactgagaaacagtgtttagggaaaacttaagtttaatcctaacgcgatacttcaggaactggcaacccgctgttcccagatttcgctctactacgtactcggacagggaggacttaagtgatctagagggctgtcaccacctctacacctacctcaaatgtactgtgggatacgcatcaattattggataacaattacctaaacacaacgtttaagcaattaatatctactttagtgtttataactcaccaaagcaatcactatattttacttgattatagtgaacaataatcccgtttgctattaggaactaaccaagagataattctcacaagataaatctaaattactcaggaagatagttcagttgaaatcagagtaataaacaaaataaaagaaataggagaagattaccgacaacttcggaattcttccgacttcttctactctactctcttcatattctagtataaaatatagtacaatagagcctcttataattcagctcaagcttggaagtgtgtgtgaagtgagggaggtccttaaataggacagttaatgacggttagcgaataggaaatgtccaaagtgccctccaaccgtcatcagggatgcatccgggacgtccacgccaaaccccagcttggacgactgtaattgtggttcggccgaaccaggggtacggccgaaccctggctgggctcccttggcctgtccttcggcccatttctctttctgggcttgccttatccgattctcggaattttgggctaattcttcaatgttttgatgaagttcaaagctcctccttgtatggatatgcatcctccttcacttttagttgcttttcctcccaccttcggggtttatcatatacatacaaatatacaccaacacttgtggaatatgtgagacttaacacctatcactatgttggatgttttattatctggactttatgcatatgttggcgatatagaattggcatttaataaccactaatagttgctcaaaactactttgtaaactcgaacctaagtcttcacagtattattaaacaaggcagtgaacccacacaaacctatcttggcctaaggcccacgatgagttggaccggacaggtagccttaagctgggcctcggctcgtcccaagccaacccaagccatccattccaaattttagttgcttagcaagttttaagaattaaaccactaacttgggtacattgctcggcttatccataattgagggtgcagctatccgattagattatactctgatcagaggtgtacatctttacccataagacacgtcttcctcacgtgtcgccgcatgcaccataccaccatggtatacggacggaggaggtgacatagttcctaactcatcctagccatgaacaagagtaccgactgaacacccgcctacggacagggctccccggacaggtaggttatagttgagccccatggcatcaggacatccctcaggagtgaccacccggatgcccgtcctgtgccacgatatctcgactaccacgacatctgtatccgtgtccttttgttcatgtccaggttgagccccaaactaagccttacccattagacatgtggaagtacggtagtgctttgaaacagaagcccgaagaccgatccttatgatggccgaggtgctactatgaaaaccatgcaccccgagcgcaatctaaaacattttgggaattttgaatgacgaggagttgtatgtccaattccaacatatgtcgcaaattacgttgcgccgacgaggtccagggccacgcccatccactttgttcaaatatcaactgcatcgcaatcctcattccaactctctagcccgtgacatcttggtaccagattcttctggttccgatcccatggcctccacaaaagcccagctcgaaatcgccaaaaacctcacctcaaggctgcacaaatctctgatttgtcctggaagatgattgccttagaagcactcgtgccgctcgtatctattggcggtccttaaatcataatatatgactatcaatacctgcatataatggaataaaatatggtattcaacttagtggtagggtttattactaatcatttctattagtgttggtatatatttggatgcaggtgacaaactaacaaagttgagaggaaatatacatgaaggaggataatcaaacacatatacaaacttatggagttttggacccaaaaacccaattaaacacctccaaatggcccaatccaccatgccaatgggctaagggcctcaaaattagtgtccacgaggaaaaatgagccgaacggagccatcccgggttcggttgaaccaccagtttagccaaacccatttggaggccgttgatcgcctgattttacatcgatggccctgattacatcctaatggcggttccggggcattttggacatttggcataggctctaaccgtcatacctgcctataaaaggaggagctaactcttatttccaacacacaactttgagctgaattacaagaggctctgttgtatcttttgtacattagaaataggtagagagtgaggggaagctctggaggaatgcccggaagtttggtgctcatccgacttctaccacgatgagtgtagcttcatagtaggaattctggaggagtaccggagttgtcggtacactttactccgggttcgcagaaacttcttctataaagtaagcatttgggatcctttcttttttattatttaattatttagtctaagtgagatatatttccatctttgtgggttcattatttagtattcgtactaagtgctctagtactaggactccggatagagaaggaagttcctacgcaagtattagagtagtaattgtttattgtgtatcccacagatttgtcagaggtagacggcaggtggtgacagccctgaatcccgtcccagtaatcctccgcattcggataaatcatagagctatagccggaaccacgttggcagaccagcaggggtcggtgtccggagcatcatacaggaaattatgttttactcagcttagataattaaaaacatagaaagtcctctctagcctgcctagcctaccttcagttgttgttcttggatagtcttagccttagatagattatacacgttccctgagttcgatatccgtttggggttacccgaatgtcacgcctagaaattcatgaaccagaatttctaagctgaatgtgcattaaactaaactaggggtgagactaatcacagtgaatctggttgatcgcccataaccgcgagcacgactattcgaatagttttactctggccagaggtgtacaactgtacccacaagatatgattccacacatgtcgccatgccccgaagtatcaccatgatactgcaaagggggaaatcgtgacaagaccctccgcataaccctcccctaaccattcacaccacgctaaggtttcacccccacccctcaaaaggcagtgggcggtcccctcttgcgccgcggtgaatccggcagctagacaaccggacaccccggccgacccaactccatcacgcccaccatcgccaccggtgcctaggaaagtgtcgagctatacttcagatcaagcagttacccactccctcttgtggtcagcacggtaagtctcccagggtttcccgtgaactggtccttaactgccatgggtgcgaccagcgaaaccatgcacccacagcccaccattcagtgtattttaattaactaacaccattgcggtggaaccaatccaaagctatgctaatagtcaaagtctatgtaataatgtgatccccctttgtgtactagttgaactaagcatggctaagcatttcctaaaccaacatctaatcattttgaaacccaagttatcaatggcataaggtaaacaatatatggctgaataataggacccatcccatatgatattgtaaaagaatgcaacatttaatagaaatgcgggatatttgtaaattgggtacaatacgatcaaatgtaatacatgacttgccttgctctcgcactgatgagaccacagcaacgtcttcgagaaaccgcggatcgacgaagcggccgaaatctacgcgacaaacaaagcacaaaagaaaaacacgctataagactactgtaacagagaacaaaaccatttttaatagattctagggatttttatgaatttattgagacttgaatggacttaaacggagctcggatgaattacttatgaattttagaagataatctgtgtttttactaataaagaaaaggccttaattaattatggcgcaataaatccccagggctgacgtcagcaaggggggcgccgacaggtgggccccgcacgtcagcgactcaagagagaggaaagggcaccggcatgtgggccccacgggcggtggctcaaagtggagggagt

SEQ ID NO: 83257 - DNA, 26635 bp, Oryza sativa
cggagtggaagacgaaggcggcgacgaccacccggtgagaggaggggcggacgagcggcggcgacacctagaggaggggaggagaggagttaggagaggagacgatgaccacggcggctttaaacgccggccggagatggaggggaatggatagctcaccggctcgcgagggagatggggttccgatggggttccggcgacgcgaggtggtggccgagatgacccacacggcggtgaagctagcggcggcggcggcttggcgcggcggcggctctagcggcgacggcgcacggccggaggcggtggtaggcggcggcgctagcggcgagtggcgcgggcgcgataggaggcacgggagagagcggcgagcgcggaaaaaggaagaggggactccggggagggattttataggcgagggaggggagaacatggccgggaggtcgtggttggcgccggcgacgacgtgggggaggtggggagagagagggtgttgggggatttcaagtcccccaccacttgcgggcacgcgcgcgggggagatgcggggaaggtggaggaggtgggtggcgtgggcgcaaggtgcgggagcgagaggcggggaaggtgggcggcatgaggagcggtggtttcggtggcggttggcgccggggcgtgggcgactggaggtaggggacgacctgacaggtgggccccacctgtcagcgtcccagagaggagagtggggtgatgggccggactagtcaaggagggagagaggacgcgggaggaaggaaggttgggccgacggcccaacaaaggaaatagggaggaaaagaaaagggaaaaagggaaaggattctcctgggattaaatattgcggttgtcacgcccggaaataccctagtaatttccgaactaatttgtgcatgaaatcctcgtccaggaatcagccgaggtacacaaactgacaatttaatatacagattcatcataataataacgttacatacttacaaaagaaaagaaaactgctgcggaattacggtctagcgaagctccggctccactctcacaggcagctcaactggggtataagccaaacgtcttctcctttgcgacttgtcttcaactgagatttgattgattattgcaaggtgagcatatgacatactcagcaaggcacacaacaaatatgcaagtgcacaaggataccaaagaatggcataatataggtgttgatagaaaacacgaggcctgggagatctgcttagctccagtgcaggtccaaaactcgcctttggatgtatgagcgtgccagttgatttgatcctgcaatcaacaagaaacaaagacaaagaaaccgtaattaaatccataaatgatagccgatcggctaaatgccgatgacatatcatttatctttgagccgatgttatatgtaaatcgatcggcaattgttaagaaaacaaatcagaactaaatctactcgatcggctgtaaatatcaatgatacataatccttatatcgatgtatacttgaatcaagtaattgggatagatcggtcaccttgccgagacagtataaatcacttacatcgaaatatatattaataatgagattatatatatattcatagcatagccgatcagatagatctagcgtgtatcggctaatactccgatactactttatattaagatattaaagcaaagagaatatactaaacagaaatctaatatacttaaatgcaacaagatcttaacatgaagggcagatccaacatgttaattgagcatgtagaacaaaagcaattggatcagataagatcggctgaaactccgatactaccctaatcggcaaccagtaggcaggctagagattgaaattttaagcacgacttaatagatcaaactcaactgatacagcattaagtatgaaaagaagaacaatatctagacgatcaagccgctggatgtttcatagagtggtggatatctcatataatctaagccaatgtcgttatttaacctaatcggctgccttctggtagcagatgttagccgattgtaggttaaatgacgatattgtcaaggattatgtaagatatatgataacttgacggactacataaacaagattagagtatcataaagatggaagcactaatctcgagaacacaagccgccataacaagttttacctcttgttgaacatcaaaaccgatgcagctcaacccgaaagcaataactcgttgaaataaaacgaaagcaaaaagagtggcgatgcgccgaaattgtattgaacgtgtgtgttcatcattacatagggctcggggtctatttatacccgagaaatacaagatatgtccatattggacacgactcttatctctaacaaactctaagataccacaagtctttgcggcagacttttgcccacatttatctctaaggaatttacataaaatatcctaattaatagatacaattgccttcccaggactctatctatgcgtggcaatcatcttgaaacacatcaactcgaacccaatgtcgcacatgggtcgtattatcggaatcggctgtatcacttaaccagactgactcagacttagccaatcccagtcgtagccgatccggactccagccgattcttactctgtttccgaaaaaaaccttatcttcgagtccgcttcgatttcatcttcatctccgatgttgatattaccaaatttggttgttaacaataggctcatttgcaaaagcagcatttagcaaacatttaagagaagtaaaatagtagagcaattaatcatcaattttaatcaacactgaacatcacacccatgctgcacaggcccaaccaaacctaaacaaccatacccggctgtacagatctatctccaaaccaggaatataccattccaaaccaggagctaatcaaattttaccagttatagcatcatctattatggtgagaagtgtgagactatcatgaaagacattgttagacccgcccataaccgtgggcacggctattcgaatagttttactctggccagaggtgtaccactgtacccacaagacacgattccacacatgttaccatgccctgaagtaccaccacgtcactgcaaagggggaaatcgtgacagtacccttcgcacaacacaactcaaagcattgcaccgttcctggatcataatcacccccttataaacaaggcatggactccccagcgacccccgtgggcttatctccgccacttctcagtctggtgctccgcaatgaaccatgctatacaaaagataaagccgttgcccatgctggcttgtggttggcacggttaatgtttcacaactgaaacttgtgaaccggtccttaattgtcatgtgcatgaccatcaaaaccatgtgctcacaacccaccattatcaagttttagttagcatattaattaattaaccaatcacgattgaccatcgtgagctaatcattaaatatccatcattaagtaatagtaaaacattagttatcccaatcgtgtactaatgtttctaagaatggctaagcaattatgtctaacatctagctgaaccaatatataaagctcaactagtcaaattataataacccaaggtaatcaagaaatagggtaatcaatgcaaattgaccataacaaaggaataagttcacaccacccggtgacattcgaaaataaatgcacagttgaaataaatagagactttaaatataggatcaacatgctcaaaggaattgtgtttgggatctgtgtgacttgcctagcaataatcggtctttaataagtcttctggaatacttccgatgcacacgcgaacctttgcaacggcggaaacgacaagctaacacgcaaaacaaagaaaaagactaataaaaaccaaataaacagtacatataaagtaaacaaacatgtagatcataattttagatgaatttagagacttaaacggcatcattccgatttcatatgaattagttatgaattttacaagatttaattccaattaaacctattaaagaaaagactattccaaattaattaaacaatttacaaatgatttataactgagggaaaagattaaaacaacctccagaaaatattagattatatttggtagatgacatatagtaaaatgaataatatgccattgaaaagagaggaaaggatttatatggctgagattaatcttgaccaagtcgaccaagatcggatggcttagattgatctggcaagcgagcctcacgagatatcgactcaacgagtcaattctacgtgacacgggaccacccaaaagatcaactgaaactggcgaacggaaccagcggctctgaacggctctaacctaaaggacgactcaacacggacgaacgaatgaagcacggggaacacctcattcgaacgaacgagtgaacgactcaacaatggctatggctaaaccggtgggctagaaacgattcacggtaaagccccggtacgacaaacgataggccggtaggaacctagggatgcacctacggctttacaactgggctaccgggctacggctaaagcggcacacgactgcgacacggcacagcagcgacggcaaacggtgactacggtagcgggacggcagcgacttggcacgctcgagcagcagcagcacggctgtagcagggagtggcacatcgatggctaggcggctagcgcagcgacgacgtacagcggctaaacggcgacgcggcggcaacaaggtgctggcggcagcggcggtgcacagggcagccggcaagtgacgcggcagcggctgcgctagggttagagcaacagcggcggcgacatgaccgagggattgaaacctaacccgaggggacacggatagaagtctcaccgaaccaaagcgatcggagagggagggtcgttgacgctagacaaacaacggattagattagattggattaaggccctagggacaaaatatctacaccggtgaacgtcatgggagcggcggttgccggcgaaccacggggcacattaatgcaaacgaagggcaccaggaggaagaggaggcaacggcgatgcttaccaacacttacgcagcgacgaacagtgacagaagatggccggcgacgagatcgggacggcggcgagatactatccatggtggcgacggtgtttttggcgaccttcggcgacaacggaggggtggacggccttcggcttggtgctgcgatgccgacgacggcctcggggtgaaccggcgacgaccgcaacagcgaggaggctcggccggagatcaaaccgaggcggcaaactcggccttcacggtgacagcgacttccagcgagacttggcggaggggaaccggtagacggggtagagctcgaccttgcggagccgatggaggtggcggcgcaggagggcgacggcctaggagacggcgcacggctgctgcagcggcggccggaggcggcgaagcttggattcttgtcggcgaggtacttccagaggtcttcgtcttcggggaagtggaggccggtcttcctctccttcttgcgaatccaacggcggcagcggcgaccgaaagcgacgacagacgacgacgaacggtgcggctggagcggcgccggcgcttggagagagaaggagagcgtggggagagcgattccggcggcggcggaagaagggacttgagaggataggtataggacgactagtgggtcctttatataggcacgggagctcgggtccgggcccaaatcgacgggaaaagtcgggaaagtctagggttctcgccggagtaaggaaagattgaaccgcgaaattggaaaagatttccatagaaacttttagtgatttcttggggaaaaggaagaggagattgagaggatcccattcccgcaactaatttggaaagaggagcaacggggaggtcggatttggaaggatatcggcggcagctgtgcacaggctggagagctcgggcgctgtccagaggtagaagaaggagcactgtagcgagagggacgaaaaacagacttttctgcgtctgagaggaagggagagaatgagctgaattcggcccaagctgaggggaaaattcttattacttttccaaataaattaaccaatgagatgatctttcaattgttaaaaatacttccaatgctcaaataattaaaagaaaaatcttgaacatacttggacactctaagtatttaataatattgaaaccagaccatttaatgattaatttattaattaaataattactgaaatattctttgtattattaaaattaatacttgagctctgaaaaattcgagaaaattccagagagtataattaatcatggagaatttaataaaaaataaatccagccatgctttatatttaggaaattttatttcccacatttaacttcacttgtaaattaatgaacatttaatataaattctattaataatttattaaataatttataaatcctaatacgaaaattcaggttgtgacagcggttaatgaattttaattggttaaaattatttatagggctgtgaaaattccactaaaaatcttgttaatacattaggacatggggaactcaagaaaaattccaccacgctatttctgactattaattgcatttattaattagggattcaactctaggttaattagaacaatttcttcggacgatttattcaaccaacttttaaagaaagaagaacggggaaacttcagggcatgacaccgaatgtaaagtgctacagtggtattccgtgcgcttcggatttatctatggttgtaagaaattccaacaagcatttctggcgtcgttgctagggaactgttgctaatttattcgagtctaggtcatcctcgtatttttgtttttatttcttcttttttatttctttccttaatggagtgttgtcgaagcgataactgcgtacgtcgaaggacgtggttactcaacagtgtttgacggagcgtggggctcctcaccgggagaccgcgcaggcccccctttgccggttcggccgggggcgctaagtgagattcttcgccctcgatctgaggaacgtcagcgagcgagaaagtgcacaagacacaggcgacgtagacaggttcgggccgctgagaagcgtaataccctactcctgtgttttggtggatctgtgagtgaaggaataccgagagccggagagccagggagagttcaggccctccctcttctccttttttcttcttcttcttttctttttctcttcccctctccttaggcctgggcctccttttttatttggtcaggggtcaccacatgggcctctcgctgcctaagaaaggaaacatgctttttacaatgagggctagtctacagccggaagtgacatctgacaagcagagcacacgcctcctgccccgctcgcccgcttttcccggggacgcccatttcaaccttcatttaatggccagcgacttccttgccatgcttgcgctgaagcctggaatgaatctgaccgggactgacatacccactcctggagttggcatgccggctccggctagggacgagagccaggaagctctcatcattccgacgggacggggcgaggcgtgtgacaggccgcctgttgccacctaacccgcgatcttgacctgtctgtgaccggtcactcaccgcgaccggtcacggaccggataagcgtgcgctgcgccgcattaaacgcggcgtggcgcgctcgtccaacctgctataaatgcggttaggtgagcccgctgtgctcacctaacccacacacgtggcgccaaaaccacagggggtcggggcaccccagccctcggggccgaaacgggagcggcccgacccctcggggagacagagggaggggtggccacgtcaccttcgagcccgacccccccgagggggtcaggccacgagggtgaccgcggctacccaagcctctagtcacgatacccccggccccatgtcaccgacagtgttggaaacagtaaatgtattaatttaagatttttctttgggatccccctttacatgtccctagaggactatttataatcctattacaggttcacccctttagggtttaggctttacaggggaatttacatggttgcccttatgaaagggacgtttgcttgggtatacagtgtaatttggatacatgggcctctaatgggccgattggcgaacaggcctgagcggccgggatggccccttgagcctcctcaaagttgggcttgttattgcgaagtctccatccttcggcatacacccttcgcccaagacgcatttggtcttgccggataccagcacgactcttcggccttcgccatctttgcttcatagtcctcgctggttgcacggtttcggcaggtctggtcgaagggtctcatgacatactgccaacaagcccctcacgggcaagggtgagttaggagcttcggccgagaccgtgcaaaccatgtggtatggtatgaggcgccccctttcgaccgacgctcctgccgaaacctataatacagtcctacaggaaatgtgtacactttgtgcatatgtatttttacggttagtaaattttcctagctttcgccttttgcaaacggcgaagccgtccttatttttttccgtgggccgcaataaacagtgacaggcttcccttcatgggcttagcactgtgtagctcaatgaatgggaatttaccattttgcctaccctcgtgacacatggcggcttacgattgggtgggaaggcgaattgacgcttgggtgggttatatatcccccccttttcaccgccgcacccccgtcattttcaccgcgagctctctcttttccgccctctcacttcacggtcctcttgagtcactagtacctttcgactgttcctcttttcgtcacggcccacacttttcaccatggctcctcgcaagccgaacccagcttccgtgacgggccctgatcccggcaggattgatgacgacaccaccgcctatctcggggcttcgcttgtggacgaggatgagttggcaaagctggtcacctccggcgtgctggcggagaagcaggcctcccccaggaaaggctgttgtgccgaagcccggcgatagccggacggtggtcttcgccgtgttcttcgagacggccttcggtttccgtgcaacgtgttgttttcggagatccttcgccttttttaggtggagctccctcaactaagcccatcggctctcgtccgaatcgccatcttcgactgggcgtgccggaccgctgggttcgaaccattttttacggcaccattttttacgcaacgtaaactcgaagacggtggtcactcccgcagggacgaagaagacagcgttcgggagcgtgaacttcaatgttcgccccgagcactctgatctttggccggtcaacgccgccatgttcaagttggctcgccactggatgtcgaagtggttttaccactccatccccttcgaggccgggtctgagtcggcgaaagctctccgatggcggcgcagggcgatcgcgccgaacaagaagcccaaggtcaccgtcgatggcgccatggaagcccggttcgccctgctttgcaaggtctactcccgccttagctgccgtgacctattgtcaaatgctcctttgctatgttatgtaactttatctcagccctatatgagtttttcttaaataaaagtttgataaaaattgttttcaagaataaaagaaatgtctctcggaaaaaaaaacatttttctctcgagtaaaaagtaaaaataatgacaaaaataaaattatggcaaatttatgggatccatgctcattaagttttcaatccaattcctttttagcatgaatgtgaacaactaatcttgaggctatgataaaatcttttcaactttttgtggtccctccggtatttgttgtccactgaccttctgcaggaaataaaaagacaactaaggggaagtgtataataatctcaacattcataccacgctccttggactatgagaagacagatgctcagggaaccaggcagagcaaatgcaaagttgtgttgcattcttgcatccgaatcaaagcttggtaagtcctatctagtaagaattcgaaacaccctgtgtatcattgcgtcacatatgtccaccctgctaggttacccatcacctctattgctgccataaaaaatgataaaaaaatataaaatataaatataaataaaaacaaaataaaagtgaaataaaataaaagtaattttaggcacttcatgcgcctagaattacttgaataaaatttggctcaccggtattttaccccggtggaagcccattttgctttccatcattttgttgaataaagacaaggtacaaaacaagtgtgggggagtcttttcggaactcctgacgtgcaacagcatcgactcaacatgacaatatgttgaacacccgcccacggccgcgcacaaaacttagcagtcagaaccaagtcttggttgggttggtcgaaccaagtgttcatttgacccatgcctggctcagttctgtcatcgttcgccgtgtggtcaggtttgcgcgtctccttccttatcctcccttgtttgtgagttaaactttggcagaaaatttgaatacaatttagtttaagtccaaatgaaaattgaaagcattaactctcaacaaataaaaagaaactgaatacaattttcctatgattaatcatgtatactttttattctttgccaacacttgtcacttgtgaacaaacatccattatagggaaccttgctaatataagtaattgatatatgtgatatggttatgacaaaagaaattcttgtccaactgtcatgatacttgggattttgtctttgcgaaaattaaaaaattcttttagagcaatactcctcactgactatattattacctacaaaggccatatatgattctcattgcaaaatcctgatatatgtttaggctgcttgcattacattgagctttgtcaaattattgtgacccgtgtgagatgcttttcatactttcatgatcaagatcacgtacactccatatacacacactatgctaaacttctacactggaaggtagcatccctcatccatcatttattttacccattatccacaaaataaatactccatgtcatttatgcctttttctccaaaattctttcaaagaaaaaaaaacagagatagagagaggcatggctatgcaaaagaaggaaaaaaagtcttgctcatacaagtatggagcattgataaacaaaagagaaaaaaatgaataaaaaaatctgctcatacaaagtatggggcatgatgaaaaaaaagggaagaaaaaaagatagccatgcactctctcaaatttccaaagagagaaaattggaggaggagatatatcaaaggagttgttatcttctattttcctttttccatccacacaattctccatacccatacacagatcacacacatgcacattcttgatcagagagtatgacttgctatctccttgggtccggtatcttggctttgctatatatgtgatgcaggtatgccccgattgatccctaccgagctccacctatacaacctagtagaatagggacaattcggcaaacatgcatggtgaggatccacaaatcaaaccacatgagtgatctgagagaaggtcatttgaggagtaaagctactttgcgaaaataaatgaaaaccctaacagattgataggaggaaaaagaaggacttgaatcatgaccgttccattcatcaatttcccaagatggtaagttagatagggcaaaggttcataggtacaggtatgacttagaataatttgtgtacttgtattgtatcttgggaaattttattccacattaatccttaacctttactcgggacgagtaatgagctaagtgtggagagttttgttgacggttgttaagtgccaaaataacaccgtcaatacttgcagaaaaccataaatgtgaaacatccaacatagtggtaggatttatttataacaatttccacgagtgttggtgtatatttgtatgcaggtgatcaaccaccaacgttgggagaggatgaggataaagaatggaaatatattccgtgctgatggactcacatggttttgagctacaacatataaaatgtgcaatcatttggagccaaaacatggagcatcatgaagtggagcccacatgtcagcatcctgaagaaagatgtgggccaggggagccaaccagggttcggccgaacccctagctggcccagtccagcccatattcggtatgacggttgtactcctcatcccaatgatggttgtggccgtttctaccggtggaaactgtcatagagaggacacttgtcaagaggagatgaagctagaaggaatatgctcatatgatgcttggagcatctccactctctctaagcaactctccacctataaatacccctctcctctccctcattcacacacaccaaagcatgagatgaattacaagaggctctagtgcactttattgtatattagaatagggagagagtaagctagaaggaatcggaggaatcccggagttgtcggtaatctcctcttacttttgtatcttgtttattactctgctttaatagaaatatcattatgagtaattaagattttcttagtgagaattacttcttggttagttcctaattagcatacgggatcattgttccctatagtccatttatttgtagtgattgctttagtgtttgaaggacgcggtgtctgggtaattactctccagggttgctgcgtatcccacggtacgtttgaggtgggtgtagaggtggtgacagccctcaagagcacttcagtgccccctatccaggtacatagtagagcgacatctgggaacagcgagttgccagtgcctgaagtattgtgttaggattaaagttaagctttccctagacactgtttctcattaggaaatcctctctaccctctgcccatattagctttgtgtcctcggatgaacctgacgaggagataaacacacacgttcccttggattcgatacccttggaatacttcgtaggggaagtgctacatcggtatatccgtgcgcttgcggattctatccgtgatcgtaagaaataccaacagtctgtggcagcacaggccactctgggattgattgcctagaaacccgtgaagaggcgatgtacatgggcaacaacaacaacgagtatcatccacaatgaggtcagtggtggaaccagccacgcctattctatcaaggaggtaacaataacagtaatttctgtaaccaaccctccttgaaagatctcgtctttgcgcaagctaaaaccactgatgctttaggcaaaaagcgagctgctaatgacaaggtcttagaaaactgttggcggctgttaaatgtcaattctataccgccaacatctgcataaagttcagataataaaacatccaacatagtgataggtacataatctcacatattccatatgtgttggtatatatttgtttgcaaatgataaacctcgatgatgggaggaaaatcagactaaagtgaggagaaatgtgtacccctgcaaggatgggttgtgaacttcatcaaaacatcagtaaatcggcccaaaataccgaagaatgaatagaggaggaccggggggaacatgagctgatggccaggccaggagggcccagcccaggttcggccgaaccaccacctccactgttggatgtggggtttggcgtggacgtcccagatgcatccctaatgacggttggattgcacttcggacatttccccttcgccaatcgtacctacccctatataaggacatcagctcactcacttcaacacacactcccaagcttgagatgaattataagaggctctattgtactatattgtatactagaataggaagagagtagagtagaaggagtcggaagaagtccggagttgtcggtaatattctcctatttcttttattttatttattactctgaagtcaatataatattcttcttgagtaatttggatttatcttgtgagaattatctcttggttagttcctaagtagcatacgggattattgttcactataatcaactagaatatattgattgctttggtgagttataaacactaaggtagatattaattgcttagacatggtgtttaggtagttgttatccagtaattgctgcgtatctcacagtacgtttgaggtgggtgtagaggtggtgacagccctcgagatcacttaagtcctccctgtccgggtacgtagtagagcgacatttgggaacagcgggttgccagtgcctgaagtattgcattaggattaaagttaagctttccctagacattgtttctcactagaaaatcctctctatcctagcctatcatttgcttggtgtccttggatgaaccggaggaagatctgatcacacacgttcccttggattcgatacccttggaatactccgtaggggaagtgctacatcggtatatccgtgcacttacagattttatcagtgaccataagaaataccaacaagcatttctggcaccgttgccggggaatggttgctgatcatttccgaaccctgttcatcctcgcatcctttttactttttttttaccttcacccctgctatcctagagaagtattcctgtcaaactcttctcgaccatggagcaactgctttttgagctgtctgctcctcggggcgaattctatgaaccacctccttcatcagagcccatttatacaactggctatgaaattcgtcccgaactaattagtatggttagggaaaaacctttttttggctttgatctagaaaatctctaccatcatctgcgatacttttaacaagtttgctcatgccttaagattcgtggcatgagacaagaaactgtgcggtggaaattgttcccgttctctcttcaagagagagcaaagcaatggtacacctctaccgttggatgtgtaggcggtagctgggagaagttgcgagacagattttgtcttgccttctttccagttactcgtattactgccattcgagtagaaattctcagttttaagcagatcaaaaatgaatcaatcggtgcagcctggtccaaattcactaatttagtgtagtccggaccaaccctgtccttacccgagtatgtgctactccaacatttccatacgggtttggataaggagtctgcattctatctggacataaccgcttgaggatcgttcatgcacaaaacgccgtcagaaggaaggacaattttggatcgcattctagaaaatacttccttcatggcgcaatccaatgaaccctagccagaggcatccatgtccaagatagaggaacctctaacgatcgagccactcactgaaccatccacttctgctagctcgattgatgagaaggttcctaagcagccgactgtcgagaatgaagaaattcagactccggattatgccgcaattctgttcagggacggctttgacgaagactacggcaataccctgaactattttagaaagaggaaaccacccgttcctttgccacctcctaatcctatggaactcgggttcctacgagaaactgtacgggagttaacatccataatgagcgatgaatggctaagggaggcagaactttcatccaaagtaattcggataaataccgctccccgaatcattccttgccatctggaagggaacgacgtcggtattctctacagtccaactgtccgggccaatctcgtttcctagtcttttgcattcgcttatttaagcgataaggcaatgaccccgactaacaaattcttcaaacatccaaacggaaatatcattgaaggatttgggattgtacaagatgtgcctgtctgctttgaagacagggaggcgatcttggatttccacgtctttgaaattcaagatttcgacatcctaatcgggctgcccattgagcaacttctcattaacacaccccgattagatagcctcaaaataatactgggagggaatgaatttcagttccattctcacgagcaaggatcgccttgaccgattccctcccataaattgagtcagcggaggaggttagtgcagctccccactcacgagtctcccgaggcccttctggaagatgaggtccccgattttatcaaggaagaagcagatcccgttgagactctcgacctgccaatcatggaaccgtcacctcgacctccgcttgagcataaacctctacctccaggcctacgatatgctttcctacacaatgacagagaagctcctgtcataatcagtgacaagctctctgaaaacgagactcaacgtcttctcaccatgttggaaaagcatcgttctgttcatggctactcgcttcaagacctcagggggattaatcccgtgctttgcacccatcgtattcctattgaccccgagagtactccttccagggaacctcaacgatggcttaataatgcaacacgagaggttgtaaagaaagtggtcttgaaactctagcatgccgggattatctatcccgtaccatacagcgagtgggttagcccagtccaggtcgtgccaaagaagggaggaatgacggtcgttgcaaatgctcaaaatgaactaatcccgcaatgattacaggaaacttaacaaggctacaaaaaaggatcatttcctgctacccttcattgatgaaatgttggaacggctggcaaatcattcctttttttgtttccttgatgggtattccgggtatcatcaaattcctatccatccggaggaccaaagtaagactacgttcacatgtccgtatggcacctatgcatactataggatgtactttggactgtgcaacactcctgcatctttccaaatgtgtatgatgtctattttcttggacatgatagaggacattatggaagtcttcatggacgactttttggtctattgaaagaccttcggtcattgtctacgaaatttagacaaagtcttacaacgatgccaagagaaggacctggtacttaattgggaaaagtaccatttcatgggccatgaaggaatagttcttgggcatcgagtgtccgaacgaggaatcgaagttgatcgggttaaaattgatgttatagatcagcttcctcctcctgtgaacatcaaaggaattcacagcttcttgggacatgccggcttttatagaaggttcatcaaggacttttctacaatcgctagacctctgaccaatttgctagccaaggatgcgccctttgtgttcgatgacacgtgcctaaaatcttttgaaattctcaaaaaggcactcgtctccgctccaatcattcaacctcctggatggactctgcccttcaagatcatgtgtgatgcaagcaatttcgctgttggtgcggccttgggccaaaccaaggataaaaatcatcatgcaatctgctctgctagcaaaactctaaccggagctcagttgaattatgcaactaccgaaaaagagctgctcgcggttgtttttgctatcgataagtttaggtcttacttagtgggaggcaagctgataatctatactgatcatgctgccttgaagtacctgctcactaagaaagatgctaaaccacaagatggattttgctgctccaagaatttgacttagaaataaaagataaaaagggagtagaaaattccatagcagatcatttgtccaggctgcagatcactgacacgcaggaacagccgataaacgacttcttgagagacgacatgctgatgatggttcgcgactccaacccgtggtatgccaacatagtaaactacatggtatccaagtacataccaccaggggaaaatcaacaaaaactgaattatgaaagtcgccgtcatatatgggatgagccatacctatatcgggtctgctccaatggcttactatgaagatgtgtgccaactgatgagaacttaagatcatagagcgatgccatgcctcaccctatggtggccattacggtgcattccgcactcaggccaagatttgacaaagtggtttcttctggccaacaatgtacgaagactcaaaagaattcgtcagaagatgcacaagctgccagaggcaaggaggaatcactgctcgcgatgcaatgcccctcacatacaatttgcaagtcactaaacgattaagtagagatgtatgcaaagaatgtcgagatattcgatgtttggggtatggactttatgggacctttccataagtctcgcaactgcgagtacattctggtggcagttgactatgtctccaagtgggttgaggctatgccatgcaacaccgctgatgcgaggcatgccaagaagatgttcacagaaatcatctttacaagatttggtatccccagaatggtcataagtgacggaggttctcacttcattgacaaaaccttccaagacctcctacgagagatgggagccaaacacaatgtggccactccttaccatccgcagaccagtggtcaagcagaaacatcaaacaaacggattaagaatattctgtagaagacggtcaacaaaatggaaacaggatggaaggataaattgtcggacgcactgtgggcataccggacagcgtatgagacacccattggaatgtccccatatcagataatctacaggaagtcatgtcgactacccgtggaacttgagcaagtatactgggccatcagaaactggaacatgggactttgacggagcaggagaatggaggaaaatgcaaatcaccgaacttgaagaatggagagagaaggcctaccacaacgcaaagatatataaagaaaggacgaagcactgacatgacaaaaggataaaaatcaagaaattcaagccaggagacaaagtgctaatgttcaactccgaggttaagcttttcggtcacggaaaattgcgtagtaaatgggaaggaccgttcaacgtcatcaatacctcttcgcacggggcaatcactctccgcaacgattcaggtaatatattcaaggtaaacggtcaacgcttaaaaattttcctttagccaaatgaaactttagatgaagaagtggatgtcgttgaattaatcaattatgaaccatgatgatctcatcttatgcatgcttaaaaccctttataattgtcatgtttgtgcttagcttagaaattagtaggcttaggaaagaaaatggaggcctgccggacccaccagggttcggccgaaccagggcggcacccgttcggccccatttttggatggtagactcccccgcccgtcctgagtctgtttagatgcgagtttggaggtagagcgatcggatcactctcctgagctagttcctctctttcttcctcctttgcaaaagcctctctattcaatctcccattcaccctcaaaaacctttgatccaagtcctagtgaacacccatggctggtatatctcaggacgggttcccggccaatatcaagaagatgaggtgaagtcgtcagagccctcgatccataagctcgccgtgcaagtgaagaaactccgcaaggagaatatagagcttagggatcgcaacacggagctaggggtagagcttgctgaaattagaaataatttcgatacccttagtcgcggtttgtgcgctaagatcaagcgcgcattcgtagaaatgggaaaggaaaataagtattacgctaattagatgtttcctttcccatgaataaaataatagtaggtggttggttttatttttccaatcatgtaagcacttgctatgaataatgtggctcattggtattaaccccaatgtttgccaaagtttatttttgttttatgtttaataaaattcaggttttgaataagtgtgggggagatatcccagcttctggcatgcagataatctgaaaattgctgaatatctgaacacctggaaagcactaaactctacagaaaattgcagaggtagtggacaccagagtggtccggccgaaccaccaggttcggccaaaccagtgttggccccaatacctctcagttttcataggtaagcaggtgagcacgtcttgtatctgtatatctccaccatggtatagtactagagctgaaaattcagaaaacaatcggttcaagcataagaaagataaaatttccaactaatgaaattcttcatatgattgatcttgtatatctatcattcttagctgaacttgtgcttgtgaaaaaccttccatgtttagggaaccttttgcatctaattaatagctttatgtgagatgattgaagatgaaaggaattcttgcaactcgtgttatgactcttgggaatatgttttcaaaataaaattgttttaaaacctcaatcctccaatttacttcatcttatacttaccaaggccatatgcaagtacattactgatcaactttattatgcatatagttgcttgacattgtattaagctttgtcaaatttatgtgacttgtgttagatatctttcatactctcatgatcaaggggtcattgccatttccatctttttccacatatataattaagctaagcttctacactggaagtcggctttccatagaaaaaattccatttaaataaactcctatattagactatgctttcttctgctggaaaagttcgtggcaaaaagaagatgaaaaaaagaaaaaaaaaggggaggaaaggcatggctatgaaaaaaaaggggaaggaaataaaagcttgctccaaaaacattgagcaatgttggaaagaaaatatagccaagccccttccatgatcatgccagaaaatattttacttttccatttttcaccacaaataaagacccttgatctaggagtatggctgatgatcttcttaagtccatatttttggctttgcaatatatatgatgcaggtatgtcccgatttatccctaccaagctccacatatcagccttagaataggggtgaattctggcacattttgccttagtgaggatccaaaaagaaaatatacatcctagagagacaagagagagagtcaataggaggagaagagctgatttacgaaaatttctaaaaatcccatgagtctgacagagaagcaagaaggactgtaatcgagatcattccatttatcaattactcaagatggtaagatagctacttataaagtttacaggtacaggtatggttgtgaatgatttatatgcttgattcataccttgacgaaattcattctgtactaacctttactcagggatgagcaaagggctaagtgtggggggtgttgttggcggctgttaaatgtaaattctataccgccaacatctgcataaagttcagataataaaacatccaacatagtaataggtgcttaatctcacatattccacaagtgttggtatatatttgtatgcagatgataaaccccgatgatgggaggaaaatcagactaaagtgaggagaaatgtgtatccctgcaaggatgggttgtgaacttcatcaaaacattagtaaatcggcccaaaataccgaagaatgaatagaggaggaccagaggagaacatgggctaaaggccaggccaggagggcctagcccaggttcggcagaaccccttggtttggccgaaccaccacctccaccgttggatatggggtttggcgtggacgtcccagatgcatccctgatgacggttggagggcacttcgaacatttctccttcgccaaccgtcatacctacccctatataaggacatcatctcactcacttcaacacacactcccaagcttgagctgaattataagaggctctattgtactatattgtacactagaataggaagagagcagagtagaagaagtcagaagaattccggagttgtcggtaatcttctcctatttcttttattctgtttattactctgaattcaatataatattcttcttgagtaatttagatttatcttgtgagaattatctcttggttagttcctaagtagcatacgggattattgttcactataatcacctagaatatagtgattgctttggtgagttataaacactaaggtagatattaattacttagacgtggtgtttaggcagttattatccagtaattactgcgtatctcacagtacgtttgaggtgggtgtagaggtggtgacagccctcgagatcacttaagtcctccctgtccaggtacgtagtagagcgacatctgggaacagcgggttgccagtacctgaagtattgcattatgattaaagttaagctttccctagacactatttctcactagaaaattctctctatcctagcctattatttgcttggtgtccttggatgaaccggaggaagatctgatcacacacgttcccttggattcgatacccttggaatactctgtaggggaagtgctacatcggtatatccgtgcgcttgcggattttatctgtgaccgtaagaaatgccaacaaaaacataaatgataaactagatggctttgcttctgcatttcaaaactagctaagctttaacaagatgattgaaacccggcaggctcaattagctgttttagtacctgcaaatgaatcttggaggattctggggcagcccgaatcctccgtttaaaatgttaaggtgatcacaacgaggggaggttagtccactcgtgatctgctgtaccctaaccctgcagggactagcagtatcgccaaggaagcgccatctggtaattcggctgatgaagaggttcagcaagagaagattgtgtagcaggagtactacgacacacaattgctgccgtttccacaaaggaacataaaaccgtaagtagacgagcagttcgctcgttttgttgaagtgatcccgaaaaatccacatcaacgtgccattgttggatgctatgcaagtgccaacatacgcacattatctcaaggacatcctcgacaataaaagaccgctcccgccaacggaggtggtcaagctgacggagcagtgcagcaatgtcatactcgacaagctcccggagaagaagaaagatccggggtgtcctacgattatgtcaggtcccgaaactaatgattccgaaaccgacatgtttagactgtatcaagccctggattagtaaattgatataggttcaacaatctagatcttcattgcatacgtttgaataaggctccaaaggatatattattacaaaatatatgggtatttacaaacttgtggcaaactaatacaacagaagctatagaatgacttaactctaatgtttggctatagacttaaaccatctatctaatctagacttgagaattaggttgaaatgaaactaacttatatgattgaactcccagcttaggcacaaactccaaaatgactctgaaaaaggtgaggttgaagcaagggtgagtacaacgtactcagcaagctattatattcaataatgtatgaaatagtagcatttgagtaaggctagatttaattgcagaaagcagaggatgtagaagaagaaagcctgtaatgactttaatgcaacagtatttagtaaaatcttgaatttggtttctaaccaaataccatatgagtcccgctactcaattctgtgagcatggctattcgaatagtttcataaatattctactacagtagatgtacgctttacccacagtccacgagttgccaatatttattagcttagtcatggcctagtattacgttattaacaattgtggcacctgttccatgaactctagtccccatgcgctctaaacgtaacgttatcagcagcgagaggagttctggcgctcccggggtctttagagagaactgattgtatgacaccatgtcatcgcaatcagggttcacaaacagactagtcatcataatttatctcaaatatttacctgcggctcggtaaatattacaatcgcccttcgcggcgtaaatttgcctcctgcgcgaggacttacaaaagaaaccactgtacagaggtaccacattgttaattaacataatatctaggtctgtccccattctagaagctacggtcgtactcgttcgttcttcacaagtacttgggcagtcttatgtcggttggaacagtactagccacccggaaatcaaccattttctactgtactgtttcaatctaagttcattatattttatgcagtctaactagccatggctaagcaaaagctagcatatctggtttgctatgttcagtttatgcgtttgaaatcatgtatgactaatgcatagaaaagagatatagaatataggacatttatgctcaaaggagaggaataataacttgctttgctccaacgcacataaatccgagatagacaacctgattatccgatcctcgaaataccacaggttgtcattcaaaatacaatagactctacttgaagaagagaaagaaccaaattcaataaaagccatgaaatgtcaaaagaatgataaatggctagaagggctagagtttagagtataaatatctcctttataaggtatataggttattgggcttatattagttgtatgatttctaaagggttggaggctagggtggagggaggatcaagcaactaatgttgcttatattttatgtgaaagctttgattggttggaaggatgggaagtagctagtttggatagttgtcttggttaggcgggtatgtagctagctatgatttggtggcggtaggtttaggtagtatcatatctagggtttggttatatgggagttaattgtggtgtaagacaatatatcggctaggttctatattttatgtataggttctggtgggtgaagagtaggtggctgagagtatggtggataggcgatactggtgggtgtgggacttagatgacggttggaattcaactaacaaggtgtcagctagagtttggttgtatgctagtcgatgctagagcataatgactagatttggtgtcttctgtagtcggtgtcagcaggcagcatatcgactagagggaataggaggtgggtgcaggtttagtagggtggaagtgttactccgacaaccgtgggtggcggcggagcggctaggatcacacagagcccgagaactaactgtgcacagcgtgctgtggaggtcgatggaatagtgaagcttcgaccgctatacgcatcgaggcgtggggtgccaggagcagcacttcgaccttgggattggtttatgccgggctttacaaccaacggttcgacgtcggggccaatagaccacgcgaacgtccccatggaaggcgtaaagttccaaccggcggtttttagtggctaaagagtatttttgggtaaaaaggaaatatttgaaaggaaaatctaagtttaaattgggaattcaaatataagattaaatcaaatatttattcaaatagtatttgaataaattaaggaaattcaaataaaatattaaaatagcaaatttggtatcaaaatgtatattttgaatttatataaatttaggtccaagtttgactggaatcggatctacggtttaggagatatgggcttctaaagattggatttgaattaaatagagaaattgtaaaaagtcactgttgatggacctacctgtcagtaccttttttccttttctttttctttttctttctcttcttcttcctcccgtcgttctcttccttccttctgcttcttttttcccgagccaatagagagagagagagggagagggggcagcggctttccggcggtcggaaggcggcgacgccggtgacgggtggtgttcccgagcaccgcgcagccggggagggcggtggctggccgagagagtgagggagaaggtcggaacggcggatggaagagctcggtttggtcggttatggtggcgacggtggtggcttaaatcggagggggaaaggaagggagaagtaggggaatggatttgcctcgtcgaggcaaagttggtagcacaagggtttggattgggatgctttagggatggagatcgatcgatggccgacgatggtcgccatgggaggagagagagagagcttggctcatgtgtgtagagggagaagaagaactcgccggctatttatagggaacgatagacggttccggatggtcggttcggaggaggaggaagacgaggaggacacggcgacagctgcttaggggagaagaaaacggcgccggcggtggcctgtgattggtcggcgacggcggcgcgtacacgtggctgatagaactctctattggatcacctaggtttagatctagtcgggtggttctatttgagatgaatgactgaacaacaatagagattaatggaaaaagggtttagggatgtgactggttgacgcgttggatgaggaggaagtcccggccatcgtcgttgtcgtcgccctgcttgacgtgggcggcggcgatggtggtcgtgacggtgacggtgctgcgcagcagtggcggccgtaggcgatcccggcgaggtcgtgggcggcggtggagtctttccgtcactggctgcgcccccttgatcggttagggttttgggg

SEQ ID NO: 83258 - DNA, 11590 bp, Oryza sativa
tttatatggcacagtgtgacgggggcccaccagccattgggctgggcgcccccgatcagggcgcgggtcaaggccccattgagccgttgggctcaaggggagggagatctatctaacattctccctcttgatctcagtatttcttttagctttttctattccatcacagatttacatatagagcatgtttcatcatcacggttaattaccgctggatttgacagccactatatacatctctattcagaaacagatactttaacttttaggccctacagtccaggactcataaggcttcccttaaacccatgcatgctacatgttctttgaacatgttgggaggtaggcctttcatgagcggatccgcgagcatcctctctgttcttatgtgctcgagactgattgtttgatcccagactttgtctttcacaacatagtactttatgtcaatgtgtttggcagcaccacttgagggattgttgtgagagaacattactgtgggtttgctatcgcagtataactttagtggtttctcaatactgtcaaccgcctttaaaaccgggtatgaacttctttagccagttcacctgccccgttgcctcatagcatgctataaactcggcatacatagtagaccctgcagtgatggtctgttttgagcttttccatgaaatagctcctactgtgagggtaaatacgtatcccgatgttgactttgtattatcttttgcaaagtcagaatctgaataccccactgtctggagcgattctgattttctgtaagacagcatgaggccttttattccttgcaaataacacaagactttctataccaatttccagtgctctgggcctggattactctgaaatctgccaagtaacccggtaacaaatgccaagtcaggtcgtgtgcacaattgagcatactgtaggcttcctacaactgatgcatttggctttgttttcatttcattgagctcacactgatttctgggacattgcgatgccccatacttttcgcctttgactataggagcaggtgcagcactgcatctgttcatattgaatttcttcaacaccttttctatatatgccttttgagaaagtcccaatgcatactttgttctatctcggtgaatctctatgcccaaaacatgtgagtcctcaccgaggtctttcatgtcaaagtttgaggataagaatttctttgtttcctgcagtagactaacatcactactagcaagtagaatgtcatctacatacagaattaggaaaataaatctcccattcttaaactttgaataaatacagttgtcctcgacattctcttgaaaacccaaatttctttattgttccatcaaatttcaagtatcactgtctcgaagcttgttctaagccattgggctgggcgcccccaatcagggcgcgggtcaaggcccccttgagccgttgggctcaaggggagggagatctatctaacagtggcagctgtagtagggttgggcggcgggagaaggagagcacggcacggcgtcgatgtggcatggttggcaaggcagcggtgcaagccgtgggcggcggcgtgcgaaccacggcaacggtggtggcggcgtatccatgtacagaggaaggagaagggaggtaatatagacttattcctgactgggccagatgaaggaactttggcccaaaatgaataggaagctttgctaattttggataaattttaagaaggtattagaaatagaggaataagattttaacccagtatcatatggtatggactaaaggaaatttggatttttgaatgaaaaggaatgaaaataaatttcttagcacaagagcaatcattcatatatttgtaatagtattattcttgtgccgagaaggaaatcaagccacagagattaaattggtggctaggtcaaaaggaggaatttggatatttggatcaagagtcaaaggataggtttaagatcaaaggatgggctaacaattaattccaataaaattggaattactttggtttaggttcaagggcaacattgggaaggtttcttggactacaattcacaaaggggtttttaaataaatttaaataaaggaaatcatggtaaaaaaggaagtatcaaatcacgatataactgaagataggttttaaataaaagtcataaaataatttaaataaacgaagaagttttacgcaagttagttttaggaggtctctctctctctaattatattttcctaggtttagaaggttaataagaacataagaaccggcatgatcaggaaattcttcccgggtgcacacgagtgaggacaaagtgtgcagaaaagacttgtgttagtctgtgagggcattctatgacctatgagagctatcagatgtaagcggcccggcctgggagaggcggaacgttacagtcaggatcaagtgtgggcaaaatccatagaatattcaagtggtcgaagtggagcatggtgaagttcatgcagaatttcctgaaaaaggaaacaacgtttcccaggaaccgttattggaagacgctagtaaaatccagtacaccggccaagaagctagagcaaccggctcagaagaagccatctcccgcaccaaaaccaaagagggtgtggaaggaaaagccaaagacgcccgctccatcacctccggagacgggtggaaaatctgcgaactaaactgaaaggaggtacggtcttgcacgtcggacccaaaatgacacgaccctcgccaacaggtaaattggtatgtatccgcatatttattttcatcaatttgaatttttgcatcaacacatgtttgcatcaacacaggtaaattaggtttactaacctcttgcagagaatgaactcaaaatggaggagaatggacatcaaatcagacgatcaatcaatcggacgatgtcgagaatcagacttatcaatgaataggccaagaactcagaaatgacacgactaattgggccaaagttcagaagtctgtggaggggagaagtccaagaagccagcagccaaattatgggctggttgggccggcctctggttcggccgaacccccctcatcgccgttggatgcagggtttctcctggacggtgtagattggcccccaatgccggttggagggtatttccgaccattccaaccatcacaaccgtcattgggaggctatataaacccctcactctctccatttcaaaacacactccaagcaaatctctctcattttctctcaagtttagtttagtgttcttaagctagtagagtaggaatagaatagaaatcagagtccgaaagccttcgaaagagttcgggtatgactctagtagctctcctttcctcttttgtaagctttgtactttatttagaatactcttctttatacatttcttgtaacaaacccaaattgtagaaacttggaaattcaatataatgaaaaaaatattattgtggtgaaaatttgttttaggtgtttttggatcttctatgcatcatttcattttgcatatataaattaaattagaaaaaaaagggtaatacgattagtgatgagtataataaacaacaaatttaattagttataactcagcttttgcatctcaattaaaaagatgaaggcaaccaaaattaatttaaattggaataaaagaaggaaacttgtttgaatttccaaaaaataactgcacatgagaaaaatctcaaaaaaaaaatcaccaaatggagttcaccactacagtaacttgcagtaaaattggcgcatgcttttgagcagtgtagtcattccaaaaaaaaaaaagaattcgtcaaaccctcagccctctctaaaaatccctgggaagaaatgttcctcacctcccctattcctgtacttctctgatcaacgggcccaagcaccctggaccccacctgccagtggcccagcaccccatcccactctccttctctttcccatctctttccttgcagatatttcatcgaacacataggatgcgagccgaaagtcgtcgcctccaagccgcccattcctcctctgcccgcgaatctcactgcaaggctgtgcaaagctgacgacgcctctgccccgcctctgcccgatgccctgccgcgcccagcgctgccctcgcagccgctgcgcccaaccgacgccgtccctctgcccggagcgacgagacgctacaaactcgaccgttgcttcctccgtctgcaaagccgccgacctgcgtctgccgtctgcaaagccgacgcccctgcctccgtgtctcccggctgcaaagccggcctcgcagcgcgcctcgccaacccggagccgacgccctctgccaaagccgacgcccgaagcgacaaggcgagaccgaccgcccctggcttcctctgactacccctgcactccctctgcaatccctgcgcaaagccgacgcctgctgcccgccgtgttccccgccgaccaccgcctgcgcgcgcgagagacgccgaacgcgtcacgacaacctccgcgtccgcctctcgctcctccctcgcctataaatcgaaccctcgcgctagctaactctccagaccaccttcaacctccactcctaaagcggaagccctaaaccctctgattcaccgggaacggccgcgccaccgtcgcgccccgcgccggccaaacagaacgccgccgctgagcccacaccatcgagccgtcgcctcggtgagtttcctctcgattcctcgcgccatcaggctcataggacctccataaatccattttcgaaatctcttttatgacccctcgaccggagagccgccgccaccattgccgccgccgaccgcctcgggagctcgtcgccacgccacctcggaccgcctccgcccaaaaagaacgcggggtaagccaccacatagtccctaggtgcttccctgtcctttaatcgagtcgccgttcgccatagccgccggccgccatcataccgaaccactgccgccgcttgccatggccagccgcctctagccacccccggccacgccaccgccactaggagatgcacgtgaacctcctctagccacccctgcctctgccctagccagccccgcggccgctcgccgccggccagcccatccggagccgccctcgtgctcccctctgtctgttgcgaacggaggaagaagacaggacctgttcgtaaataagaaaaactctagggctcttgatacaaagcgccaatacacttacatgttggaccgagacctagatctcaatagccgcaagattagggtctgttctgtgaaacatcgagacacttacatgtggaccccactgtttaaagtggatgcgcgctaccgtaatacgttttgcatgtaggaaagcgtactctatatagtacgcttcagccttttgtaaagagaaattaataaatctaagaaaatggtttcggttaattatttatgcactataaaatgctgaaactttgtaaaatcatagaaaattcattttaactccgattgaggtgaaccaaatttcgttagattcataataatgttgtctttaatactgtacactcaaattatcaccactgttgtgaaaattttcactaatttaaatttgaatagtaaacttcgtatttaccgtactttaaatattagaaacacgataacttgcacatacaacatcaggtttaggcgattctttctcatttatattaaatcactctctttacactgaacatgttcatgcaccatgcatcatattttatcttggagttttattggatgttcatttgaatgtacgtttaaatttaattagaggacgaatcgattgttgccgttggcgagagtgtgcaggaccaagagttatttgaggaaccaactgagcaaggcaagtcctattcaattcctacttcgatcatgttgaatcctatatcttcgcaaatgctttattattttataaattgcatgcgatgttttataaagaaaatggggtattggtagaaataacctaattgctgcattacctaccttgatatattgattatcgttgaagccctaggctgagaatatgtgtgtgttgtacatgcacaatgtgggtatattcgagctgctactatagctacttgcttagccatgcttagaaaatttccaatggttatatatgacatggtaatcattctttacaaatggaatatttttatagaggagttgcctttgttgtttatgaagattggaaactgaaaataatgattttagacttgggcggcaagtggtgtgcatatggtagtagttgcgcaccgatagggggagtgttcgcctaggtcaattaaggactgaactacgtgtcaccaactaagattacagtgcaaccacatgtgttggttatggggcaaccttagcttattatgttgcttattgcttaaccttgcattgggaggccgttgtagtagggactagtctgagcaatggttcataggagctacacatgtgaccctctatgggaacggttgtgttcgccatatggcatgggcgtctgagcatatccaatattactgatagtgcctcgttgagggaacggatgtgttcgcctcacggcgttaggattaggttggggcccatctttcctagtggcattggttcatggccattgtggagaaacactctccgtgcgcatgcaaggttaatctttgagcaatgtagtggcttcgtcataggctagcaaaacaggtaccggtttggtatcgcgtggcatggtttacatgattgctagctcgtgtcatgtgcgtaaagtgcacaaactctgcagagtctaaactaattgattagccgtgctcacggtcatgagcgacttggtgaaatgatacaagtataatgttcgtgacttttgttaagtaaattctgaaatgggtatggtaaataatggtgatgatttatgcccagcatgggttaagaataaaattgttacttgttgccatggagggcacaaggatggcactatgataacattaatgttactattactgttgtttatcctttgatttacaaaatttcgttgcaatctactattatttactattgtgaaacaaaatttgctttatgctgaaaatgagccacaaatatagccatccttgatctcagcttacaataatcctaggtttcccaaggtttgggtaggacttgccaatacctagtgtattgacccacctattgttgttgtttttagacttggatgcaggatgtgaggtgcctagtgacgattactttgcaccgggtaccggagtttttgaggacggttctttctagggtgattcttagtcggttgcctgtgtggtttggtagatgggcataccggaacatatatatctttatcttttccgctgcgtttaaactcttttatttggccggtcggcctaactactatgtaagacctatgcaccgttaagttatgagaaccacttatctacttatatgtcaagtatgattgtatggatgtgataacaatgttgtggacgcgtgtactagccattgatcatgggactagtacagtgtacgctccaggtattcgggaattcaatccccgggtgccgacatttctggtattcaaatattttccgagtatatgaatgccagcttagtattatgttcatgttatactgattatactgctagcttatctgggagatgcatcggtacgggtataatgtttgcttatgcaattactctatgtcatgacgatgatattagagtagtatctggtagtttaggcatggtgtctagattacgggatatcattatttggggttatatgctgccgatgagaggtgggccgctgatggtgatagctcagtacgggtattcactactagaaaaatcatttgttgccacgaaaaaaatcgtggcatcaatactcaaattgtggcaatagatacatcttgccacaattgtaaaatcgttgctagccgtggtaataggttattgcaacgatttttattttgtggtaataaatttagatgttgccacggaatggatgtggcaaaaagtcatattgcaacacttcacatcgttgtaataaaaattattgccaccactccatatgtggtattagttttacgtaccaaattaaaagttcaaatattaatctatcatcctatctatttatctacttatttttttgattttgtgtcttggctaggattcgaacccaagacctatccttcacgcgtgctctcctttaccaactcatctacgcatcaattctgttggaaaatgcatatcgttccatttgagcctagctaactgagatttgaatcatagatttgaatatctaaaagatttcaaatgaaaaagttatcacctataaaattgtagatctcgtcgagagctataatttccatataaaatttgtctcaatccgtgtccatatgaaaaaattaatttaaattatgagacgacaatttttttattgcaatgaatttgttgatcgtggcaaaaaaaaaatagtgaaaagtaccatgtactatataaattgccacaaaaattaaaattgtggcgatagaacatgtttttttgcaacagtacgattttttgtggcgatatatcattttctattgcaacaaaagtattaaataaaacaacgattataaatcgttgcaataaaaaataattatttgccacagaaaaattatcattgcaatagtataatatattgctacgaattattttttgttgcaataatttggtggcaatagctcaattatcttgtagtgattcctccgtgtgtgtatatagtcctaagttaatttcttggggagggtactcctccgtatttaaccccggttgtatgatcatgacgggttgtcgtaaggaactcgacagtcaggggtggcttctcgaagtaccaggagggcatcgggtagagggtattagctagttaatcatataattagaatgtatgtatactatgtatactagaagtataggaatatattttctttctattttctttccacttagcttagatattttagtatgagaatgagtagctccatgcttgtgtgtcactctaccctttgatttatcttaacccctacttagactatgattattacaagtaatatataaattattagtatagttctctctattatgatcttcccatgggattaaacaaatatgatacccttggaatactctcgggtgaaatgctacaatggtatatccgtgcgcttgtggatgaactctgtaaccataatatatcaagagtatttctgcgccattgttgggaattatatttctagtaatgtcgttaagaaataccaacagcgagtcctcttcacccttgacacagtaaagaaactggaagtttggactgaggtgctgctggatacaggctaatcaaggccggccttgatgccaacatggttgacaacgacttccaccatcagagcttggccatcctgaactagtggagctgacggtgttggctctataccagtcctatggacatcagtcaaactcaacctgatgacttggaggaggctgcgctagacatggtttttgcgcatctcttaaaggtggcgcaatgcctgtcctgaaattgggattgctaagacacacgctgcaaccaagatcatcgatgtaaaagacgctaccctagagaacgcggaagatgcccctaaagatctagagctagcttggtcagtgcctctaatcctgcatcaactttatcgtgcaaagagaggaaacattatcagcatgtgacccttgctgagccagtgacaaagcaaaggaggctggtgactcctccccacatcgtgagcgaacaggactacttcgcctaggcaatgttggacgacgacgaagccgggacgatacacctcgatggttcggcgatattgtttccaacactgtttccggccaatgcgcgttctgaatttggcaagattcaatctcctttgattatgtgtcgatatacatctccaaatctgagtctatcttgtcaaatttcgctcttaacaccggattccctagcactgggcttcctcttgggacttagcaactaactccttggcccagtgatgtgttggttaggcacaactagttaatgaacatgttagttctatagtagagccaccatgtgttgagtttaaacatgttattcacattgctagtgtcacgaccgggaataacccaacaggcgttccttacgtgcgtgcattattccttgtcccaggaggcaaggtacaccaaaagttgatacaattcagagtttaacaagcggaagcgtaaatagttaatttattacatgggcggcgaaggcccagcacaccagaagacaaacgacaaacagcggaagactagggcgacgaccacaggcgcttgacggcaggcacgagctagacaccaaagccttcatcttccaggaactcctcttctgagtttaggaaaaattgagcaagactgagtacaaccaccgtactcaacaagacacacccacaagtgcaggataaatgcaagggagtacaagggggttataatataaagggttagggtttgcagtaaacagcattaaaagacacttagttgctcaaagctattttgtaaatacgattctagagctatacaagattattaaacaaggccgtcaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagatgtgacatagtttccaacccatcctagccatagacaagagtaccgacccaaccccacctacggccggaacctccgggacaggtaggcaggactgagcccctagcagcaggacaccggccctgtgccatgacatctcgactaccgggccgcagctcgtgtagccttcatttgccctagagatgtccatcgacccccgacttcgtccatctccatccgtgtacttttgtttataaccagactgagccacaaactaagccttacccactagacatgtggaagtacggtagtgctttgcaacagaggcccgaagaccggtccctatatggccgaggtgtgactgtcaaaaccatgcaccccgagcccagcctaaaaccattttgaggattttgaatagagggggaggtgtgaatccaattccacaatagtccaacaattacatagtgtccaggtgaaaagagtattcccaaagtctagagttgtaaaaccacctaatgttgcctaattaaccagcgaagcatctacctaaattcatactatatatagaaaatatttgaattcaaattcaaatttgaaacgggtatataaacttttgacttataaactttaggtctataaactttagatgtatagaaatactatatatagaaaatatttgaattc

SEQ ID NO: 83259 - DNA, 10163 bp, Oryza sativa
gtttcccttagctgctagctgttgtaaatatcctctacgatgaccaaattacagttgcacaaatatgcaaagttacatgccagtcacctatacattataaaataattagatgcaagcaggaaaaacaaaccatctgtgcattaaatttttttccccaatatacttgggttgctataacagataattaagaattaaatactttgtctgtaagcagaacacaaatcaaacatcagctgtgcaagtgtgcagaaacagtattgcaattaggattgctactgttgccaggattcgatggctgaggaatttgggcaataccaggaagaaaatcaccgatgaatctgcggcgtgtcgatgctgctgctgtggggcaaacgatgggtgtgtggctggcggatgacgcgggggccatgcatctctggcggcgccagcggcgctcagcctggaaggcacaggcggcgatgggtggacggtgggtgctaggcggcacaggcggcgttcaccccggacggcgcaggcggcgatggcgtgggtagtaggtgcgcagccctggcgtcgccggcggcgctgagcccagacggcacaggcggcggccatggggctcatacgcgagaggccgccgtcttcacggtggagctaatggaaagattggaacagattttacaagagaaggagaggggtttgttctcttagataatatcgtaactacttccgagttccaagggagataaaaaaaatccgcatgaatgaggtaaaaagttggaaagattgatctttttggagggaacgagcaaaaaaaaattcctaccaaattgtttagcgctgattaatgtgattgtagagacggtctattatcctgtccgtaattagcgtatctacgtaagaggcaaagtgggagatgggctttaatagggacgacgtgcttagccgtctcttacggaacgtctctacaggccgtttttgcagtagtgctatggatacaaccattgctcacatcatggatgaacaaggagatatcaagatcaagtcctccaagtgctggaatccgattcggccacctgctacattgctgacttcaaacggccaccgaatctgcatacgaccactgttttcggcccgtaagtgcttgatggaaagctctcggagccctctttacagcctcattgccaaattccatgtcgtttggccgcaatcacataaataaggtgctgcgtcacctgtcttgggcctctggaattgtaactaatgtgattccactcctcatcgccgacaatgtcaaccaccgccagtcctctgagcgcatcaacctctgagaatgtcgaggtaagtacccatcggctaatcctctttcttttccgtgcaagattggtttttcttctgctcaatcttcgattttcctccttctgtagcatctctctcatcaagtcgcagtccctagtataaccgatgagttccagtttttccttggcccaattggtaacccagaccccacagagttcatcaatggtgaaaccaactgaatcccctttagatttgctaaccggatctaagcctatggaagaacaccttcaaatcttagccatcggccgaaaagagctggcccgcttggtataacaggatgtcagctagaaagttaaccaactgggaagaaatcggcatatcccaagccttggctttaactgcagcagacatggcaaaagatgagtccatgatggtagctgccacttacttctggtccacagccatgaataccttccttttctctcaaggaccgatgactccaactcttttggatgttataatgattactggcctagatgtgacctcatcggctaacctgaccatcttgaatatccaatccacccaagagttcaaaatcagaagcataggcggttggtcaggctatgttgccaagaacatgggtactaggccgatctttgcaagggagcatgcagctttcctcatgatgtggcttgagaagttcttttttcatggtccaagttgtggtcctactgcaaactggcaacatgtagacaagaaacaatttccccttggaaagtatctgctagagctatctgtaccaaactctgaacactgccataaccaagatggcctctggagtatcaatcggcacagggggtccctagtggttactgcagatctggctaaacttgcacaccagaatggttgtcaatcggccaccattagccgatacaagatttccaagatgtgagccgatcatcgatgatgatgcagaaagaatcactaaatgccgatgcaggtcctttggagaagcggcatcggttagcattgcatccaagctatcggctgaacccttcagagagtggttcaacaacttttacgatgggtttcccaaaaacactagaatttagtttgcatacgaaggacatggcacttgtaagctaccaggcgatttacggtttgatgagatcaactccgaaaaatatgacaaatctagagaagtattctcagcagccatcgtccttgcatccttcctattggcatccatcaaggcaaaaaaatccaaatgacatatgagttctatcatccgacaagtgctgcaaggcaattcggcatgggtcaactgccgatcagcttgttctttgccgataagatccagagtagaggagaaatcacttctttgcccataagatccagagtagaggagaaatcacatcaccacttatgatggatcggctgctgaacatagaaggaccacccctaggcagcatcaacaatatcaagctaaggatgttgagaagtgcatcctttgaccgatggtggatagagtggaaaaaacatcggcttcaccaatcgtcttcaatgtatctaatagatctattccctaagccgtccctcaagtaagaatcttctcctttgtcaattatgttaactacaagccgatgaattaatcttgaccttgtgcaaattctctcttgcagacaacagaatattctcctcctcatcatagcaacagcggtgtagagatccaatatgccccagggctactgctcaatggtagtggactatctcctccggtcatcggctacaatgcccccaagacttcaacactgctgcatggcatgccccgtgtgccaatagcccctgatgctggcagaaaaaagagagcaaaatcggctgctgcaccatcggctgcaaagaagaaacccaagaagcaaaagaccactgccgatgaattgccagccatagattcggatgtagcagaattcctgaagggtgaaacaatggcaaaacatgtggatgaagcggctgaacatgtcagtgaaacaagggaacaaactcctccagccgatccacctgctcctcaaagaacgccatcacctccagtacgtcccacatacaaaccaagagtatgtgcatgttttcaatcttcagcttaagtctattatgcctttataccaattctcaactttgattttcttgcagaaaaagattgcttccaagaagccacaagcaccagctgcatcgattgatttttaaacctcatcaactttcctctctcagttttttaaataaccgatgctaatttgtacttgtattttcagcctattcgtcctccaaccccaatttccaaatctagcgagccaactccatcggttgcaggcggtcaccatgtggaggaaaaagaagaagtggcagcaccagctcatgctgtcctgtaagtatataccttaagtttacaaatcatgtcggctgccatcctttttacttaactcatagtcccaatgtttctctttttcaagttttagccgacatgttctcttttgatatttggccattcttagataagaggaagaaacaacaagcacagctctggtgcccttagccgatgatatcaagtcaactctactagacatctcaaaaaggcttaaaggctctctggaaaccttggttgcaagctatggatccatccgagacagacacaatgaaatccatgacaagatcccggatgagctagccgatgcccttactccagcagccaaccttgagcagcatcggcttaaacttgaaaaagcccaaaggaggattgccgatcggcgtgaaagaagagatcttgaggcaaccatccaggccaacagggtttctatgaatgaagagaaggccaagctcgatgaattggaggctggtccagattcaactcaaactatcattgatcagcttaatgctcaaaaaatagaactcctggctgagttagagcagtgcaatgcacaaatcgcccttgaacagcaaaagcttgcagacttgccaaaagccattgaggatcagaagtcaaagttgaaggcatctagcaagcacttggccgatctaaccaaatctcgaaaggtgatcctaagcactgatgcagtcgatgtccaaatcatagacgaagtagatcggattaagcaaagggcaatatcagccatcaaaaaatacatgtctggatgagctaaatcttgtaattccaactttaaatttgcaaacataacttttgggatgcaatatataactttctgcttgtggtgaaaacttgctctttgatgtgaccatggctactacggatacatccgttgctcacatcatggatgaacaacaagatatcaagtgcaagggtgctggaatccgattcggccacgtgctacactgctgacttcaaacggtcaccgaatctgcatacgagctccgttttcagcccgtcagtacttgatggaaagctctcggagtcctctttccaacggatccagcctcatcaccaaattccatcctagtcaacagcagatgaagaaataaggtgttgcatcacctgtcatgggcctttgggcttgtaactatgtttgggaccccggcccatgtagggcccatgtggggtgcgccccaaccaggtggaggacgacgtagaggtcctcccacctccttaaataattaggtaccctctagagtatcttgggttttgtttagataaaagtttagcttcgctacttttccgtgtaatcccgtgatcggttagatcaccggtttgctcgttacggaacctcaaacttatcatttttgctccattcctatctgcaattcagattgcttttatcttgttcttgcttgtttcttcgatttgcttgcaggaataaggttgatctgcactggcaagatcaacaacctacggagaggtgtatcgatcgctaaggcgtaacacaaaaacgtctagtacggttgtagtcgggtcgttaacgtttctcccaaatcgtagttatcatcaactcaccaaaagatcgggccaaacaacagccttgagtgccgagtggagctcagggttcatcatttggtatcagagctttcgttgctcggtgagttttatctacccataaccagaaaattgatataaaaaaattgtcctgtacctagccatattgtgccattgcattgtttttatcagtttttgctttgttgagttttgtgttacatcgtcgagtcgagttgctggtgttagcgtctagttcgtttagagtttcgagttctggtcacgttttgtaccacagtcatcgtcacctccatgtatctgttgtcgtcaggacctacgaaaacggaatcggctcgctgccacgattctatttttgtagtttgcaaaagtttttaccggttggttttgcagttgttgagttgcatctttggtttgctgactgccgtgcttctgttttggccgtgcctgtgtcctgcacgagaggaggaaggtgaattaccatatctgattttggaagtagtcaagtttgttttggaaagatatagtagattggattggttaaaaatcagtttcctttttatcccatacaccaaattcggctgccatccactccacctcctagacgacttccactcacccctttggccgagtccgactccctccctccctttcacggttccgagttgtgtcaaacaccttggtgaatatttgtttggtgtcggttttgagatctgtttggaaaaatggaaccggcataaattcagcattccatttttgtataattttaattttgggtttagacttttacatttgagtccctgtaatttttatatttacgtttgagtccctgtagccttatattgaggtccttgaatctgtttttgtaaaaaaaatcaaaaaaaaaagaaaagcaaagaaaagctacaccctaaaaaaaagaaaagaaaaggaaaggaaagaaaaaaaagaaagaagaaagaaagaaaagagaaaatattgttatgtttgagctgaacttcatatatcagagttgtgcatgagttgttcctagtgctatcttatggtatcgtttgtgtctagactcgcgtctctagtacgttctagcctaggaccagcacggtacttgactttgaaccattattcaattttgcattctctgatttgaaccattgctttcctttgctacatattttaagcccacccagagctctacagatttgattgcagccgtacagcaagtgtttgccaaggcatcgatacatccaacctccattggggtgcttggttgagtcggtgtatgtcacctttccgcttgctttggtaagaacttgtaagagcttggttaaaagcttgagtgtgtgtgatatttgagctgccactacctagtagttgataggagcgtgcatatatttgtgtatgtttcttgcttgctactaaccatggcaggattgtgaaaggggaaacgagatggtcatgctcaacatcgacttcttcaccatcaacgagatatatcgtcttcttcacgctttgcatataaggtacatgataatgatcttgcaagggtagaatctaatttgcctgtttttgatggtaattatgattccgccgcttatgttaattgggagctagcagtagacaaacaatttgatgagtatgatttctctaatgctcaaatgattaaggctgctagtaataagtgtactggttctacatctttttggtggtatattgttggcaataagtttgaaacttgggatgaatgcaaaacaatgatgagaaaaaattttgtgttttcatattataaacatactctccttgagaaattagaacatttaaaacaaggtgacaaaaccgtgcgggagtactttcatgactttaaaatttgtatcacttatagtggtttaaaagaaagcaatgagaacacaatgactagattttttagagggcttaattctgatattcaggctgggcttattaacgtgacatataatcatataggccacttgttcatgcttgcttgcagtgttgagagcaatattttaatgaacccaagggagaaacaatctatgcttgtgcctcctattactgacattttgcagggagctcagtacattcaccatgaggagaagagcaatatgatcgagatgccatctccatcgctcacgaaggaagaagagaagactggtgcacctacattatctgaagagggcataaaaggtaaattaaatggtgttgatattactcaaggtgagtgtgcttctcccttgtcacatttctccactatccatgctaatctagagcaaattttggtggaaactacttctgatttgcctttgtcacgagttgatttacttgttgttccttgtgataaagaagagttgtgtgataatacttcacttatatccatgccacaactagtgaatgaaaatgctatttctagtgtttctttgtgtgctgattttaagcatgttgttcacattgctaatgatgttgaggaacgtaaattgataacttctttaaatactttgggttatgttcagtttgatgatttttgtgagctcaataatttggaggagaaattatttgctaactctgatttgccatgtccaactaatgctatttttcatatctttggcgaatataacgatagaggaatatatttggtgcatagagttttcatttgttcgaatttagagaaacatgttattgctaatcacactacttcgagtttctctggttttgattggatgaaacatgttattttgaatggactatgtgaagagcaccatatggaaaaaccgaggatggttttccgtgaagaaggggaggatgatgtgaccatggctactatggatacatccgttgctcacatcatggatgaacaacaagatatcaagtgcaagtcctccaagtactggaatccgattcggccacgtgctacactgctgacttcaaacggccgccgaatctgcatacaagctccgttttcggcccatgagtgcttgatagaaagctctcagagtcctctttccaacggatctagcctcatcaccaaattccatcctggtcaaccgcagatgaagaaacaagctgctgcatcacctgtcatgggcctttgggcttgtaactatttttgggaccccggcccatgtagggcccatgtggggtgcgccccaaccaggtggaggacgacctagaggtcttcccacctccttaaatagttaggtacccctctagagtttcttgggttttgtttagattaaagtttagctttgctactttgccgggtaatcccatgatcggttagatcgccggtttgctcgttacggaaccccaaacttatcattggtattgaattcctatctgcaaatcagattgcttttatcttgttcttgcttgtttcttcgatttgcttgcaggaataaggttgatctgcaccggcaagatcaacaacccacggagaggtgtatcgatcgctaaggcgcaacacaacaacatctagtatggttgtagtcgggtcgtcaacacttctcccaaaatcgtagttatcatcaactaaccgaaagatcgggccaacaacagccttgagtatctcaagtggagctcagggttcatcactcttgaattttccttttgaaatccagactttttatatatatttgcccccctaattttgcaatgttgaaggcattgataaaattataatttggactatgggtgatatatcaaataccggccatcatacatcggcaaagcacaaccgattatgataagaaaaaaaaacactaaggacgatataatctatatcggccatcatatatcggcaaagtacaaccgattatgataagaaaaaaccactaagggcgatataatatatatcggccatctcaaggcgatgtcaacacatcggctaacatgtattggcaaccatcagccgatcatgagttaatccatacagttggatagtatttcttcagatacttgccattaagcgctcgttcataaacttcaccatcaagtccttgcaacatataagcccctttggacacaattttgtatatttgaaacggtccttcccaattaggtgaccacttgccgaatttattatctcgagttcctattggcaagatcaatttcgagactagctccccttcagaaaaagactttggcaccacttttttattataatgccgagcaactcgttccttatccttagtcacctttgcaagggctctcaatctggattgaactagatcttctgtttcatcttctataagattgtaatacttatcggctgttaaatcatcctgtaaagctactctccttgagccgcttgtagtttcccatggtaaaactgcctcatgtccataaacaagcttataaggagggacttgaaccgatgcgtgacaagccatccgaaaagaccataatgtttcagccaaccttgtgagccattgccgaggaaaatcagaaatctttcttttgatcaacttaatcaagctcttgttagatgcctcagctcgcccattagcttgtgcataatatggtgaagaattcaacaacttgatacccatgctatcggcaaactgaacaaattcatcaaatacaaagattgacccctgatctgttgtaatagtctgaggaatcccaaatcggtagataatatactccttgacaaactgtattgcatccccataatcaactttcttcaatggaactgccaccacccatttggtaaaataatcggtcgccaccaatataaacttatgtcccttgcttgaaggtggattaatctgaccgatcatatcaattccccatcctctgaacggccatagtttgatgatatgattcatagccgatgctggtgctctctgaattgctccaaattttggcaatcttgacatcctttgta

SEQ ID NO: 83260 - DNA, 11245 bp, Oryza sativa
ttttttttgccaacacaagatcacctaatgatttgcggtgcattaaacagagtcgccaaaatcaataaatcaaaattggctagtgaaaccgatttcgagattaattcgctttcgtggaatcacacgactaatttacgagcaaattagtaaagaagataatatcgtacttacgtgacgacgaacgactagtttccgagcaaactagcaaaggataaccttctcgctttcatggagaagcacgaccgtttttcagcgcaaaacggcaaagattaaccaaattctagggttgctagaactcagccataaaaacaaaatagaaaagaactaaaaagtaaaagagatgaatattagattgaaattgggttcccttctattctaccgtggaccaatatatatagctaattgctctgatcttttggcatgtctactcggtcccacgcaatatgcaatgatggtttaccggaatatttgaaacaattcgatccaacaaactctttatcttctaactagataaataatatcgcacgcggcttggctcggtcgccgcagccctgctctcaacgcagatgccacgtgatggttggatccagcgaataccatcacatccatgcaagcagcactcccatcacagccgcacgtctgagcccctggctcgctcgatgacgatgaagactctttggatcagtaaatacgacacctgactttccatctgcaggagcaacgaaggattcccttgccacttaatcacccaattagggataatcacctgcctccgtgattaacgtaacgtgacggtcacgccctgtatagcttctgtagcctgcataaaaaccaaatatacatatgcatatatatgcaatcagcttgcacaggcaacaatactataaactacatcggtccatattcatttagtcaatactagcacatatgaccgacgcatcacaatttcctacacctgtaaactgagtagattttcaagtgaatcatttgacagttgtatcatctattctaaaccaatctggtaactataagccaaattatcgtacaaacacatgccccctgttttcggtataagaaggacgtataacttttgctttaccgaaaacaccatagaattaatcaatccagaccacgatcgtcctctcagaacaatactccacacacggtattagtcctaagcccatccacaatcatcttctcaaaacgatactcccacatatggtatcagtcttgagcccatctacagtcgtcctctcaaaacgatactcaaataagtatttgttctaagacaatcaagttttctaccttctcaaataaggataataccttctcaaatatttcccatttagtactaaactatactacaaattcagttgtccgtaatgtccacctaactgaattggctgcagttcttgggcctaaaataaattaaaaacaatcccatctaaacttcgatacattttaaaaaaactcatcctatagctcggcaatatatttagtcatccaacaaaggatggaattcccgaatacctggagcgtacactgtactagtcccatgatcagtggctagcacacgcatccacaacattgctatcatatccatacaacatacttgacatataaatagatgaaatggttatcataacttagcagtgcaatggtcttacatagtagttaggccgactggccaaataaaagagtttaaacgcagcggaaaagataaagatacataagttcttcagtatgcccatctaccaaaccacacaggcaactgactaggaatcaccctagaaagaaccatccttagaaactccggtaacagaaggaacacccgtttcctgcaaacgagactaaaaacaacaagaggtgggtcaatacacgaggtattggcaagtcctacccaaaccttgggaaacttttgttactattgcaagctgagatcaaggatggctatatttgtgcctcatttttagcgtaaagcaaattttgtttcgcaatagtaaataataatagattgaaacataatttttaaaacaaagaatagaccataatagtagcagtataagtaccatcatagtatcatccttgtgccctccatggcaacaggtaacaaattcattcttagcccacactgggtaaaaccatcaccaatattcaccatacccatttcacaattcatttagtaaatcaccaacactatacttgtatcatttcaccaagtcgctcatgaccgtgagcacggctaatcgattagttttagaccctgcagagtttgtacagctttacccacataatgtgatttactctagtttgtccggtacctgtcggtaccaccacactctacatattgaatgcggtctacacactgggtggtaggaaggtattatttcaaaggggtaggcaagcttttcagtaggtgcattctctgatgttttctctttttactgaaagaaccaataggaaataaaagaagaaaagtggcaggcaaccaaacataacaacacacagtcatcgcattatgtcttgctcaagttttttttttcacttgcgtgactaattgatttatggcaaaatctatttcaccctagtgcatcatatcctgggcttctgtgcttagctagctgatatatcaagtgtgacaggacgaaagagatgactacctttccatttgataccagtaaaaaaaatgtaatttcaatgtggctgtaaataaagctttttttttgcaaatcaaatagaattctagaataatttttcccagggaaagattttaaaatatttatttctagatatagtatacatgttgtttgaaaaccacttgtttgtaaaatagtagacagtgacgtatagacactgcttttaattccattttattttattttaaatcaagaaagattaaggaattttattttggaaaacctcaaaactcagagtcggtgcatgtattattttacatccaaactgctaattatagccggtttatctattatcaaaaacacactttactgtcttgataactagaatcctattatgccaaagaattttcgttgttaatttttcctgtcaatgtatctaaacaccggtccaaataatgatttaacagtccaagaaaaatgctgaattaatctattggactattaaaataccgaaagcatctacacccctcacaccaacaacgactaaactttccaaaccgaataatagagcatctactcggtctaaagtgcaaggatactctaaacggactgatagggaccgatgtgtcataagcaatattacttggtaaatataaaacaataccaactccttgccaacccacacaaaacatgaccgaaataaattctaaagaataatatatataaatacaagaaaaaaaaatatctccagcccttaattatttcggtctctaaaaattaatatcaacatttgtagtaattagtcaatatgcataactatatggtaacatccccccatgatataaagacccatatgacatccaaggataagaataaaaccatgagggataactatacataccttagaattggttccatgacataggtatcagtggcataagtgaagaatatatataatatggtggcgaaagaacctaatgattagatgtaaactgttgatttggtgcacacctcctaactcccttctcattctttgcccccatgtggacaccccgagtattataccatctagtgtccaacacgaccaccacatactattggagaagtgggatccatacacgcataaatagccactcgtcctcaatgtgtccatgatcgcggttgacaaccttctgttataataaccgaaatgtcgagtagtaagcacaagacataatcgtaagatagcttgccagtccaccacgtcatatgcccgtcaaccactcgaaggtggcgaccaaaagcataccccaatgactcgatccaaagcgctatccccaattatctcaagcgatcaaaacccgttactcatgcttagctagtccctaggaatgcgactagcctcacactttcatcgcaagcaattaataaacatagcaaataccataatagggttaaagtgcagcgaggtacatgacacataatagggtccgaggtcccaacatacaacacataaatatagcagcggaagtctcaaatagagttcataagcaaaagataaaatcggtggtgccacaaccccactagggcaaaccaaccgggcaagagccaagctgcaagagatcactcattgccctcaccacccttggcagagcactgaccacacaagaagcataactcaaaaccggattcctctcctgaaattgcagacaccgggttaagtacaagattgtactcgcaagtcttacccaaaattatatatacataagggagaaagaagtatgcaagctttctagcctatggtgggtctctaggttcaacatttgcataaagctaattttattgagcaattatgagtaaaataagcaaggaaaagtaagtctagcatcattttaatttatggacagcaagtatataattctgaaatgtataagcaaataagcccaaacggcgctctcatcatcaaccatggtccaccaaagtccataccaacatggcacaacatgccaacaccaccatcaaacataatcccatccataataatctacatttgatgctaacatgagtgagatacacatcaagcaatgtccataaccaaggacgcggctattcgaataggttatactctgatcagaggtgtacaactggacccacacgaaatgaacaaagatcaaatgctacacaccctgtcaagtgcggtacacaagtgattcaagctcattacatgccctttcttaaccccaccccaaccacctataccacgctggggttcccgacgactcagtcacgtgcgtgcgtgatgtgaccaaggcgggcgggccacgggggaggcacccccggccaacataggcacccgaggccctccaaagggctacctgctctcacgtctctccaatgtggtataaataatgatagtagaactagtaaaggacaagctggtcccaaataaggcatgtggtaagtatgaagggtgcttgaatagatgtcaaaatgttcgatccttaatgactcagacggggctacttgcatcagacgaaaaccaacctcctttcatcgccctatcacccgtccaagtccaacatatttcatcaaccattatttagtgtaagtactcaagttttatgcccaataaagcaagttgtctatgtaccacaattaatagcaatgtccatccctatagttctattagcactaagcatggctaagcattaatgaataagatatcccaagtaatcccatccagtggtaataggttataaggacatcaatattacaagaactaaatgcataaatagtttcttcccatacaccataaaccgacaatattaatatctaggcaatgcatgcacatatatatatgtatagattgcaaccaaatcatttttagagaaagcataggttctatatgcttaggtgcttgccttgctgctgagggaagtcactatcctcctctggatatggctcattactctccggaatctccaaatctatcgaaaagaagcaatatgcgaataagagccaaataaacatgtacatgcaaaatgatcaataaattatgaaataaatacagtgggtagatcatattttaacttgaatttaggtgaaagaatcaccggattatcacttatggtttgggagatatgaaaatgacaagctctcaggtgctgaaaatggcatttctgtaaatattaatgtttcctttacagcattgcaagcaacctataactcaaaccaagttttcataataatgattatttttagagtaaagtacatctttcacatgtcctaagaaaaattatttcatagctatatatgttgccattatttatttatggattttacaagttaaaatcatgggaatgctaaacaactcctaaacaagatttaagaggtagttttgccaaaaacaacaccacaacagcaaagagtactaaaatataagctcaacaaaattggtttcacaaatttagcttttaccaataatttcttacgaatttattaagagctataccacacaagggatacatatagctatttatatttttactgggaaaaccagtacaaaagttggtcatttttattttacaacgttgaagatcacgtttttcttaatccacagaaatttggttcactgaattcggagttcatatgaattagttatgaatttttaaagcgcacacctctttcagctcaatagctatctcagaaatcgatttctattttcactccccttttctccaacttccaccggacttcactcacatggcagcaacctggacgtagggttgtgcgaggctaaggccttgggctgatggcaagagatggagcaaggtcttgggctgcgcgcaagagacgttgcttagggctgcttcacccgaaatcaaaaaaaatgacttcgggttaggttcagccccctttttagtgcaaccaatgagtggaccacctataaaacggtgctaggatgtttaacatggagggaattcaaaagaggcaccatggatgaaaaggaagctcaccaaatggaggaaaacaaaatgctgctgctgcagccctgtaggctgaaaccagcactcttttattccttctcgatctctctcaactctccatgcatgtgcaagatgttgggatggatggaaagcttggatgatgggaattgttgtggtcaaacatgcaggaattgatcttgggctattggatgtgatttggggaggaggagtgagatgagagctcagcttgatgaagaaaagatagaacaagcagtgaagatgaaaggggttttctctgcccccccccccccttaagtcctgaggtgggagcacgcccatggatgtgttgtggggctatagaggcacccaaggtcagtgacaagtgggcccaagtcgtggctgtctatgagggtgagagaggtgggtgaaaaactgagtatagattcgttcttgtaatttccaggatttattttctttccctctcttggtaaattcaatttgactaggtaaaactagttcaaaaattaagggatttggtgtggtgacaggtgttggtttctaggttccatttttcaaagtttcactcaaaaattcaaaatattttaattctggtgaaaagatgaaattggttaggctgaaagttggtttgaatttttaggaggactaaacagaagtaaaaattccacaaaatttatattttttggtgataaataaactagtatttgaataaattattataaatgtacacttctgttcaagttattgttcaaatagaagtggtttcaattttaccgattagagttaactttgtcatcgcctatgatcaaattgcaatatagtaaatatgaaatgtaaaggacaacaaaagcacttctaaatacctggttatgaacctagggctgttacaccctacttcaactttaacatctgtttcattatgcacctgaacacttcctttaggaatccatgccatacctctcttcttcacattctctacacttagcttttctagctgcttcttctgccaatttgacaagctctgtgagtgtctcggttgattgccattgccccccgagctcttcagcagattttgacttgttactaactctgccgaagatgcctctcgcttcatactcacatggtgtaaattttctagttgttgtacacgtgcatgccccctaggttcaataacatttttctgaactgaagccttttgtacacccacacgtgcactagtagctaagcccttttcttgacctctagacttcggcacccatatttgctccttattgaactacctcccacctgcgccgaagaccacttcttattagaccacctagaccgatttgttttaccaaaacggtcatccttggcatgtgacattcctagagttgcaaaattcaatcggccttcattaatagccgattgtatcttctgacgaaaagtgttatagtcagtagtacaatgatcaaacgaattatgccatttgcaataaattcgttcttttagatcctgaagtgatggcatgacatggtgatcaagtaatttaatataattatttttcaacaatgcatcaaaaatatgatcacacatggttaagtcaaaagtatacttcttctcctctagccgacacttttgtgcagatggttttaaagctaagcaaacgaatggttcagatttgccatctacccattcgactacacggttagaattatccactatagtagcatcagcctcattaatattttccaattttagttttgtgtctctatctctagattgatgataagcaaaccatgtagacataaactttggcaatgatgatatggaaaatttaaacactttactattaccaataagaaaattaacctccccaatcgatccctttgagttatttcatgatgatattactagtgcaaatattatttttagataaatgatcaaattgggaaataatcgcattacctgcagactttacctgatctgatgtgttggagaagcgtggtgatttcttcacatgaacaatgtcctcgttcatcctctaatggccctccaacatctcctctgtgttctcaaggtatcgtgctccatcgacttgatgctcatcaactttcttggcacgaagttcatctggcaaaacaaaaactcctatgtctctagagaaatcaagcacaactacctcgtctttgttagacgataattctaaatttatcggcttttgttgtttttccatgacgcttttccttttctttagaaggcgtgcaagtttctgttttcttagctccacgctttctaccttgagctcccactctaactcgcgtcgttgatcctcagataaatcatctaatgtgacaatgctattgtcgggatcgaaagtgtgcttatgatcaatattgccagttcgtatttcagtttgccccctagccgaatttacaacatttgaactctgtgcgtgtttgaaaatatacatagtactatttgattgacattttgaagatggaactactagtggaacgactattaattcggctataatcgctactagtatatgaagccgaattatttccactagatattatgtagtgcgacccataagactgagatataacatgtgactgaccgatacttggcatggcatgcaatgatctaatagaatcaactgaattataaataccgccatagccatacatatctttcatcggcaaattttgttgtgtagtaataggttccgaaataatcgccgatgaattaaaaggtgcgcctacatattgtttattgctaccattattaaaatttaaagcatgtgaattattttgcataggctgtgacttgttattctcataatttaaagatcttgaacattgatttaaagcatatctagcaacattgacatgagtgttgatggcacttgaagaattattttgtggaacgagcaatgtgtctgtagagtgtacctcacaactggcatagcaaggtgaccacgtagcactccagtacgcatccatgtatttttctggtgcaatcaatgatgagggaatgttaggtcccgatctttcgataggtactgataaacagtcgatttgggcggagtcaccacacaactcgatccggcttctgaacgaacacgctactgagcctcccaatcgcagcaccacgtctcctctggttatcaaccgtgccgaaacccgattgacctcgccgagatggctaatccttgcatgcaaatcgaagaacacaagcaagaacaagatagattgcaaccaaattgcatatgaatgattaagcacacgaatttggggttccacaaaccgatctagcggcgaaactgttcttgacagattaatctaagcaaaacccgactctaaacgatgacggctactgaataaaaaagattagggacgtcctagggttccctagggcgcacacccccttgagctaagcccacgacacaattacaaggcccaaaacccaaatcagattcggactggatgagatacgtggcttgttttgcagattcccggtagctcggtaggaattttgacatgggaccaaaaccatatgaaattagactccataagctttgtaacaagtactcatgggccccgaaattccttctagatcaacagctaggtccgttcgaagttgatgctattaggaggcccgaatccgaatccaaaacatgtagaattttatctcgtcttctatgggccaaaagtgttgtggtgaggtagaagtagacttggagaaggtcttggtttggtccccaatcaacttctttaattatccatgcattaggtacgctcggtctcttttccttcgcccaagcaagtacttctgcaaacgaaaacacacaaaactcattgtgtagcaacgtttgttcaaataaatatataacaagtaaatctaatgtagaacatatgaacatttatttaattaatacataaggtagttatttatggttatatccgagctagttatgttcttatcatcctccctttcttgattggaaaccgtcctcggtttcaccttgtcatggagtgtattgtacttatctttgtctatcacaacatcctgtgcggaacatttcttgatggacatatgattggatcctaaaatctttgtagtcgaaaacctcaacactcctcttgcaaaccaacttgtaactcatttaaacaactagaggaactagatagagaattacttatatgcatgcggtcctctagacaatacatttcatcatgaaaaggaggtatagtcaaattcgaacaaatatatactcgatgcacattatattctcctttactttcataattgccaataatatgaaaaatcacatcagaagggcatggcaattcaaatctagcaaataatttcttctttaagcagttgagtggacaaatatcatcaaattgaatataaccccaagtatttaaagaagatagcaatttaatttcttcattctcgctagcaatgtgaataacatgtttaaactcaacacttggtggctctactatagaactagcatgttcattcactagttgtggcatggataaagtgaagcatcgcacaactcttctttgtcacgagaaacatcaagcaaattgttttgtgacaaaggtatttcagcaattgtttccaccatgg
